United States Patent 7,745,391 (HUMAN THROMBOSPONDIN POLYPEPTIDE) - sequence listing, part 44

SEQ ID NO: 109599 - DNA, 649 bp, Homo sapiens
ggactgcttgaacccagagtcaaggctgcagtgagccgtgatcacaccactacactccagcctgggcgacagagcaagaccagtctgtttaaaaataaataaataacaaatgcctgttggttgtaaaaattgaatactgaagtgtatcctctttgattcaattttcttttctttttttttttttttttttgagacagtcttgctgtgtcacccagggcgtgggagtgtgcaggtgggtgcggatctgggcctcacgtgaaagaaccttgccaccgtgcgttggacacgaaggcgaatggcgcccggagccgtgtacgcgcatcgcacgaagctagcggggacatgcggcgagggtggcaatgccgaccggcgagccggcggtaaaaatatatttggagcgcgtaattagagcggcggaagacagaggcggtgccacacaagggtcgagccagcaagagaccggggtactctacgagaaacatgcgcagagaaacacaagagagggtacacggacccgcacaattagagaatcgtgagggagacgtaccaacaaagcgcgacgagagaggaaataaaaaagggtggtgaaagacaacaatgcgaatgatacaaactgtgaccaaaaagcaaaacagagaataaaacaaga

SEQ ID NO: 109600 - DNA, 150 bp, Homo sapiens
gcgggactcacccagctgaggcttcaataaactggtgaattgggtggagaagggccaggcacagaacactttggtgctgatgagtggagcggacagagcttttacccttcaaagatctaccacagtgtgtgtgagatctggatgggccag

SEQ ID NO: 109601 - DNA, 440 bp, Homo sapiens
gggcctgttccatcgccgctcagcaaatagaatgtgatgacaaggcactgctgcgtgggagcatccaagcagctggtgcgccatagggaacagggcgagggctttgcaggcaacaggctgagccttgatccctgcctctgcacctgctagctacgcatcgcagacgggcctcagtttcttcagctgtgaaatgggaccataattctctacccccaggggcagtgtggaagataaaaggagacctgggatgcctgacccctcaccaatttgccagacacggacgcagagagcagggagcacacgcggtatccctgacccaccctcaccctgagagaccaggctctgttcagggcagcttggtgttcaggggcagagcacagaagccagtcggctgacctaagcgcatcggccaccaggaacctggggtgcgagcagggctg

SEQ ID NO: 109602 - DNA, 427 bp, Homo sapiens
ttctccaccttcagtgccatggatttccttggtctgggtgtgttgaagcctcacccaatgatcggagtgtgtggccagggtggagaagcatacagcgctggatgctctcagcagaggcctttggcccagagcttctgtagaagcaggcagggagcctgcacttcccgccttccaccacccatggctctggacaatgacacactgggcaagacatacatatatcagtgggcacagaagatctctttctgtttctgctcagggtgtttctgtgtaggaaaagaaatcccatctttcttcattgaagcccaaaaccagcagaactgctcttccacctggcccttctagtatgtgaacttggttcctgtaggaagctgtggctctactgtcccctccagaggccacaccaaggtctggaggaggcaggggc

SEQ ID NO: 109603 - DNA, 239 bp, Homo sapiens
ctttaatgtataatttttaataatattttgaaaatacaatttaacaatatgaaagtgttatttcatgtgtacctaaaaactaatgggacttatttaagactttattttttttagagcagttttaggttcacagtaaaattgagaggagggtaccgagatttcctgtgggtaaatttccctacccacactcatacctagcttcccccgtaatcagcatcccccttcagagtgatacattt

SEQ ID NO: 109604 - DNA, 796 bp, Homo sapiens
tcacaccatgtaacatgttgaaaccctatgtctaaaatattgtatacctatttttatttgatttactaaattctaaagcttttctaaatctctaaaaggtagtttccccagtaatgcataactgcttaatcgggaagtgtacaaaacataattacactgcctaaaactacaatattgcttatgggaatatctccgttcatgcattccactttattttgtatttaatctctattaagatgtctatgtgaaaacagataggtattcttcataaacaccataaatcataaagtcatttctttgctaactcaagtccaaaagcggccccaaaagaaactgccagggccccaaagactatcactttccatattcaagcagacaagctccttgcacagaggcctcagtgcagagccccaaaacacctagccctgggccaattagtcaggtcataatttctctcaccataaatggctctgcatgcaactcaaaaagcacccagacgctccccagaaagcagtcactcaaaccaagaagagcaattcctttctgctcaagaccccagttacaaacctcatatcaaggggcaaacagagtcccttaaatccttcttcatctaaggacacccgtggatgctctttcaagttcacctttcaacccgggggactcccaccaaaggctccagactcttgaaactggattctcctgcttcccttctggccttcgaatttgcacccacccgctcatccctagaatggggtcatgtgaatacacaaccattctctggacggcctggtattgg

SEQ ID NO: 109605 - DNA, 369 bp, Homo sapiens
tatctatagagtgatcactataatacctcccaaaaggaaagataaaatccctgaaagtgcattaccttagaggcttattttaaaacaagttttatttttttatttcacatttttaaagttccaaattatgcttggaaaagataatatcatttaggcctttaagttttttttagctttgaattcactgatatgtatttttcatttagatttgaaatatgataattgagaagagtatattcaacaaaagaagagtgaagtaatatatgaatgtatatgtaaacctaactacatatatttatagaaatatgcatatgcttccataaatattaaccatacgtgattatgtttgtaatattcacatattgctta

SEQ ID NO: 109606 - DNA, 211 bp, Homo sapiens
aagcaccaggcccgcctctagctttgttaagaagtaagctgggttccctctgctccccaactccacagcaggctgaagtggctgaagcagaaccgtgcttttcatcaccaataaacaggaccttctcaaggttctagttccctctgagctgccagccccgctctgaaacaggcatctgggcaccattttttcctttccagccgttcgatgt

SEQ ID NO: 109607 - DNA, 226 bp, Homo sapiens
tttaaatataaaatctgttgcccaaagacaaagttttttccaaaggaagatatttagctcttcaacaacagatctaggaatggatatttgatttgctgacttatgttgcttttccttttgtcgtatttgtctttttaatgaaataataatctgaaaagtcattttagcacctataacagtgcaatttaacattgaacagcttacaagtaaaattttaacatcataa

SEQ ID NO: 109608 - DNA, 307 bp, Homo sapiens
ccagcaacattcttagcacctccaggacagagacaggacaggattgtgacatacagcaagaaaacagcatttccaggagggaggggtatctagggagaagtgcctgtcaggagatccttggcaagatgacagtgtgtcctggaggaaatgtgttattcctccctttgaaagccagggagcagggtgcctcctcatgaggaggcctagcatgaacctgacactcagaatatctgttcccatgcgggcaggggctccctggcctttgtggcccccactgaggttgtgtgtctgccctccgcagcgcgag

SEQ ID NO: 109609 - DNA, 532 bp, Homo sapiens
cctctctgtgcccgagagagagactgtaaaggaatgtgtcaccatccatgcatatgaagccgatgcctgcaccccaaggcctccggcaccctggtgtggtttccaggcactgggtgggttgcagggggacctgccgggaaagggctgggagacgcccaagggtggagactggggcaagggccagcccacaccaggtgccaaaaactacgggatgcttccggggcagggaccatgggggcccatgagcaagcagggctgtggggaactagaactgaccagacctcccttggggccccacttggctccaggaagatgctcctgctagcaggaccaaggagaagcagagtcccccagggatggaagttagaggaggtgacaggcagggctaggcagagggaaggaagggggtgcctggcttagggctgctccctggggaggcctctctgcccagggcagcctccgtgaagatgcctgggacccagccccttgctgagccttgcttctcttccctcttgtaagttcccactccagg

SEQ ID NO: 109610 - DNA, 361 bp, Homo sapiens
accccttgggcagaacacccacacttgccacagtccacaccattccctattactgacatacaaggctagtttcgctcaattaattctgcatagcttagtttgttagctcttgatgggaatgaaatgatttagaggtcaacaaccagtctcataaaaaataagccacacaaagaactaaaattaggaacaaaaatcaagcagtaaaaattgcacttttccccaatatttttggtattcattagagctctatcctaagtcctcttctcttctcatttcacacacattttacagacacatcccatctgctcccaaccaattatccatgggctggtgcattattctgtctctaacctggtggtcc

SEQ ID NO: 109611 - DNA, 664 bp, Homo sapiens
cccactgtctggcactccctagtgagatgaacccggtacctcagatggaaatgcagaaatcacccgtcttctgcgtcactcacgctgggagctgtagaccggagctgttcctattcggccatcttggctcctcctcttccctgttctttaattaatcccatttcccaatctccgcccttttagcactccataaaagggatcatgtaatctgaaacctagaacgttagaatatatttgagaatgcccatgtcttagagaacgtgcttgaattctaattctccattagtcctttaaagtttcgttattctcagtcttcacatttatacttctttattattcatcatgatcttgtatgattttgttcctttgaaggccaaaccagtttaaacttatgtatgtatgtatgtatgtatgtatgtttgtgtctatttttttttcattcttctaggaaagggggaataaattgctaggaaggagtaaagatggtaagatgttttctgacttggggagctggtcctcacttaagctgagagcacctgtagtggaaaaatatatgagatttcatttttttttggctccccacagtttgtctgcccaaaacaatgtcctgcagtgttcttggggatgtgtaagagcacgacttttttttccctataaatctaga

SEQ ID NO: 109612 - DNA, 439 bp, Homo sapiens
gggtacttagtctcctggatccacaaggtagaatcacattaccctgaagagttgtagtaactagtaaagatggaatgatatgaacacaaagcccccggcatagcataggcagtcaacacacaggcagtcattactttgagccaccagtattaatagtgctgcttgtctgtcacagtgcccacagaccattccaccagaggcttcgcatgtgtacaggcacaaaaacaaaagcattcagtatcaaaagaaggcccaaaacaatggactaaatgtttccttttctcattcattgttctggcagcatagggaagtgtagcctacataaaggtaggccccaaatgacttttctctgccaccgtcccctgtgtgaccttaaccatgacactttgctgttcctggcccttgatttttttttttttaatctggaaatgggagggtg

SEQ ID NO: 109613 - DNA, 208 bp, Homo sapiens
aatgggctctggggatgactgtgtagagttaaagtaagctctgaaacccttcactatttatttcagtagaaaagaaatgtcattgttggcagtaatctagacacgtctcctttaaatggtggcggtggtctgtgtctgcattcaaaggtgtggcacatcgtttcatcttttcgtagtacaaaaggagtttcatttaacaatttcatac

SEQ ID NO: 109614 - DNA, 279 bp, Homo sapiens
ccccagctgttgctttctcagccttgtgaaatttcacccttagtttccacagctgattaatcagcagccaacttgacaaatagttagccagtttgctagagctctttctctccagtattctaatccacaaattttagcctctttaatctctttgaaatctgacacctgtctccttaattcagcaaaacctccaggaagaaagtggacaaccataaagctcacctcattggtttcccttttctcagacattacagtcctgcactgcccattggctaatgt

SEQ ID NO: 109615 - DNA, 104 bp, Homo sapiens
agcctgagaaccaaagctcatcagccctcattttccactctgacattggtcactcctactccagattgacatatggctcgtttttggtctgccactctgccttt

SEQ ID NO: 109616 - DNA, 757 bp, Homo sapiens
tagcaaggctccagctgcatcagctggtggccaacattttaggatgataaattcaagaactcactagctaatgcctcctctccctctggtgccatggcctcacccttcaactcctctgggcttttaaacctcaggcctctaattatctgaccaggaagctgaagtccactgtattgtaatttcctatctgattcgcaccatatagagtatatttatgcattgcaagaaaatagttatgtttgcagtattaagtctatgcacactaaaaatcaagctgtttatttcctggtctaaaaaaaaaactgttgggaaaatgttcatctattcaaatactttctcttctctctgctacctagaccagttttagcttatcactgttttcagttgctatatataaaatgtgaatagttgcttggattaaatattttaggactcatgccaatgcctcctacataataaggatccttaagcatgaaggcctgaaatccttgttctgattcataacataccaaataaatggaaaaatcgcaaacagttgtcatgttttatataatctaccacgtataatgccagaagttactgctatgtatttcctgagcggaatatagcaatatctcagtattatgaggtacctctctaagggactcagcagtttgtgttgtggtggttgttgtgtagccaagctatgcaaaaaattggaatttgttttataaacaaggatctccgcagactgccagattttaactgcataatacta

SEQ ID NO: 109617 - DNA, 328 bp, Homo sapiens
ggctaggagagtcgaaagctgaaaggaatagtaccaaagagacagagggggaaaaagtgctcaagagcttctacttaggccagggcgcagtggctcacgcctgtaattccagcactttgagaggccaaggcgggcagatcacctgaggccaggagttcgagaccagcctggccagcatggtgaaaccctgtctctactaaaaatgcaaaaaattagccagacgtggtggcgtgcacctgtagtcccagctactcagaaggctgaggcaggagaatcgcctgaacctgccaaggccgaggctgcagtgagccgagatcacaccactgca

SEQ ID NO: 109618 - DNA, 432 bp, Homo sapiens
gggttttttttgttaagattagtagccttttataattttgtaaatttagcaatatgtctttaatggaaaaaaagcagtgtattttaagtcagactttttcttctgaaataatctgtccttggatatgcagtttagtctctctgggttttgatattctttcactgtaaaatgtgaaaactggactgaacccagtggtttcaaaagaatgtctttagttctgaatgaaatataacctgaaagctccatatttaaaataggggattgaagggcaacagacttcacacagcaggcactaaggtgcctcattgaaaaccttggagttctgcagaatgtgactaagtacttaactaatctctagggtgccttccagataatgaagtgtgatttttgtattgtctatgtgtgttgggacctttaaagccgcattccact

SEQ ID NO: 109619 - DNA, 280 bp, Homo sapiens
caagtactcttaactctgcaccaagtgaagaactgagaaattactgcagtaaaatatttgaggtattatattacacattaaatacgtttaagttgtagggaagtgagtgctcaatacacactcatttcttcattggcaagtctttcataccaggccccttgaaaacttattttctgggctgtttttcaggaactccaaattggctacaactgctctcttttgactctgtactagaggcaactatcagtctcacactcagcttcagcccatgttcccttcc

SEQ ID NO: 109620 - DNA, 578 bp, Homo sapiens
gattaggccactgaaagctgttttgttagttaaatgtctatctttgttagtaatatatcaaattttacccatctaattgatggtgattatgtatgaacatacatatatgatctatgtagattatgacctgtaaaaatgctaggtctttaataatatcataaaaagagactggacagtataatttatttagtaagcattctaattcaacaataaaatttggtctaattgttaccacttttgttatataaaataagttagataaacatagccagcagatttacatccaaatgcaaaacagtcactattctaagttaatatcacattacagtttgcttctactagcatgtttcaaggaaatgcattcttataatttaaataaatatgttcttgtcgataaaattctcagaattaaaatctcaatatgtcaaactttttacaaatagtaaatcagattctaatcgattataccaaaagtgatcatgtcttgttatagaaacctggatgattttctagattgtgagatttcaaaaacattataatttaaaattaggtgacaccattcacatttgtagccattg

SEQ ID NO: 109621 - DNA, 225 bp, Homo sapiens
gtaaaggaatgcgggcaaggattcttacttacaagcatcatattttgggacctctgtgcaggtctttacaatcttccccactcatcattctttcagcccacgcatatttactgagcagctgcaatgggccaggtaacgtttgtgggggctaagtctacagcagggaacaaaacagatgaagggagctgaaattctaggggaggcagagactatgcaaagaaatga

SEQ ID NO: 109622 - DNA, 212 bp, Homo sapiens
tatgataatatttgttgcttccattagaagtaatgaaattgtgtttatgaaagcatttggtgtcctttaagctcaaaggtgttatgcaaataaagtattttattatcatttctatacacctttcatgtgtacataactcaaatgaaagtcaagaaaaggttatatacccaagagttctgttcagtcagaatttatttatattaatcaatgat

SEQ ID NO: 109623 - DNA, 563 bp, Homo sapiens
gggagcgatggctagagagatgatcagaggaagtatttgtggggcccagagacctagctctgggggcaccctcaaggtgggaccagcccaaagccttgttttaaagcatccctccagaaatctctgcttatgccaggtgccaggtcattgcaaaatccacacctgacccaaagaagttcaagatcttcttcccactgtacaggaaaaaggggggtagtttataagaaagcagaacaaaattcagaaactctggtcccctatctgtgggcagtctcctgctgcactttcaacccagcacctgtatttccttcttacaacaccagctcgaagcctgaaacaaagaggaaggagaaaagaaaagtatgcctggcctaagagatggtgtccagaggatgggggtggaagtccctttcagacacaaaatgcattcactgacctcagggagcagagtcaggactgtgctgttcacctttttgtctgacaaatcttaggcctgatcagctagaagggcagtgttccggggaggggcaggtgaaacccagcggggctgtagctgtagtccc

SEQ ID NO: 109624 - DNA, 465 bp, Homo sapiens
ggcctgctggcctcacagggagagggaggaaggggggtccaccctggccaggtgcactctggtgagagcagcccacagaggccttgtggtctcccaacttcctcagtccttaggatgctaacagggctgtagcagagcgagtcctcaaaaccaaggggcttccccaccactctgaatccaccagcaatctctgcctctgcacggcacccagggcagggtggtccttccccgcttttctattccagaccgtccatgaactgcctccatttcctccacccacccccaacatagcctccttcatggagcatatacacatgtgcaagtgcatatgttcagacccacacacacacacactcacactcatacacactcacacaaacacatccatacacacatgcactcacacttacacacacactcccacacatacacacccacacatgcactcacactcatacacacact

SEQ ID NO: 109625 - DNA, 765 bp, Homo sapiens
gggatcccggtactggcggcaaggggaacctccccaattgcactgggcttcagaagaatgtgggccccacttgtttatgtgtgctaagatggcattcttcttgttgtattgatttcgtagatctgtcctctattattttaatttgagagatttgttaccacaacccagaaaggtgaagaatttaaaaaatctaaactatcatgtagttgtttcatttttttaatcagagtactattaggcacataatacctgcttaggagccatttacctcttgacttatacactgtaaaacagagttatgcatgtaaaagcacaaggtctgtcgacagactgggttcaactcccatctctggcacttcatagctttgtgaatctctgcctcagtttcctcagctttatagcaggaatacgaatagtgtttcagtctattttctctgctataatagcataccacagactggtatttataaagaaacaaggtttctggaggctgggaaatccgagagcatggtgctgacatctggtgagggtcaacctatggtgcaaggcatcacctggccagctaatgcatgagacagagaaaggaaattgggtcaaacgcatctttttaaatcagaaactcactctcaataactaacccactcctgccactgttgccgtgtaattgttacaatggcagttaaatttcaacttgcatttctgaggggacattcaagtcatagcaaatagtaactatatcataggcttgttatgaggattaaatgg

SEQ ID NO: 109626 - DNA, 359 bp, Homo sapiens
attatacaaattcagaagaaaagctgaggggcagatcatgttaaggggaaaaaacaaaaccaaaaaagcaaaaacaaaaacctctatcttatactaaacattcaaaggtttaaaaaacaaaaaaattaaatctcaactggtgacccagggattatctgctgaccccagaggtctatctaaccattcgtttaatgatctccaactcagaaacaggtctggcagtaagaactctgcagggtagctcaaagagagctggtagaaccagatgtttttaagaaaggagagcagacctacccttttgaataactaccagctgtgctgttttatattctgtcccaaagctgtgaccagttggcatt

SEQ ID NO: 109627 - DNA, 416 bp, Homo sapiens
ggctttctgagatgtgaggatggaaatgcttttctctaagaaccctattctgggatagggaagccaaattggaaatgtggagccacactgatatacagcttccagaatagtcatatttccccgttccaaccacacataaattcctaaacttgcttcacacagagaatctgggaagtgaacaaagcctatgttttccctcttctactctccaaagtgtgggttgtgtgttggcaccttaggacaggaagggaatttagaccgcatgctcttgattgcacagtctgggagggtatggggtggtaaggagagcaaatgttcagctaggccagtagaatgttgccaccaatctgtcactaacgcagctgccaaaattttcacattgccgagaaagtaagtctttaaagcaaaggctcttt

SEQ ID NO: 109628 - DNA, 210 bp, Homo sapiens
tcttcccaagggactcctcttctagaaggtgctaagcttcacaaattcggctggacacaaatagttctgctcagcatggggcatgggaaagatggacagcagctgcagttggcttggccacagatgggcaggtgggaaagtggggtctgcactttgcaaaccacagttcattcttcctcccctcctggatgcccagttactccctgggcc

SEQ ID NO: 109629 - DNA, 469 bp, Homo sapiens
ataaccgctctccgagttcatgctcttctgaggtctagaaagaaatgggtgtctctgtcccaacctggttagttattctgtctctaaaaacacaattaagtcaatgttaagactaagttcattaagctgctcgtgtttttatgccttgacagtttgttaatggtggttgcataagttttacagaactagtttcgtcttgttgcccaggctggagggcaatggtgtgacctcagctcaccgcaacctccgcctcctgggttcaagcgattctcctgcctcagcctcccaagtagctgggattacaggcatgcgccaccatgcctggcttattttgtatttttcgtagagacagggtttctccatgttggtctggctggtctcgaactcctgacctcaggtgatctgcccgccttgacctcccaaagtgcagggattacaggcatgagccaccgcggccagcctgtagtca

SEQ ID NO: 109630 - DNA, 817 bp, Homo sapiens
ggagtataaaacaataaaacaatatgagagggtctctctcttccctcaccagagggggccaaagttttatgagacatctcctcatctgtgcacagatgggtggcggactctggagtccaggctgttgcttcccattctagtggtgaatcttccatagtctggtattgttgtctctaacccagacctgatcacctggctacagcaaggaaaagaaactttgaccatgaagagacaggtgatgattgccaaacacacaggtattgttgtctccaagccagacctgatcatctgtctggagcaaggaaaaatcctttgagtatgaggagacatgagatgattgccaaacacccaggtgggtgcaagtgaaagtgaatacaacagacgacacagatggagtttcactcttgttgcttagactggagtgcaatggtgtgaccccagttcactgcaacctctgcctctcaggttcaagcaattttcctgcctcagcctcccaagtaggtgggagtacaggcgcctgcaaccacacccaggtaattttttctattttaagtagaaatggggtttgaccatgatggccaggctggtcttgaattcctgatctcaggtggtctacctgcctcggcatcacaaagtgctggtattacaggcatgagccaccacatccagccttgtgtattttggagatagtgtctcactctgtcaaccaggctgatttgctcggttcactgctgcctgaatctcccaaactcagatgatcctctcatatcagcctctcaagtagctgcattacaagtatgtaacatcacacccagcc

SEQ ID NO: 109631 - DNA, 869 bp, Homo sapiens
cgggaggcagaggttgcagtgagccgagatggcaccattgcaccccagcccgggtgacagagtgaggctgtgtctcaaaaacaaacaagtaaacgaaaaaatactgccatgtgggtgagttcctgttactgatgggaatgtgttgggtcaaagtggaggggaaaaatgctgaaaatcaccacatcagagagagagactttacagccctcggaaaagaggccactgggaaaggctcttgttttataagctttttccgacgtgtgcgtcctttccttttgtccttcgtggccacggggcaccataaaactggggccagtctgtcggatggaagccggacggcgtccgacgtccgggcagcccgcaggtcccgctctccgcagcaaggcccgcttacaacctgggagttttggaagtccgctcggccagcccttccccaggctttgctggggctgcagaagaactcttagggcagtcgacgcggtgaggcatgtacggacagagtttggccttattcagtctaattatgaaaattcttggcaggaattctacatgaatcacctccaaaaaaatttacgttaaagttaatgctacaagtctgacttcagcccacaaaactcagaaaactaggttctgcgtctacaaatgcagccttaactcctccttgtccacagactagtgacttttaccacaaacaagggagcgtgaattttgttaggaatctgcccgtggggggtgaggttggcttcggagggggccgccccagtggggatttggtctaccctgaatgaaggcaggcgtcaggccctttggctgcggtcataatacgttgtatgacttccggcagctccttagcctctctgaacctcagt

SEQ ID NO: 109632 - DNA, 742 bp, Homo sapiens
gggcgtgaaataacctcacactcggtgttaggtgctcttgttggtgaccttgggccatgccatatacccctgaacttcagttccattttggtctctggttttacttaatattctatgagccttgaggccaacataattctgatacactggtaagccacaaaccaagtgagaccaaccagaatgtcaccatgggcatgaagcatttttcttagattttctgggctttgatatctcaaccacagggtgtgctgaagcctgaaaactgggccagattgtggaatttgtctatgatctctctccctggtcttttactgcataaccctgctggtcacatggtgttatccactttctttctccagcaattaactgtcaccattattgctaatgatatatgatcaacactatagtaagcatccctgtgcaaatgacatgtaatttagagaaagttgatccactgtttaaaaaacaccctaccgtcctgccattatgactataatagaatgaagaggattgagccctgaaatgcaggtcaggagacttgagttctattccaaccctgctgcttattatctgtgggaccatggacaatcacttcctttctctgggcctcagtttccaaagctgcagaattaatagggtgggctcaatgctttaaaggttctctcctctgtcaatgccacatcacagcctttcacagtgccctcaaggcctttctgttgaacctatttcttattgtttttga

SEQ ID NO: 109633 - DNA, 356 bp, Homo sapiens
ccaggctggtctggaacgccttggctcaaggaaccctgctgctgccttagccttccaaagtgctgggattataggcgtgaggcaccgtgcccagcctggtgatgtttctttaaatgttacttgcttttaaaaatatttgtgccaaggattataacttaatcagctgactccttagagaagaaattctgatattttagatctagattgtgggaacaaatgttaacttgggattttccctgtcattttagttatgtggtgaaatgtgaaaaaaccacactgattcttttatatcttaccatgtgaattatttacctctcattccgctcatttcttatagtcttgatattcttacaact

SEQ ID NO: 109634 - DNA, 386 bp, Homo sapiens
ggttttaatatttatatggttggatcagctattttcatcatggcatttgggtgtaacgtatttaggaaggcgtttcctctgtattagaaatatatgaatccatagttgcctaattcttctatagttttatttataaaatgagtttctctcctacttggaagcttcttctaggatgaaatagaataattaagcatagccctgcccctcctacctcctgaaagtgcatactcatcatgaccttgttttcttctactgccttttcctatgtccttgcttcactttcactccctacatctattattaagcctttctagatctttcctagccctgagtttatctatatatctttcagtaatttcttctctccttcccccatcagaaaataa

SEQ ID NO: 109635 - DNA, 739 bp, Homo sapiens
ggaagagaggatgacagagcctagggcgaaatggacagaacccaggcactggatggaagagaggaaggagaaaagggttccaaggttaagacctgaatcacttggagaaaggtgatataagggagacaagaagggagaaaagggacagttggagtgggaagaggactggtttgctttttgagtttaaggtgagtgctgttcatcaaagggaaccgatgcttaggaggctgcaaggattaaaatgcaggtaagaggcaaagctgtccaagtaaggggatttctagggaaaagggggcgaggaagtgagggtgggagagaacagaggtgcaaggactggacctcagaaaaggctgacttctggggtggagacagaaatgagcaatatataatccttcttgaagaaaaatttttaaaaagaaatggagcaatgcagagtccttacaatgaaagaagacagtcgagtggcgtgaggagacaaaaatgaataaggaagggacggcccatgccgggtcaaatgccaggatctgacgggtggttgctggtcctttgaaaactgcagtatgttttgctcttttttcctaaacagcagagggattgggggtagacacaagagtgcaaaggattcaggagtaggaaggtggtaagaaaatgcaggtggcaggcaggaaggggtcatctgaagtacccaccagaaaaaatgaaggagaaccagattaaacaggacgctgtgttcaggtca

SEQ ID NO: 109636 - DNA, 220 bp, Homo sapiens
ctcaagcctcctgctatgaaattccattaaagttacaacaaccccacacaatggttcaaagtctaagagggtcagaataataacccctcacaaagcctggcaggtcccagttccatttcatctgctgaataaaggaatgaaaggtgaaaaggcgagtgaattcacagcaaatgcaaatataaagccacagaactaagggaaattttgactctggactggc

SEQ ID NO: 109637 - DNA, 347 bp, Homo sapiens
cttaagatgccaccttcattttcttccaaagtgttactttgttctgtcctacagtgtatgctgtagattagctgaaaatcacaacatgttaatgagtatttcagtgattaaggaaagaagatataaaccaaggctgtaccttcatttgtgatgatgaaagaacatactgaaagctgtaccacactgtgctgaatgtagtaatatgaatgtgtctgtctgtggtcttatccttagtcctgctactgtgtagctctctggctttgtgggaattaagtaagttagtctcatggacctatcgccccttctataaagtaagaagattggactagagggatcctactagtgct

SEQ ID NO: 109638 - DNA, 261 bp, Homo sapiens
aacatcagggatgaagtctctgataaaggcagagaaggaagttaccattttgccctaactggaaaatcctttcatgttataagtcaacatttcagcagcctactgccaaagatattgatcaatgggaccatctttgcaagaatgtctcctgggcagaagtccagtctggtggaagaatttcagaaactggagtaggttctttgccagtgcaggtggcatgaactgcatggaggcataacagtcagggggagtggaagaggt

SEQ ID NO: 109639 - DNA, 648 bp, Homo sapiens
atatggaaaaatcatctttcgtagtgcccaaatatactttttaagtctataatccaagtaaacagaagaaactggaatgttttcatcaagaaaaataaaaaggatttatttggaaagtagactattcagcaattaatctttttatgtatttcaggattcagctgtggaaatggctatgtcaaaacaactttctcttaatgctcaagaaagcatgaaaaacactgaagatgagcggaaagtcaatgagctgcaaaatcaacctttagaattagatactatgttaagaaatgaacaattagaagagatagaggtatggaaacataaaaacactgacaacatgattgcatcatttatccagtgcaatacaatatattttaattgccaaaaacttgcttgtacagagtgaaaagtcttatttaacctttgcctgatgatcaatttggtaactgtataattatgtactaagtaagttgtataaatctttccatttagaaagtagaagagttaaagggacattagtcttctttctatttcacaaagttcctaaagacttagtgagaaaatttggagattttgacttgccatcattccttttcttacaagtatatattcttctgattctgacaaatgtatttttcctaacaatca

SEQ ID NO: 109640 - DNA, 308 bp, Homo sapiens
cagacggctgcattggggtatattatctctcgacactgtatgcgggcctggggtagcttgttgagttcctattacatatcctataattagacggtgccatccactctttcacctttgtaccagctgtatgcaaaaagatgctggggcagatcgtagaccagtagaagcacctccttcccctctgcgacattgaacggcgtggattccatagtgagcttggcagtgggggacccggaaactctacttcagataacactggatccttgctggtgcttgaacatgcaaagcaaccttttatctcaatctcg

SEQ ID NO: 109641 - DNA, 408 bp, Homo sapiens
aagaagaagagaaagtttttgtgagttcctatgcatagtggagacctgttctagtgacggtccctggggctgagcctgtgggtcagtggaatgatgctgtgaggagggtcttgttatagcagatggcccaaaaaaggctgatggatcatgagcagctggaagaatggagagtttgggggacgtagttcctacctggctttccaacaatgtgtaagcccggaattcttacataagtccatggagaagggaaaggaatgctggtaacgacaagattgaattctccacctgccaggcatccagggactcagagcagatttaactgaagttacagaaataggaatgtgacatttcttacatccgggtgtgctggagcaaatgtattccctctcaggtttgtggggaaggaga

SEQ ID NO: 109642 - DNA, 408 bp, Homo sapiens
ccaggcacaatggcatgcatccatagttccagctgttaaggaggctgatacaagaggattgagaatcacttgagctcaggagttcaaggccagcctggacatcatagtaagagcctgtctcttagaaaaaaaaaaaaaaaacagaaaaccctacagctgacaccatacttagtggtgaaaacctgaattctttccccttcaaaatctgtagcaagctaagtcctattcaatgttatactagaagttgtagccagtacaaaaaagcatacagattggaaaaagaagaaatcaatctttttgaagatatcgttgtctatataaaaatttccatagcatctgaaaagctcctggaacaaatatatcaggttaacaaggttgcaggatggaagaccagtatacaaaaatcaa

SEQ ID NO: 109643 - DNA, 514 bp, Homo sapiens
atttctctatctaaagtgtttgttgacagaaactaaactcatgatagctagatgcatagaaattattcaacacgcccatacttcctttgtaagtggatgaaatccctgagaccccaattccctctgcccctttgtgttgcccagttaatttagcctaagacttcactaaattcttaagctgtagtgcctctcctctttccctccaatgtagagagagattacccgggaatgagccttcctagcaatatggggaaaagctacgtttaaaatgttgattatcaatgctttcagaagaggaagatctcaatcaaaaaggggaaatgagaagaaaagtagctcagagatgtctgagctatgtgaggtatgcaaaatgtatcagatccagagagacatgagtattgaaagccaacttgtaactactgctaatcaaagcatatattcatggcaacttgaatctgtgtctccttggttgcagtccccaaatttggcccaaataaattctcgacttatgtta

SEQ ID NO: 109644 - DNA, 426 bp, Homo sapiens
ggtgagactgccctctagtgggccagtggagctattggtctagctgtgttctgggcaactttgctttctcacgccacatcaatgtagagcgattattcctacggaaaggaatttcaattttattctttctcaagcactgtggcccatagtaactctgttgatctctaagcactagccatcatttgcgcgtcttatagaaggctgggtttgccttctatacatacacacattagaagtgtcttacttccctaacaagattcaggctcctaaaagccaggacatgcatgtatgtatgtatgtatatattttgtggagacagggtcttgctctgtcactcaggctagaatgaagtggtgcaatcacaacccaacctctacctcttgggctcaatcaaacctcctacctcagcctcccgagtagctgaga

SEQ ID NO: 109645 - DNA, 401 bp, Homo sapiens
gtagaaatgaaaaaatcattaacaaaatattagcaatttatacacaatgaccaagtggggtttattccacactttttttttttaataaataaatcccacttgggatttgtttatcccaagtggggtttattccaaatgaaaaaggttcattcaacattcaaaaatcaatcaacataatataccatattaacaggctaaagaagaaaaattacacaatcagatgtcgccatcggagtatacataataaacctttagttcccttcaatttggatgaaatcaaccattacactttaaaggacttgcctatataagagtaactctttttcaccaacaaaagcttgacctatttcaaatgttgcataatatctgaattttgagaactagagaaaacaagacactga

SEQ ID NO: 109646 - DNA, 311 bp, Homo sapiens
cttattctggtaacctgagttgttggtagagccagggtattcccgaatcccacaactctggatttccatccaatgctagcttctccctcccgtgctgcttgtctttggcgacagtagccacactgagtgttttaggattcctagaattctgaggcatagaaagcctcaccactcatagcccctgctgtagtctctgctcaccagattctgtttgcataactaatgcgtccaaattcattactacagaaccatagtcatgcccttaagcagatgcctcctcttttcaccatctcacattattagttttgcct

SEQ ID NO: 109647 - DNA, 377 bp, Homo sapiens
cggaattcttctgcataagagattggtctcttctctgtgtatacatgcatgcatgtatgtatgtcagtatggatatttatttattttatactttggattataatctaatacttgtttatttcattgatcagactgttgtagctttggccatggaagctctttcagttggctactgtgtccctttgatatacccccactgttgcattgttgttgtttttgagtactttcttaatttctggcactacaagatgctcatgcacatcttgtatattccctgctccagtgctagaatcaatgattttttccaaggagccctggtttcttttattggagactgttactagaaaccaagatctgctatgctcattgctactggg

SEQ ID NO: 109648 - DNA, 314 bp, Homo sapiens
gggcaaagggatcaatctggatcatagtagagaatttgtgtaattggagaatgtttcctaaaaattttgagtcaaaaggagattaagaaggaaatcagttgatactgtaaagtctacaaagtaattacagatggtcactgcaggatgagagatgttcagcaagacttctcaggaggaaatgctagagctccatcatgagggctgagtgggagccaagtaaatggaaggctggtattcctggaagagtaaagaacttgtttaaaggtaaaaccaggagacattgtggcatgtttgggaactgccagatggctcaa

SEQ ID NO: 109649 - DNA, 575 bp, Homo sapiens
agttaataagtattttctgctttgcaggccatatggtctctgttgtaactactgagttcagccataggcaacaatatgtaaacaaatagatatggctgtatttaggtaaaattttatttgcaaaaataggtggtctgcagaccatagttttttaacccctgatttagactatccctgtatgctatatttgagccattcacttagatttttagtattggaagaagtcattgagtcaaactctcttttataaaagagttcatagctagttaggaattagggcttggatttctggtcagttttttttccagtgtaccatgtctcagcatctagaaaagttttgtttatatctggaaccttaaatgtctggaaacttaaatgtcacctgttctgtgaaacctttcttaactgttccttccatgtcttccttttctttatctctagccagaatttattggtttttgtcctggcttctgtataactttttaaaatagccttgatcatgctgtactgaagttaatctacaagttatttttcaccactagacagcaagccttatgaaggaagggactcccata

SEQ ID NO: 109650 - DNA, 360 bp, Homo sapiens
taagacacggagtatcactctgtcgcccaggctggagtgcagtggcgcaatctcggctcactgcaacctccgcctcctgggttctagcaattctccagcctcagcctcccgagtagctgggattacaggcgcccgccaacatgcctggctaattttttgtattttagtagagacggggtttcactgtgttgcccaggctggtctcgaactcctgagcttaggcaatccaccctgcctcagcctcccaaagttctaggattacaggtgtgagtcatcgtgcctggcctatttatacttttttttaacatatttctgatatggggagtaaatcttcctttgggaacaacagagttcccatag

SEQ ID NO: 109651 - DNA, 363 bp, Homo sapiens
tgtaaactgatgtttgctgtatgctcctcctgatttgaaatagatgaaagaaaatgaacctattatcaccatggttcacacaatgattgagaactcggcgctaagaccccaactgtaccagcaagtaaggtcttggacagtgaatgatactgctttatcatctgcaaaatccctcagtgacagttttgatttattctcagatttactcatgacatcagtgtttttcttattttattttttgtttatgtttatttggaaaaccacaattcatccatgcttttcaagatgctgcagtattcttagcatgcttcgctgaacattttgctgttgaatattaaatgtgccattttcctaaagtttttg

SEQ ID NO: 109652 - DNA, 188 bp, Homo sapiens
atcttgtaaaacaacaggaaggagaagagtggaagctcaaagctggagctgctgaggacccaccaaaaggcacgcaaaggagcaggctctgtgattgagactagttggggaggccggcaggaagccaggagccagtttatgtcatagtgccaaaggagaaagaggaggggcgcaggcagcattgtcga

SEQ ID NO: 109653 - DNA, 372 bp, Homo sapiens
cccacagctgccagtcactgggggagtgctgatgtcaggtttagtggaggtcattaattctggccagcgccccctgcaggcagtgaagagtccaggagccagagaagcctttaagcaaggaggcaaaggggtctggcatttgaagtcaatagatgctgtgagattttggtcacatatgagtaatctcaaaatactgaaaacatataaattttctactttgtactgtggcagacttcattgcagtctgatctggctttttccttgtactatgatttagggcattctgtcctctgcccctgactgctaagtgttgagaaatgcaaatttaaccatacatagagtgtaacatagttaggaaatgctgttccccac

SEQ ID NO: 109654 - DNA, 708 bp, Homo sapiens
tgggatttccaaaaaattagaaataggctaatagaaatggagaatacactatagaagaaatcagcaaattatttggataaatggagagtatcagtttgaatgaaagaaaaataaaataagaagcaaaagaatggcagtttctggcacaaaagtcttgataaaatattcagtgcatgtatgcctcttgtttgccagagtgttgtacttataattttttctatgtattttctctttttaatccttacagaaaatctatgaaatcagaattagaatcaatttatggctgagattattgaggcacagagtgagttaattaacatagctaggttgcatagtaaaagagattgcttcatctgactacaaagcactcattctttcttccatactatcctgttagtcattaatagatgactcccagattttctcacttgtgagactaaaaaagtactggtattcaccagtagccaaaaacaagtaaataaatactaataaaattttaaaattgggctttaggaaaagatgctaatttgagagagattctaatgaatttatttggatgtaaggagttcaatgtgattcttagcatatacaaaaacagtgtaagtgatttgagggagaaaaagggatgggcaaagttaaaagaaatttaaaaattttaaaacatttttctaatctgaaatcagtagcggcgatgaggtggaactattg

SEQ ID NO: 109655 - DNA, 1020 bp, Homo sapiens
gtgaatttctcctgtgtgttcctgtgtggatcccgacactcttctcgctttaagagagcctcccgcgcccctcactccgccccttcccaagtctctgggctcgtcaaagcttcccgagagccatggttggtccaggcaggcagtcggagcacctcgtggagcggctgctaacccagggtggggtggggtggggtggaggggtctgcttgtagtactctcagtcctgatgtcacaggcgcggcaaggacatcgcaaggaggagtcggattacagtaaggatgggcagtgcagcaggcagcccgagcgcactctccagccgccggggatcttagccctggaaaggcagcctgcaaggcgctcatcccgcggaggaggcacgctctcggcgctcactgctctccacgccggggacatttccaccgaatgtagcatgaaagggctctgctctacgtgccagccttgggtgagagctgatgctgaagacaccgcggtgggattccagctgtctgattaatgagaaacataatgtattttggtggtacatgccagagtcctgctctcccggcccttgtaccgtccaccagtcccctcctttgcaaccatcgctggatattaaagccatttcttccctttgcctcttgtaccactgcagtcgtgcgagtgcgaacctcgttccccaactttctaatgcagatggacccagattcagaaagctgtaataaaccatacattcggggttcctcttccccaccgaagaaagcaaatcatatcatgcaacatttgccagttgagatttaattctgatagccaggctgcggcccactacaaaaggcacgaaacatgccaagaagctcaaagcactggaagccatgaaacaataagcagaaatctgtaactgccaaggacagcgcaaagagtaccttcacctccatcacgtaccaataccatcaataccagcttctgacaaaacagacggtactgcaggaaacccagcaatatcaacgacggaacactgtggaa

SEQ ID NO: 109656 - DNA, 526 bp, Homo sapiens
acagctgcagccagcccgcccctccctctgctgactgccccttggaaaggaaaattgacccggattcttcccgcctgtctgggagtagaatccaaccatcggggatggaggccctggcctccatgaggctgcctctttttgctgggctgctcttcctgtgcctgtctggcctggcactgccaccccggctggactgaggctgttcctgctggctgccggggctgcctttccccaaccccacccaacactttcagaatgtcagtctgaggagccctgatgggtggggacatggggctcccaggcttcttccattgtttttctaaaaatgaaagtgctgggagctttagactcgggccgcaggttttatggtaaagtgctgttccagtaaccttgtcaccaaaaggtgcaattaaaatgtttggaatcattatttttagttcagtgttagattttgtctctaatacagatggtccggaggcaaagctgtgaaatctaggggggagaaaagagaaatcaacaagaacca

SEQ ID NO: 109657 - DNA, 239 bp, Homo sapiens
gtcagaatggtttaataatgtgttcaaaatgttggatgttttgagatcttcagatgaaaagcactgcggaaataaggtgtcattacagttcatttgactatgccttagcaaacaaattttttaaagttatggaatcaaaacatgtagctcacccttcctgtcatattatcccttaaaacatgcagaaaatctctaaattattagtgaacttgaataacaatgtataaaattatgatccc

SEQ ID NO: 109658 - DNA, 374 bp, Homo sapiens
gaggaagaagggggtgggacctatttttaaacaaccaaatcttgtgagaactctatcacgagaatagcaccaaaggggaaaatccaccccatgatccaatcacctcccgccaggccgtatctccaatattggggattatgtttgacatgagacttgagtgaggacacagatccaaaccgtatgagagatagaacatttcctttatctccccaaagttccttcgtgtctttccaagtcagtcccctcctttccttattcccagccagaggtacccactgttgtgatttctttcatcatagattagttttatctactcaaacgtcatgtaaatggaatagtaaagtatgtgttctttgtatcttgcttttattctt

SEQ ID NO: 109659 - DNA, 546 bp, Homo sapiens
attttaaatgtccccccagtcctgaagagattgagcagcattttcaggaggaggcctcaccatcatcattgccacactggccataaaccagagactctgctggagaaaccctctgcagaccttggaggcctcacacatcccagttacgggcagcgcagctgtcccctccggagaagattcctctgcaatgggaaagcatttgtgaaatgaggcagggtttacataattggtgtgagcctgagcacacccggcacacctgtgtcctctgcgtacacctgcctgggtgccgacactgcttgcaggtggttttggggaaagtgcaggcctggcttccatatggcacatagtggcttttctaagactgttcacatgtctgccaatgaggaatggccctggcccctatttcctgtagattcccaacaccactggagggcccgtgaggatccttctgtccctgcaaggtgtggcctactggggtgtccctccaaggtgtggcctgctggggtgtccctccaaggtgtggcctgctggggtgtccctccaagg

SEQ ID NO: 109660 - DNA, 456 bp, Homo sapiens
gccacaaatggttgtctggagaggttggaaagagaaagcggatctgctggctttcatcataagccaactggaactacctgtttttaagtatgtgtatgaattactttaaaaaaattaaaagtaaaagaaaacgaggaaactgaccaacaaagtgtatggaaagaggctccactgcatcagttaccaaggcagaggcacaggaagccacaggcaataccaggagagcggtgggaaggcaaagccgggcagcagcaagagtaggcacgaatgcagggcgatctgcttacggatgtgaacgagacggtgagaacagtcatctccaagtgtcttcactggaaagcagaaggtacacattccccaagatgtggtcagtcctctcccagatgcacgtcgcagaggaaccttgctgttcacaccaggaggtgttggggaggctgcagcagccttctggtaaca

SEQ ID NO: 109661 - DNA, 564 bp, Homo sapiens
ataaaaaataaatttgtctcccatctcatctcctaataccgaattcccgttccacagaagggagtacttaatgtgtctgtacttaatgtgtctactttgagtaatatttcatctacatacaagcagatattgtatgtttagtgtacatatatttaatttctcctcttttacaaaaatggtagcacgcaatacccattgctttctatttttttttatttaacaatatcttggcaatctttctgtatcagtatataaagtgctattctctttttaaaaaaaaaaagctgtatggatcttctataatttgtgtaaccactaccatattgatagacattttacttttcgatttcactaggcatgcctggcccatattgctctacaggttgtgcattgcacaagtccaagcagtgtcattcacatggaccacagtgttaatagtattccaagtcatgcttggaaccctgcacttggggaaatatcaaaaactttaatcattcaaaccatggattcacaggcaatagagaagtaaaggacagagaaaggaaaccagaggaaggaaaagga

SEQ ID NO: 109662 - DNA, 443 bp, Homo sapiens
ggaagttgttattggttatacagttggttatggctacttagatattacttataatgggtgtgacctctattgcggattgtcatagcccgaattgtgttccaccccaaaaaattcatgtttggtatcctaaacctcagtgcttaagaatgtgactgtatttcaagattgggtctttaaagagataaataaggttaatggagttcattggtgtgggctgtaatccaataaaactggggtccttataagtagatgagagtagaacacagacatgtacagaggaaagaccacatgaagatgcaaggaaaagatgaccatctgctaaccaagaataaaggtctcaaaacatcgggcctcagaattgtgagaaaatagatttctgttgctgaagccacccagactgtggtactttgtaatggcagccctagcaaatagacagtgatgaa

SEQ ID NO: 109663 - DNA, 460 bp, Homo sapiens
gatgtgaggtaagggtctgagttcttttcttgcagatggatatcctgtagtagatttggagtgagaagattacattcaatccaagttcttctatttactaattttacagtcttagagttaatcacgtttcgaagcctgtttgcccatctataaaatgtgattagttaaatctaataagattattgtcagaatgaaacaaatgagacaataagtgaaaccactttggcatagtgtatggcgcctagtaggactaagatagataaatgttagtggagtttgaaaaacactcccaggatacccaaatactcttcttgtttgtttctttaaattcgtttcagtgagtgaataatgcccaagcttttggttttcagatataatcattgtaatatttaatcccttgaaattacctcttaatcttaaagtctatcagctttaaactctaggcagcaaatgcactgca

SEQ ID NO: 109664 - DNA, 104 bp, Homo sapiens
gattctgtgccttcgaacttgggcaaattgctcccatcttcttcctcccttttcccattctgtagaaggaagggatgggattagataatataggacaacatcca

SEQ ID NO: 109665 - DNA, 414 bp, Homo sapiens
accttctgaaccagctaagggaaggaatggcagattctacagcagggagcaaatcatcctcagcccaggagttcagagatccctgtgtcctgcagtgacctgcctgcctatggaatggagctgggttcatctcatcacattagattatccctcagggtgacaccaaagcacccagacagatttagaagcccaaagtttagggtcaaatgtaaaccctggaacctgagtcccaagaaatggtagactgggaatggaaagaatggggtaaaccacagtctacatagggaaggactctttccttagccttctcttattgattggagagggactgacatgctcctcattctcttaactttgccaaacccattcttgtactcccttgtgatctataaaagatttttctatgatgccaag

SEQ ID NO: 109666 - DNA, 484 bp, Homo sapiens
ttagcaaggtaatgccacatcaggtcattagtgacattaatgagagaacaggggaattattggaaagtcttgacttaaggccagacgagaaatccttaactgctagtgtgacttccctccccacaaaagagaatgctctcgtaatacaccgaactgttggatgctgttgtatatactttatatataatcttacccaaggtggcagagcattaactttaacatctgtctccctgacctcaccagagttcataatctttgccctacttacactgtctgaaggatgacttggcctttttttttttttttttttttttgatagtttaattattgtgtcttagtgagcagttctttcatttgaatttcactggagacctctgtgcctcctgtacttggatgctagcatctatcccctaattagggaagttttcagcccttactgctttttttttttctgattctatactctttttttttcattattgct

SEQ ID NO: 109667 - DNA, 507 bp, Homo sapiens
aagtcatcctcacccaaatctcatctcaaattatattaataatgctcatgtgttaagggagtgactgaatcatgggagtggtttcccccgtgctattctcgtgatagtgagtgaattctcacgagatctgatggttttatcacttaccatgattctaagtttcctgaggcctctcagccatgtgtaactgtgagtcaattaaacctcttacctttataaattacccagtctcgggtatttctttatagcagtgtcaaaatggactaatacaccccttttcccgtggtaaaacatccagcagaggccaggcacagcagctcacacctgtaatcctagcactctggaaggccaaggcaggaggactgcttaaggccaggagttcaaggaccaacctgtgcaacatagtgagaaccccccaatctctacccccacccccgccaaaaaatttttttaataagccaggtgtggtggtgtgcctataattccagctattcaggaggctgaagt

SEQ ID NO: 109668 - DNA, 492 bp, Homo sapiens
  misc_feature (487)..(487): n is a, c, g, or t
tgatgtgtcagtacagggttgttgattacaacaaaggtaccatttgagtggggacattgctaatggtagaggctgtgcatgcatgggagcagggggcatatgacatatgccaagtttcctccaaatttcgctgtgaacctaaaagtgttcttaaaaaatagtcttttttaagagacagggtcttgctctgttgcccaggctagagttcaatagcacaatcacagctcactgtggcctcaacctcccaggttcaagggatcctcctgcctctacctccagagtagctaggactataggcacacgccaccatgcctggctaatttaaaattttttgtacaaacagggtctcaccacgttgcccaggctggtctcaaactcaaaagcaatcctcccaccttggcctccccaaagtgctgggattacaggtatgagccacagcacccgaccaaaaaacccattcttcatgtctttaaatatagcaaatatngtgtg

SEQ ID NO: 109669 - DNA, 412 bp, Homo sapiens
  misc_feature (11)..(11): n is a, c, g, or t
  misc_feature (35)..(35): n is a, c, g, or t
ccaagtctttnataacactgtaaccttcatctccngggttcaagcgatcctcctgcctcagcctccaaagtgctgggattacaggcatgagccactgcgcccggccaggaattagttttttacttggtacaataattcattatagttaagtattgtaagaaatcttaaaatgtaccagctgaaggaattttacatgtacagttaagatagtttgacaaatctacttctctaagatgaataatactgtatttttatttttgtgactggctttttgcgattagtataccattgcttataccatggaacaggatgttattttctaaggctaaataatattccattgtatgtatatgcttaccacattttggttatccgttcagccatcaatggacattgatggattgatccacct

SEQ ID NO: 109670 - DNA, 301 bp, Homo sapiens
cccctcagagttggagtcagggtggttttctgtgacatgtgggttttcacccaggaggatatgatctgtgctcctattctgatggaagcttttggaatttccttgcccaaggcttagcctgcttctggatggcgatggggagttgctgatttaaaatgacaatcaaaaggggcaagttacaatcaggaacgtctataatgtgctttccagtttacaagaggctatcacttttctcacttaataggatctcggtatttttaactgtagctccttcctgaggctccacttgcccatgaatggg

SEQ ID NO: 109671 - DNA, 694 bp, Homo sapiens
aagacggtgtctagaggtgtgctgggtgcacctgcgaagccgacgtcactcatgcttctgctatttcagtcttgactgttagcgtgtgtgggtcaacagcggcattctttgtggttttgctttggctgtgtggaaggctctctttgctgtttggaccatcttggtctccttggcaaccgtgagcgtcaccttcatcctgaatgcctgtgctgggcgttcatcttaacttttctgggatttccctctcatttattctgcattagcagctcccattcatagccacatgaggggcatcctgtgggcctaaacgcttggctttcggcagcgtttattcttccttcctggtaaaatatcaagctgcgagattcagtttcacttagaaggagaaaaataattcttcccatttcttcgtgaaatcattgttcttggtccaactgtcctagtgttttcagtggatactgaagctaacctctgccacatgcacagaacggtgtttccacctgcatctttcccaggactgtaatgtttctcccacctgcggagaaaatgacctttttgttggagcaggcacagtggttgagatggccctggcaggttgttaagtcttttcaggaggcccttactttgcctcaggtgttgagtgggccttttctgggacctctgaggctctgtcttcacagggcttataccctga

SEQ ID NO: 109672 - DNA, 381 bp, Homo sapiens
tgcttgcatggttcctgaagaaatgtctgatgtaattcttatccttgttcctcaataggtaaggtttctcttaactaccatctgtggcttctttaagtatctttttgttgtctttgattttctgcagattgaatatgacatgcctaagtgtagatttttggtatttatcttatgtcatgttctccaaactttctgcctctgtgatttggtgtctgtcataaatgttggaaagttttcagccattttttcttcgattactattttaatgatttttcagctttacaatggtgcaaaagcaatatgcattcagtagaaaccatacttctcttgctatgctgggcagcagcaagcctcagcttccagtcagctatgcctttttga

SEQ ID NO: 109673 - DNA, 352 bp, Homo sapiens
tggttaaagcaaaagaatagactgttttattttgcaaatagatagctaaatcaacattccagatgtgcttacttcccagtatatatgcactagtcatttccaaaaactattgattgacaaaaaacattcttttcaatttgatctacatagtaatgattttaatatccttagaaccaaataacactatatatagcatcagaaataaatttttgttaaactggttgactcagtgaactattcttttttatgatatacttacatgctttgtgcaacaagtaagttcatggagtttgagaaagctaaacagtagcacactcatggaccaggcatggtggcttattcctgtaatccc

SEQ ID NO: 109674 - DNA, 185 bp, Homo sapiens
tgctgggattacaggcatgagccaccacacccagccgagaatggggcacttgtgcacgagagtcctctcttcatggcctttccctggctctatttttcagagttgttttttgttgttttgttttgttttgttttgagatggagtcttgctctgttgcacaggctggagtgcagtggcggaatctc

SEQ ID NO: 109675 - DNA, 912 bp, Homo sapiens
aataggcagccataattcagaaactcctccaagcaacccaaccttcagatcaactcctgacaccatggcctgctgtcagaccagcttctgtggatttcccagctgctccaccagtgggacctgcggctccagctgctgccagccaagctgctgtgagaccagctcctgccagccacgctgctgtgagaccagctgctgccagccaagctgctgccagaccagcttctgtggatttcctagcttctcaaccggtgggacttgtgactctagctgctgccagccaagctgctgtgaaactagctgctgccagccaagctgctaccagaccagctcctgcggaactggctgtggcattggtggtggcattggctatggccaggagggcagcagtggagctgtgagcacccgtatcaggtggtgccgcccagactgccgtgtggagggtacctgcctgcccccctgctgcgtggtgagctgcacacccccatcctgctgccagctgcaccacgccgaggcctcctgctgccgcccatcctactgtggacagtcctgttgccgcccagtctgctgctgctactgctctgagcccacttgttgaaaacctccttctgctggggatcctgataagatggcaccttaaaactagccaaattagaatcctaacaatcttctgaactccagtacctataactgggcttgcaacctctcatcacacagccacataaattccctaggaagtaaattcatttacaatggaagaccaaaaatttttcctagacctggttgtcagccaaagtcctacaatgtgaaaagagttagatactattttactataaatatcacctgaaatatttcaacagttattgggacttaaatttaataaaagttttcatctcttcaatgaaaaaaaaa

SEQ ID NO: 109676 - DNA, 773 bp, Homo sapiens
aataggcagccataattcagaaactcctccaagcaacccaaccttcagatcaactcctgacaccatggctgctgccagaccagcttctgtggatttcctagcttctcaaccggtgggacttgtgactctagctgctgccagccaagctgctgtgaaactagctgctgccagccaagctgctaccagaccagctcctgcggaactggctgtggcattggtggtggcattggctatggccaggagggcagcagtggagctgtgagcacccgtatcaggtggtgccgcccagactgccgtgtggagggtacctgcctgcccccctgctgcgtggtgagctgcacacccccatcctgctgccagctgcaccacgccgaggcctcctgctgccgcccatcctactgtggacagtcctgttgccgcccagtctgctgctgctactgctctgagcccacttgttgaaaacctccttctgctggggatcctgataagatggcaccttaaaactagccaaattagaatcctaacaatcttctgaactccagtacctataactgggcttgcaacctctcatcacacagccacataaattccctaggaagtaaattcatttacaatggaagaccaaaaatttttcctagacctggttgtcagccaaagtcctacaatgtgaaaagagttagatactattttactataaatatcacctgaaatatttcaacagttattgggacttaaatttaataaaagttttcatctcttcaatgaaaaaaaaa

SEQ ID NO: 109677 - DNA, 635 bp, Homo sapiens
aataggcagccataattcagaaactcctccaagcaacccaaccttcagatcaactcctgacaccatggcctgctgtcagaccagcttctgtggatttcccagctgctccaccatggagctgtgagcacccgtatcaggtggtgccgcccagactgccgtgtggagggtacctgcctgcccccctgctgcgtggtgagctgcacacccccatcctgctgccagctgcaccacgccgaggcctcctgctgccgcccatcctactgtggacagtcctgttgccgcccagtctgctgctgctactgctctgagcccacttgttgaaaacctccttctgctggggatcctgataagatggcaccttaaaactagccaaattagaatcctaacaatcttctgaactccagtacctataactgggcttgcaacctctcatcacacagccacataaattccctaggaagtaaattcatttacaatggaagaccaaaaatttttcctagacctggttgtcagccaaagtcctacaatgtgaaaagagttagatactattttactataaatatcacctgaaatatttcaacagttattgggacttaaatttaataaaagttttcatctcttcaatgaaaaaaaaa

SEQ ID NO: 109678 - DNA, 384 bp, Homo sapiens
gatatatgcatgtatctatggaccatgtaatgcttgttataatgacatgaggctctacttggtcatggccacattcatctaggagaaaattcctaactttagtaaaatgtactctttcaaataataaagttattttattcaattttttttttttgagacggaatttcactcttgtcacccaggctggagtgcaatggtgcaatctcagctcactgcaacctccacctcctgggttcaagagattctcctgcctcagcctcccaagaagctgggattacaggaatgtgccaccacgcctggctaatttttgtattttttttagtagagacggggtttcaccatgttggcgaagcttgtcttgaactcctgacctcaaatgatctg

SEQ ID NO: 109679 - DNA, 216 bp, Homo sapiens
ccaggtggtggggggagcacagcatttgaagcccactcccctttgaccacttgctgttgtccagacagacatcacgcacgtgggccttgcattggttcctgcttactttgtctctgctgacccggtttctgctccttgaagtctcagcccccttcttccatgattccaaggcatgtccctctaaggaggcttgaccccaccctggagggcctgctc

SEQ ID NO: 109680 - DNA, 653 bp, Homo sapiens
gtggcacgatcttggctcactgaaacctccaccttacaggttcaagcaattctcctgcctcagcctcccaagtagctgggattacaggtgcctaccaccatgcccagctattttttttgtatttttagtagagacagggtttcaccatgttggcaggctgttcgggaactcctgacctcaggtgatctgctcacctccgcctctcaaagtgctgggattacaggcatgagccaccacgcctggctatttcttaagatataatttggacagttcctgtttctttcagttgatttaattatttttatgtgacaacatttataaggaatgtgcagttttacaaagaaaattggttaaactatgtccacaggttttttgacacctttctactcaaaaggtgcgaccaaatttctttccccttgagtgtattgttaaacttagtgatccatttctaatgcacagagtatggctgaagagatggtacatgacttctgagatgaggtcataaaagacattgctggtttggttttgctttttctcttgaatcacttgttataaagaaagccagctaccatgttatggggacactcaagcaaccctctggaaaggtacacacagtgaggaatcagggactccagccaacagccccataagta

SEQ ID NO: 109681 - DNA, 1128 bp, Homo sapiens
tgaaggaagcaggcacactctcatgcttccccacctagggtttcgcctttcttctaatatttaggattcccagtgaagggtactccacacacaccctctgcctacccctaatcccaccccattgtgtctgatcccacaattactcccagggtatctatactcacagcttttgcgctcaaagaacattgtcgtctgcagggaacgggtggagcccttctcagaagctcccgggggcgagtccattttaagaatgagttgaagtaggaaagaaaacacagatgctgtctttgcattcgacattctatcaccagcaagagaatatgtaactcctgttctttccttcattattccatgaattaccttttttctctagggatctaccagttggtgatttagggcttttaaatattatgcttgttatgtatttaacaaaatgcaatatgtctactggtggcattgtttccttgggaaattagaaaagtagaagctacatactctagttcctaggtggtctctggaaagttggcctcatgctggttggctaaataataagtgtttaggatttgaaaggaagaaagagagctgaagtcctggtgacagagtttgtgagaaacagaagatgtaacactctggcatttgttgaggagatgaggaagaacttttgaaaaataagctattctattcagttttgtgcaaatttattgcagttgcttcatagaggaagaataatgttgagaatggaataattgcaaatgctagtgatgaaatctaaaggaaacctctactcatagttaactgaaagtatttttgttgttgttgtttaaatacttatctcattgctttctttcctttgcagaattattttcctataatagtttccattaggtgtcagtctgaactggttcttacttaagttaggggtgaaaatgttccatcatcacaccttttaagataagaaagtgggaaaaattaaaactttattaagttgaaattactggagttaatttttattgttaaagacagcttttttattcccagaaaaagtaattttaaattatgtcaccactagtcaatgactgcttttgccctgtcactgtccatagccatgattaaagaagtacaaaatgc

SEQ ID NO: 109682 - DNA, 521 bp, Homo sapiens
agccccaacactggcttctcttattgactccatggataaacccacgggcatactgccaagaacctaatgtttcctttctccttcctttctccctttcccacaaggttctatattttactcagctcctaaagcagtctcaaaagttccacatgccaactctcgttacctttataacagctcatcctccttcccagcctgctgaccctgttcctagatcactcacttttctgtcaaatacttgaactgaaagaggctcttgtttcaggttcggcctcctgaggaagccaggctaacagaaagttcatattgtatgtaaacaagtattgacttgataatattctttggtaacttttataaagaaaaacaggctttaagaaattgagttttcagagtataaagtaagtatactttgttttcaaaacactcaatttgctttcacctttagccaacataaatatcactgaatgctaaatgtaaaaaccattaaaaaacaatttaatccatattcttagatattctgc

SEQ ID NO: 109683 - DNA, 382 bp, Homo sapiens
atcatgggggcagtttcctccatgctgttctcatgatagtgagtgagttctcatgaaatttgatggtttcataaggggctcttcccccttcactctctctttcctgctgctgtgtgaagaaggttcctgcttcccctttgccttctgccatgattataagtttcctgaggcctcctcagccatgcagaactgtgagtcaattaagcctctttcctttataaattacccagtctcgggtagtatttttatagcagtgtgaaaatggactcatacacagagagtacctaaaggaggggctgccaccacctcattcctacctgattcttgttctagatcctgagcccgttgctctagcctactggcttgtttcatcctactttgt

SEQ ID NO: 109684 - DNA, 746 bp, Homo sapiens
gaattctcccagggacctgttaaaaatgcatattttgagaattgctgaatcagagttttaaaggtttggggctcagaagtctgcatcttgaaaaggcatctcaggtgattctgctatacacggaatgaagtttaaaaaccactcatagagagtagtaagtaaatgctgctgctaaaaagggcagaacatatctgacatcactgatcatgttgctaatgttgatctctgcagcaggtactttataaaatatatactggtgttaaagctgttatatctgagccttgccacaggcacaggctctccctcccagtgtggtcaccacatagctgctctaggaaaaatgggaacaacgtatgacattaggtgttccttgcatttgactcattcaaatgattggtatgtgcaagagtttaactagaaaacgtttagactctttagtgttttagtcattatgagttagagattagaatgtagttaaatttgtagggttaggcagtttttgcaaaatgcattaaaatggttaaaatgggctaaaacatcagtgttttctcatgggggttatattgtgtagcaacggaatgttacttttaatattgaatgtagctaattatgcaacatatttatttacctttttaaaaaattttaattttaatttttagttctggggtacatgtgtaggatgcgcaggtttgttaaatagataaacgtgtgccaaggtggtttgctgcacctatcaatccatcccc

SEQ ID NO: 109685 - DNA, 291 bp, Homo sapiens
taggagcatgtctggcatgcttctggcatgaagagcatatactggctagaagaccagtatagcctgagaacacagtgtacgagggggaaaaggtaaggagtggggtcaaagagataccagagagccagaatggccatgctggatataaaggctttagcttttacagtactctaaggaaactgtgaactcagtggagagctctgagcacagacatgatagttctcgacttacactattaaagaattatcctgggccgaggtgggcaaattacctgaggtcaggagttcaaga

SEQ ID NO: 109686 - DNA, 394 bp, Homo sapiens
ttcatatattcctagccaaaactgaaagaggggacataaaaggagaaaagtgagaatttgggggattgaatatcctacaatattgactagtctgcaaccaggtcttaattttcggccgaaataaagtcatactatttctatattttatttttatctataatgaaagaagataaaactattttacttcagaaacatatgccagttgcctaaaatctagatgagtaaattctaatttggagtacacattggaattactggggaatatttttctcaaagatgttatgactgccccaccccagactaactaaataagcatcagcaaggatggtgtcaaagcatgcatagcttggaaaaatttcccaggtatgatgtatgtccatggttataaattgct

SEQ ID NO: 109687 - DNA, 1178 bp, Homo sapiens
aacagctggccttctggtgggcaaaccatcccctgatggactggaagcctaccccccaccccaagccctggctgcgacagctctggaaccctgactgcctgggtgcccctcagctctggaaccctgactgcctggatgctcctcagctctggaaccctgactgcttggataccccctcagctctggaaccctgactgcctggaaccgtgatccggaacccaagatcctttcaaggcctcaggggtattgctgctgccctcctccttctcaatttaaccccgcgtccagccgtcgccaccaggggcgtcagagcgcgcgcatgctcctagctcggagccgcgccgatctcgcgccggcacctggcagccaatcgcaggtctccactggacgcgcgcgtgtggaggcgtgcgcgtcggcggcgccgggggcctgaggaggcgtagtcgccgccggctgtgccccgggagcgcctccggggctggtgcgtggccggcagctcgcgaacagcagctgatccggactggatgtgaccttctgcctggaatagctcaagttcttaaaagttgcgttgtaataaacctgaggctgggaagttcaagatcaagatgctggacgatttggttccttagtgaaggctctcttcctggctggtggatgacagccttcttgctgtgttctcacatgacagaaagaggaagcaaggtggcagtttatataaaggaagcattgggacttgtggccccaccattcaggaataaaaaaattagaaaatggaacaatcatgtgaggaagagaaagagcctgaaccacagaagaacatacaagaaaccaaacaagtagatgacgaagatgctgagctcatctttgttggtgtggaacatgtaaatgaagatgctgagctaatctttgttggggtgacttcaaattcaaaaccagtcgtttcaaacattttgaacagagtcaccccgggttcatggtcaaggagaaaaaagtatgatcaccttagaaaagatactgtcgcaaattgcagcctaaaagtcatgagaccgttacatcagaagcagtgaccgtcctgccagcttcccaacttgaatcgagatcaacagatagtcctattattattgagcctttgtctaaacctgattatagaaatagtttcccacaagttgtgcctaata

SEQ ID NO: 109688 - DNA, 358 bp, Homo sapiens
gcacgagaagaaaagagtggggagagagtaaaggctttgcttctgtcttagaattgagctagcttgagtcaatttctgtgcctgcaaccaaatgaaaattaatatagtgagttctttcaggagctttctctgtttttctattgatacctctatatatttttaaggcaatgtcactttgttttgtttacaaatatattgaatatgtcaagattactattttgttattgccctttgtgaatttccttgtctattttgctcgcttgttctttcaggtgaaatttattattttattaatgttgccaaaaattataagtaaaatatcaattatagtaataaaatgttttgtgaaaaaaatgct

SEQ ID NO: 109689 - DNA, 837 bp, Homo sapiens
aacagctggccttctggtgggcaaaccatcccctgatggactggaagcctaccccccaccccaagccctggctgcgacagctctggaaccctgactgcctgggtgcccctcagctctggaaccctgactgcctggatgctcctcagctctggaaccctgactgcttggataccccctcagctctggaaccctgactgcctggaaccgtgatccggaacccaagatcctttcaaggcctcaggggctgggaagttcaagatcaagatgctggacgatttggttccttagtgaaggctctcttcctggctggtggatgacagccttcttgctgtgttctcacatgacagaaagaggaagcaaggtggcagtttatataaaggaagcattgggacttgtggccccaccattcaggaataaaaaaattagaaaatggaacaatcatgtgaggaagagaaagagcctgaaccacagaagaacatacaagaaaccaaacaagtagatgacgaagatgctgagctcatctttgttggtgtggaacatgtaaatgaagatgctgagctaatctttgttggggtgacttcaaattcaaaaccagtcgtttcaaacattttgaacagagtcaccccgggttcatggtcaaggagaaaaaagtatgatcaccttagaaaagatactgtcgcaaattgcagcctaaaagtcatgagaccgttacatcagaagcagtgaccgtcctgccagcttcccaacttgaatcgagatcaacagatagtcctattattattgagcctttgtctaaacctgattatagaaatagtttcccacaagttgtgcctaata

SEQ ID NO: 109690 - DNA, 2059 bp, Homo sapiens
gaagaagccctaatatctataatttgaactgtactggacccatagttttaactgaaaagggccaaacaagtggtgtctgtccagttcctggactgggctaaatttagttttcccactgttaagctggaatgaggactgtcccaacaacagtaggtacagtggacaaaaatagcccagggtgactgactgaatttaaacccataatggctttatatttttctgtgcatatatatcttaccctaattgaacatgtgaagcttgcaactttatgtcttgctttggacatgaatgtattacagcttgcagctattctgttaaatgtatagtttcccagttttttgacactaatgctgtttgggtcttacctgacacacaccagtgtgcaagaaatgtctctctaattcaataagttttaagacttagagttaatgtccttcatctgatctatcctatctaatctgtactatgggtgaatctttttcccttgctctccccaggggctgtttcacagtattctggagtaccttttgagtattggttcctgaacatcagcagtcttggctgcctctgtggactcccggagttgtctccctgcttgtgttctggtgccatcctttgttcctccacccctgaccaaggtgcccagcagcctgtcttcaccagtcaaggaatccgccatcttggctgtagacatacataggtctggagaaatctctccctttttccttgatttctttttaaaggtaccttatctctccccactcctttcttccctcctcaatctagttaaatttcctaagctttcacaaaaatccgggaagagataattaagagcttagcatccctcttagagtagaaggcagtacagataacaaagaagttgtgagtatattatctacattttagaaaattttctgactctagatccatagattctgttgtatttatttgccggacactcatttgattgatttgcaccttgaacactatactaggtcttttcagttacgttgcttgggttaagacactttgctaaaattacagcctgaatcctttctttagttgaagaaagggtatgtgtgtgcaagtgggtgtgtgtgtgccagtttttcttgtctcaggtagatactcccactgtgtataaatagatctacagacttttcatacttacctcccgtattctgtttctgtggtaaaaatatgaagtgttttagttgtatgttgagtgattggttggtattatcaacactgttgtttgcagtctcattaaagcatgctcttaaggagtacatatggtcattaattgccaactgtagattccagtgatctggcccctgcctacctccttcctctctttttcattctctgtcatgcttctccactgttttccccaatgatgcactattttgacacactggccttgctattccttaagcaaatcacattcttcccaatccaaagactttgcacatgctgttgtctttcttagaatgcccttcccctaggcctgcatggcttgctacctcacttaattgtttgacacttcctttggttcattgagcttcaaggctcttaaaatgccactgacaatgagatctccctttaaaaaaaaaaaaaaacttctacttttcctcttaaaggcactttactctctccccactcttttcttcctcttcaaagtatttaaatttcctaggttttcatgaaaaagctggaaagcgatcatcatcaagggctttgcttctgtcttagaattgagctagcttgagtcaatttctgtgcctgcaaccaaatgaaaattaatatagtgagttctttcaggagctttctctgtttttctattgatacctctatatatttttaaggcaatgtcactttgttttgtttacaaatatattgaatatgtcaagattactattttgttattgccctttgtgaatttccttgtctattttgctcgcttgttctttcaggtgaaatttattattttattaatgttgccaaaaattataagtaaaatatcaattatagtaataaaatgttttgtgaaaaaaatgct

SEQ ID NO: 109691 - DNA, 2203 bp, Homo sapiens
aacagctggccttctggtgggcaaaccatcccctgatggactggaagcctaccccccaccccaagccctggctgcgacagctctggaaccctgactgcctgggtgcccctcagctctggaaccctgactgcctggatgctcctcagctctggaaccctgactgcttggataccccctcagctctggaaccctgactgcctggaaccgtgatccggaacccaagatcctttcaaggcctcaggggtattgctgctgccctcctccttctcaatttaaccccgcgtccagccgtcgccaccaggggcgtcagagcgcgcgcatgctcctagctcggagccgcgccgatctcgcgccggcacctggcagccaatcgcaggtctccactggacgcgcgcgtgtggaggcgtgcgcgtcggcggcgccgggggcctgaggaggcgtagtcgccgccggctgtgccccgggagcgcctccggggctggtgcgtggccggcagctcgcgaacagcagctgatccggactggctgggaagttcaagatcaagatgctggacgatttggttccttagtgaaggctctcttcctggctggtggatgacagccttcttgctgtgttctcacatgacagaaagaggaagcaaggggctgtttcacagtattctggagtaccttttgagtattggttcctgaacatcagcagtcttggctgcctctgtggactcccggagttgtctccctgcttgtgttctggtgccatcctttgttcctccacccctgaccaaggtgcccagcagcctgtcttcaccagtcaaggaatccgccatcttggctgtagacatacataggtctggagaaatctctccctttttccttgatttctttttaaaggtaccttatctctccccactcctttcttccctcctcaatctagttaaatttcctaagctttcacaaaaatccgggaagagataattaagagcttagcatccctcttagagtagaaggcagtacagataacaaagaagttgtgagtatattatctacattttagaaaattttctgactctagatccatagattctgttgtatttatttgccggacactcatttgattgatttgcaccttgaacactatactaggtcttttcagttacgttgcttgggttaagacactttgctaaaattacagcctgaatcctttctttagttgaagaaagggtatgtgtgtgcaagtgggtgtgtgtgtgccagtttttcttgtctcaggtagatactcccactgtgtataaatagatctacagacttttcatacttacctcccgtattctgtttctgtggtaaaaatatgaagtgttttagttgtatgttgagtgattggttggtattatcaacactgttgtttgcagtctcattaaagcatgctcttaaggagtacatatggtcattaattgccaactgtagattccagtgatctggcccctgcctacctccttcctctctttttcattctctgtcatgcttctccactgttttccccaatgatgcactattttgacacactggccttgctattccttaagcaaatcacattcttcccaatccaaagactttgcacatgctgttgtctttcttagaatgcccttcccctaggcctgcatggcttgctacctcacttaattgtttgacacttcctttggttcattgagcttcaaggctcttaaaatgccactgacaatgagatctccctttaaaaaaaaaaaaaaacttctacttttcctcttaaaggcactttactctctccccactcttttcttcctcttcaaagtatttaaatttcctaggttttcatgaaaaagctggaaagcgatcatcatcaagggctttgcttctgtcttagaattgagctagcttgagtcaatttctgtgcctgcaaccaaatgaaaattaatatagtgagttctttcaggagctttctctgtttttctattgatacctctatatatttttaaggcaatgtcactttgttttgtttacaaatatattgaatatgtcaagattactattttgttattgccctttgtgaatttccttgtctattttgctcgcttgttctttcaggtgaaatttattattttattaatgttgccaaaaattataagtaaaatatcaattatagtaataaaatgttttgtgaaaaaaatgct

SEQ ID NO: 109692 - DNA, 1175 bp, Homo sapiens
gaagaagccctaatatctataatttgaactgtactggacccatagttttaactgaaaagggccaaacaagtggtgtctgtccagttcctggactgggctaaatttagttttcccactgttaagctggaatgaggactgtcccaacaacagtaggtacagtggacaaaaatagcccagggtgactgactgaatttaaacccataatggctttatatttttctgtgcatatatatcttaccctaattgaacatgtgaagcttgcaactttatgtcttgctttggacatgaatgtattacagcttgcagctattctgttaaatgtatagtttcccagttttttgacactaatgctgtttgggtcttacctgacacacaccagtgtgcaagaaatgtctctctaattcaataagttttaagacttagagttaatgtccttcatctgatctatcctatctaatctgtactatgggtgaatctttttcccttgctctccccaggggctgtttcacagtattctggagtaccttttgagtattggttcctgaacatcagcagtcttggctgcctctgtggactcccggagttgtctccctgcttgtgttctggtgccatcctttgttcctccacccctgaccaaggtgcccagcagcctgtcttcaccagtcaaggaatccgccatcttggctgtagacatacataggtctggagaaatctctccctttttccttgatttctttttaaaggtaccttatctctccccactcctttcttccctcctcaatctagttaaatttcctaagctttcacaaaaatccgggaagagataattaagagcttagcatccctcttagagtagaaggcagtacagataacaaagaagttgtgagtatattatctacattttagaaaattttctgactctagatccatagattctgttgtatttatttgccggacactcatttgattgatttgcaccttgaacactatactaggtcttttcagttacgttgcttgggttaagacactttgctaaaattacagcctgaatcctttctttagttgaagaaagggtatgtgtgtgcaagtgggtgtgtgtgtgccagtttttcttgtctcaggtagatactcccactgtgtataaatagatctacagacttttcatacttacctcc

SEQ ID NO: 109693 - DNA, 185 bp, Homo sapiens
gaaaggaatgctggaaagaaaaaaatgaccattttgcaatcatcacaataaaaagctggatcagacaagagtcaatggatgctaaatctagaagaaaccgtgaaaagaatcagaatatctgcattgtttccccacaagctgcttattgcttggcaaaagagagggcaaaaaaaccaaatggtgga

SEQ ID NO: 109694 - DNA, 836 bp, Homo sapiens
  misc_feature (150)..(150): n is a, c, g, or t
  misc_feature (165)..(165): n is a, c, g, or t
ccgcctccagcgcgcccttgctgccccgcgcgaccccaggattgcgaactcttgcccctgacctgttgggcggggctccgcgctccagccatcagcccggatgggtctcctggctgggacttggggcacctggagttaatgtccaacctngggtctgcggagacncgatccgaggtgccgccgccggacgggactttaagatgaagttatgggatgtcgtggctgtctgcctggtgctgctccacaccgcgtccgccttcccgctgcccgccggtaagaggcctcccgaggcgcccgccgaagaccgctccctcggccgccgccgcgcgcccttcgcgctgagcagtgactcaaatatgccagaggattatcctgatcagttcgatgatgtcatggattttattcaagccaccattaaaagactgaaaaggtcaccagataaacaaatggcagtgcttcctagaagagagcggaatcggcaggctgcagctgccaacccagagaattccagaggaaaaggtcggagaggccagaggggcaaaaaccggggttgtgtcttaactgcaatacatttaaatgtcactgacttgggtctgggctatgaaaccaaggaggaactgatttttaggtactgcagcggctcttgcgatgcagctgagacaacgtacgacaaaatattgaaaaacttatccagaaatagaaggctggtgagtgacaaagtagggcaggcatgttgcagacccatcgcctttgatgatgacctgtcgtttttagatgataacctggtttaccatattctaagaaagcattccgctaaaaggtgtggatgtatctga

SEQ ID NO: 109695 - DNA, 856 bp, Homo sapiens
ccaaagcgtccgagactgggtacagtcgtccaggcgtgacgggggcgcggggagccagtgactcctctgggaggggaagggattagggccagaatctctcaaaggtgcaaaaatccagtcaagagagggttttcgggtataccacggaggattaaaactttcaagacaaatgcagtctttgcctaacagcaatggtgccgccgccggacgggactttaagatgaagttatgggatgtcgtggctgtctgcctggtgctgctccacaccgcgtccgccttcccgctgcccgccggtaagaggcctcccgaggcgcccgccgaagaccgctccctcggccgccgccgcgcgcccttcgcgctgagcagtgactcaaatatgccagaggattatcctgatcagttcgatgatgtcatggattttattcaagccaccattaaaagactgaaaaggtcaccagataaacaaatggcagtgcttcctagaagagagcggaatcggcaggctgcagctgccaacccagagaattccagaggaaaaggtcggagaggccagaggggcaaaaaccggggttgtgtcttaactgcaatacatttaaatgtcactgacttgggtctgggctatgaaaccaaggaggaactgatttttaggtactgcagcggctcttgcgatgcagctgagacaacgtacgacaaaatattgaaaaacttatccagaaatagaaggctggtgagtgacaaagtagggcaggcatgttgcagacccatcgcctttgatgatgacctgtcgtttttagatgataacctggtttaccatattctaagaaagcattccgctaaaaggtgtggatgtatctga

SEQ ID NO: 109696 - DNA, 778 bp, Homo sapiens
ccaaagcgtccgagactgggtacagtcgtccaggcgtgacgggggcgcggggagccagtgactcctctgggaggggaagggattagggccagaatctctcaaaggtgcaaaaatccagtcaagagagggttttcgggtataccacggaggattaaaactttcaagacaaatgcagtctttgcctaacagcaatggtgccgccgccggacgggactttaagatgaagttatgggatgtcgtggctgtctgcctggtgctgctccacaccgcgtccgccttcccgctgcccgccgcaaatatgccagaggattatcctgatcagttcgatgatgtcatggattttattcaagccaccattaaaagactgaaaaggtcaccagataaacaaatggcagtgcttcctagaagagagcggaatcggcaggctgcagctgccaacccagagaattccagaggaaaaggtcggagaggccagaggggcaaaaaccggggttgtgtcttaactgcaatacatttaaatgtcactgacttgggtctgggctatgaaaccaaggaggaactgatttttaggtactgcagcggctcttgcgatgcagctgagacaacgtacgacaaaatattgaaaaacttatccagaaatagaaggctggtgagtgacaaagtagggcaggcatgttgcagacccatcgcctttgatgatgacctgtcgtttttagatgataacctggtttaccatattctaagaaagcattccgctaaaaggtgtggatgtatctga

SEQ ID NO: 109697 - DNA, 681 bp, Homo sapiens
  misc_feature (6)..(6): n is a, c, g, or t
catacnggccaaaagtctccaagtccctgctaacttcttgctctcgcaacagaatacctatttaggtgggaagaatgaggtgtgggcggcaggctgggtgccgccgccggacgggactttaagatgaagttatgggatgtcgtggctgtctgcctggtgctgctccacaccgcgtccgccttcccgctgcccgccgcaaatatgccagaggattatcctgatcagttcgatgatgtcatggattttattcaagccaccattaaaagactgaaaaggtcaccagataaacaaatggcagtgcttcctagaagagagcggaatcggcaggctgcagctgccaacccagagaattccagaggaaaaggtcggagaggccagaggggcaaaaaccggggttgtgtcttaactgcaatacatttaaatgtcactgacttgggtctgggctatgaaaccaaggaggaactgatttttaggtactgcagcggctcttgcgatgcagctgagacaacgtacgacaaaatattgaaaaacttatccagaaatagaaggctggtgagtgacaaagtagggcaggcatgttgcagacccatcgcctttgatgatgacctgtcgtttttagatgataacctggtttaccatattctaagaaagcattccgctaaaaggtgtggatgtatctga

SEQ ID NO: 109698 - DNA, 670 bp, Homo sapiens
tggagaggggcgcagggacccgcagggagcccaggcttaacgtgcattctgcggttctctcccccacctcccgcctgcccgcgcaggtgccgccgccggacgggactttaagatgaagttatgggatgtcgtggctgtctgcctggtgctgctccacaccgcgtccgccttcccgctgcccgccgcaaatatgccagaggattatcctgatcagttcgatgatgtcatggattttattcaagccaccattaaaagactgaaaaggtcaccagataaacaaatggcagtgcttcctagaagagagcggaatcggcaggctgcagctgccaacccagagaattccagaggaaaaggtcggagaggccagaggggcaaaaaccggggttgtgtcttaactgcaatacatttaaatgtcactgacttgggtctgggctatgaaaccaaggaggaactgatttttaggtactgcagcggctcttgcgatgcagctgagacaacgtacgacaaaatattgaaaaacttatccagaaatagaaggctggtgagtgacaaagtagggcaggcatgttgcagacccatcgcctttgatgatgacctgtcgtttttagatgataacctggtttaccatattctaagaaagcattccgctaaaaggtgtggatgtatctga

SEQ ID NO: 109699 - DNA, 170 bp, Homo sapiens
atgaggttccaaaaagatgtttcagtattttgaaccccataaatgacattgctctatgtaagtcatttttagatttttttacccccctattttagggtatttggtttccttgtctttctccctcattttgatgctttgttcagtggatcctctgtttaacaataggttgt

SEQ ID NO: 109700 - DNA, 375 bp, Homo sapiens
ccttgaggagagaagtcatctggggaactccttgctcctggccttgcccccctcacagggccttccctctgcccacttagcacaacctctgaatggcttggtgcctgggccactggagtccagcaaagccttctggtattgcctttgggttttcctgtcctctgaaacagggagtggtgagcttcaatttggtaaatgtatacgagcagaagataaggtgtgtgcagtgctgtcaggtacagaagcccagagcagaggagctaaaggttttgggtgggtcccttttctgtcaccagcctgctctgagactgagaccaactccttctctagatatcagtttcctctttgtaaaaatgttggccaggcgcggtgact

SEQ ID NO: 109701 - DNA, 231 bp, Homo sapiens
tagagaagctctgggataggagacaccagctcagcagatggtgatgggggagggttaacttcagatactgaaggtgacaccctgagttcatttgttcttttcccgaaatgccaacaatcagacctatgccctatcggacaggagatcaggggatttcttcatcgaaaaattgaatagccttgggatcccccaaccaaaaagtcagctttttacccaggtaattgagaataa

SEQ ID NO: 109702 - DNA, 182 bp, Homo sapiens
aagtcaaagatctgggtcaaagagacctgcttatggccccgattgtgtaatccattcccattctgtagtgctggggcttacgccccacccgagggagcccaggtttcttttcacatggcccccaccccgagaacacggctccaggttggcacctactcatggccctctacctctgcagccgc

SEQ ID NO: 109703 - DNA, 365 bp, Homo sapiens
atgattttgccccttggggacatttggcagtgcctgaaaccatttttggtagtcccaactggggatggggtggctactgctactgtttagtgggtggaggccaaaggtgctgctaataaacatcttacaatgtacagggcagcctactcacctttccagcaaagaattatctggtccaaaatgtcaataatgccagtattcagaaaccctggtcaagtgttttttgagatagcgtcttactatgttgcccaggctggtcttgaactcctgggctcaagcgatcctcttgccttagccttccaagtagctggaactataggcataggccaccatgtccagcttaagttaaggcaaaaaacatagaa

SEQ ID NO: 109704 - DNA, 716 bp, Homo sapiens
ggcatcttttttctttctgttcctgtgacgattgactaattcagatcctttttatttcaagctcaagctcattccagcaaaaaggtctacaggtctccctgctacaggcacaggcaccaatctctcacatactaccataacaatctgcttcagtgataccaattttcattgttccctttctctgcttaaaacttttaatgcactactccttcctcggtcccacaatctgtatgggaaaagaacaagactgaccttcacatgacaatcaaaatccttcacttatctacctggctcccaccttcatttcttatcttatctaccgtgataaaaaataccatcaccttacatttatgcagtgctttatctaatttagaaaacctaacatgcaccgccatttcatctggacaaaggccttagagagtagctaaacaggcattagtgtcctccttttacagatgagaaaacagactactagcatggaacccaagtctaaacaaataagtccctgtcccacttcaccctgggaaccttaagtaagtccatcaacctttctttcttttttttgagacggagtctcactgtgtcgcccaggctggagtacagtggcgtgatctcggctcactgcaacctccacctctcgggttcaagcgagtctcctgcctcagcctcccgagtaactgggattacaggtgcccaccaccacgcctggctaattt

SEQ ID NO: 109705 - DNA, 211 bp, Homo sapiens
aaaagaaaaaaaaaagaaatcttcaatgtggaaggctttggaggtaggggctttgctgagaagagttaggactaagcagcctcttctggatcagattccaaatttgacattgctgaatttctgggaatttggtgactatgagggaaggacttaaaagtgacttaaaattttgagacttgatgacaggaacgttccagactgtactactgtt

SEQ ID NO: 109706 - DNA, 421 bp, Homo sapiens
tcccctcatacaaacaagcaaactttgaagttcatgaggcattagagagttattcgcatctcagatgttattttgagaattacagtaatatttgtcattaatggaatgcccatcatgtgctagacactactaccaatactttgatagatataattgtctgtcctcatagtagtccagtaactgagtataagtatgctcacaggagaacagggattgagatggggaaccatactcagtgcaggaagtgtcatcactacatgaagtgatgaaactacgttcacactcagtgctgcacgaatacagtgtgggctctggagtccacctggctccaaagctctttaccagctgtgatcttgggcaaggaatttaacgtctggctgctttggttctctcgtgtgtaaaatgaagataataatccaca

SEQ ID NO: 109707 - DNA, 250 bp, Homo sapiens
ttggcctcccaaagtgatgggataacaggcatgagccaccgcgcccagccggaggagtggttttcatgccatgtggtgcctgtcttggaggaagcaagattcgggagacattaaagaatgagcagccctttgtctgcttttctgagtgttttgtctctgggctgtgtccccgcaagtcaggcataaacagtaggccccaaagtgagtggcgactcctcagtaacaaacttccacaatgatgcacagttaa

SEQ ID NO: 109708 - DNA, 337 bp, Homo sapiens
aaataagcagttttactaatagaaagaggacatttaataagataaatagaaatatgtataacttattcttctctagtgacagaaattgaggcagcttatagtaaaacatacagaaagtttgcagtttaaaatttaaaatataaacagatatataaagttatataagggataaggaattatgtttacacttcaagatatttactgttgctgaacatttatttgaagacagcttttttgtgtggaggttgaacggataggaaatgtaatgaacgtggtaataacctttttaaaaattctcaagaataggaacttaggcaacataaaaatttatcaatgt

SEQ ID NO: 109709 - DNA, 412 bp, Homo sapiens
atctatcggctggggtctgtaggcacgtggagtatgtcagcataggccaggcacggtggctcatgcctgtaatcccagcactttgggactcggaggccgagtcgggtggatcacccgagatcaggagtttgggaccagcctgtccaacatggcaacactccatctccaaaaaaaaaaaaaaaagaaaaaggaatggaccgcaaacacaggcaaaaacatggtagatctcaaaagcagcatgataagacaagaaagaacaaaagcatagcaaaagaaagcagatcagcagttcctggggttgggggcaagaattacctctaaaggggcaggatggaatttttcaaactcattgacccgcacagttaaaattagtgagttttagtgaacaagaattacacttcgtaaatcttta

SEQ ID NO: 109710 - DNA, 1433 bp, Homo sapiens
cccatttctactaaaaatacaaaattagctgggcatggtggcccacacctgtaatcccagctactcgggcagctgaggcaggagaatcccttgaacctgggaggcagaagatgcagtgagccgagatcacgccattgcactccagcctgggcaaaaagagcaaaactccatcttaaaaaaataaataaataaaggaaaatgagccgagtgatggtcttagatataagatggaatggcaagcaaataaaattataaatatgaatacatatgtatatataaaagaatagtgtcaactaaaatactagacaacaatagcatgtaaattagaagggacagaaatgttctaagaccctccggttgttgggaagagggtgtaagatagtgtttaatttgactttgataagttaaatgtgcatagtgtaatttaatgttaattactaaaagagtgtaaccagtctatacatctctaatccaataaaaagaataaaacactgtgatttaaaatgtagtcccagctgcttgggagactgaggcaggaggatctcggcttggatcctcagaccaggagtttgaggcagcagtgagctatgattgtgccgctgcactccagactggacaacacagtgagagcccataaaataaataaatgaactgaacacaaacttctgtcaattaaaaaataagaacgaaatcaggctgggcctgagcgctgtggctcacacctgtaatcccagcactttggaggccaaggtgggtggatcgcttaagcccaggagttcgaaaccagcctgggcaacatagggagaacctgtctctacaaaaaatacagtaagtaagcctatagttccagccacccaggaggctgaggtgggaggatcacctgagcctgggagctcgagactgcagtgagctgtagtcataccactacactccagcctgagcaaaagagtgagaccctctctcaaaaaagaaaaaaaaatcagaaacaaactgggcaaattaagatggtggaaacaaaactaaatatgtccctaaccacagtaagctgtatagaattgccggttgacaggtaaaggttaggactgggtgcagtggctcatgcctgtaatcccagcactttgggaggccgtggtgggtggatcacctgaggtcaggggtttgagaccagcctggccaacatggtgaaaccccgtctctactaaaaatacaaaaatcagccagttgtggtggtgcatgcctgtaatctcagctactcgggaggctgagacaggagaatggtttgaacctgggaggcggaggttgcagtgagccaagattgcgccactgctctccagcctgtgtgacagagtgagactgtcatacacacaaacacacataaagattaggaggaaaatctgtgacccagagtcacacacatgaagacagacaggagg

SEQ ID NO: 109711 - DNA, 229 bp, Homo sapiens
tatccaaatcccttatgaaaatctggtttataggccaagcacggtggctcatgtaatcctagcagtttgggaggccggagtgggtgggttgcctgagctcaggagtttgagaccagcctgggcaacatgggaaaaccccacctctactaaaaatacaaaaattcgctgggtgtggtggtgggcgcctgtagtcccaggtactcgggaggctgaggcatgagaataactt

SEQ ID NO: 109712 - DNA, 694 bp, Homo sapiens
tcatagtctgtagctgtcattggaccgggagcttcctgtttcttccagcaatttttgtttgtgttttttgttgttgaagagaggaacatttaaggagttagataaactggtaattttcagatgtgtagaaaattgcataggtggtgaaagccaatgccataggctctgaaattttactatttcctacatcaggaaatgtgtaccaaaagtgctaaaatgccaagaataattttgagtatctaaagatagataaatcttttcatctgagtggaaatggcattatgactttatattctcatggttttccttgtaccttgaaattgagcatcacttgaattggagccccagaagcaaggttaaagtgagttactactgagtttctggtgttcctaacttatccctttggtatatatgtagaagataacaaagcagctgtgtacagtggcttgtgcctgtagtcccaactattcaggaagctgaggctggaggatcccttgagcccaggagtgagagactgcagttagccactgcactccagcctgggcaagagtggctcctctctctcttaaaaaaaaaaaaaaaaattaaaaagcaaagccacagcaatttgctcttttatgtgaattgagaagcaaatgttatgaacctgtaataagttgtaccctatatgcatgtcagcaagacttgagatctc

SEQ ID NO: 109713 - DNA, 304 bp, Homo sapiens
tgcctctgagcacacctgcctcggggtgtggaccttgccggttctttggcctggaatgcactgcccccaggttttttatggctgaattcttcttgtcatttaaatcttcgttcaaaagtgatcctctcaagccaggcatccccccgtcactctctactgcgttacccagttgtgtttatttttttcacagcactcatctgaccggcaaggatctcatttgttgacggactcctcctgcagacagggtctcgtctgtctcgggcgcctctgtgtccctagttcctgcaggcctggcacgtggaag

SEQ ID NO: 109714 - DNA, 353 bp, Homo sapiens
taaagaaaattcaagttttacagccttagcttacacactaatcttcagaacaccatagccatttctttaatctgatggatgccctcgcatgatgcctgtcttctctgatcagaaatgacattcttaacatcaatagattcttagacttttctgacaggaaatatttttgaggatatgtaatcagttatggggtatgcttgtcaatacatttttcctgcaaaaataaatcagaaatcctatcaaaatagcattatgaaagaatccatttcccttaatactcctcatgaaatggtcatgcctgaagtttctgagaatttttatttagatgaaggttgtgtatttaatttatatac

SEQ ID NO: 109715 - DNA, 604 bp, Homo sapiens
accaggtttctacttttcccaattagtatttgtgtttcaaccaccctgcatggaaacatgggttatgaaatgccttcacaagtatggtagaaaatatgctgctattgtgtgttgccttggacttctagaagtctaggtgttggtggttattatatggcgatagtaaagtaaaatcctccctactgttctagtacccacaatactacttttcatactttagctactttaccttcagtctctctgtcaacctctgatctaaagacttctttactaaataacattcttcttgcctaatactgtattatggacttcatcagggaagggactaatccatctttgcatgctaacgtttaagctgaaataaagtaatccctcaattaacattttgcagaaacctccttaggttcccctacaaacctgcccctattttagttaatagaatgcattcccactgacatgctggaaatttcagcattgtctttggtcctccctccagtctaatctgaatctcacaagtcatcaaggcctgtggcttctgtctctgaaatgtcttttgagtctttctccctgtacctcttgtccttagacagtccccctccctatt

SEQ ID NO: 109716 - DNA, 852 bp, Homo sapiens
gctaaggcaggagaatggcgtgaacctgggaggcggaggttgcagtggcatgatctctgctcactacatctgcctcccgggttcaagtgattcttgtgtctcagcctcctaagtagctgggatcgcatgcgtgagccaccaaacctggccttagaattactcttagaacagtggaatgcccacacatccaagacaggcaagttcatggagactaagggaacagtggtatcatgtctcccttctcccttgtgcttactacaagaatggcaggcagaattccctacttatttaaaatatcactgatgtctcactctttttctttatattttatttattgatttgccacaaagtttaattcacctaagtgagacgtgcatatgatgtaactccactgtacagatacacagatctttacagaagaactatttttggcaacccctatgcccctgggtagggtccagaagtgaacaggcttggtgggggattgttttcacctcttggctactcagagtacctaaacctgtccttacttatggagagcatgtgtcacaccaagatggcagtaagctggcaactgcgaagacctgactgatgcccatttgggaagccaggcaagtgaaaatggaccgaagaaacagagatggctgtcttttatgcagggcttttccataaagaggttacactggggcaaccaagtatgtgtagaaagccagagctaaacttcagcttggcattcacagttttctcttcactgagctaataggcccagagtttcgggcagagctgtgaaatagtgcttctctaatagcaaccatattattgttacataattaaaagccagctcttttgtta

SEQ ID NO: 109717 - DNA, 399 bp, Homo sapiens
gcagagtctcactctgtcacccaggctggagtgcagtggcatgatctctgctcactacatctgcctcccgggttcaagtgattcttgtgtctcagcctcctaagtagctgggatcgcatgtgtgtgccaccatgtgtagctaattttttgtatttttagtagagataggattttgctaagctggccaggttggtttcaaactcctggtctcaagtgatccgcccaccttggcctcccaaagtgctgggattacaggcgtgagccaccaaacctggccttagaattactcttagaacagtggaatgcccacacatccaagacaggcaagttcatggagactaagggaacagtggtatcatgtctcccttctcccttgtgcttactacaagaatggcaggc

SEQ ID NO: 109718 - DNA, 779 bp, Homo sapiens
gctgcaaagatctgctatagagttaaactacagagataattgacttaaaacatgggaatttattcataatatacaaaaaggagcagctctggtgaagactgtctggccaaggcaagggaggggcttacaaaggcaaagccccagagcttcacatggaagattgatttgttggtttgaacaagtccttgccttgtagattcaggttgtctggttctggaggagcttcatgctgcagatatgtctgcatgctgcgccccaagtcaaagtaatagagccacagtttcaccatcaggccattttctgatgatctgaccagtttcctgaagagcagttgccctggtccttcttctgggccttgcttgcttgctgtctgtaccttccaagctccgggtcctgtagtgggcacataaaatgcatgtgtttgggctcagtaaaaatatccttttcaaggcccttatagttatctgccttgtaagcatgtctacttggatttcttgcaagtgtttcaggctcaaagaaaataactaacctaccaactttcacctccctcttccccagctcctctccctctagtgtcatcagcccaatgaatggcatcactctctaccgcatctcccaaagcggaaaccgaggagttgcctgttccttcatcttcctcactctcatcccatgaaatcagtctctgcatcccaacaattctactccttatgatctaaccactctgcccttcctgcaggtttctctctccagcatcctcctgactagtatccctgtctcca

SEQ ID NO: 109719 - DNA, 703 bp, Homo sapiens
gaaatgagacacatgcccagacacacacatgcatgttataaaacaagatgtttatatgaacagtgtagtgaggtggcatataatgaagagccacataggtaatacctactctactccagggtggaggccaaaaagtacatactacaggtgccaatatatattacctttaatcctcaaagccatctccattttacagctgagcaattcctcaaatcccaggacagttggagaggaccatggatggcccctggctatggcaggaatgcctcttagaataatcctgcttgaccttcacccagcccaatgccagaaatgtcttacggggaattttggtcactgcctatttcaattctggatttctctaacaatgagaaatggtctccttgtactgattcttagaagctatttctacacaggggaaaatgagatagagattattaaaattgtgaaaaatgaaacagaattaagttaaaacaaaaaaaagcagaggaagggaagaaacgaccacctgtttttctctagtctttgagtggcaagagagaaaataactttatatataaaaatgcctctggccgggtgtggtggctcacacttgtaatcccagcactttgggaggccgagacaggccgatcacctgaggtcaggagttcaagaccagcctggccaacatggtgaaaccccatctctactaaaaatacacaaa

SEQ ID NO: 109720 - DNA, 920 bp, Homo sapiens
catatccaaaattcttgggaccagaagtgtttcagatttctgatttgtttggattttgaaatatttgtatcggtacttaccagttgaacatcccaaatcccaaaaatccgaaatgttccagtgagcatttttgttttaattgttatgttggcactcagaaagttttggattttggagcatttcagattttgtatttttggatttgggatgctcaacctgtgattgtccaaatcaatcaacgacattgaaatccagtgatacggatgaatgttagcaatatgataagtcaaaaatgtaagacccaagagattacatacagcatgataagcttttttaaatagttagaaacaaacaaaaaataatgtcttacattgactacatgtagatgaatttaaaacaatataaaaaggaaagcaataaatgattaacctggaattccagataacggtgggaagtagcacatggttagatgaaggttattgtgaaagtgctaattttgttatagtggtagattttagggtgcttattacttcattaaagataaataattatataactagtcttctaagtggaccatgcatataccagttatgcgagtgttttcaattaaagatgatgtattccattttgtacacctgagttccagttaaaaaaaatttttttcagagttcattgaatatagatagatatagatatagatatagagattgagtgtcaggaactaccctaggaattggctagaaatgagagacaaatatgacatattgtctatctggtggtctaatgtaatagaaataggcttttcaataagtgtgtaaaatcttgcactgaacatggtagaagtctttggggatacaaagaagggagcatttgtttctacgacatgtctagaatttgcctccactctgctccttctcacc

SEQ ID NO: 109721 - DNA, 539 bp, Homo sapiens
gtacttgatatctcaattacattagaggctaagacagttttctaccagcatgagaactgaaacacgatagcatgccttttatggcgaaatgtgtttgaacttcaaacaacaaatatataaaacttattatgcaatacaccctatcagcaaattaattgaaggctgcctctagattgttaggtgtggacgacaggaactttatttcctacttcttttgtacatgccattgctgtttaacagtgttgggttcataacaggtgattagacagtcttgttgatagtttggagaaccatcttaatcatgacctagaatcattcttatttcacagcaacctgtgtcttgactaatgttaaactgactaatttgttttgaagctgagaatgagaaattggaggtccttctcatagatctgagattcctttttattcccgagttggataaattagggtaaacaaaatcaaatacttgtaaaaatactgtacaaaggaatgacatatgcatgctggttccctagcagggtaattccatcagcgcttta

SEQ ID NO: 109722 - DNA, 417 bp, Homo sapiens
gggattccagtgtttgagccaccgcgcccagcctcagagaaaccactttcacacatcctgagtagcagaggcatcagaaagtgtcactggtacgacccatcaagtggccatttcaacctaggaacagggcacagacaaaggagagagttgcccagtttttaagcacctggtctgtgccgggaacagtgctgtgctgcctacatgagtttcacttcatcctttttgtatcaccaaaaggctgaatgcagttgacccactttacaggtgtggaaactgaggccctgggtggtgaagtcttttggccaaactctctcagaaaataagtggcagagccagatctgaagcctgggtctgtctgattccaaggcctgggtcccctactgcatctcctcacccaagggaagttgtcacagggag

SEQ ID NO: 109723 - DNA, 685 bp, Homo sapiens
cgtggtggctcacgcctgtaatcccagtaccttgggaggccaaggcgggcagatcacctgaggtcaggagttggagaccggcctggctaacatggcgaaaccctgtctctactaaaaatacaaaaaaatttgcagggtgtggtggtgcatgcctgtaatcccagctactcaggaggctgaaactggagaatcgcttgaacctgggaggtggaggttgcagtgagctgagatcgtaccactgcaccccagcctgggcgacagagtgagactccatctcaaaacaaaactaaacaaaacaaaaacaaaaaaactatatatggtcaatgtggtcagaaaacagcagtactttggtgtcagaacctggaagactgaacagtgcagagctgggcagcaaaggggccagctaacacgcgcacggggcacttcttgggtgctgggagtgatggggtgtgtgtggaaaacccagtctcaaggagcagcttgtagcctagcaagattcgaaagactggcagcaatttaggatacggcagcctctactgcagctgcagagctctggctctggactcagagggcctgggttcaggccactaactagctatgtgacctccactaagttacttaccctctgcctcagttgccttgcaaaattaggttccccacagtgcctgtcacttatcattgttgg

SEQ ID NO: 109724 - DNA, 364 bp, Homo sapiens
aaaaacttattttgtccaattgaatcttttgtggcattttcatcatttctaacgtctctatgttggttcttcttgattgtggttttccctgctgtttccgtatttgactgattgctgaggctcctactatttgctttcagctcagaaggtaagcaagcaaacttccagtccagtttcagatggactttgaaccaatgttgctttgcagtagggctgagcactgccacagtcaaatgtatcctccctggttggctttgatcgctttcgaggcaggcccatccctcatgggtcaagctggtttttccttgtcagcttctgaagcctccccgagaggggggacccacagtgtggtgttaccactttt

SEQ ID NO: 109725 - DNA, 139 bp, Homo sapiens
aatgagtgcttagagcatgctatggcgcagttaggaattcttagccaacccctctgtgcattgtctttccgctacctcgtctgacaacgcatgccaagtcagtcattcccttcaacaaatattctgaagcacttcagtt

SEQ ID NO: 109726 - DNA, 810 bp, Homo sapiens
taccaggtcttgcaataatcatagctacctcatttagctcattatattttaatagaatctcatctgtattattttttaaaatatgtattttttaatctttgaagaatagattactcatctcaactggcctctattacattttataatgcaaggattttatttacctatttcacatattaatttggttttgttattactatttatggagcacatgaaaggccagagtgcttgaattttcttatatccctaagctgtactaccatctgtactacccatctatgtattttctattaatgactattagaaactttgggtcaaaaaacagtgtaagccaggcatggtggcacatgcctgtaatcccaccctgctcgggagtctgaggcaggaggatcgcttgacccaggagttcgagtccatcctgggcaacatagcaagacccccatctctaataataacggtagatagaagcataggctctgaaatgaaacagcctttgttttttcatctgtgaaatggaaattaaaaataatggtacctacttcatagggtgcctgtgagaattaaatcataatatacaaaaaaaagtagtactcagtatgtagtatacatttaatgtatgttttgacatgcctttattatcattatttgtcattaccattacttaattagaatgtcatggctatgtgaatatgatgtcctgtgtgaatcattagttagcccttccaactctgtctttgactttttttttcttttcactagagcctatgtgcttctcttacctgcaaacttataatagccgtgttttagacc

SEQ ID NO: 109727 - DNA, 280 bp, Homo sapiens
ggcgaggcagtctcctaatggagcgaactagagggcatatatctttgaatgctgatatctttaaaatacaaatgtgtgttttaaaaaaaaaaaagtccccgcccagctttaaaataacagggaaaaatgtttttgccaaaagttaagggacatctacagtgtgacttcaaatgttaaaaaagcaatgtgtttagaaaataattggaaggaaatacaccaaaatagtatatcaaaatacaaataccagttgcttctggttgggttgaggcatgcagctttt

SEQ ID NO: 109728 - DNA, 904 bp, Homo sapiens
tctatccataaagatgaagacattctttcgcagggatttaatattggggctgcatgcctggcccctgagaaagcccaagcttcctcctccttttgaatcgaacccagtgcagctttatgcgctccagacgagcctgcattccccctaatgcccctggaattgcttactcacaccaaaatccgctgcctcaggcgtttccagccagaggtaagccttcttttcatgggcaatcaggcagtagcctggagcacagaggggaaggggggcacctgcatgcccggctgggtctctgtagacagtggatcatgcgaggcctcccctctccttgaccctgtgtgatgagccctgggaggaggcacccaggccagggaggagctgcgtagtgacagaaagggcatctacatctctaccacgtaagtggggaaactgaggctgggcctagcaccagatcactcatgttgaaacctaggtttgaactgggtctctgaatcccatccagagctcactgccttaaggctgaggtgcctgtgagtgtctgaggacccttactatgagacagtgttatcgctgacttacagtctgggtaaagaaggtgaatgcagtcagaggagtagattcaggtgtcagatatttgcataaaataccaattgctcctcatgttggggaggtaattcacaagcttgaatctctaaaaggctgcatctggtggagggcggggctatgtgtctgtgcacgtctggtctttggagttcttattcagcaaatattgattgcaagcccaccatgtgccaggcatcatgcctggggcttgggatccagagatgaagagacagtcaaccaagtccatcaggctctgccaacccctgtagtgtgagtggtggttggagcacgtgttataccccca

SEQ ID NO: 109729 - DNA, 430 bp, Homo sapiens
gatccacaatctagacatggaacctactgctctttgacaggtgccatctcagtggcatcactggaaagtccagattgcctgacacactggtaaccaatgactaggggtcaggtctcaacagatgtctgggcttaagggagttaagtctatgctgaaagatggaaagggagaagaggacataaaaacaaatttgtttttctataccacaaggcttttgtgccaaggtggccatgtgtgtcaaagtcagggaatccctcctcctgggagccaagagagaaatcacaaacaaggagtctggcctaaatacagccttctcttcctcttcctctaatgcaggaagagggatcaggtggcaaggtgtcaggctgaattgcaaaggtcaagtggaaatgatgtgactggctggggctgagaaaacaggcctaaggca

SEQ ID NO: 109730 - DNA, 179 bp, Homo sapiens
atgaagggatcttgcctctcttatccactgctgtaagcccaatcctcagtttaatgtatttcataaacacctgtggacttcatagacccacagtgttaaaacactgccaaaccctgcaggttaaactctgtattgcttctactggaatatttgcatttagagcaataaaataaaaatgt

SEQ ID NO: 109731 - DNA, 372 bp, Homo sapiens
gcctgacgcccctcatttgtcccagcgtcactgtggctgtatctgtgcctcagttctcaccaggacagcctgtacccaccagggacaaagaattgtggctgaaatctctctgctctggtcccagggaacccatggctttggcagtcccagctggccctcagcttgcctgagcagaaaaatgattttcaaatgaccacagattttctctacataaattcctgttcaatagggctcctctgaaatacttaggcattttctgagaaactgctttggcccacaggtaaaattgttctgaaacgcccaacatcacctttccttcatcagctgaaaatactctgacttctgcactgacacaggaaaacacccacttcc

SEQ ID NO: 109732 - DNA, 705 bp, Homo sapiens
ctgaatagtaattaaacaagatactccttgtaaagcacttagaagagtgctgagtactgaataaatgttagctataaataataaaagcagataaaaaactttaaatcaggaccctgattagtgtcatcttctcacttttcagaatcttcccctatttagtaggctcacgccaccctgtttcctataaagtctagagaaaatcaacctaatcatcaatttcacagtaagatgaaaaattcaggctccacatatactaattctttactcttataggctccctctaggagggaaaaatgtttcctttgaagggcaatgtttcaaaaaaaattactctagtaatgtaattcaaatgctaaagcaactaagaagggaagttattgcagactggggctaggtgtggttgatgggtgccttctctcaagagtcctggccaggcctggtgactcacacctgtaatcccagcactgggtgggtaaggcagaaggactgctggagcccagaagtttgagaccagcctgggcaacaaagtgaaatcccagtctctacaaaatatcaaaaaattagctgggcattgtggcatgtggctgtagtcccagctactgagaacgctgaggtgggtcacttgagcccaggaggtcaaggctgcatgattctcctgtctcagcctcctgagtagctgggactacagctgcacatgaccatgct

SEQ ID NO: 109733 - DNA, 197 bp, Homo sapiens
cccggctgggccgtggtggtgctgttctaacgcttgcagttgtcttgcagccttttgctcctgtgaggaaagggttgtggcctggccccgcccagggctcgggttaggatgagcccaagctcaacccaagctctcccttaccctggtggcagcccctgctggtagtggcattccctataagagaagcccatgccggc

SEQ ID NO: 109734 - DNA, 254 bp, Homo sapiens
gcggccgctactactactactaggttagcggcccgtcgagtaaaatttcatatatttaagtaacccatgtgtaagatttttcattgcaatcctgcacgtagtggcaaataacacacacacatgaaaaaacaaaacaaaacaaaacaaaaaaactaaaggatcatcaataagttactggttaaataaattcttacaatacatttaatgaatgactatgcagctccaaaacaacaacaacaaaaaaaaacagtgag

SEQ ID NO: 109735 - DNA, 407 bp, Homo sapiens
cagtttccgattgtcaccttcatttgtgtccacacaagtccaatatgtgagaaggtagcaatgtcagcttgagttaaaggcttgtcatttgtaaacagtactcatcagctgaagccttcttccatgacagctaagttgtattcccagagctgaaaatgtgcacctttggggctgcactgtcgccatcttaatgttcttcataaatgaacgccacactttgatgtaatgtaattgctgctcaatagtaaatgcaaagaaatggaagtactctttgctgtgtaggaggttaaaccctcttaggtttacccaaggtcacaccagtattgtaaaatctgggtgagattccccgcccccgcccccgacagtgagcctctcagcaggagccgccctaaagagccagatgcccc

SEQ ID NO: 109736 - DNA, 311 bp, Homo sapiens
aaagagtgtcataccagcatggacttgaacccaggggtcctgatcccagccccatgtcctcctcactccctcactggtgtccaacacatcagcaggggtgggaggcacccagaaccccaacccagatccctcacacctctctcgcttaaaatgaacaatgtcaaaaaaatagcatctctacagttcagcactgagctgagcccaagtctccatgatggtccatcaactggaagggatacagtattgagcgccccctgtaggtgacatcacgtgatgggattcctcattccaatagaaaataccattaaagg

SEQ ID NO: 109737 - DNA, 395 bp, Homo sapiens
ataattctgacccagggcttctagctagtggggggcagagccaaaccagatcgcaggccctttgtctccaaattctgtgctgttccatagagagcccagcttccagaatataagctccacgagggtagagactttttcttcttcacagctgtatggccaatcgccagaacacacagcaagcactcaataaatagttaatgaataaaggaatgaagtcaagctgccatggtttggctgtgtgaccttggaagggcttctcatcctctctaagcctcagtttccttatatggtgaatggaaggtgacaataatacccattccctgggttgaggtaaggattaaaccagaccattcatttaaagcacttgggatggactggaacataatgagcaacca

SEQ ID NO: 109738 - DNA, 643 bp, Homo sapiens
gattggggtggggggagattgagtgaggaatgaaataaaagatcaagtttggctctgagccagtctcttctctgctcctggaaaactcattacaacacaatactagtgtagttccataaaaccatcttcactgagctcagctgacatcagttgacacaggttaagtgcagagtacatgctaggggcagctgactatgccaggggaaaagaaaagaaatacacctaaaatctgaattcagaccaggcacagtggctcacacctgtaatccgagcactttgggaggccaaggtgggcagatcatttgaggtcaggagtttgagaccagcctgtctctaccaaatgagaccagcctgtctctatggtggaacgctgtctctaccaaaaagtacaaaaattagcctggcatgctggtgcacacctgtagtcccagctactcaggaggctgaggtaggaggatcccttgagcctgggagatggaggttgcagtgagctgagatctcaacactgcactccagtgagactccatctcaaaacaaagatagagactccatctcaaaaacaaaaaacaaaaaacctgagctctatctactctcaagtcatttgtggtccagatggggagacagaagtacacagtaaaagcta

SEQ ID NO: 109739 - DNA, 240 bp, Homo sapiens
gagtgacaggtgagcagtcagtgaggtgctggaggagggtggatgtggggggtgtgaaggtttaggagtagaaaaaactcacactcggggctctgggttgctgggtgctttctttgcagccctggtttgtgaagtgatttatgggccatacatcaccttcctggttggctttgttgacaccttgtcacattcttgcttgggcttgaggaattcattgttcttgtttgaactgataagaac

SEQ ID NO: 109740 - DNA, 297 bp, Homo sapiens
tccttaaagattttatcacctccaccagaaaaagttggaggaggaaccaccttgaagaacccaacccagggaaatacttcccaccatggttacagcaggaatccctaactcatgattttaaaaactgaaataatttcaaaatttacactgaagacaatactactgatttcttgttaactagtagtatcatatttaataagtttccttcatttcctagtctaggaataatcccatgggggtttcttctttaatttagtaatgtattgattttctgattctgaattctccttgttttat

SEQ ID NO: 109741 - DNA, 468 bp, Homo sapiens
aaatccaaaacactaacactaccaaatactggcaagaatgtggcactgtcactcattgctggtgaatgaatgagaaacacactcaactgatttgaaacaccacttttattacaaatgtatccaggcatttagtttataataaaggtggcatttcatattggtgggaaaaggatatattatacaaaaaattacggtgttgggatatctaggtaaacatgtaggacaaacagctgaatctgctcttcacatcttacaccatgataaattccaaatgggtcaaatattcaaatgtagaaaatgaaaccatagaagtatttttttaaaagaagaaagttagcttataatctcagaatagggaaggccttcccaactattaaaacctaaaatcttaaaaaagggaaaaaaaaaaagacgataaagtttaacaccatcaaaaatgactttaagtagtcaaaagacaaaaaactg

SEQ ID NO: 109742 - DNA, 368 bp, Homo sapiens
agccggtcgcatggatgtgttaacgcccagcgtctttgggagacacaagtgtttggtggaggcgcatagggtcactgccagctccttcctgcagatcccaccgccagccacaaaacacaaaaacaaaacacccaaacaaatccagaagagcagctgcctctcctgaaatctttcccaacaggtgagtgcctcaaaggtgtcccccactgctgactggaactgctaggtgaacatgtggaagaaagttgtcctcctaaaagagcctgaaacacaattttgttcccctaatgactaaaaaaagaaacaactttaaacttcacaacacagcttattttctcctcgtctgcgacccgagcggggtggatgac

SEQ ID NO: 109743 - DNA, 803 bp, Homo sapiens
agctattcgccgtagccttcaacctggtcaagtcttacatgagtgaagagacacgcaggaaggtggtgattctcggagacaactggaagcaggagctgacaaaattcatcagccccgaccagctgcccgtggagtttggggggaccatgactgaccccgatggcaaccccaagtgcctgaccaagatcaactacgggggtgaggtgcccaagagctactacctgtgcaagcaggtgaggctgcagtatgagcacacgaggtccgtgggccgcggctcctccctgcaggtggagaacgagatcctgttcccgggctgtgtgctcagatgtcctgaggttttacaacacctacagcctggttcattctaaacgcatcagctacaccgtggaggtactgctcccagaccaaaccttcatggagaagatggagaaattctaggtgaacctcatggtccccacaccctcctctttgatctctgaatccacaatgagttcacagccttccctggccagaccctgttcaacctctcaggaacagggattctacaacagcaggtcacagcctatgcatcacagctggcccactcctcaggaacggctgggacagtgtcctagtggtggcccgatggtcacagcaaagcaacacagacactccatccccactatgacctgctgtgacctcaagctcagcaaaaaccccaggcttttttctatcaaccaataccaagaaataagttactcttctaaaatatagtattaggccaggcatggtggctcatacctgtaatcccagcactttgggaa

SEQ ID NO: 109744 - DNA, 227 bp, Homo sapiens
cccttcttcctgcctcacaatccctcttccctgaggaaaataattacaacatcagtggtcttgttacttctcattctatagtgtttatggcttattacgatcacttcttccctctggttttagcaatgtgatcaggcgcctataatttctagtacttcatcttattctccttcccctcttgatggagacatgctgtagaattaaagcaaaattatgctgtcccctca

SEQ ID NO: 109745 - DNA, 452 bp, Homo sapiens
aaacccctagtgcaagagcacactggaagcaatagaaccaagattgagctcagatctctctgcctccaaaatgtatgcctttaaccatgacaccactttgcttattagtcaaatggccttgagccaggtacttcctctctgttcttcaatgtttctaccataaaatgaagagtcgaactccatgatccctgaagtctcttccagaaatgatcccagctcagaagctaaaaagaaaaggactctgaacaagccaaaggcttcatcctgtgtgtccagcagtgccagctgtgcccatgattgacggaggccttggaaccaggcgcctagtgtccagtccggtgaagcgctggaaggcgagagggggaagggctggaaggcgggaaggggagagatatctcccccgccactggtacccacaccccccctctactggcccgtggggcgtcatgagg

SEQ ID NO: 109746 - DNA, 599 bp, Homo sapiens
atgtttttttaacctttacagtgtttctcaaactttaatgagcatttgaatttcctggggatctttttaaaaggacattctgatgcagaaggaagaggacctgaagtgctgacagctggtccaagagcacactttgagtagtgagactccggaatactgagcagcgagcaccagagcagcagttctcatcaaaggagggcatcagaacaaacacgcggtcctcgcctcctgctccctttctcaagacagagacattctgatccagtaggtgtagggtgggtcctaacacaggtgtttcgaaacagtctcaaatggtttcatgcgcccatccccttgtaaaaactggttgttcctgaatccaataataatacctatgttaaccaagtagtcggcgtgtgccagatgacttaaacgcacctttccaatcattcctcacaacagtcttgtggaggaggttctgtgaggagtctcattctacagacgaggaaactgggaggtgaaggaaactgtcaagccacaaagcctggaccctcagtcacgatgctaaacagcttcctttgtcaagcagaagaaggaagcattggggtccaaggacctgg

SEQ ID NO: 109747 - DNA, 491 bp, Homo sapiens
gggggtggtgtggtcggcagtgtgacagtggcgcgtgtgctgggggcggtgtggtcggcagtgtgacagtggcgcgtgtgctgggggcggtgtggtcggcagtgtgacagtggcgcgtgtgctgggggcggtgtggtcggcagtgtgacagtggcgcgtgtgctgggggcggtgtgatgggacacctgctgtctgagacggccctggcccccgtcccagcgctgaccatgcacgtgagcggcaggcggcccctcaccgagaagagaggataagccgtggcacattcccacctgcgccacgtgaagcggcgccccaaggccaggacgtggtggccgggacacacgggtgcacggcaggcctcacactcccaggtggggccgcagggtccctaagtcatgggtggggctgctgctacggaggctgctgcaaggacgagaaggggacggagggatggaggctcggctgcgtccgctcacctatttctggggaag

SEQ ID NO: 109748 - DNA, 243 bp, Homo sapiens
ggaggaatttgtttgcatttcttttgccacttaaaattagctgtggtctgctcagccaggggacaatggagcttcaggaaggtctgaggcaacctcctccctggttctgtcaatagaaacccaatgttaaggcaattcctaaacagagatgcacctagcaacttgctgtatgtgttcattctttattgctttcagcttcagggggtgtaacaagtataaatgtttggtttccttatgaggaag

SEQ ID NO: 109749 - DNA, 1115 bp, Homo sapiens
tttttagctacaataaaagtatttccttagaaataatatatgttttagtaagcaatgtaatactctagaaattatctcaaaaagatgacaagaaataaaacaaacaaaaaaaaaaaactttttgggccccccgggcccccgaaaaagttttttaacccttccgtttgggcgcgcggcggggcccgcagatttggtgtttaggttgaaccgtgtggtctcattcgcggtgtgttttccctataggagagaatctcggggcgccaatgagcactatggtgtgctgtgtgggttttctctctccacccaatattaaataaaaacgccgccggggcggggccacaccggggctgctgttccttgtggacaccaaactctccgaaaatgtgagggcctccgagggagggaactacatatcaagggggtactctcttatctaccacacgagggagagctctcctaggagggagagagcgctcgcgacatatattctaatatatttatagcgcccccgccccgctggtgggataatgaacatacatgaacataaacagaacaacacaaccaaaccaacaagtaacaacaaacagaccaccaacacgacaaacaagcaagaacaaccaaaccaacgacaaccagcaagagacagcaaaacatacactaatactaacggcggaacgacagcacagcagtgccgatccacgagctcacgaacatcgagacacctgcacgaagacgaactagaccaagcaacaagcaacgcaacgcatcctaccactcacgctagatagctcacacggcaacgcaagtatcaagttctaagccctactaaactaaatgtcacgatatagcaatatctatatgcatacgagctgcacagcacataacactacttgaattattattgtaagacagagctagctatagtaactcacatagatgcaacaagtagactgtatattctaagatcttgtcgaacttctcgacacgctcatgtaagcccatttctcataagaactactcacatcgtgctctcatctcactaacatccaccaacacaacccacaaccgacatcaatctatatagcacatactttcatttctgcacccgtctgtcc

SEQ ID NO: 109750 - DNA, 376 bp, Homo sapiens
tatcttctagtagaaaagacgaaaagagatataatttacaaaatatctggtacatagcaggttaaaatcctaaaaggaatatgaaaatatttgtttctacattatatgacagttgtatgaattaatagaattttaaatatttgatttgagggacattttatacaataccttctttaatatgattttggccaagaatcccctttccaaatactttgggaatagggagactttttgtgttgcattgtaagactttataataggccaggtgcagtggctcacacctgtaatcccagcacttcggaaggctgaggtgagaggatcactggagcccaggagcttaagaccagcctgagtaacatgtcaggacttcatcttt

SEQ ID NO: 109751 - DNA, 343 bp, Homo sapiens
tgaggatccctgttgctaggtggagtgcaattgttctgaaatgttttcaaagcagttacatcatttaaaagaaatttcatgaatgctaaatatgtacaacagatgagagcaagcagtgactgcaatccaggtgaggggcgcagagccagttcttagggtgactctaccagacccaactaaagctgtttgttgaagggcaagctcctagctttatgtttgctgcctttcaaaagtaaacacaatagcataatggatgttaactctttttcaaccttattttgtcctttcttatgaaggattataaaacagccaggcacagtggctcacacctgtaatcccagca

SEQ ID NO: 109752 - DNA, 563 bp, Homo sapiens
cagctatgacatgtttaggattttaatgcgactccctataggggaatttggcctcgaaggccaagattcgggcagaaggctaagcatcttacacatatttctcattaaatccacaggtgaccattgtgaggtagatattttgttctaattttccagatgaggaagctgagaccctaaaaggctgaccggttccctgatgtgttacctgcttctgctactgatccaaactgcagaacttctcattcatccccaaggcctccaggcagtatccaatggggaatcagctctaaaaggaaccagaccaacgttttccagccccttcattctgtagcttccctctgtgtgaggaaaggatagaaatgttcaggacatcatcatacaggctcctcatctacaaagttccagtagcagtgacgcctacacggaagacttggaactgcaaacaggctggggtcacctcagtgacatctgacgctgtccaaccagaagttcgatttttgttctgggggtgaaggaggaaacagactgtactaaaggactaaaataatttcttgtctatacta

SEQ ID NO: 109753 - DNA, 1182 bp, Homo sapiens
ggactcttcatgtgcttttcttaactgattagagttaacacctcagctaaagtgtatagaacatacatggggcttcatcaggcttcagaatcagtttcactagatgtgctatgtaggaggccacggaaaaattactgtagtagtaaaagttatcagttctgatgtaaacaatcattttgtcccatattataaataaattggcctgaaaatatcttttcatatgtgaggaataagtatatgatgcctttctcctttaaagtatgaactgctaaaagacagggataacgtgtattctgtattccagcagccacagtgtgtttctggtctttgtaccaggtgctcaggaagtgttttcactggcttgggttgactacttgccatctgctctctgagcattcatttctgaatgaaaggggagaaagtgaaaggagaggtgggaagaaagaggaagctgcagaaatacgaggaaacagctggaggagggaggtgaagttgaggaggtaaggtcagtaaaacaaaaagctagcagagggcagggtcaggcccttggggtagagggctaattaacttctgtcagctagttgaatagagccttgtgtgctttgttagagaccaaaggtacttcaaaggaaaaaaatctagattcttccctgtgtaccttaataattgttcatcaggtcaaaatctatcctgtcctctaggaattctggtcttccctcaggcctagcagagagctttctgccactactcaggcaaccaagggtgaagtgcttcaagtagtatttgtggacagcagcaggctgaccggttccctgatgtgttacctgcttctgctactgatccaaactgcagaacttctcattcatccccaaggcctccaggcagtatccaatggggaatcagctctaaaaggaaccagaccaacgttttccagccccttcattctgtagcttccctctgtgtgaggaaaggatagaaatgttcaggacatcatcatacaggctcctcatctacaaagttccagtagcagtgacgcctacacggaagacttggaactgcaaacaggctggggtcacctcagtgacatctgacgctgtccaaccagaagttcgatttttgttctgggggtgaaggaggaaacagactgtactaaaggactaaaataatttcttgtctatacta

SEQ ID NO: 109754 - DNA, 2066 bp, Homo sapiens
tcaaggtcaagaaacatcctttaaaaagttaattcccttttctggagcctaagccagatcttatctaggccttgtgttgccatctgttagcattgatttctggaatggagcagctttctcaaagtttggtcttgctagtcatgaggtcatgtcagtgtcttaggtcactgctgctcaccttccttacccagggagtatactgcataggtttctgaacacctgttttcattattcactgttcctctcactgccaagaatggagggaccctcagttgaagatcaaattgactctgaagaaaaactggagatgtttctcttggagtttggatagagtattcacttgataacatgtttttcccctgccttgctcttcacaagaacatctggccaggcattaacaattagtaaatttttttgcatatgaacagtatttttctggtcatgtagatgggtgcacatgacactaaacagcattgtttagtgttatccctcttaactggtgggttgtatttggggtggaggctgtagccgaggagaagacattcacctctgtactcgagaaactttgtgtaggaatttagtttatttttttattttttttaattttttattttttactacttttactgttagcacaatgctataattgagctaatctttgtagtttggtgcaggaccaccaagtttgtgtgacccattacctactttttccatgctcagcccattacccctgtcctggggcatctgagggcagtaaggaacaggtgtccaaaggaggaatgttggtgcctatgagtatgttttccagttgtattgaatttcttacttggtgtatttttgacttgtcttagtttctttccttgtggtctatgctattttacttgcgatttgttggatattctccctgtcattaaagagttgtaaaatggaagttagtttctctatgcaaatgctttaatggatgaagctgataggtttagcattgatttttgctggtgtccttcaacaagcatgaaggtgataaatgtgtttccatggctttagactcatttttgaagtcttggattgtgtgaacattcttagaaacaataaaatgttttaattaaaagccctcgactaccagctgaattcagtgtctactaggaaaatgggtagatttgttacattgtccctttgctctctatgactttgttccagttgtcaaggaacttaaatgggtattcaggaaaaagaattcttgtttccctttcctcaccttgccagttaaataactcctggtgacacttcaggtggtagaattgaaacacaaacctgacttctgaccacatgggtcaaaggcaaaaggcaaatggcttcaaagcccttagtgtgcttatccagttcaggcagtgaggagataacctctgctttcctccctgaggagtttggagtatttaaggggggatggggggggtgtcactttgaaaatatgttgctttttctcctgattgtattgaggctgatatggaagggttatttctttctggccaatactttttggtatttctaaatattgcaatcttgatttttactattaaatttgttaattgtcagttctggcttttttgcataaagagttggtccattaacttgccaatttgaagcttctaactagatattccctactgaaagttttggatttgtttttagtttgtggagcagtcttagctggggacaggtaattgacaacggcagagatactttcttttcctaggattctaagtctgtaatccacatcctcaatgtattcacaggactttaaaattctctccaaatgaggaaggaaatatcctgttgctttctaatgtttactaaaagttgtgtttagaacaacagattttaataggcatcttcctttgttatgtgtcattagccctttgcccgtttaccttagggctctttgaaggagaaatggatgggagaaaacctgtcacttggcgaaagtaaaagggataattaactggctcagagcttatgacggggaatcagggttcgattccggagagagagaatatgagcgaagaaat

SEQ ID NO: 109755 - DNA, 611 bp, Homo sapiens
ttccttcagcttctcttcctctgtctcccccccatatccgtgcgccgagctgataaaggcgccattttggaggggccgcgggagacgtggtgccgctgcgggctcgctctgccgtgcgctaggcttggtgggaaggcctgttctcgagtccgcgcttttcgtcaccgccatgtcgggaggtggtgtgattcgtggccccgcagggaacaacgattgccgcatctacgtgggtaacttacctccagacatccgaaccaaggacattgaggacgtgttctacaaatacggcgctatccgcgacatcgacctcaagaatcgccgcgggggaccgcccttcgccttcgttgagttcgaggacccgcggtgaggcggcatggggcttgcagccttgaggaaataggtccgagtagttggggaaggctccaaggccttaacatagagaacggggaagcgggggctcttagagaggttggggcgagactgtatcgcccatgcaggagtcgagtaaggagctgagttgatgtggcttctctggcgcctcgccttggacgtccccggagcccattcgcaggctggagcgggaaactgaggcgctgagggctggtgtagtg

SEQ ID NO: 109756 - DNA, 1092 bp, Homo sapiens
ggactcttcatgtgcttttcttaactgattagagttaacacctcagctaaagtgtatagaacatacatggggcttcatcaggcttcagaatcagtttcactagatgtgctatgtaggaggccacggaaaaattactgtagtagtaaaagttatcagttctgatgtaaacaatcattttgtcccatattataaataaattggcctgaaaatatcttttcatatgtgaggaataagtatatgatgcctttctcctttaaagtatgaactgctaaaagacagggataacgtgtattctgtattccagcagccacagtgtgtttctggtctttgtaccaggtgctcaggaagtgttttcactggcttgggttgactacttgccatctgctctctgagcattcatttctgaatgaaaggggagaaagtgaaaggagaggtgggaagaaagaggaagctgcagaaatacgaggaaacagctggaggagggaggtgaagttgaggaggtaaggtcagtaaaacaaaaagctagcagagggcagggtcaggcccttggggtagagggctaattaacttctgtcagctagttgaatagagccttgtgtgctttgttagagaccaaaggtacttcaaaggaaaaaaatctagattcttccctgtgtaccttaataattgttcatcaggtcaaaatctatcctgtcctctaggaattctggtcttccctcaggcctagcagagagctttctgccactactcaggcaaccaagggtgaagtgcttcaagtagtatttgtggacagcagcaggtaagcttgatgtgttattcacagcttaaagagtagatgctgagtacagctgttgtccatgtgtagagcttttaataaccagcgcagcaggccccttcacctgcttttatgcctggaccagatgactgaatgtagaactttaggcacttttttttttttttgagacggagtctcggtttgttgcccaggctggagtgcagtggcgcaatctcggctcactgcaagctctgccccccgggttcacgccattctcttgcctcagcctcccaagtagctgggactacagactccca

SEQ ID NO: 109757 - DNA, 495 bp, Homo sapiens
atgacataataactcaatataatactcaagtatgactcatgtacatgtatactatagtgtgctcatttcatatattagcgtctttgggtctctaacatggtagtcggcacctgtatgtgttaccatgcttctgctactgtttcaatcctgcatagccttgtacattcttccctcaatggactaccagtggagctatcctacttgggcgaatcagtctcttaacacgaacgcatactcatccttttccagccccttccttctagcttccctctgtgtgaggaaaggatagaaatgttcaggacatcatcatacaggctcctcatctacaaagttccagtagcagtgacgcctacacggaagacttggaactgcaaacaggctggggtcacctcagtgacatctgacgctgtccaaccagaagttcgatttttgttctgggggtgaaggaggaaacagactgtactaaaggactaaaataatttcttgtctatacta

SEQ ID NO: 109758 - DNA, 279 bp, Homo sapiens
  misc_feature (35)..(35): n is a, c, g, or t
tccgttagtctcatctctctgcatccaggagaagnaaagtactttagcttccctctgtgtgaggaaaggatagaaatgttcaggacatcatcatacaggctcctcatctacaaagttccagtagcagtgacgcctacacggaagacttggaactgcaaacaggctggggtcacctcagtgacatctgacgctgtccaaccagaagttcgatttttgttctgggggtgaaggaggaaacagactgtactaaaggactaaaataatttcttgtctatacta

SEQ ID NO: 109759 - DNA, 425 bp, Homo sapiens
ttccttcagcttctcttcctctgtctcccccccatatccgtgcgccgagctgataaaggcgccattttggaggggccgcgggagacgtggtgccgctgcgggctcgctctgccgtgcgctaggcttggtgggaaggcctgttctcgagtccgcgcttttcgtcaccgccatgtcgggaggtggtgtgattcgtggccccgcagggaacaacgattgccgcatctacgtgggtaacttacctccagacatccgaaccaaggacattgaggtaagttacccatgtcgggaggtggtgtgattcgtggccccgcagggaacaacgattgccgcatctacgtgggtaacttacctccagacatccgaaccaaggacattgaggacgtgttctacaaatacggcacatcgtggccccgcagggaacaacc

SEQ ID NO: 109760 - DNA, 6169 bp, Homo sapiens
ttccttcagcttctcttcctctgtctcccccccatatccgtgcgccgagctgataaaggcgccattttggaggggccgcgggagacgtggtgccgctgcgggctcgctctgccgtgcgctaggcttggtgggaaggcctgttctcgagtccgcgcttttcgtcaccgccatgtcgggaggtggtgtgattcgtggccccgcagggaacaacgattgccgcatctacgtgggtaacttacctccagacatccgaaccaaggacattgaggacgtgttctacaaatacggcgctatccgcgacatcgacctcaagaatcgccgcgggggaccgcccttcgccttcgttgagttcgaggacccgcgagacgcggaagacgcggtgtatggtcgcgacggctatgattacgatgggtaccgtctgcgggtggagtttcctcgaagcggccgtggaacaggccgaggcggcggcgggggtggaggtggcggagctccccgaggtcgctatggccccccatccaggcggtctgaaaacagagtggttgtctctggactgcctccaagtggaagttggcaggatttaaaggatcacatgcgtgaagcaggtgatgtatgttatgctgatgtttaccgagatggcactggtgtcgtggagtttgtacggaaagaagatatgacctatgcagttcgaaaactggataacactaagtttagatctcatgagggagaaactgcctacatccgggttaaagttgatgggcccagaagtccaagttatggaagatctcgatctcgaagccgtagtcgtagcagaagccgtagcagaagcaacagcaggagtcgcagttactccccaaggagaagcagaggatcaccacgctattctccccgtcatagcagatctcgctctcgtacataagatgattggtgacactttttgtagaacccatgttgtatacagttttcctttattcagtacaatcttttcattttttaattcaaactgttttgttcagaatgggctaaagtgttgaattgcattcttgtaatatccccttgctcctaacatctacattcccttcgtgtctttgataaattgtattttaagtgatgtcatagacaggattgtttaaatttagttaactccatactcttcagactgtgatattgtgtaaatgtctatctgccctggtttgtgtgaactgggatgttgggggtgtttgtggttatcttacctggggaagttcttatgtttatcttgcttttcatgtgtctttctgtagacatatctgaagagatggattaagaatgctttggattaaggattgtggagcacatttcaatcattttaggattgtcaaaaggaggattgaggaggatcagatcaataatggaggcaatggtatgactccaagtgctattgtcacagatgaaattggcagtattgaccttatactaaaaggcaggggttaaaaatgattatatacattttccttaaaacacttgcaaacattttattcagttgtctttagctacaattgctttgctttttaaaccttggcaattgtggcaaaattatattgcccattttgtagcaacttattttgctcccttccccccatttttgttttaatagggactaatgtgggaagaactggctaatttgtcacagtgcttagttacaactgttaatgtgtgacctgctgttggtgtacatgtgggtacagggtgtttttaaatccaacaagatagagtataatatcaatactgctaaatctgcatgtcctctgtgtgactgatagagcgttgctatttcatttttttaagacaaaatgaaagcaaaatatagagttccaatgtattggtgtagataatctagttgggaatacttttaagtctcaccttcccctttaaactaatattcataattggttcatatgtttaaaagactttaatttacaaattaaattgcaaatgggagcattagatttagttttagacttaggtgggtagcaatgccagtaaacttaaattacgtaacttcttgcaaccacgaaacctgtaatacgctgtacagtaacaagtgttggcattatcagttgaactgtaaatacaaaatgcttcttccaattagtctctatgatgattaagtttctaaaatttatctgaacaccattcagaaacttgttttggggaatttgatagttattgatgtgcatctgttaaactgatgacagacataactcatcattccccagaaaccttttttgattacagtatctaacattttgcctcctcttttttggttttgctggttataaaggtttggattggagagggctcactggatcccaatccttggagctggatcattggattcaaatcataatgtggataggatagggaggatgaattaccaggattcatggagcgggatcagattaccaggaacataggagtggattcctgccccaaccaaaccgcattcgtgtggatttttttattcaacttaattggctattccaaagattttttttttcctatttttgacgattggagcccttaagatgcacgatggaattgtgttttgcgttttttggtaaaaggagcaaagcgaggacctggagataaacgctggagcaatctccttggaaggattcagcacgagtagatggtaaacatttaaaggggaaagggggggtttgtttaaaatagtaaatcagtaagtcacttctaaatttaaagaaaacaaaattggagttgaagaataagtaggtttccaattggctattgccgttttctttgaaaaaataaacattttttaaaaaactatgcatggttgtcctttttcctcttcatgtaagattctaactgggtctatcagttaatctttaaattgttaagtaagataagattttgactcttgtgttaatgtgttagcaaattaaaagttcttaaaaggcaatctaatggtattagccatcttttattgttaattgtaaaagtcttcaggggaaagcaaaaggggagaataaggcatttgtgtatgtaacttggtaaatgacggtgggggatggatctagcatctgaaagataagcttctctactttgttataaagtggttaaaaaactatagatgctgcttattttctggtggtcatagacaacataggcttttgtgcaaaattggttgatggctactaatgttcacttggagatagcttttgatattctcaatgaaactcatctcaaaaaaaggtaagtattaaatgttaacatcagcacagatgtattagaactgttttttgtttttgagacagagtctcgctctgttctccagactggagggcagtggtgtgatctaggctcactgcaacctccacccctggatttgagtgattctcgtgcctcagtctcccaagtagctgagactacaagtgtgtgccacccttgcccggctaattttgtatttttagtagagatgtggtttctctgtgttacccaggctggtcccaaaactcctggcctcaagtgatctgcctgccttggcctcccaaagtgttaggattacaggtgtgagccaccatgctcagcctgtagaacttttaacccaagtctcatttcttttttgaaagggaagagtgcacaagattaactgcttctttggatgaatcattgttaataaaaagctgggcatttagaattttgccttataagcccttctccaaccataagattattttgtaccaaaaactttggtgttctctaccaaagcagttaaaaacttttagcctgctacttcttgtatttgtctactgacagccccttggtactatttaggttgggggaggggacctaaaataaatagactttaacatttcccttgggtgctaatcatagttggaagttgaatttaaggtgattatttgggtgacaattaaaaacctaaggaaaaccagaaatcttggtagtggaagaaatgtgtaaggtcaccccaatcggtagattttaatgaacgttgtggaatgttgggaagaggggatgttaagttgaatgcagaatttcactaagtacttagtgtaagtttaaggatgtagctctttttatctaagaattcaatgtaatggccaaaaggcagatttactgtttaaaaatttgaataattttacatgacattcttgaaattctaagaagttttatgtgtagaacattttaaaaattcatcagattattaaagggaaaataaatgattaatgataattttggaaggttaatgtgagctagacttaagtaaactttggttcatttgtgttcattgaatgttttggaaatgaccaaaaaatgtaaatggccttcactcaagtttgagtgtttaaagttgaaagatgtgctctactaaaagttatagtaattctaacctcacattgaaatgagacagtattccttgttatacaggctgaatttgaagattagagaggatctaatgtttacttaggtaaaggggcataggttttgtagttaagatgaccagacagctaaaagctgtgatgggaagtatggactgctcctatttatagtctcagaaaatggacctttaggtctctatccgtattggcaattattagaagaaagttacacccttttgaaactacaaaagctgtcttggaatttccccctcttctccctatttatgtccccttagaatattttagggagcctataattattttctaaccaaggaaaaacttaagtctctttaagaagcaattacttttcataacatcagattgaataacccaccttgctgttcagcccacatcctactggaaacaaaaggtaagaaacccattttctggttcttgattgtttgggtctgaattttgtttttaaaactaagctaagtttaatgttttttaaaatgctgtttggaatatgaatagattccccgtaaaatgatttttcctaagttttatgctttagtaaatattcagtgctcacgtctgtgcatcatagtgcttgcgtttaatatgatttattgtagaatctcaacttttcttggtgtttgttgtctttgaaacattgtcttggtcattagggctggtgttttcacatttctgtggtcaaggtggatttcttatgtgtgcctttttgcttactttgtatatgaattttgtaatttaaattgcaagtaagttatatatatgtatttaccataaatagtattaaaagatgagaaactgttagactgaagttctgttgtaacataaccattatttccatcacagtatgaagactgcaaacgcagaaaacagattacagtctcttatccattttttgaaatccaaaaactacgaaaacaaaagattttctgttgttgagctaattaaatgtgaaccctgaccagaattgctgccttcattttgcacttagtgtgactaaactgtttcctgttgaacttcattattcattgcacagttgccacagactttgctgagggttttatgtaatacagggtatatatgtacctcataaagtgcatacagctctgaatcccagatatgtctgtctccaaagagttcatataagggattgtaggaactgtactagcatacacaggcctaatgcttttgtctgtaactggggtgtcttgactgaaaaacctgttattgtgaatcctttgttgattgaattttaagttcccccatctttttaggctgaagcagccacaagaaaaaaaggtatggcccacatttctttacattctgttgtaatagtggactcaacaattatatcccattgaagcaaatactcaggcatcctagagtgtacaatacaacattcttttgagttattgtttctgtatcagtacttaaaggaacattgaccaattagatcctataggaaaagctgggattggcatgaagtaaagagattatcaggaaacatctgttcattatgtctatcgtgattgtctattgaatgaatagtaatgctgccaaaagtaacttgctttaaacaaaccccaagagattatagtatacttaaaccagtacttattcctgttattgagaccttcacggtgcttcttggtagctttgaaagctaatgcctaacaaccctgagggttcttgtgagcttgtagtgattaaaggaaggattttttaattattat

SEQ ID NO: 109761 - DNA, 6115 bp, Homo sapiens
ttccttcagcttctcttcctctgtctcccccccatatccgtgcgccgagctgataaaggcgccattttggaggggccgcgggagacgtggtgccgctgcgggctcgctctgccgtgcgctaggcttggtgggaaggcctgttctcgagtccgcgcttttcgtcaccgccatgtcgggaggtggtgtgattcgtggccccgcagggaacaacgattgccgcatctacgtgggtaacttacctccagacatccgaaccaaggacattgaggacgtgttctacaaatacggcgctatccgcgacatcgacctcaagaatcgccgcgggggaccgcccttcgccttcgttgagttcgaggacccgcgagacgcggaagacgcggtgtatggtcgcgacggctatgattacgatgggtaccgtctgcgggtggagtttcctcgaagcggccgtggaacaggccgaggcggcggcgggggtggaggtggcggagctccccgaggtcgctatggccccccatccaggcggtctgaaaacagagtggttgtctctggactgcctccaagtggaagttggcaggatttaaaggatcacatgcgtgaagcaggtgatgtatgttatgctgatgtttaccgagatggcactggtgtcgtggagtttgtacggaaagaagatatgacctatgcagttcgaaaactggataacactaagtttagatctcatgagggagaaactgcctacatccgggttaaagttgatgggcccagaagtccaagttatggaagatctcgatctcgaagccgtagtcgtagcagaagccgtagcagaagcaacagcaggagtcgcagttactccccaaggagaagcagaggatcaccacgctattctccccgtcatagcagatctcgctctcgtacataagatgattggtgacactttttgtagaacccatgttgtatacagttttcctttattcagtacaatcttttcattttttaattcaaactgttttgttcagaatgggctaaagtgttgaattgcattcttgtaatatccccttgctcctaacatctacattcccttcgtgtctttgataaattgtattttaagtgatgtcatagacaggattgtttaaatttagttaactccatactcttcagactgtgatattgtgtaaatgtctatctgccctggtttgtgtgaactgggatgttgggggtgtttgtggttatcttacctggggaagttcttatgtttatcttgcttttcatgtgtctttctgtagacatatctgaagagatggattaagaatgctttggattaaggattgtggagcacatttcaatcattttaggattgtcaaaaggaggattgaggaggatcagatcaataatggaggcaatggtatgactccaagtgctattgtcacagatgaaattggcagtattgaccttatactaaaaggcaggggttaaaaatgattatatacattttccttaaaacacttgcaaacattttattcagttgtctttagctacaattgctttgctttttaaaccttggcaattgtggcaaaattatattgcccattttgtagcaacttattttgctcccttccccccatttttgttttaatagggactaatgtgggaagaactggctaatttgtcacagtgcttagttacaactgttaatgtgtgacctgctgttggtgtacatgtgggtacagggtgtttttaaatccaacaagatagagtataatatcaatactgctaaatctgcatgtcctctgtgtgactgatagagcgttgctatttcatttttttaagacaaaatgaaagcaaaatatagagttccaatgtattggtgtagataatctagttgggaatacttttaagtctcaccttcccctttaaactaatattcataattggttcatatgtttaaaagactttaatttacaaattaaattgcaaatgggagcattagatttagttttagacttaggtgggtagcaatgccagtaaacttaaattacgtaacttcttgcaaccacgaaacctgtaatacgctgtacagtaacaagtgttggcattatcagttgaactgtaaatacaaaatgcttcttccaattagtctctatgatgattaagtttctaaaatttatctgaacaccattcagaaacttgttttggggaatttgatagttattgatgtgcatctgttaaactgatgacagacataactcatcattccccagaaaccttttttgattacagtatctaacattttgcctcctcttttttggttttgctggttataaaggtttggattggagagggctcactggatcccaatccttggagctggatcattggattcaaatcataatgtggataggatagggaggatgaattaccaggattcatggagcgggatcagattaccaggaacataggagtggattcctgccccaaccaaaccgcattcgtgtggatttttttattcaacttaattggctattccaaagattttttttttcctatttttgacgattggagcccttaagatgcacgatggaattgtgttttgcgttttttggtaaaaggagcaaagcgaggacctggagataaacgctggagcaatctccttggaaggattcagcacgagtagatggtaaacatttaaaggggaaagggggggtttgtttaaaatagtaaatcagtaagtcacttctaaatttaaagaaaacaaaattggagttgaagaataagtaggtttccaattggctattgccgttttctttgaaaaaataaacattttttaaaaaactatgcatggttgtcctttttcctcttcatgtaagattctaactgggtctatcagttaatctttaaattgttaagtaagataagattttgactcttgtgttaatgtgttagcaaattaaaagttcttaaaaggcaatctaatggtattagccatcttttattgttaattgtaaaagtcttcaggggaaagcaaaaggggagaataaggcatttgtgtatgtaacttggtaaatgacggtgggggatggatctagcatctgaaagataagcttctctactttgttataaagtggttaaaaaactatagatgctgcttattttctggtggtcatagacaacataggcttttgtgcaaaattggttgatggctactaatgttcacttggagatagcttttgatattctcaatgaaactcatctcaaaaaaaggtaagtattaaatgttaacatcagcacagatgtattagaactgttttttgtttttgagacagagtctcgctctgttctccagactggagggcagtggtgtgatctaggctcactgcaacctccacccctggatttgagtgattctcgtgcctcagtctcccaagtagctgagactacaagtgtgtgccacccttgcccggctaattttgtatttttagtagagatgtggtttctctgtgttacccaggctggtcccaaaactcctggcctcaagtgatctgcctgccttggcctcccaaagtgttaggattacaggtgtgagccaccatgctcagcctgtagaacttttaacccaagtctcatttcttttttgaaagggaagagtgcacaagattaactgcttctttggatgaatcattgttaataaaaagctgggcatttagaattttgccttataagcccttctccaaccataagattattttgtaccaaaaactttggtgttctctaccaaagcagttaaaaacttttagcctgctacttcttgtatttgtctactgacagccccttggtactatttaggttgggggaggggacctaaaataaatagactttaacatttcccttgggtgctaatcatagttggaagttgaatttaaggtgattatttgggtgacaattaaaaacctaaggattttaatgaacgttgtggaatgttgggaagaggggatgttaagttgaatgcagaatttcactaagtacttagtgtaagtttaaggatgtagctctttttatctaagaattcaatgtaatggccaaaaggcagatttactgtttaaaaatttgaataattttacatgacattcttgaaattctaagaagttttatgtgtagaacattttaaaaattcatcagattattaaagggaaaataaatgattaatgataattttggaaggttaatgtgagctagacttaagtaaactttggttcatttgtgttcattgaatgttttggaaatgaccaaaaaatgtaaatggccttcactcaagtttgagtgtttaaagttgaaagatgtgctctactaaaagttatagtaattctaacctcacattgaaatgagacagtattccttgttatacaggctgaatttgaagattagagaggatctaatgtttacttaggtaaaggggcataggttttgtagttaagatgaccagacagctaaaagctgtgatgggaagtatggactgctcctatttatagtctcagaaaatggacctttaggtctctatccgtattggcaattattagaagaaagttacacccttttgaaactacaaaagctgtcttggaatttccccctcttctccctatttatgtccccttagaatattttagggagcctataattattttctaaccaaggaaaaacttaagtctctttaagaagcaattacttttcataacatcagattgaataacccaccttgctgttcagcccacatcctactggaaacaaaaggtaagaaacccattttctggttcttgattgtttgggtctgaattttgtttttaaaactaagctaagtttaatgttttttaaaatgctgtttggaatatgaatagattccccgtaaaatgatttttcctaagttttatgctttagtaaatattcagtgctcacgtctgtgcatcatagtgcttgcgtttaatatgatttattgtagaatctcaacttttcttggtgtttgttgtctttgaaacattgtcttggtcattagggctggtgttttcacatttctgtggtcaaggtggatttcttatgtgtgcctttttgcttactttgtatatgaattttgtaatttaaattgcaagtaagttatatatatgtatttaccataaatagtattaaaagatgagaaactgttagactgaagttctgttgtaacataaccattatttccatcacagtatgaagactgcaaacgcagaaaacagattacagtctcttatccattttttgaaatccaaaaactacgaaaacaaaagattttctgttgttgagctaattaaatgtgaaccctgaccagaattgctgccttcattttgcacttagtgtgactaaactgtttcctgttgaacttcattattcattgcacagttgccacagactttgctgagggttttatgtaatacagggtatatatgtacctcataaagtgcatacagctctgaatcccagatatgtctgtctccaaagagttcatataagggattgtaggaactgtactagcatacacaggcctaatgcttttgtctgtaactggggtgtcttgactgaaaaacctgttattgtgaatcctttgttgattgaattttaagttcccccatctttttaggctgaagcagccacaagaaaaaaaggtatggcccacatttctttacattctgttgtaatagtggactcaacaattatatcccattgaagcaaatactcaggcatcctagagtgtacaatacaacattcttttgagttattgtttctgtatcagtacttaaaggaacattgaccaattagatcctataggaaaagctgggattggcatgaagtaaagagattatcaggaaacatctgttcattatgtctatcgtgattgtctattgaatgaatagtaatgctgccaaaagtaacttgctttaaacaaaccccaagagattatagtatacttaaaccagtacttattcctgttattgagaccttcacggtgcttcttggtagctttgaaagctaatgcctaacaaccctgagggttcttgtgagcttgtagtgattaaaggaaggattttttaattattat

SEQ ID NO: 109762 - DNA, 2961 bp, Homo sapiens
ttccttcagcttctcttcctctgtctcccccccatatccgtgcgccgagctgataaaggcgccattttggaggggccgcgggagacgtggtgccgctgcgggctcgctctgccgtgcgctaggcttggtgggaaggcctgttctcgagtccgcgcttttcgtcaccgccatgtcgggaggtggtgtgattcgtggccccgcagggaacaacgattgccgcatctacgtgggtaacttacctccagacatccgaaccaaggacattgaggacgtgttctacaaatacggcgctatccgcgacatcgacctcaagaatcgccgcgggggaccgcccttcgccttcgttgagttcgaggacccgcgagacgcggaagacgcggtgtatggtcgcgacggctatgattacgatgggtaccgtctgcgggtggagtttcctcgaagcggccgtggaacaggccgaggcggcggcgggggtggaggtggcggagctccccgaggtcgctatggccccccatccaggcggtctgaaaacagagtggttgtctctggactgcctccaagtggaagttggcaggatttaaaggatcacatgcgtgaagcaggtgatgtatgttatgctgatgtttaccgagatggcactggtgtcgtggagtttgtacggaaagaagatatgacctatgcagttcgaaaactggataacactaagtttagatctcatgagggagaaactgcctacatccgggttaaagttgatgggcccagaagtccaagttatggaagatctcgatctcgaagccgtagtcgtagcagaagccgtagcagaagcaacagcaggagtcgcagttactccccaaggagaagcagaggatcaccacgctattctccccgtcatagcagatctcgctctcgtacataagatgattggtgacactttttgtagaacccatgttgtatacagttttcctttattcagtacaatcttttcattttttaattcaaactgttttgttcagaatgggctaaagtgttgaattgcattcttgtaatatccccttgctcctaacatctacattcccttcgtgtctttgataaattgtattttaagtgatgtcatagacaggattgtttaaatttagttaactccatactcttcagactgtgatattgtgtaaatgtctatctgccctggtttgtgtgaactgggatgttgggggtgtttgtggttatcttacctggggaagttcttatgtttatcttgcttttcatgtgtctttctgtagacatatctgaagagatggattaagaatgctttggattaaggattgtggagcacatttcaatcattttaggattgtcaaaaggaggattgaggaggatcagatcaataatggaggcaatggtatgactccaagtgctattgtcacagatgaaattggcagtattgaccttatactaaaaggcaggggttaaaaatgattatatacattttccttaaaacacttgcaaacattttattcagttgtctttagctacaattgctttgctttttaaaccttggcaattgtggcaaaattatattgcccattttgtagcaacttattttgctcccttccccccatttttgttttaatagggactaatgtgggaagaactggctaatttgtcacagtgcttagttacaactgttaatgtgtgacctgctgttggtgtacatgtgggtacagggtgtttttaaatccaacaagatagagtataatatcaatactgctaaatctgcatgtcctctgtgtgactgatagagcgttgctatttcatttttttaagacaaaatgaaagcaaaatatagagttccaatgtattggtgtagataatctagttgggaatacttttaagtctcaccttcccctttaaactaatattcataattggttcatatgtttaaaagactttaatttacaaattaaattgcaaatgggagcattagatttagttttagacttaggtgggtagcaatgccagtaaacttaaattacgtaacttcttgcaaccacgaaacctgtaatacgctgtacagtaacaagtgttggcattatcagttgaactgtaaatacaaaatgcttcttccaattagtctctatgatgattaagtttctaaaatttatctgaacaccattcagaaacttgttttggggaatttgatagttattgatgtgcatctgttaaactgatgacagacataactcatcattccccagaaaccttttttgattacagtatctaacattttgcctcctcttttttggttttgctggttataaaggtttggattggagagggctcactggatcccaatccttggagctggatcattggattcaaatcataatgtggataggatagggaggatgaattaccaggattcatggagcgggatcagattaccaggaacataggagtggattcctgccccaaccaaaccgcattcgtgtggatttttttattcaacttaattggctattccaaagattttttttttcctatttttgacgattggagcccttaagatgcacgatggaattgtgttttgcgttttttggtaaaaggagcaaagcgaggacctggagataaacgctggagcaatctccttggaaggattcagcacgagtagatggtaaacatttaaaggggaaagggggggtttgtttaaaatagtaaatcagtaagtcacttctaaatttaaagaaaacaaaattggagttgaagaataagtaggtttccaattggctattgccgttttctttgaaaaaataaacattttttaaaaaactatgcatggttgtcctttttcctcttcatgtaagattctaactgggtctatcagttaatctttaaattgttaagtaagataagattttgactcttgtgttaatgtgttagcaaattaaaagttcttaaaaggca

SEQ ID NO: 109763 - DNA, 6369 bp, Homo sapiens
ttccttcagcttctcttcctctgtctcccccccatatccgtgcgccgagctgataaaggcgccattttggaggggccgcgggagacgtggtgccgctgcgggctcgctctgccgtgcgctaggcttggtgggaaggcctgttctcgagtccgcgcttttcgtcaccgccatgtcgggaggtggtgtgattcgtggccccgcagggaacaacgattgccgcatctacgtgggtaacttacctccagacatccgaaccaaggacattgaggacgtgttctacaaatacggcgctatccgcgacatcgacctcaagaatcgccgcgggggaccgcccttcgccttcgttgagttcgaggacccgcgagacgcggaagacgcggtgtatggtcgcgacggctatgattacgatgggtaccgtctgcgggtggagtttcctcgaagcggccgtggaacaggccgaggcggcggcgggggtggaggtggcggagctccccgaggtcgctatggccccccatccaggcggtctgaaaacagagtggttgtctctggactgcctccaagtggaagttggcaggatttaaaggatcacatgcgtgaagcaggtgatgtatgttatgctgatgtttaccgagatggcactggtgtcgtggagtttgtacggaaagaagatatgacctatgcagttcgaaaactggataacactaagtttagatctcatgaggtaggttatacacgtattcttttctttgaccagaattggatacagtggtcttaacagtggaatttcaaggtaaggattcaggcaaggttgtccaagtaaattgccagatttctggttttagttacattgtattcattcagcatgtctgaagatagatgaaagcttagatctttcaatggaaagttctgtctatccaatagggagaaactgcctacatccgggttaaagttgatgggcccagaagtccaagttatggaagatctcgatctcgaagccgtagtcgtagcagaagccgtagcagaagcaacagcaggagtcgcagttactccccaaggagaagcagaggatcaccacgctattctccccgtcatagcagatctcgctctcgtacataagatgattggtgacactttttgtagaacccatgttgtatacagttttcctttattcagtacaatcttttcattttttaattcaaactgttttgttcagaatgggctaaagtgttgaattgcattcttgtaatatccccttgctcctaacatctacattcccttcgtgtctttgataaattgtattttaagtgatgtcatagacaggattgtttaaatttagttaactccatactcttcagactgtgatattgtgtaaatgtctatctgccctggtttgtgtgaactgggatgttgggggtgtttgtggttatcttacctggggaagttcttatgtttatcttgcttttcatgtgtctttctgtagacatatctgaagagatggattaagaatgctttggattaaggattgtggagcacatttcaatcattttaggattgtcaaaaggaggattgaggaggatcagatcaataatggaggcaatggtatgactccaagtgctattgtcacagatgaaattggcagtattgaccttatactaaaaggcaggggttaaaaatgattatatacattttccttaaaacacttgcaaacattttattcagttgtctttagctacaattgctttgctttttaaaccttggcaattgtggcaaaattatattgcccattttgtagcaacttattttgctcccttccccccatttttgttttaatagggactaatgtgggaagaactggctaatttgtcacagtgcttagttacaactgttaatgtgtgacctgctgttggtgtacatgtgggtacagggtgtttttaaatccaacaagatagagtataatatcaatactgctaaatctgcatgtcctctgtgtgactgatagagcgttgctatttcatttttttaagacaaaatgaaagcaaaatatagagttccaatgtattggtgtagataatctagttgggaatacttttaagtctcaccttcccctttaaactaatattcataattggttcatatgtttaaaagactttaatttacaaattaaattgcaaatgggagcattagatttagttttagacttaggtgggtagcaatgccagtaaacttaaattacgtaacttcttgcaaccacgaaacctgtaatacgctgtacagtaacaagtgttggcattatcagttgaactgtaaatacaaaatgcttcttccaattagtctctatgatgattaagtttctaaaatttatctgaacaccattcagaaacttgttttggggaatttgatagttattgatgtgcatctgttaaactgatgacagacataactcatcattccccagaaaccttttttgattacagtatctaacattttgcctcctcttttttggttttgctggttataaaggtttggattggagagggctcactggatcccaatccttggagctggatcattggattcaaatcataatgtggataggatagggaggatgaattaccaggattcatggagcgggatcagattaccaggaacataggagtggattcctgccccaaccaaaccgcattcgtgtggatttttttattcaacttaattggctattccaaagattttttttttcctatttttgacgattggagcccttaagatgcacgatggaattgtgttttgcgttttttggtaaaaggagcaaagcgaggacctggagataaacgctggagcaatctccttggaaggattcagcacgagtagatggtaaacatttaaaggggaaagggggggtttgtttaaaatagtaaatcagtaagtcacttctaaatttaaagaaaacaaaattggagttgaagaataagtaggtttccaattggctattgccgttttctttgaaaaaataaacattttttaaaaaactatgcatggttgtcctttttcctcttcatgtaagattctaactgggtctatcagttaatctttaaattgttaagtaagataagattttgactcttgtgttaatgtgttagcaaattaaaagttcttaaaaggcaatctaatggtattagccatcttttattgttaattgtaaaagtcttcaggggaaagcaaaaggggagaataaggcatttgtgtatgtaacttggtaaatgacggtgggggatggatctagcatctgaaagataagcttctctactttgttataaagtggttaaaaaactatagatgctgcttattttctggtggtcatagacaacataggcttttgtgcaaaattggttgatggctactaatgttcacttggagatagcttttgatattctcaatgaaactcatctcaaaaaaaggtaagtattaaatgttaacatcagcacagatgtattagaactgttttttgtttttgagacagagtctcgctctgttctccagactggagggcagtggtgtgatctaggctcactgcaacctccacccctggatttgagtgattctcgtgcctcagtctcccaagtagctgagactacaagtgtgtgccacccttgcccggctaattttgtatttttagtagagatgtggtttctctgtgttacccaggctggtcccaaaactcctggcctcaagtgatctgcctgccttggcctcccaaagtgttaggattacaggtgtgagccaccatgctcagcctgtagaacttttaacccaagtctcatttcttttttgaaagggaagagtgcacaagattaactgcttctttggatgaatcattgttaataaaaagctgggcatttagaattttgccttataagcccttctccaaccataagattattttgtaccaaaaactttggtgttctctaccaaagcagttaaaaacttttagcctgctacttcttgtatttgtctactgacagccccttggtactatttaggttgggggaggggacctaaaataaatagactttaacatttcccttgggtgctaatcatagttggaagttgaatttaaggtgattatttgggtgacaattaaaaacctaaggaaaaccagaaatcttggtagtggaagaaatgtgtaaggtcaccccaatcggtagattttaatgaacgttgtggaatgttgggaagaggggatgttaagttgaatgcagaatttcactaagtacttagtgtaagtttaaggatgtagctctttttatctaagaattcaatgtaatggccaaaaggcagatttactgtttaaaaatttgaataattttacatgacattcttgaaattctaagaagttttatgtgtagaacattttaaaaattcatcagattattaaagggaaaataaatgattaatgataattttggaaggttaatgtgagctagacttaagtaaactttggttcatttgtgttcattgaatgttttggaaatgaccaaaaaatgtaaatggccttcactcaagtttgagtgtttaaagttgaaagatgtgctctactaaaagttatagtaattctaacctcacattgaaatgagacagtattccttgttatacaggctgaatttgaagattagagaggatctaatgtttacttaggtaaaggggcataggttttgtagttaagatgaccagacagctaaaagctgtgatgggaagtatggactgctcctatttatagtctcagaaaatggacctttaggtctctatccgtattggcaattattagaagaaagttacacccttttgaaactacaaaagctgtcttggaatttccccctcttctccctatttatgtccccttagaatattttagggagcctataattattttctaaccaaggaaaaacttaagtctctttaagaagcaattacttttcataacatcagattgaataacccaccttgctgttcagcccacatcctactggaaacaaaaggtaagaaacccattttctggttcttgattgtttgggtctgaattttgtttttaaaactaagctaagtttaatgttttttaaaatgctgtttggaatatgaatagattccccgtaaaatgatttttcctaagttttatgctttagtaaatattcagtgctcacgtctgtgcatcatagtgcttgcgtttaatatgatttattgtagaatctcaacttttcttggtgtttgttgtctttgaaacattgtcttggtcattagggctggtgttttcacatttctgtggtcaaggtggatttcttatgtgtgcctttttgcttactttgtatatgaattttgtaatttaaattgcaagtaagttatatatatgtatttaccataaatagtattaaaagatgagaaactgttagactgaagttctgttgtaacataaccattatttccatcacagtatgaagactgcaaacgcagaaaacagattacagtctcttatccattttttgaaatccaaaaactacgaaaacaaaagattttctgttgttgagctaattaaatgtgaaccctgaccagaattgctgccttcattttgcacttagtgtgactaaactgtttcctgttgaacttcattattcattgcacagttgccacagactttgctgagggttttatgtaatacagggtatatatgtacctcataaagtgcatacagctctgaatcccagatatgtctgtctccaaagagttcatataagggattgtaggaactgtactagcatacacaggcctaatgcttttgtctgtaactggggtgtcttgactgaaaaacctgttattgtgaatcctttgttgattgaattttaagttcccccatctttttaggctgaagcagccacaagaaaaaaaggtatggcccacatttctttacattctgttgtaatagtggactcaacaattatatcccattgaagcaaatactcaggcatcctagagtgtacaatacaacattcttttgagttattgtttctgtatcagtacttaaaggaacattgaccaattagatcctataggaaaagctgggattggcatgaagtaaagagattatcaggaaacatctgttcattatgtctatcgtgattgtctattgaatgaatagtaatgctgccaaaagtaacttgctttaaacaaaccccaagagattatagtatacttaaaccagtacttattcctgttattgagaccttcacggtgcttcttggtagctttgaaagctaatgcctaacaaccctgagggttcttgtgagcttgtagtgattaaaggaaggattttttaattattat

SEQ ID NO: 109764 - DNA, 6092 bp, Homo sapiens
ttccttcagcttctcttcctctgtctcccccccatatccgtgcgccgagctgataaaggcgccattttggaggggccgcgggagacgtggtgccgctgcgggctcgctctgccgtgcgctaggcttggtgggaaggcctgttctcgagtccgcgcttttcgtcaccgccatgtcgggaggtggtgtgattcgtggccccgcagggaacaacgattgccgcatctacgtgggtaacttacctccagacatccgaaccaaggacattgaggacgtgttctacaaatacggcgctatccgcgacatcgacctcaagaatcgccgcgggggaccgcccttcgccttcgttgagttcgaggacccgcgagacgcggaagacgcggtgtatggtcgcgacggctatgattacgatgggtaccgtctgcgggtggagtttcctcgaagcggccgtggaacaggccgaggcggcggcgggggtggaggtggcggagctccccgaggtcgctatggccccccatccaggcggtctgaaaacagagtggttgtctctggactgcctccaagtggaagttggcaggatttaaaggatcacatgcgtgaagcaggtgatgtatgttatgctgatgtttaccgagatggcactggtgtcgtggagtttgtacggaaagaagatatgacctatgcagttcgaaaactggataacactaagtttagatctcatgagggagaaactgcctacatccgggttaaagttgatgggcccagaagtccaagttatggaagatctcgatctcgaagccgtagtcgtagcagaagccgtagcagaagcaacagcaggagtcgcagttactccccaaggagaagcagaggatcaccacgctattctccccgtcatagcagatctcgctctcgtacataagatgattggtgacactttttgtagaacccatgttgtatacagttttcctttattcagtacaatcttttcattttttaattcaaactgttttgttcagaatgggctaaagtgttgaattgcattcttgtaatatccccttgctcctaacatctacattcccttcgtgtctttgataaattgtattttaagtgatgtcatagacaggattgtttaaatttagttaactccatactcttcagactgtgatattgtgtaaatgtctatctgccctggtttgtgtgaactgggatgttgggggtgtttgtggttatcttacctggggaagttcttatgtttatcttgcttttcatgtgtctttctgtagacatatctgaagagatggattaagaatgctttggattaaggattgtggagcacatttcaatcattttaggattgtcaaaaggaggattgaggaggatcagatcaataatggaggcaatggtatgactccaagtgctattgtcacagatgaaattggcagtattgaccttatactaaaaggcaggggttaaaaatgattatatacattttccttaaaacacttgcaaacattttattcagttgtctttagctacaattgctttgctttttaaaccttggcaattgtggcaaaattatattgcccattttgtagcaacttattttgctcccttccccccatttttgttttaatagggactaatgtgggaagaactggctaatttgtcacagtgcttagttacaactgttaatgtgtgacctgctgttggtgtacatgtgggtacagggtgtttttaaatccaacaagatagagtataatatcaatactgctaaatctgcatgtcctctgtgtgactgatagagcgttgctatttcatttttttaagacaaaatgaaagcaaaatatagagttccaatgtattggtgtagataatctagttgggaatacttttaagtctcaccttcccctttaaactaatattcataattggttcatatgtttaaaagactttaatttacaaattaaattgcaaatgggagcattagatttagttttagacttaggtgggtagcaatgccagtaaacttaaattacgtaacttcttgcaaccacgaaacctgtaatacgctgtacagtaacaagtgttggcattatcagttgaactgtaaatacaaaatgcttcttccaattagtctctatgatgattaagtttctaaaatttatctgaacaccattcagaaaaccttttttgattacagtatctaacattttgcctcctcttttttggttttgctggttataaaggtttggattggagagggctcactggatcccaatccttggagctggatcattggattcaaatcataatgtggataggatagggaggatgaattaccaggattcatggagcgggatcagattaccaggaacataggagtggattcctgccccaaccaaaccgcattcgtgtggatttttttattcaacttaattggctattccaaagattttttttttcctatttttgacgattggagcccttaagatgcacgatggaattgtgttttgcgttttttggtaaaaggagcaaagcgaggacctggagataaacgctggagcaatctccttggaaggattcagcacgagtagatggtaaacatttaaaggggaaagggggggtttgtttaaaatagtaaatcagtaagtcacttctaaatttaaagaaaacaaaattggagttgaagaataagtaggtttccaattggctattgccgttttctttgaaaaaataaacattttttaaaaaactatgcatggttgtcctttttcctcttcatgtaagattctaactgggtctatcagttaatctttaaattgttaagtaagataagattttgactcttgtgttaatgtgttagcaaattaaaagttcttaaaaggcaatctaatggtattagccatcttttattgttaattgtaaaagtcttcaggggaaagcaaaaggggagaataaggcatttgtgtatgtaacttggtaaatgacggtgggggatggatctagcatctgaaagataagcttctctactttgttataaagtggttaaaaaactatagatgctgcttattttctggtggtcatagacaacataggcttttgtgcaaaattggttgatggctactaatgttcacttggagatagcttttgatattctcaatgaaactcatctcaaaaaaaggtaagtattaaatgttaacatcagcacagatgtattagaactgttttttgtttttgagacagagtctcgctctgttctccagactggagggcagtggtgtgatctaggctcactgcaacctccacccctggatttgagtgattctcgtgcctcagtctcccaagtagctgagactacaagtgtgtgccacccttgcccggctaattttgtatttttagtagagatgtggtttctctgtgttacccaggctggtcccaaaactcctggcctcaagtgatctgcctgccttggcctcccaaagtgttaggattacaggtgtgagccaccatgctcagcctgtagaacttttaacccaagtctcatttcttttttgaaagggaagagtgcacaagattaactgcttctttggatgaatcattgttaataaaaagctgggcatttagaattttgccttataagcccttctccaaccataagattattttgtaccaaaaactttggtgttctctaccaaagcagttaaaaacttttagcctgctacttcttgtatttgtctactgacagccccttggtactatttaggttgggggaggggacctaaaataaatagactttaacatttcccttgggtgctaatcatagttggaagttgaatttaaggtgattatttgggtgacaattaaaaacctaaggaaaaccagaaatcttggtagtggaagaaatgtgtaaggtcaccccaatcggtagattttaatgaacgttgtggaatgttgggaagaggggatgttaagttgaatgcagaatttcactaagtacttagtgtaagtttaaggatgtagctctttttatctaagaattcaatgtaatggccaaaaggcagatttactgtttaaaaatttgaataattttacatgacattcttgaaattctaagaagttttatgtgtagaacattttaaaaattcatcagattattaaagggaaaataaatgattaatgataattttggaaggttaatgtgagctagacttaagtaaactttggttcatttgtgttcattgaatgttttggaaatgaccaaaaaatgtaaatggccttcactcaagtttgagtgtttaaagttgaaagatgtgctctactaaaagttatagtaattctaacctcacattgaaatgagacagtattccttgttatacaggctgaatttgaagattagagaggatctaatgtttacttaggtaaaggggcataggttttgtagttaagatgaccagacagctaaaagctgtgatgggaagtatggactgctcctatttatagtctcagaaaatggacctttaggtctctatccgtattggcaattattagaagaaagttacacccttttgaaactacaaaagctgtcttggaatttccccctcttctccctatttatgtccccttagaatattttagggagcctataattattttctaaccaaggaaaaacttaagtctctttaagaagcaattacttttcataacatcagattgaataacccaccttgctgttcagcccacatcctactggaaacaaaaggtaagaaacccattttctggttcttgattgtttgggtctgaattttgtttttaaaactaagctaagtttaatgttttttaaaatgctgtttggaatatgaatagattccccgtaaaatgatttttcctaagttttatgctttagtaaatattcagtgctcacgtctgtgcatcatagtgcttgcgtttaatatgatttattgtagaatctcaacttttcttggtgtttgttgtctttgaaacattgtcttggtcattagggctggtgttttcacatttctgtggtcaaggtggatttcttatgtgtgcctttttgcttactttgtatatgaattttgtaatttaaattgcaagtaagttatatatatgtatttaccataaatagtattaaaagatgagaaactgttagactgaagttctgttgtaacataaccattatttccatcacagtatgaagactgcaaacgcagaaaacagattacagtctcttatccattttttgaaatccaaaaactacgaaaacaaaagattttctgttgttgagctaattaaatgtgaaccctgaccagaattgctgccttcattttgcacttagtgtgactaaactgtttcctgttgaacttcattattcattgcacagttgccacagactttgctgagggttttatgtaatacagggtatatatgtacctcataaagtgcatacagctctgaatcccagatatgtctgtctccaaagagttcatataagggattgtaggaactgtactagcatacacaggcctaatgcttttgtctgtaactggggtgtcttgactgaaaaacctgttattgtgaatcctttgttgattgaattttaagttcccccatctttttaggctgaagcagccacaagaaaaaaaggtatggcccacatttctttacattctgttgtaatagtggactcaacaattatatcccattgaagcaaatactcaggcatcctagagtgtacaatacaacattcttttgagttattgtttctgtatcagtacttaaaggaacattgaccaattagatcctataggaaaagctgggattggcatgaagtaaagagattatcaggaaacatctgttcattatgtctatcgtgattgtctattgaatgaatagtaatgctgccaaaagtaacttgctttaaacaaaccccaagagattatagtatacttaaaccagtacttattcctgttattgagaccttcacggtgcttcttggtagctttgaaagctaatgcctaacaaccctgagggttcttgtgagcttgtagtgattaaaggaaggattttttaattattat

SEQ ID NO: 109765 - DNA, 6091 bp, Homo sapiens
ttccttcagcttctcttcctctgtctcccccccatatccgtgcgccgagctgataaaggcgccattttggaggggccgcgggagacgtggtgccgctgcgggctcgctctgccgtgcgctaggcttggtgggaaggcctgttctcgagtccgcgcttttcgtcaccgccatgtcgggaggtggtgtgattcgtggccccgcagggaacaacgattgccgcatctacgtgggtaacttacctccagacatccgaaccaaggacattgaggacgtgttctacaaatacggcgctatccgcgacatcgacctcaagaatcgccgcgggggaccgcccttcgccttcgttgagttcgaggacccgcgagacgcggaagacgcggtgtatggtcgcgacggctatgattacgatgggtaccgtctgcgggtggagtttcctcgaagcggccgtggaacaggccgaggcggcggcgggggtggaggtggcggagctccccgaggtcgctatggccccccatccaggcggtctgaaaacagagtggttgtctctggactgcctccaagtggaagttggcaggatttaaggaaagaagatatgacctatgcagttcgaaaactggataacactaagtttagatctcatgagggagaaactgcctacatccgggttaaagttgatgggcccagaagtccaagttatggaagatctcgatctcgaagccgtagtcgtagcagaagccgtagcagaagcaacagcaggagtcgcagttactccccaaggagaagcagaggatcaccacgctattctccccgtcatagcagatctcgctctcgtacataagatgattggtgacactttttgtagaacccatgttgtatacagttttcctttattcagtacaatcttttcattttttaattcaaactgttttgttcagaatgggctaaagtgttgaattgcattcttgtaatatccccttgctcctaacatctacattcccttcgtgtctttgataaattgtattttaagtgatgtcatagacaggattgtttaaatttagttaactccatactcttcagactgtgatattgtgtaaatgtctatctgccctggtttgtgtgaactgggatgttgggggtgtttgtggttatcttacctggggaagttcttatgtttatcttgcttttcatgtgtctttctgtagacatatctgaagagatggattaagaatgctttggattaaggattgtggagcacatttcaatcattttaggattgtcaaaaggaggattgaggaggatcagatcaataatggaggcaatggtatgactccaagtgctattgtcacagatgaaattggcagtattgaccttatactaaaaggcaggggttaaaaatgattatatacattttccttaaaacacttgcaaacattttattcagttgtctttagctacaattgctttgctttttaaaccttggcaattgtggcaaaattatattgcccattttgtagcaacttattttgctcccttccccccatttttgttttaatagggactaatgtgggaagaactggctaatttgtcacagtgcttagttacaactgttaatgtgtgacctgctgttggtgtacatgtgggtacagggtgtttttaaatccaacaagatagagtataatatcaatactgctaaatctgcatgtcctctgtgtgactgatagagcgttgctatttcatttttttaagacaaaatgaaagcaaaatatagagttccaatgtattggtgtagataatctagttgggaatacttttaagtctcaccttcccctttaaactaatattcataattggttcatatgtttaaaagactttaatttacaaattaaattgcaaatgggagcattagatttagttttagacttaggtgggtagcaatgccagtaaacttaaattacgtaacttcttgcaaccacgaaacctgtaatacgctgtacagtaacaagtgttggcattatcagttgaactgtaaatacaaaatgcttcttccaattagtctctatgatgattaagtttctaaaatttatctgaacaccattcagaaacttgttttggggaatttgatagttattgatgtgcatctgttaaactgatgacagacataactcatcattccccagaaaccttttttgattacagtatctaacattttgcctcctcttttttggttttgctggttataaaggtttggattggagagggctcactggatcccaatccttggagctggatcattggattcaaatcataatgtggataggatagggaggatgaattaccaggattcatggagcgggatcagattaccaggaacataggagtggattcctgccccaaccaaaccgcattcgtgtggatttttttattcaacttaattggctattccaaagattttttttttcctatttttgacgattggagcccttaagatgcacgatggaattgtgttttgcgttttttggtaaaaggagcaaagcgaggacctggagataaacgctggagcaatctccttggaaggattcagcacgagtagatggtaaacatttaaaggggaaagggggggtttgtttaaaatagtaaatcagtaagtcacttctaaatttaaagaaaacaaaattggagttgaagaataagtaggtttccaattggctattgccgttttctttgaaaaaataaacattttttaaaaaactatgcatggttgtcctttttcctcttcatgtaagattctaactgggtctatcagttaatctttaaattgttaagtaagataagattttgactcttgtgttaatgtgttagcaaattaaaagttcttaaaaggcaatctaatggtattagccatcttttattgttaattgtaaaagtcttcaggggaaagcaaaaggggagaataaggcatttgtgtatgtaacttggtaaatgacggtgggggatggatctagcatctgaaagataagcttctctactttgttataaagtggttaaaaaactatagatgctgcttattttctggtggtcatagacaacataggcttttgtgcaaaattggttgatggctactaatgttcacttggagatagcttttgatattctcaatgaaactcatctcaaaaaaaggtaagtattaaatgttaacatcagcacagatgtattagaactgttttttgtttttgagacagagtctcgctctgttctccagactggagggcagtggtgtgatctaggctcactgcaacctccacccctggatttgagtgattctcgtgcctcagtctcccaagtagctgagactacaagtgtgtgccacccttgcccggctaattttgtatttttagtagagatgtggtttctctgtgttacccaggctggtcccaaaactcctggcctcaagtgatctgcctgccttggcctcccaaagtgttaggattacaggtgtgagccaccatgctcagcctgtagaacttttaacccaagtctcatttcttttttgaaagggaagagtgcacaagattaactgcttctttggatgaatcattgttaataaaaagctgggcatttagaattttgccttataagcccttctccaaccataagattattttgtaccaaaaactttggtgttctctaccaaagcagttaaaaacttttagcctgctacttcttgtatttgtctactgacagccccttggtactatttaggttgggggaggggacctaaaataaatagactttaacatttcccttgggtgctaatcatagttggaagttgaatttaaggtgattatttgggtgacaattaaaaacctaaggaaaaccagaaatcttggtagtggaagaaatgtgtaaggtcaccccaatcggtagattttaatgaacgttgtggaatgttgggaagaggggatgttaagttgaatgcagaatttcactaagtacttagtgtaagtttaaggatgtagctctttttatctaagaattcaatgtaatggccaaaaggcagatttactgtttaaaaatttgaataattttacatgacattcttgaaattctaagaagttttatgtgtagaacattttaaaaattcatcagattattaaagggaaaataaatgattaatgataattttggaaggttaatgtgagctagacttaagtaaactttggttcatttgtgttcattgaatgttttggaaatgaccaaaaaatgtaaatggccttcactcaagtttgagtgtttaaagttgaaagatgtgctctactaaaagttatagtaattctaacctcacattgaaatgagacagtattccttgttatacaggctgaatttgaagattagagaggatctaatgtttacttaggtaaaggggcataggttttgtagttaagatgaccagacagctaaaagctgtgatgggaagtatggactgctcctatttatagtctcagaaaatggacctttaggtctctatccgtattggcaattattagaagaaagttacacccttttgaaactacaaaagctgtcttggaatttccccctcttctccctatttatgtccccttagaatattttagggagcctataattattttctaaccaaggaaaaacttaagtctctttaagaagcaattacttttcataacatcagattgaataacccaccttgctgttcagcccacatcctactggaaacaaaaggtaagaaacccattttctggttcttgattgtttgggtctgaattttgtttttaaaactaagctaagtttaatgttttttaaaatgctgtttggaatatgaatagattccccgtaaaatgatttttcctaagttttatgctttagtaaatattcagtgctcacgtctgtgcatcatagtgcttgcgtttaatatgatttattgtagaatctcaacttttcttggtgtttgttgtctttgaaacattgtcttggtcattagggctggtgttttcacatttctgtggtcaaggtggatttcttatgtgtgcctttttgcttactttgtatatgaattttgtaatttaaattgcaagtaagttatatatatgtatttaccataaatagtattaaaagatgagaaactgttagactgaagttctgttgtaacataaccattatttccatcacagtatgaagactgcaaacgcagaaaacagattacagtctcttatccattttttgaaatccaaaaactacgaaaacaaaagattttctgttgttgagctaattaaatgtgaaccctgaccagaattgctgccttcattttgcacttagtgtgactaaactgtttcctgttgaacttcattattcattgcacagttgccacagactttgctgagggttttatgtaatacagggtatatatgtacctcataaagtgcatacagctctgaatcccagatatgtctgtctccaaagagttcatataagggattgtaggaactgtactagcatacacaggcctaatgcttttgtctgtaactggggtgtcttgactgaaaaacctgttattgtgaatcctttgttgattgaattttaagttcccccatctttttaggctgaagcagccacaagaaaaaaaggtatggcccacatttctttacattctgttgtaatagtggactcaacaattatatcccattgaagcaaatactcaggcatcctagagtgtacaatacaacattcttttgagttattgtttctgtatcagtacttaaaggaacattgaccaattagatcctataggaaaagctgggattggcatgaagtaaagagattatcaggaaacatctgttcattatgtctatcgtgattgtctattgaatgaatagtaatgctgccaaaagtaacttgctttaaacaaaccccaagagattatagtatacttaaaccagtacttattcctgttattgagaccttcacggtgcttcttggtagctttgaaagctaatgcctaacaaccctgagggttcttgtgagcttgtagtgattaaaggaaggattttttaattattat

SEQ ID NO: 109766 - DNA, 5797 bp, Homo sapiens
ttccttcagcttctcttcctctgtctcccccccatatccgtgcgccgagctgataaaggcgccattttggaggggccgcgggagacgtggtgccgctgcgggctcgctctgccgtgcgctaggcttggtgggaaggcctgttctcgagtccgcgcttttcgtcaccgccatgtcgggaggtggtgtgattcgtggccccgcagggaacaacgattgccgcatctacgtgggtaacttacctccagacatccgaaccaaggacattgaggacgtgttctacaaatacggcgctatccgcgacatcgacctcaagaatcgccgcgggggaccgcccttcgccttcgttgagttcgaggacccgcgagacgcggaagacgcggtgtatggtcgcgacggctatgattacgatgggtaccgtctgcgggtggagtttcctcgaagcggccgtggaacaggccgaggcggcggcgggggtggaggtggcggagctccccgaggtcgctatggccccccatccaggcggtctgaaaacagagtggttgtctctggactgcctccaagtggaagttggcaggatttaaaggatcacatgcgtgaagcaggtgatgtatgttatgctgatgtttaccgagatggcactggtgtcgtggagtttgtacggaaagaagatatgacctatgcagttcgaaaactggataacactaagtttagatctcatgagggagaaactgcctacatccgggttaaagttgatgggcccagaagtccaagttatggaagatctcgatctcgaagccgtagtcgtagcagaagccgtagcagaagcaacagcaggagtcgcagttactccccaaggagaagcagaggatcaccacgctattctccccgtcatagcagatctcgctctcacatatctgaagagatggattaagaatgctttggattaaggattgtggagcacatttcaatcattttaggattgtcaaaaggaggattgaggaggatcagatcaataatggaggcaatggtatgactccaagtgctattgtcacagatgaaattggcagtattgaccttatactaaaaggcaggggttaaaaatgattatatacattttccttaaaacacttgcaaacattttattcagttgtctttagctacaattgctttgctttttaaaccttggcaattgtggcaaaattatattgcccattttgtagcaacttattttgctcccttccccccatttttgttttaatagggactaatgtgggaagaactggctaatttgtcacagtgcttagttacaactgttaatgtgtgacctgctgttggtgtacatgtgggtacagggtgtttttaaatccaacaagatagagtataatatcaatactgctaaatctgcatgtcctctgtgtgactgatagagcgttgctatttcatttttttaagacaaaatgaaagcaaaatatagagttccaatgtattggtgtagataatctagttgggaatacttttaagtctcaccttcccctttaaactaatattcataattggttcatatgtttaaaagactttaatttacaaattaaattgcaaatgggagcattagatttagttttagacttaggtgggtagcaatgccagtaaacttaaattacgtaacttcttgcaaccacgaaacctgtaatacgctgtacagtaacaagtgttggcattatcagttgaactgtaaatacaaaatgcttcttccaattagtctctatgatgattaagtttctaaaatttatctgaacaccattcagaaacttgttttggggaatttgatagttattgatgtgcatctgttaaactgatgacagacataactcatcattccccagaaaccttttttgattacagtatctaacattttgcctcctcttttttggttttgctggttataaaggtttggattggagagggctcactggatcccaatccttggagctggatcattggattcaaatcataatgtggataggatagggaggatgaattaccaggattcatggagcgggatcagattaccaggaacataggagtggattcctgccccaaccaaaccgcattcgtgtggatttttttattcaacttaattggctattccaaagattttttttttcctatttttgacgattggagcccttaagatgcacgatggaattgtgttttgcgttttttggtaaaaggagcaaagcgaggacctggagataaacgctggagcaatctccttggaaggattcagcacgagtagatggtaaacatttaaaggggaaagggggggtttgtttaaaatagtaaatcagtaagtcacttctaaatttaaagaaaacaaaattggagttgaagaataagtaggtttccaattggctattgccgttttctttgaaaaaataaacattttttaaaaaactatgcatggttgtcctttttcctcttcatgtaagattctaactgggtctatcagttaatctttaaattgttaagtaagataagattttgactcttgtgttaatgtgttagcaaattaaaagttcttaaaaggcaatctaatggtattagccatcttttattgttaattgtaaaagtcttcaggggaaagcaaaaggggagaataaggcatttgtgtatgtaacttggtaaatgacggtgggggatggatctagcatctgaaagataagcttctctactttgttataaagtggttaaaaaactatagatgctgcttattttctggtggtcatagacaacataggcttttgtgcaaaattggttgatggctactaatgttcacttggagatagcttttgatattctcaatgaaactcatctcaaaaaaaggtaagtattaaatgttaacatcagcacagatgtattagaactgttttttgtttttgagacagagtctcgctctgttctccagactggagggcagtggtgtgatctaggctcactgcaacctccacccctggatttgagtgattctcgtgcctcagtctcccaagtagctgagactacaagtgtgtgccacccttgcccggctaattttgtatttttagtagagatgtggtttctctgtgttacccaggctggtcccaaaactcctggcctcaagtgatctgcctgccttggcctcccaaagtgttaggattacaggtgtgagccaccatgctcagcctgtagaacttttaacccaagtctcatttcttttttgaaagggaagagtgcacaagattaactgcttctttggatgaatcattgttaataaaaagctgggcatttagaattttgccttataagcccttctccaaccataagattattttgtaccaaaaactttggtgttctctaccaaagcagttaaaaacttttagcctgctacttcttgtatttgtctactgacagccccttggtactatttaggttgggggaggggacctaaaataaatagactttaacatttcccttgggtgctaatcatagttggaagttgaatttaaggtgattatttgggtgacaattaaaaacctaaggaaaaccagaaatcttggtagtggaagaaatgtgtaaggtcaccccaatcggtagattttaatgaacgttgtggaatgttgggaagaggggatgttaagttgaatgcagaatttcactaagtacttagtgtaagtttaaggatgtagctctttttatctaagaattcaatgtaatggccaaaaggcagatttactgtttaaaaatttgaataattttacatgacattcttgaaattctaagaagttttatgtgtagaacattttaaaaattcatcagattattaaagggaaaataaatgattaatgataattttggaaggttaatgtgagctagacttaagtaaactttggttcatttgtgttcattgaatgttttggaaatgaccaaaaaatgtaaatggccttcactcaagtttgagtgtttaaagttgaaagatgtgctctactaaaagttatagtaattctaacctcacattgaaatgagacagtattccttgttatacaggctgaatttgaagattagagaggatctaatgtttacttaggtaaaggggcataggttttgtagttaagatgaccagacagctaaaagctgtgatgggaagtatggactgctcctatttatagtctcagaaaatggacctttaggtctctatccgtattggcaattattagaagaaagttacacccttttgaaactacaaaagctgtcttggaatttccccctcttctccctatttatgtccccttagaatattttagggagcctataattattttctaaccaaggaaaaacttaagtctctttaagaagcaattacttttcataacatcagattgaataacccaccttgctgttcagcccacatcctactggaaacaaaaggtaagaaacccattttctggttcttgattgtttgggtctgaattttgtttttaaaactaagctaagtttaatgttttttaaaatgctgtttggaatatgaatagattccccgtaaaatgatttttcctaagttttatgctttagtaaatattcagtgctcacgtctgtgcatcatagtgcttgcgtttaatatgatttattgtagaatctcaacttttcttggtgtttgttgtctttgaaacattgtcttggtcattagggctggtgttttcacatttctgtggtcaaggtggatttcttatgtgtgcctttttgcttactttgtatatgaattttgtaatttaaattgcaagtaagttatatatatgtatttaccataaatagtattaaaagatgagaaactgttagactgaagttctgttgtaacataaccattatttccatcacagtatgaagactgcaaacgcagaaaacagattacagtctcttatccattttttgaaatccaaaaactacgaaaacaaaagattttctgttgttgagctaattaaatgtgaaccctgaccagaattgctgccttcattttgcacttagtgtgactaaactgtttcctgttgaacttcattattcattgcacagttgccacagactttgctgagggttttatgtaatacagggtatatatgtacctcataaagtgcatacagctctgaatcccagatatgtctgtctccaaagagttcatataagggattgtaggaactgtactagcatacacaggcctaatgcttttgtctgtaactggggtgtcttgactgaaaaacctgttattgtgaatcctttgttgattgaattttaagttcccccatctttttaggctgaagcagccacaagaaaaaaaggtatggcccacatttctttacattctgttgtaatagtggactcaacaattatatcccattgaagcaaatactcaggcatcctagagtgtacaatacaacattcttttgagttattgtttctgtatcagtacttaaaggaacattgaccaattagatcctataggaaaagctgggattggcatgaagtaaagagattatcaggaaacatctgttcattatgtctatcgtgattgtctattgaatgaatagtaatgctgccaaaagtaacttgctttaaacaaaccccaagagattatagtatacttaaaccagtacttattcctgttattgagaccttcacggtgcttcttggtagctttgaaagctaatgcctaacaaccctgagggttcttgtgagcttgtagtgattaaaggaaggattttttaattattat

SEQ ID NO: 109767 - DNA, 6406 bp, Homo sapiens
ttccttcagcttctcttcctctgtctcccccccatatccgtgcgccgagctgataaaggcgccattttggaggggccgcgggagacgtggtgccgctgcgggctcgctctgccgtgcgctaggcttggtgggaaggcctgttctcgagtccgcgcttttcgtcaccgccatgtcgggaggtggtgtgattcgtggccccgcagggaacaacgattgccgcatctacgtgggtaacttacctccagacatccgaaccaaggacattgaggacgtgttctacaaatacggcgctatccgcgacatcgacctcaagaatcgccgcgggggaccgcccttcgccttcgttgagttcgaggacccgcggtgaggcggcatggggcttgcagccttgaggaaatagagacgcggaagacgcggtgtatggtcgcgacggctatgattacgatgggtaccgtctgcgggtggagtttcctcgaagcggccgtggaacaggccgaggcggcggcgggggtggaggtggcggagctccccgaggtcgctatggccccccatccaggcggtctgaaaacagagtggttgtctctggactgcctccaagtggaagttggcaggatttaaaggatcacatgcgtgaagcaggtgatgtatgttatgctgatgtttaccgagatggcactggtgtcgtggagtttgtacggaaagaagatatgacctatgcagttcgaaaactggataacactaagtttagatctcatgaggtaggttatacacgtattcttttctttgaccagaattggatacagtggtcttaacagtggaatttcaaggtaaggattcaggcaaggttgtccaagtaaattgccagatttctggttttagttacattgtattcattcagcatgtctgaagatagatgaaagcttagatctttcaatggaaagttctgtctatccaatagggagaaactgcctacatccgggttaaagttgatgggcccagaagtccaagttatggaagatctcgatctcgaagccgtagtcgtagcagaagccgtagcagaagcaacagcaggagtcgcagttactccccaaggagaagcagaggatcaccacgctattctccccgtcatagcagatctcgctctcgtacataagatgattggtgacactttttgtagaacccatgttgtatacagttttcctttattcagtacaatcttttcattttttaattcaaactgttttgttcagaatgggctaaagtgttgaattgcattcttgtaatatccccttgctcctaacatctacattcccttcgtgtctttgataaattgtattttaagtgatgtcatagacaggattgtttaaatttagttaactccatactcttcagactgtgatattgtgtaaatgtctatctgccctggtttgtgtgaactgggatgttgggggtgtttgtggttatcttacctggggaagttcttatgtttatcttgcttttcatgtgtctttctgtagacatatctgaagagatggattaagaatgctttggattaaggattgtggagcacatttcaatcattttaggattgtcaaaaggaggattgaggaggatcagatcaataatggaggcaatggtatgactccaagtgctattgtcacagatgaaattggcagtattgaccttatactaaaaggcaggggttaaaaatgattatatacattttccttaaaacacttgcaaacattttattcagttgtctttagctacaattgctttgctttttaaaccttggcaattgtggcaaaattatattgcccattttgtagcaacttattttgctcccttccccccatttttgttttaatagggactaatgtgggaagaactggctaatttgtcacagtgcttagttacaactgttaatgtgtgacctgctgttggtgtacatgtgggtacagggtgtttttaaatccaacaagatagagtataatatcaatactgctaaatctgcatgtcctctgtgtgactgatagagcgttgctatttcatttttttaagacaaaatgaaagcaaaatatagagttccaatgtattggtgtagataatctagttgggaatacttttaagtctcaccttcccctttaaactaatattcataattggttcatatgtttaaaagactttaatttacaaattaaattgcaaatgggagcattagatttagttttagacttaggtgggtagcaatgccagtaaacttaaattacgtaacttcttgcaaccacgaaacctgtaatacgctgtacagtaacaagtgttggcattatcagttgaactgtaaatacaaaatgcttcttccaattagtctctatgatgattaagtttctaaaatttatctgaacaccattcagaaacttgttttggggaatttgatagttattgatgtgcatctgttaaactgatgacagacataactcatcattccccagaaaccttttttgattacagtatctaacattttgcctcctcttttttggttttgctggttataaaggtttggattggagagggctcactggatcccaatccttggagctggatcattggattcaaatcataatgtggataggatagggaggatgaattaccaggattcatggagcgggatcagattaccaggaacataggagtggattcctgccccaaccaaaccgcattcgtgtggatttttttattcaacttaattggctattccaaagattttttttttcctatttttgacgattggagcccttaagatgcacgatggaattgtgttttgcgttttttggtaaaaggagcaaagcgaggacctggagataaacgctggagcaatctccttggaaggattcagcacgagtagatggtaaacatttaaaggggaaagggggggtttgtttaaaatagtaaatcagtaagtcacttctaaatttaaagaaaacaaaattggagttgaagaataagtaggtttccaattggctattgccgttttctttgaaaaaataaacattttttaaaaaactatgcatggttgtcctttttcctcttcatgtaagattctaactgggtctatcagttaatctttaaattgttaagtaagataagattttgactcttgtgttaatgtgttagcaaattaaaagttcttaaaaggcaatctaatggtattagccatcttttattgttaattgtaaaagtcttcaggggaaagcaaaaggggagaataaggcatttgtgtatgtaacttggtaaatgacggtgggggatggatctagcatctgaaagataagcttctctactttgttataaagtggttaaaaaactatagatgctgcttattttctggtggtcatagacaacataggcttttgtgcaaaattggttgatggctactaatgttcacttggagatagcttttgatattctcaatgaaactcatctcaaaaaaaggtaagtattaaatgttaacatcagcacagatgtattagaactgttttttgtttttgagacagagtctcgctctgttctccagactggagggcagtggtgtgatctaggctcactgcaacctccacccctggatttgagtgattctcgtgcctcagtctcccaagtagctgagactacaagtgtgtgccacccttgcccggctaattttgtatttttagtagagatgtggtttctctgtgttacccaggctggtcccaaaactcctggcctcaagtgatctgcctgccttggcctcccaaagtgttaggattacaggtgtgagccaccatgctcagcctgtagaacttttaacccaagtctcatttcttttttgaaagggaagagtgcacaagattaactgcttctttggatgaatcattgttaataaaaagctgggcatttagaattttgccttataagcccttctccaaccataagattattttgtaccaaaaactttggtgttctctaccaaagcagttaaaaacttttagcctgctacttcttgtatttgtctactgacagccccttggtactatttaggttgggggaggggacctaaaataaatagactttaacatttcccttgggtgctaatcatagttggaagttgaatttaaggtgattatttgggtgacaattaaaaacctaaggaaaaccagaaatcttggtagtggaagaaatgtgtaaggtcaccccaatcggtagattttaatgaacgttgtggaatgttgggaagaggggatgttaagttgaatgcagaatttcactaagtacttagtgtaagtttaaggatgtagctctttttatctaagaattcaatgtaatggccaaaaggcagatttactgtttaaaaatttgaataattttacatgacattcttgaaattctaagaagttttatgtgtagaacattttaaaaattcatcagattattaaagggaaaataaatgattaatgataattttggaaggttaatgtgagctagacttaagtaaactttggttcatttgtgttcattgaatgttttggaaatgaccaaaaaatgtaaatggccttcactcaagtttgagtgtttaaagttgaaagatgtgctctactaaaagttatagtaattctaacctcacattgaaatgagacagtattccttgttatacaggctgaatttgaagattagagaggatctaatgtttacttaggtaaaggggcataggttttgtagttaagatgaccagacagctaaaagctgtgatgggaagtatggactgctcctatttatagtctcagaaaatggacctttaggtctctatccgtattggcaattattagaagaaagttacacccttttgaaactacaaaagctgtcttggaatttccccctcttctccctatttatgtccccttagaatattttagggagcctataattattttctaaccaaggaaaaacttaagtctctttaagaagcaattacttttcataacatcagattgaataacccaccttgctgttcagcccacatcctactggaaacaaaaggtaagaaacccattttctggttcttgattgtttgggtctgaattttgtttttaaaactaagctaagtttaatgttttttaaaatgctgtttggaatatgaatagattccccgtaaaatgatttttcctaagttttatgctttagtaaatattcagtgctcacgtctgtgcatcatagtgcttgcgtttaatatgatttattgtagaatctcaacttttcttggtgtttgttgtctttgaaacattgtcttggtcattagggctggtgttttcacatttctgtggtcaaggtggatttcttatgtgtgcctttttgcttactttgtatatgaattttgtaatttaaattgcaagtaagttatatatatgtatttaccataaatagtattaaaagatgagaaactgttagactgaagttctgttgtaacataaccattatttccatcacagtatgaagactgcaaacgcagaaaacagattacagtctcttatccattttttgaaatccaaaaactacgaaaacaaaagattttctgttgttgagctaattaaatgtgaaccctgaccagaattgctgccttcattttgcacttagtgtgactaaactgtttcctgttgaacttcattattcattgcacagttgccacagactttgctgagggttttatgtaatacagggtatatatgtacctcataaagtgcatacagctctgaatcccagatatgtctgtctccaaagagttcatataagggattgtaggaactgtactagcatacacaggcctaatgcttttgtctgtaactggggtgtcttgactgaaaaacctgttattgtgaatcctttgttgattgaattttaagttcccccatctttttaggctgaagcagccacaagaaaaaaaggtatggcccacatttctttacattctgttgtaatagtggactcaacaattatatcccattgaagcaaatactcaggcatcctagagtgtacaatacaacattcttttgagttattgtttctgtatcagtacttaaaggaacattgaccaattagatcctataggaaaagctgggattggcatgaagtaaagagattatcaggaaacatctgttcattatgtctatcgtgattgtctattgaatgaatagtaatgctgccaaaagtaacttgctttaaacaaaccccaagagattatagtatacttaaaccagtacttattcctgttattgagaccttcacggtgcttcttggtagctttgaaagctaatgcctaacaaccctgagggttcttgtgagcttgtagtgattaaaggaaggattttttaattattat

SEQ ID NO: 109768 - DNA, 6115 bp, Homo sapiens
ttccttcagcttctcttcctctgtctcccccccatatccgtgcgccgagctgataaaggcgccattttggaggggccgcgggagacgtggtgccgctgcgggctcgctctgccgtgcgctaggcttggtgggaaggcctgttctcgagtccgcgcttttcgtcaccgccatgtcgggaggtggtgtgattcgtggccccgcagggaacaacgattgccgcatctacgtgggtaacttacctccagacatccgaaccaagaatcgccgcgggggaccgcccttcgccttcgttgagttcgaggacccgcgagacgcggaagacgcggtgtatggtcgcgacggctatgattacgatgggtaccgtctgcgggtggagtttcctcgaagcggccgtggaacaggccgaggcggcggcgggggtggaggtggcggagctccccgaggtcgctatggccccccatccaggcggtctgaaaacagagtggttgtctctggactgcctccaagtggaagttggcaggatttaaaggatcacatgcgtgaagcaggtgatgtatgttatgctgatgtttaccgagatggcactggtgtcgtggagtttgtacggaaagaagatatgacctatgcagttcgaaaactggataacactaagtttagatctcatgagggagaaactgcctacatccgggttaaagttgatgggcccagaagtccaagttatggaagatctcgatctcgaagccgtagtcgtagcagaagccgtagcagaagcaacagcaggagtcgcagttactccccaaggagaagcagaggatcaccacgctattctccccgtcatagcagatctcgctctcgtacataagatgattggtgacactttttgtagaacccatgttgtatacagttttcctttattcagtacaatcttttcattttttaattcaaactgttttgttcagaatgggctaaagtgttgaattgcattcttgtaatatccccttgctcctaacatctacattcccttcgtgtctttgataaattgtattttaagtgatgtcatagacaggattgtttaaatttagttaactccatactcttcagactgtgatattgtgtaaatgtctatctgccctggtttgtgtgaactgggatgttgggggtgtttgtggttatcttacctggggaagttcttatgtttatcttgcttttcatgtgtctttctgtagacatatctgaagagatggattaagaatgctttggattaaggattgtggagcacatttcaatcattttaggattgtcaaaaggaggattgaggaggatcagatcaataatggaggcaatggtatgactccaagtgctattgtcacagatgaaattggcagtattgaccttatactaaaaggcaggggttaaaaatgattatatacattttccttaaaacacttgcaaacattttattcagttgtctttagctacaattgctttgctttttaaaccttggcaattgtggcaaaattatattgcccattttgtagcaacttattttgctcccttccccccatttttgttttaatagggactaatgtgggaagaactggctaatttgtcacagtgcttagttacaactgttaatgtgtgacctgctgttggtgtacatgtgggtacagggtgtttttaaatccaacaagatagagtataatatcaatactgctaaatctgcatgtcctctgtgtgactgatagagcgttgctatttcatttttttaagacaaaatgaaagcaaaatatagagttccaatgtattggtgtagataatctagttgggaatacttttaagtctcaccttcccctttaaactaatattcataattggttcatatgtttaaaagactttaatttacaaattaaattgcaaatgggagcattagatttagttttagacttaggtgggtagcaatgccagtaaacttaaattacgtaacttcttgcaaccacgaaacctgtaatacgctgtacagtaacaagtgttggcattatcagttgaactgtaaatacaaaatgcttcttccaattagtctctatgatgattaagtttctaaaatttatctgaacaccattcagaaacttgttttggggaatttgatagttattgatgtgcatctgttaaactgatgacagacataactcatcattccccagaaaccttttttgattacagtatctaacattttgcctcctcttttttggttttgctggttataaaggtttggattggagagggctcactggatcccaatccttggagctggatcattggattcaaatcataatgtggataggatagggaggatgaattaccaggattcatggagcgggatcagattaccaggaacataggagtggattcctgccccaaccaaaccgcattcgtgtggatttttttattcaacttaattggctattccaaagattttttttttcctatttttgacgattggagcccttaagatgcacgatggaattgtgttttgcgttttttggtaaaaggagcaaagcgaggacctggagataaacgctggagcaatctccttggaaggattcagcacgagtagatggtaaacatttaaaggggaaagggggggtttgtttaaaatagtaaatcagtaagtcacttctaaatttaaagaaaacaaaattggagttgaagaataagtaggtttccaattggctattgccgttttctttgaaaaaataaacattttttaaaaaactatgcatggttgtcctttttcctcttcatgtaagattctaactgggtctatcagttaatctttaaattgttaagtaagataagattttgactcttgtgttaatgtgttagcaaattaaaagttcttaaaaggcaatctaatggtattagccatcttttattgttaattgtaaaagtcttcaggggaaagcaaaaggggagaataaggcatttgtgtatgtaacttggtaaatgacggtgggggatggatctagcatctgaaagataagcttctctactttgttataaagtggttaaaaaactatagatgctgcttattttctggtggtcatagacaacataggcttttgtgcaaaattggttgatggctactaatgttcacttggagatagcttttgatattctcaatgaaactcatctcaaaaaaaggtaagtattaaatgttaacatcagcacagatgtattagaactgttttttgtttttgagacagagtctcgctctgttctccagactggagggcagtggtgtgatctaggctcactgcaacctccacccctggatttgagtgattctcgtgcctcagtctcccaagtagctgagactacaagtgtgtgccacccttgcccggctaattttgtatttttagtagagatgtggtttctctgtgttacccaggctggtcccaaaactcctggcctcaagtgatctgcctgccttggcctcccaaagtgttaggattacaggtgtgagccaccatgctcagcctgtagaacttttaacccaagtctcatttcttttttgaaagggaagagtgcacaagattaactgcttctttggatgaatcattgttaataaaaagctgggcatttagaattttgccttataagcccttctccaaccataagattattttgtaccaaaaactttggtgttctctaccaaagcagttaaaaacttttagcctgctacttcttgtatttgtctactgacagccccttggtactatttaggttgggggaggggacctaaaataaatagactttaacatttcccttgggtgctaatcatagttggaagttgaatttaaggtgattatttgggtgacaattaaaaacctaaggaaaaccagaaatcttggtagtggaagaaatgtgtaaggtcaccccaatcggtagattttaatgaacgttgtggaatgttgggaagaggggatgttaagttgaatgcagaatttcactaagtacttagtgtaagtttaaggatgtagctctttttatctaagaattcaatgtaatggccaaaaggcagatttactgtttaaaaatttgaataattttacatgacattcttgaaattctaagaagttttatgtgtagaacattttaaaaattcatcagattattaaagggaaaataaatgattaatgataattttggaaggttaatgtgagctagacttaagtaaactttggttcatttgtgttcattgaatgttttggaaatgaccaaaaaatgtaaatggccttcactcaagtttgagtgtttaaagttgaaagatgtgctctactaaaagttatagtaattctaacctcacattgaaatgagacagtattccttgttatacaggctgaatttgaagattagagaggatctaatgtttacttaggtaaaggggcataggttttgtagttaagatgaccagacagctaaaagctgtgatgggaagtatggactgctcctatttatagtctcagaaaatggacctttaggtctctatccgtattggcaattattagaagaaagttacacccttttgaaactacaaaagctgtcttggaatttccccctcttctccctatttatgtccccttagaatattttagggagcctataattattttctaaccaaggaaaaacttaagtctctttaagaagcaattacttttcataacatcagattgaataacccaccttgctgttcagcccacatcctactggaaacaaaaggtaagaaacccattttctggttcttgattgtttgggtctgaattttgtttttaaaactaagctaagtttaatgttttttaaaatgctgtttggaatatgaatagattccccgtaaaatgatttttcctaagttttatgctttagtaaatattcagtgctcacgtctgtgcatcatagtgcttgcgtttaatatgatttattgtagaatctcaacttttcttggtgtttgttgtctttgaaacattgtcttggtcattagggctggtgttttcacatttctgtggtcaaggtggatttcttatgtgtgcctttttgcttactttgtatatgaattttgtaatttaaattgcaagtaagttatatatatgtatttaccataaatagtattaaaagatgagaaactgttagactgaagttctgttgtaacataaccattatttccatcacagtatgaagactgcaaacgcagaaaacagattacagtctcttatccattttttgaaatccaaaaactacgaaaacaaaagattttctgttgttgagctaattaaatgtgaaccctgaccagaattgctgccttcattttgcacttagtgtgactaaactgtttcctgttgaacttcattattcattgcacagttgccacagactttgctgagggttttatgtaatacagggtatatatgtacctcataaagtgcatacagctctgaatcccagatatgtctgtctccaaagagttcatataagggattgtaggaactgtactagcatacacaggcctaatgcttttgtctgtaactggggtgtcttgactgaaaaacctgttattgtgaatcctttgttgattgaattttaagttcccccatctttttaggctgaagcagccacaagaaaaaaaggtatggcccacatttctttacattctgttgtaatagtggactcaacaattatatcccattgaagcaaatactcaggcatcctagagtgtacaatacaacattcttttgagttattgtttctgtatcagtacttaaaggaacattgaccaattagatcctataggaaaagctgggattggcatgaagtaaagagattatcaggaaacatctgttcattatgtctatcgtgattgtctattgaatgaatagtaatgctgccaaaagtaacttgctttaaacaaaccccaagagattatagtatacttaaaccagtacttattcctgttattgagaccttcacggtgcttcttggtagctttgaaagctaatgcctaacaaccctgagggttcttgtgagcttgtagtgattaaaggaaggattttttaattattat

SEQ ID NO: 109769 - DNA, 2675 bp, Homo sapiens
  misc_feature (2614)..(2614): n is a, c, g, or t
ttccttcagcttctcttcctctgtctcccccccatatccgtgcgccgagctgataaaggcgccattttggaggggccgcgggagacgtggtgccgctgcgggctcgctctgccgtgcgctaggcttggtgggaaggcctgttctcgagtccgcgcttttcgtcaccgccatgtcgggaggtggtgtgattcgtggccccgcagggaacaacgattgccgcatctacgtgggtaacttacctccagacatccgaaccaaggacattgaggacgtgttctacaaatacggcgctatccgcgacatcgacctcaagaatcgccgcgggggaccgcccttcgccttcgttgagttcgaggacccgcgagacgcggaagacgcggtgtatggtcgcgacggctatgattacgatgggtaccgtctgcgggtggagtttcctcgaagcggccgtggaacaggccgaggcggcggcgggggtggaggtggcggagctccccgaggtcgctatggccccccatccaggcggtctgaaaacagagtggttgtctctggactgcctccaagtggaagttggcaggatttaaaggatcacatgcgtgaagcaggtgatgtatgttatgctgatgtttaccgagatggcactggtgtcgtggagtttgtacggaaagaagatatgacctatgcagttcgaaaactggataacactaagtttagatctcatgagggagaaactgcctacatccgggttaaagttgatgggcccagaagtccaagttatggaagatctcgatctcgaagccgtagtcgtagcagaagccgtagcagaagcaacagcaggagtcgcagttactccccaaggagaagcagaggatcaccacgctattctccccgtcatagcagatctcgctctcgtacataagatgattggtgacactttttgtagaacccatgttgtatacagttttcctttattcagtacaatcttttcattttttaattcaaactgttttgttcagaatgggctaaagtgttgaattgcattcttgtaatatccccttgctcctaacatctacattcccttcgtgtctttgataaattgtattttaagtgatgtcatagacaggattgtttaaatttagttaactccatactcttcagactgtgatattgtgtaaatgtctatctgccctggtttgtgtgaactgggatgttgggggtgtttgtggttatcttacctggggaagttcttatgtttatcttgcttttcatgtgtctttctgtagacatatctgaagagatggattaagaatgctttggattaaggattgtggagcacatttcaatcattttaggattgtcaaaaggaggattgaggaggatcagatcaataatggaggcaatggtatgactccaagtgctattgtcacagatgaaattggcagtattgaccttatactaaaaggcaggggttaaaaatgattatatacattttccttaaaacacttgcaaacattttattcagttgtctttagctacaattgctttgctttttaaaccttggcaattgtggcaaaattatattgcccattttgtagcaacttattttgctcccttccccccatttttgttttaatagggactaatgtgggaagaactggctaatttgtcacagtgcttagttacaactgttaatgtgtgacctgctgttggtgtacatgtgggtacagggtgtttttaaatccaacaagatagagtataatatcaatactgctaaatctgcatgtcctctgtgtgactgatagagcgttgctatttcatttttttaagacaaaatgaaagcaaaatatagagttccaatgtattggtgtagataatctagttgggaatacttttaagtctcaccttcccctttaaactaatattcataattggttcatatgtttaaaagactttaatttacaaattaaattgcaaatgggagcattagatttagttttagacttaggtgggtagcaatgccagtaaacttaaattacgtaacttcttgcaaccacgaaacctgtaatacgctgtacagtaacaagtgttggcattatcagttgaactgtaaatacaaaatgcttcttccaattagtctctatgatgattaagtttctaaaatttatctgaacaccattcagaaacttgttttggggaatttgatagttattgatgtgcatctgttaaactgatgacagacataactcatcattccccagaaaccttttttgattacagtatctaacattttgcctcctcttttttggttttgctggttataaaggtttggattggagagggctcactggatcccaatccttggagctggatcattggattcaaatcataatgtggataggatagggaggatgaattaccaggattcatggagcgggatcagattaccaggaacataggagtggattcctgccccaaccaaaccgcattcgtgtggatttttttattcaacttaattggctattccaaagattttttttttcctatttttgacgattggagcccttaagatgcacgatggaattgtgttttgcgttttttggtaaaaggagcaaaagancccaaagagcaaagacccacagcaaagcccccaaaagggatctctctatagatctccatcc

SEQ ID NO: 109770 - DNA, 2439 bp, Homo sapiens
ttccttcagcttctcttcctctgtctcccccccatatccgtgcgccgagctgataaaggcgccattttggaggggccgcgggagacgtggtgccgctgcgggctcgctctgccgtgcgctaggcttggtgggaaggcctgttctcgagtccgcgcttttcgtcaccgccatgtcgggaggtggtgtgattcgtggccccgcagggaacaacgattgccgcatctacgtgggtaacttacctccagacatccgaaccaaggacattgaggacgtgttctacaaatacggcgctatccgcgacatcgacctcaagaatcgccgcgggggaccgcccttcgccttcgttgagttcgaggacccgcgagacgcggaagacgcggtgtatggtcgcgacggctatgattacgatgggtaccgtctgcgggtggagtttcctcgaagcggccgtggaacaggccgaggcggcggcgggggtggaggtggcggagctccccgaggtcgctatggccccccatccaggcggtctgaaaacagagtggttgtctctggactgcctccaagtggaagttggcaggatttaaaggatcacatgcgtgaagcaggtgatgtatgttatgctgatgtttaccgagatggcactggtgtcgtggagtttgtacggaaagaagatatgacctatgcagttcgaaaactggataacactaagtttagatctcatgagggagaaactgcctacatccgggttaaagttgatgggcccagaagtccaagttatggaagatctcgatctcgaagccgtagtcgtagcagaagccgtagcagaagcaacagcaggagtcgcagttactccccaaggagaagcagaggatcaccacgctattctccccgtcatagcagatctcgctctcgtacataagatgattggtgacactttttgtagaacccatgttgtatacagttttcctttattcagtacaatcttttcattttttaattcaaactgttttgttcagaatgggctaaagtgttgaattgcattcttgtaatatccccttgctcctaacatctacattcccttcgtgtctttgataaattgtattttaagtgatgtcatagacaggattgtttaaatttagttaactccatactcttcagactgtgatattgtgtaaatgtctatctgccctggtttgtgtgaactgggatgttgggggtgtttgtggttatcttacctggggaagttcttatgtttatcttgcttttcatgtgtctttctgtagacatatctgaagagatggattaagaatgctttggattaaggattgtggagcacatttcaatcattttaggattgtcaaaaggaggattgaggaggatcagatcaataatggaggcaatggtatgactccaagtgctattgtcacagatgaaattggcagtattgaccttatactaaaaggcaggggttaaaaatgattatatacattttccttaaaacacttgcaaacattttattcagttgtctttagctacaattgctttgctttttaaaccttggcaattgtggcaaaattatattgcccattttgtagcaacttattttgctcccttccccccatttttgttttaatagggactaatgtgggaagaactggctaatttgtcacagtgcttagttacaactgttaatgtgtgacctgctgttggtgtacatgtgggtacagggtgtttttaaatccaacaagatagagtataatatcaatactgctaaatctgcatgtcctctgtgtgactgatagagcgttgctatttcatttttttaagacaaaatgaaagcaaaatatagagttccaatgtattggtgtagataatctagttgggaatacttttaagtctcaccttcccctttaaactaatattcataattggttcatatgtttaaaagactttaatttacaaattaaattgcaaatgggagcattagatttagttttagacttaggtgggtagcaatgccagtaaacttaaattacgtaacttcttgcaaccacgaaacctgtaatacgctgtacagtaacaagtgttggcattatcagttgaactgtaaatacaaaatgcttcttccaattagtctctatgatgattaagtttctaaaatttatctgaacaccattcagaaacttgttttggggaatttgatagttattgatgtgcatctgttaaactgatgacagacataactcatcattccccagaaaccttttttgattacagtatctaacattttgcctcctcttttttggttttgctggttaatctgatcccgctccatgaatcctggtaattcatcctccctatcctatccacattatgatttgaatccaatgatccagctccaaggattgggatccagtgagccctctccaatccaaaccttta

SEQ ID NO: 109771 - DNA, 1784 bp, Homo sapiens
ttccttcagcttctcttcctctgtctcccccccatatccgtgcgccgagctgataaaggcgccattttggaggggccgcgggagacgtggtgccgctgcgggctcgctctgccgtgcgctaggcttggtgggaaggcctgttctcgagtccgcgcttttcgtcaccgccatgtcgggaggtggtgtgattcgtggccccgcagggaacaacgattgccgcatctacgtgggtaacttacctccagacatccgaaccaaggacattgaggacgtgttctacaaatacggcgctatccgcgacatcgacctcaagaatcgccgcgggggaccgcccttcgccttcgttgagttcgaggacccgcgagacgcggaagacgcggtgtatggtcgcgacggctatgattacgatgggtaccgtctgcgggtggagtttcctcgaagcggccgtggaacaggccgaggcggcggcgggggtggaggtggcggagctccccgaggtcgctatggccccccatccaggcggtctgaaaacagagtggttgtctctggactgcctccaagtggaagttggcaggatttaaaggatcacatgcgtgaagcaggtgatgtatgttatgctgatgtttaccgagatggcactggtgtcgtggagtttgtacggaaagaagatatgacctatgcagttcgaaaactggataacactaagtttagatctcatgagggagaaactgcctacatccgggttaaagttgatgggcccagaagtccaagttatggaagatctcgatctcgaagccgtagtcgtagcagaagccgtagcagaagcaacagcaggagtcgcagttactccccaaggagaagcagaggatcaccacgctattctccccgtcatagcagatctcgctctcgtacataagatgattggtgacactttttgtagaacccatgttgtatacagttttcctttattcagtacaatcttttcattttttaattcaaactgttttgttcagaatgggctaaagtgttgaattgcattcttgtaatatccccttgctcctaacatctacattcccttcgtgtctttgataaattgtattttaagtgatgtcatagacaggattgtttaaatttagttaactccatactcttcagactgtgatattgtgtaaatgtctatctgccctggtttgtgtgaactgggatgttgggggtgtttgtggttatcttacctggggaagttcttatgtttatcttgcttttcatgtgtctttctgtagacatatctgaagagatggattaagaatgctttggattaaggattgtggagcacatttcaatcattttaggattgtcaaaaggaggattgaggaggatcagatcaataatggaggcaatggtatgactccaagtgctattgtcacagatgaaattggcagtattgaccttatactaaaaggcaggggttaaaaatgattatatacattttccttaaaacacttgcaaacattttattcagttgtctttagctacaattgctttgctttttaaaccttggcaattgtggcaaaattatattgcccattttgtagcaacttattttgctcccttccccccatttttgttttaatagggactaatgtgggaagaactggctaatttgtcacagtgcttagttacaactgttaatgtgtgacctgctgttggtgtacatgtgggtacacattaacagttgtaactaagcactgtgacaaacccacgcgtccggactagttctagatcgc

SEQ ID NO: 109772 - DNA, 4960 bp, Homo sapiens
ttccttcagcttctcttcctctgtctcccccccatatccgtgcgccgagctgataaaggcgccattttggaggggccgcgggagacgtggtgccgctgcgggctcgctctgccgtgcgctaggcttggtgggaaggcctgttctcgagtccgcgcttttcgtcaccgccatgtcgggaggtggtgtgattcgtggccccgcagggaacaacgattgccgcatctacgtgggtaacttacctccagacatccgaaccaaggacattgaggacgtgttctacaaatacggcgctatccgcgacatcgacctcaagaatcgccgcgggggaccgcccttcgccttcgttgagttcgaggacccgcgagacgcggaagacgcggtgtatggtcgcgacggctatgattacgatgggtaccgtctgcgggtggagtttcctcgaagcggccgtggaacaggccgaggcggcggcgggggtggaggtggcggagctccccgaggtcgctatggccccccatccaggcggtctgaaaacagagtggttgtctctggactgcctccaagtggaagttggcaggatttaaaggatcacatgcgtgaagcaggtgatgtatgttatgctgatgtttaccgagatggcactggtgtcgtggagtttgtacggaaagaagatatgacctatgcagttcgaaaactggataacactaagtttagatctcatgagggagaaactgcctacatccgggttaaagttgatgggcccagaagtccaagttatggaagatctcgatctcgaagccgtagtcgtagcagaagccgtagcagaagcaacagcaggagtcgcagttactccccaaggagaagcagaggatcaccacgctattctccccgtcatagcagatctcgctctcgtacataagatgattggtgacactttttgtagaacccatgttgtatacagttttcctttattcagtacaatcttttcattttttaattcaaactgttttgttcagaatgggctaaagtgttgaattgcattcttgtaatatccccttgctcctaacatctacattcccttcgtgtctttgataaattgtattttaagtgatgtcatagacaggattgtttaaatttagttaactccatactcttcagactgtgatattgtgtaaatgtctatctgccctggtttgtgtgaactgggatgttgggggtgtttgtggttatcttacctggggaagttcttatgtttatcttgcttttcatgtgtctttctgtagacatatctgaagagatggattaagaatgctttggattaaggattgtggagcacatttcaatcattttaggattgtcaaaaggaggattgaggaggatcagatcaataatggaggcaatgaagcgaggacctggagataaacgctggagcaatctccttggaaggattcagcacgagtagatggtaaacatttaaaggggaaagggggggtttgtttaaaatagtaaatcagtaagtcacttctaaatttaaagaaaacaaaattggagttgaagaataagtaggtttccaattggctattgccgttttctttgaaaaaataaacattttttaaaaaactatgcatggttgtcctttttcctcttcatgtaagattctaactgggtctatcagttaatctttaaattgttaagtaagataagattttgactcttgtgttaatgtgttagcaaattaaaagttcttaaaaggcaatctaatggtattagccatcttttattgttaattgtaaaagtcttcaggggaaagcaaaaggggagaataaggcatttgtgtatgtaacttggtaaatgacggtgggggatggatctagcatctgaaagataagcttctctactttgttataaagtggttaaaaaactatagatgctgcttattttctggtggtcatagacaacataggcttttgtgcaaaattggttgatggctactaatgttcacttggagatagcttttgatattctcaatgaaactcatctcaaaaaaaggtaagtattaaatgttaacatcagcacagatgtattagaactgttttttgtttttgagacagagtctcgctctgttctccagactggagggcagtggtgtgatctaggctcactgcaacctccacccctggatttgagtgattctcgtgcctcagtctcccaagtagctgagactacaagtgtgtgccacccttgcccggctaattttgtatttttagtagagatgtggtttctctgtgttacccaggctggtcccaaaactcctggcctcaagtgatctgcctgccttggcctcccaaagtgttaggattacaggtgtgagccaccatgctcagcctgtagaacttttaacccaagtctcatttcttttttgaaagggaagagtgcacaagattaactgcttctttggatgaatcattgttaataaaaagctgggcatttagaattttgccttataagcccttctccaaccataagattattttgtaccaaaaactttggtgttctctaccaaagcagttaaaaacttttagcctgctacttcttgtatttgtctactgacagccccttggtactatttaggttgggggaggggacctaaaataaatagactttaacatttcccttgggtgctaatcatagttggaagttgaatttaaggtgattatttgggtgacaattaaaaacctaaggaaaaccagaaatcttggtagtggaagaaatgtgtaaggtcaccccaatcggtagattttaatgaacgttgtggaatgttgggaagaggggatgttaagttgaatgcagaatttcactaagtacttagtgtaagtttaaggatgtagctctttttatctaagaattcaatgtaatggccaaaaggcagatttactgtttaaaaatttgaataattttacatgacattcttgaaattctaagaagttttatgtgtagaacattttaaaaattcatcagattattaaagggaaaataaatgattaatgataattttggaaggttaatgtgagctagacttaagtaaactttggttcatttgtgttcattgaatgttttggaaatgaccaaaaaatgtaaatggccttcactcaagtttgagtgtttaaagttgaaagatgtgctctactaaaagttatagtaattctaacctcacattgaaatgagacagtattccttgttatacaggctgaatttgaagattagagaggatctaatgtttacttaggtaaaggggcataggttttgtagttaagatgaccagacagctaaaagctgtgatgggaagtatggactgctcctatttatagtctcagaaaatggacctttaggtctctatccgtattggcaattattagaagaaagttacacccttttgaaactacaaaagctgtcttggaatttccccctcttctccctatttatgtccccttagaatattttagggagcctataattattttctaaccaaggaaaaacttaagtctctttaagaagcaattacttttcataacatcagattgaataacccaccttgctgttcagcccacatcctactggaaacaaaaggtaagaaacccattttctggttcttgattgtttgggtctgaattttgtttttaaaactaagctaagtttaatgttttttaaaatgctgtttggaatatgaatagattccccgtaaaatgatttttcctaagttttatgctttagtaaatattcagtgctcacgtctgtgcatcatagtgcttgcgtttaatatgatttattgtagaatctcaacttttcttggtgtttgttgtctttgaaacattgtcttggtcattagggctggtgttttcacatttctgtggtcaaggtggatttcttatgtgtgcctttttgcttactttgtatatgaattttgtaatttaaattgcaagtaagttatatatatgtatttaccataaatagtattaaaagatgagaaactgttagactgaagttctgttgtaacataaccattatttccatcacagtatgaagactgcaaacgcagaaaacagattacagtctcttatccattttttgaaatccaaaaactacgaaaacaaaagattttctgttgttgagctaattaaatgtgaaccctgaccagaattgctgccttcattttgcacttagtgtgactaaactgtttcctgttgaacttcattattcattgcacagttgccacagactttgctgagggttttatgtaatacagggtatatatgtacctcataaagtgcatacagctctgaatcccagatatgtctgtctccaaagagttcatataagggattgtaggaactgtactagcatacacaggcctaatgcttttgtctgtaactggggtgtcttgactgaaaaacctgttattgtgaatcctttgttgattgaattttaagttcccccatctttttaggctgaagcagccacaagaaaaaaaggtatggcccacatttctttacattctgttgtaatagtggactcaacaattatatcccattgaagcaaatactcaggcatcctagagtgtacaatacaacattcttttgagttattgtttctgtatcagtacttaaaggaacattgaccaattagatcctataggaaaagctgggattggcatgaagtaaagagattatcaggaaacatctgttcattatgtctatcgtgattgtctattgaatgaatagtaatgctgccaaaagtaacttgctttaaacaaaccccaagagattatagtatacttaaaccagtacttattcctgttattgagaccttcacggtgcttcttggtagctttgaaagctaatgcctaacaaccctgagggttcttgtgagcttgtagtgattaaaggaaggattttttaattattat

SEQ ID NO: 109773 - DNA, 1615 bp, Homo sapiens
ttccttcagcttctcttcctctgtctcccccccatatccgtgcgccgagctgataaaggcgccattttggaggggccgcgggagacgtggtgccgctgcgggctcgctctgccgtgcgctaggcttggtgggaaggcctgttctcgagtccgcgcttttcgtcaccgccatgtcgggaggtggtgtgattcgtggccccgcagggaacaacgattgccgcatctacgtgggtaacttacctccagacatccgaaccaaggacattgaggacgtgttctacaaatacggcgctatccgcgacatcgacctcaagaatcgccgcgggggaccgcccttcgccttcgttgagttcgaggacccgcgagacgcggaagacgcggtgtatggtcgcgacggctatgattacgatgggtaccgtctgcgggtggagtttcctcgaagcggccgtggaacaggccgaggcggcggcgggggtggaggtggcggagctccccgaggtcgctatggccccccatccaggcggtctgaaaacagagtggttgtctctggactgcctccaagtggaagttggcaggatttaaaggatcacatgcgtgaagcaggtgatgtatgttatgctgatgtttaccgagatggcactggtgtcgtggagtttgtacggaaagaagatatgacctatgcagttcgaaaactggataacactaagtttagatctcatgagggagaaactgcctacatccgggttaaagttgatgggcccagaagtccaagttatggaagatctcgatctcgaagccgtagtcgtagcagaagccgtagcagaagcaacagcaggagtcgcagttactccccaaggagaagcagaggatcaccacgctattctccccgtcatagcagatctcgctctcgtacataagatgattggtgacactttttgtagaacccatgttgtatacagttttcctttattcagtacaatcttttcattttttaattcaaactgttttgttcagaatgggctaaagtgttgaattgcattcttgtaatatccccttgctcctaacatctacattcccttcgtgtctttgataaattgtattttaagtgatgtcatagacaggattgtttaaatttagttaactccatactcttcagactgtgatattgtgtaaatgtctatctgccctggtttgtgtgaactgggatgttgggggtgtttgtggttatcttacctggggaagttcttatgtttatcttgcttttcatgtgtctttctgtagacatatctgaagagatggattaagaatgctttggattaaggattgtggagcacatttcaatcattttaggattgtcaaaaggaggattgaggaggatcagatcaataatggaggcaatgaagcgaggacctggagataaacgctggagcaatctccttggaaggattcagcacgagtagatggtaaacatttaaaggggaaagggggggtttgtttaaaatagtaaatcagtaagtcacttctaaatttaaagaaaacaaaattggagttgaagaataagtaggtttccaattggctattgccgttttctttgaaaaaataaacattttttaaaa

SEQ ID NO: 109774 - DNA, 1104 bp, Homo sapiens
ttccttcagcttctcttcctctgtctcccccccatatccgtgcgccgagctgataaaggcgccattttggaggggccgcgggagacgtggtgccgctgcgggctcgctctgccgtgcgctaggcttggtgggaaggcctgttctcgagtccgcgcttttcgtcaccgccatgtcgggaggtggtgtgattcgtggccccgcagggaacaacgattgccgcatctacgtgggtaacttacctccagacatccgaaccaaggacattgaggacgtgttctacaaatacggcgctatccgcgacatcgacctcaagaatcgccgcgggggaccgcccttcgccttcgttgagttcgaggacccgcgagacgcggaagacgcggtgtatggtcgcgacggctatgattacgatgggtaccgtctgcgggtggagtttcctcgaagcggccgtggaacaggccgaggcggcggcgggggtggaggtggcggagctccccgaggtcgctatggccccccatccaggcggtctgaaaacagagtggttgtctctggactgcctccaagtggaagttggcaggatttaaaggatcacatgcgtgaagcaggtgatgtatgttatgctgatgtttaccgagatggcactggtgtcgtggagtttgtacggaaagaagatatgacctatgcagttcgaaaactggataacactaagtttagatctcatgaggctgaccggttccctgatgtgttacctgcttctgctactgatccaaactgcagaacttctcattcatccccaaggcctccaggcagtatccaatggggaatcagctctaaaaggaaccagaccaacgttttccagccccttcattctgtagcttccctctgtgtgaggaaaggatagaaatgttcaggacatcatcatacaggctcctcatctacaaagttccagtagcagtgacgcctacacggaagacttggaactgcaaacaggctggggtcacctcagtgacatctgacgctgtccaaccagaagttcgatttttgttctgggggtgaaggaggaaacagactgtactaaaggactaaaataatttcttgtctatacta

SEQ ID NO: 109775 - DNA, 992 bp, Homo sapiens
ttccttcagcttctcttcctctgtctcccccccatatccgtgcgccgagctgataaaggcgccattttggaggggccgcgggagacgtggtgccgctgcgggctcgctctgccgtgcgctaggcttggtgggaaggcctgttctcgagtccgcgcttttcgtcaccgccatgtcgggaggtggtgtgattcgtggccccgcagggaacaacgattgccgcatctacgtgggtaacttacctccagacatccgaaccaaggacattgaggacgtgttctacaaatacggcgctatccgcgacatcgacctcaagaatcgccgcgggggaccgcccttcgccttcgttgagttcgaggacccgcgagacgcggaagacgcggtgtatggtcgcgacggctatgattacgatgggtaccgtctgcgggtggagtttcctcgaagcggccgtggaacaggccgaggcggcggcgggggtggaggtggcggagctccccgaggtcgctatggccccccatccaggcggtctgaaaacagagtggttgtctctggactgcctccaagtggaagttggcaggatttaaaggatcacatgcgtgaagcaggtgatgtatgttatgctgatgtttaccgagatggcactggtgtcgtggagtttgtacggaaagaagatatgacctatgcagttcgaaaactggataacactaagtttagatctcatgaggctgaccggttccctgatgtgttacctgcttctgctactgatccaaactgcagaacttctcattcatccccaaggcctccaggcagtatccaatggggaatcagctctaaaaggaaccagaccaacgttttccagccccttcattctgtagcttccctctgtgtgaggaaaggatagaaatgttcaggacatcatcatacaggctcctcatctacaaagttccagtagcagtgacccagtgacttcctcatcccggatcctctagatcact

SEQ ID NO: 109776 - DNA, 3678 bp, Homo sapiens
tcaaggtcaagaaacatcctttaaaaagttaattcccttttctggagcctaagccagatcttatctaggccttgtgttgccatctgttagcattgatttctggaatggagcagctttctcaaagtttggtcttgctagtcatgaggtcatgtcagtgtcttaggtcactgctgctcaccttccttacccagggagtatactgcataggtttctgaacacctgttttcattattcactgttcctctcactgccaagaatggagggaccctcagttgaagatcaaattgactctgaagaaaaactggagatgtttctcttggagtttggatagagtattcacttgataacatgtttttcccctgccttgctcttcacaagaacatctggccaggcattaacaattagtaaatttttttgcatatgaacagtatttttctggtcatgtagatgggtgcacatgacactaaacagcattgtttagtgttatccctcttaactggtgggttgtatttggggtggaggctgtagccgaggagaagacattcacctctgtactcgagaaactttgtgtaggaatttagtttatttttttattttttttaattttttattttttactacttttactgttagcacaatgctataattgagctaatctttgtagtttggtgcaggaccaccaagtttgtgtgacccattacctactttttccatgctcagcccattacccctgtcctggggcatctgagggcagtaaggaacaggtgtccaaaggaggaatgttggtgcctatgagtatgttttccagttgtattgaatttcttacttggtgtatttttgacttgtcttagtttctttccttgtggtctatgctattttacttgcgatttgttggatattctccctgtcattaaagagttgtaaaatggaagttagtttctctatgcaaatgctttaatggatgaagctgataggtttagcattgatttttgctggtgtccttcaacaagcatgaaggtgataaatgtgtttccatggctttagactcatttttgaagtcttggattgtgtgaacattcttagaaacaataaaatgttttaattaaaagccctcgactaccagctgaattcagtgtctactaggaaaatgggtagatttgttacattgtccctttgctctctatgactttgttccagttgtcaaggaacttaaatgggtattcaggaaaaagaattcttgtttccctttcctcaccttgccagttaaataactcctggtgacacttcaggtggtagaattgaaacacaaacctgacttctgaccacatgggtcaaaggcaaaaggcaaatggcttcaaagcccttagtgtgcttatccagttcaggcagtgaggagataacctctgctttcctccctgaggagtttggagtatttaaggggggatggggggggtgtcactttgaaaatatgttgctttttctcctgattgtattgaggctgatatggaagggttatttctttctggccaatactttttggtatttctaaatattgcaatcttgatttttactattaaatttgttaattgtcagttctggcttttttgcataaagagttggtccattaacttgccaatttgaagcttctaactagatattccctactgaaagttttggatttgtttttagtttgtggagcagtcttagctggggacaggtaattgacaacggcagagatactttcttttcctaggattctaagtctgtaatccacatcctcaatgtattcacaggactttaaaattctctccaaatgaggaaggaaatatcctgttgctttctaatgtttactaaaagttgtgtttagaacaacagattttaataggcatcttcctttgttatgtgtcattagccctttgcccgtttaccttagggctctttgaaggagaaatggatgggagaaaacctgtcacttggcgaaagtaaaagggataattaactggctcagagcttatgtgcagagttccaagccccaaagttaatctagaaccactcgataacaccaataaaaatatttatttcacatctgttatatatctggaaaatgttctaagcatcttacacatatttctcattaaatccacaggtgaccattgtgaggtagatattttgttctaattttccagatgaggaagctgagaccctaaaaggttaggtgacaggttatacaacttggagtgtgggaggaggagagaggaacctgaacagggcaagttggggatctgacttttgtttgggtagatgtaggcacattgtatttttggcttagatgctttattcatcatggctgaaggtaataccatttactcactcaccgaaaattgtttacaataatctagatgaatttgctgtctttggacatctgtcttttgactggaccccagtatatagtctgtggaagctcacttaaggagagagctcctttttgtttggttagagaaattttctgtcctaaaagtagaaatagccccttctaggtaaggatggagcatttgatcatactggtttcattatattcctctaacagttggaaccgattgtttttgagtacttgtttcaaacttctgagtattttccttctggaaaatagctcagtgtttaaaatttacatgaacttaaaaggttaatttttttttaaagaatgtttgaggagcaatcaattctgattttgtcttatggatagaaatagaattagccattttcctcaagaaaagtgattcttctgaatcttagcttttcagtaatgagaactggactgtttccacttgacctctatttcctgttagtgggaaaccgcttcccagaggtgctgtgtgaaagattgctggggaaagggtttctagatcccagcataacaagttcaagagtccagcgatattgtcattagaataatggtcttcattaagtactagttttcataatcctgaagcttcattttcaccaatttgaaaggcagctagggaggagaagactatgcagggaaggaggaaaactctggagtgcatcacagagaccttgagtgagttaaggcagggaagaagcagatttgctatccactgaatgaaaataagaagaattccattgtccaaggtcagagcaagaacacaaaggttttagtttacttagttaattccttaggtttggacattacaggagacatgggggtgaccatagcaatttagctgataaatgtatcagaaactctttcatcattttctgtcccctcctatcttaggctgaccggttccctgatgtgttacctgcttctgctactgatccaaactgcagaacttctcattcatccccaaggcctccaggcagtatccaatggggaatcagctctaaaaggaaccagaccaacgttttccagccccttcattctgtagcttccctctgtgtgaggaaaggatagaaatgttcaggacatcatcatacaggctcctcatctacaaagttccagtagcagtgacgcctacacggaagacttggaactgcaaacaggctggggtcacctcagtgacatctgacgctgtccaaccagaagttcgatttttgttctgggggtgaaggaggaaacagactgtactaaaggactaaaataatttcttgtctatacta

SEQ ID NO: 109777 - DNA, 2593 bp, Homo sapiens
tcaaggtcaagaaacatcctttaaaaagttaattcccttttctggagcctaagccagatcttatctaggccttgtgttgccatctgttagcattgatttctggaatggagcagctttctcaaagtttggtcttgctagtcatgaggtcatgtcagtgtcttaggtcactgctgctcaccttccttacccagggagtatactgcataggtttctgaacacctgttttcattattcactgttcctctcactgccaagaatggagggaccctcagttgaagatcaaattgactctgaagaaaaactggagatgtttctcttggagtttggatagagtattcacttgataacatgtttttcccctgccttgctcttcacaagaacatctggccaggcattaacaattagtaaatttttttgcatatgaacagtatttttctggtcatgtagatgggtgcacatgacactaaacagcattgtttagtgttatccctcttaactggtgggttgtatttggggtggaggctgtagccgaggagaagacattcacctctgtactcgagaaactttgtgtaggaatttagtttatttttttattttttttaattttttattttttactacttttactgttagcacaatgctataattgagctaatctttgtagtttggtgcaggaccaccaagtttgtgtgacccattacctactttttccatgctcagcccattacccctgtcctggggcatctgagggcagtaaggaacaggtgtccaaaggaggaatgttggtgcctatgagtatgttttccagttgtattgaatttcttacttggtgtatttttgacttgtcttagtttctttccttgtggtctatgctattttacttgcgatttgttggatattctccctgtcattaaagagttgtaaaatggaagttagtttctctatgcaaatgctttaatggatgaagctgataggtttagcattgatttttgctggtgtccttcaacaagcatgaaggtgataaatgtgtttccatggctttagactcatttttgaagtcttggattgtgtgaacattcttagaaacaataaaatgttttaattaaaagccctcgactaccagctgaattcagtgtctactaggaaaatgggtagatttgttacattgtccctttgctctctatgactttgttccagttgtcaaggaacttaaatgggtattcaggaaaaagaattcttgtttccctttcctcaccttgccagttaaataactcctggtgacacttcaggtggtagaattgaaacacaaacctgacttctgaccacatgggtcaaaggcaaaaggcaaatggcttcaaagcccttagtgtgcttatccagttcaggcagtgaggagataacctctgctttcctccctgaggagtttggagtatttaaggggggatggggggggtgtcactttgaaaatatgttgctttttctcctgattgtattgaggctgatatggaagggttatttctttctggccaatactttttggtatttctaaatattgcaatcttgatttttactattaaatttgttaattgtcagttctggcttttttgcataaagagttggtccattaacttgccaatttgaagcttctaactagatattccctactgaaagttttggatttgtttttagtttgtggagcagtcttagctggggacaggtaattgacaacggcagagatactttcttttcctaggattctaagtctgtaatccacatcctcaatgtattcacaggactttaaaattctctccaaatgaggaaggaaatatcctgttgctttctaatgtttactaaaagttgtgtttagaacaacagattttaataggcatcttcctttgttatgtgtcattagccctttgcccgtttaccttagggctctttgaaggagaaatggatgggagaaaacctgtcacttggcgaaagtaaaagggataattaactggctcagagcttatgtgcagagttccaagccccaaagttaatctagaaccactcgataacaccaataaaaatatttatttcacatctgttatatatctggaaaatgttctaagcatcttacacatatttctcattaaatccacaggtgaccattgtgaggtagatattttgttctaattttccagatgaggaagctgagaccctaaaaggctgaccggttccctgatgtgttacctgcttctgctactgatccaaactgcagaacttctcattcatccccaaggcctccaggcagtatccaatggggaatcagctctaaaaggaaccagaccaacgttttccagccccttcattctgtagcttccctctgtgtgaggaaaggatagaaatgttcaggacatcatcatacaggctcctcatctacaaagttccagtagcagtgacgcctacacggaagacttggaactgcaaacaggctggggtcacctcagtgacatctgacgctgtccaaccagaagttcgatttttgttctgggggtgaaggaggaaacagactgtactaaaggactaaaataatttcttgtctatacta

SEQ ID NO: 109778 - DNA, 4057 bp, Homo sapiens
tcaaggtcaagaaacatcctttaaaaagttaattcccttttctggagcctaagccagatcttatctaggccttgtgttgccatctgttagcattgatttctggaatggagcagctttctcaaagtttggtcttgctagtcatgaggtcatgtcagtgtcttaggtcactgctgctcaccttccttacccagggagtatactgcataggtttctgaacacctgttttcattattcactgttcctctcactgccaagaatggagggaccctcagttgaagatcaaattgactctgaagaaaaactggagatgtttctcttggagtttggatagagtattcacttgataacatgtttttcccctgccttgctcttcacaagaacatctggccaggcattaacaattagtaaatttttttgcatatgaacagtatttttctggtcatgtagatgggtgcacatgacactaaacagcattgtttagtgttatccctcttaactggtgggttgtatttggggtggaggctgtagccgaggagaagacattcacctctgtactcgagaaactttgtgtaggaatttagtttatttttttattttttttaattttttattttttactacttttactgttagcacaatgctataattgagctaatctttgtagtttggtgcaggaccaccaagtttgtgtgacccattacctactttttccatgctcagcccattacccctgtcctggggcatctgagggcagtaaggaacaggtgtccaaaggaggaatgttggtgcctatgagtatgttttccagttgtattgaatttcttacttggtgtatttttgacttgtcttagtttctttccttgtggtctatgctattttacttgcgatttgttggatattctccctgtcattaaagagttgtaaaatggaagttagtttctctatgcaaatgctttaatggatgaagctgataggtttagcattgatttttgctggtgtccttcaacaagcatgaaggtgataaatgtgtttccatggctttagactcatttttgaagtcttggattgtgtgaacattcttagaaacaataaaatgttttaattaaaagccctcgactaccagctgaattcagtgtctactaggaaaatgggtagatttgttacattgtccctttgctctctatgactttgttccagttgtcaaggaacttaaatgggtattcaggaaaaagaattcttgtttccctttcctcaccttgccagttaaataactcctggtgacacttcaggtggtagaattgaaacacaaacctgacttctgaccacatgggtcaaaggcaaaaggcaaatggcttcaaagcccttagtgtgcttatccagttcaggcagtgaggagataacctctgctttcctccctgaggagtttggagtatttaaggggggatggggggggtgtcactttgaaaatatgttgctttttctcctgattgtattgaggctgatatggaagggttatttctttctggccaatactttttggtatttctaaatattgcaatcttgatttttactattaaatttgttaattgtcagttctggcttttttgcataaagagttggtccattaacttgccaatttgaagcttctaactagatattccctactgaaagttttggatttgtttttagtttgtggagcagtcttagctggggacaggtaattgacaacggcagagatactttcttttcctaggattctaagtctgtaatccacatcctcaatgtattcacaggactttaaaattctctccaaatgaggaaggaaatatcctgttgctttctaatgtttactaaaagttgtgtttagaacaacagattttaataggcatcttcctttgttatgtgtcattagccctttgcccgtttaccttagggctctttgaaggagaaatggatgggagaaaacctgtcacttggcgaaagtaaaagggataattaactggctcagagcttatgtgcagagttccaagccccaaagttaatctagaaccactcgataacaccaataaaaatatttatttcacatctgttatatatctggaaaatgttctaagcatcttacacatatttctcattaaatccacaggtgaccattgtgaggtagatattttgttctaattttccagatgaggaagctgagaccctaaaaggttaggtgacaggttatacaacttggagtgtgggaggaggagagaggaacctgaacagggcaagttggggatctgacttttgtttgggtagatgtaggcacattgtatttttggcttagatgctttattcatcatggctgaaggtaataccatttactcactcaccgaaaattgtttacaataatctagatgaatttgctgtctttggacatctgtcttttgactggaccccagtatatagtctgtggaagctcacttaaggagagagctcctttttgtttggttagagaaattttctgtcctaaaagtagaaatagccccttctaggtaaggatggagcatttgatcatactggtttcattatattcctctaacagttggaaccgattgtttttgagtacttgtttcaaacttctgagtattttccttctggaaaatagctcagtgtttaaaatttacatgaacttaaaaggttaatttttttttaaagaatgtttgaggagcaatcaattctgattttgtcttatggatagaaatagaattagccattttcctcaagaaaagtgattcttctgaatcttagcttttcagtaatgagaactggactgtttccacttgacctctatttcctgttagtgggaaaccgcttcccagaggtgctgtgtgaaagattgctggggaaagggtttctagatcccagcataacaagttcaagagtccagcgatattgtcattagaataatggtcttcattaagtactagttttcataatcctgaagcttcattttcaccaatttgaaaggcagctagggaggagaagactatgcagggaaggaggaaaactctggagtgcatcacagagaccttgagtgagttaaggcagggaagaagcagatttgctatccactgaatgaaaataagaagaattccattgtccaaggtcagagcaagaacacaaaggttttagtttacttagttaattccttaggtttggacattacaggagacatgggggtgaccatagcaatttagctgataaatgtatcagaaactctttcatcattttctgtcccctcctatcttaggctgaccggttccctgatgtgttacctgcttctgctactgatccaaactgcagaacttctcattcatccccaaggcctccaggcagtatccaatggggaatcagctctaaaaggaaccagaccaacgttttccagccccttcattctggtgactgaggggaggaaagaatgggagggggtattcttgtctagtggatggaaaggaaacacactgtcaaattactatatctccttggttttctattacagtagaattctccagccatatttttattgtctatgggggaagttggagatggtgaccttgattagaagtgtctggagggggataaatggaggggataagattcagttggttttggaaaatgttaaagtcttaaaataatgcgtccatctgaagaattttttctaaaaccagagtttataaaaatatcactgatacagcctgccccctcatttccctgccacaggagatgtcttggactagagacacttgtttaataatagcttgtctctgatattcccagtagcttccctctgtgtgaggaaaggatagaaatgttcaggacatcatcatacaggctcctcatctacaaagttccagtagcagtgacgcctacacggaagacttggaactgcaaacaggctggggtcacctcagtgacatctgacgctgtccaaccagaagttcgatttttgttctgggggtgaaggaggaaacagactgtactaaaggactaaaataatttcttgtctatacta

SEQ ID NO: 109779 - DNA, 3413 bp, Homo sapiens
tcaaggtcaagaaacatcctttaaaaagttaattcccttttctggagcctaagccagatcttatctaggccttgtgttgccatctgttagcattgatttctggaatggagcagctttctcaaagtttggtcttgctagtcatgaggtcatgtcagtgtcttaggtcactgctgctcaccttccttacccagggagtatactgcataggtttctgaacacctgttttcattattcactgttcctctcactgccaagaatggagggaccctcagttgaagatcaaattgactctgaagaaaaactggagatgtttctcttggagtttggatagagtattcacttgataacatgtttttcccctgccttgctcttcacaagaacatctggccaggcattaacaattagtaaatttttttgcatatgaacagtatttttctggtcatgtagatgggtgcacatgacactaaacagcattgtttagtgttatccctcttaactggtgggttgtatttggggtggaggctgtagccgaggagaagacattcacctctgtactcgagaaactttgtgtaggaatttagtttatttttttattttttttaattttttattttttactacttttactgttagcacaatgctataattgagctaatctttgtagtttggtgcaggaccaccaagtttgtgtgacccattacctactttttccatgctcagcccattacccctgtcctggggcatctgagggcagtaaggaacaggtgtccaaaggaggaatgttggtgcctatgagtatgttttccagttgtattgaatttcttacttggtgtatttttgacttgtcttagtttctttccttgtggtctatgctattttacttgcgatttgttggatattctccctgtcattaaagagttgtaaaatggaagttagtttctctatgcaaatgctttaatggatgaagctgataggtttagcattgatttttgctggtgtccttcaacaagcatgaaggtgataaatgtgtttccatggctttagactcatttttgaagtcttggattgtgtgaacattcttagaaacaataaaatgttttaattaaaagccctcgactaccagctgaattcagtgtctactaggaaaatgggtagatttgttacattgtccctttgctctctatgactttgttccagttgtcaaggaacttaaatgggtattcaggaaaaagaattcttgtttccctttcctcaccttgccagttaaataactcctggtgacacttcaggtggtagaattgaaacacaaacctgacttctgaccacatgggtcaaaggcaaaaggcaaatggcttcaaagcccttagtgtgcttatccagttcaggcagtgaggagataacctctgctttcctccctgaggagtttggagtatttaaggggggatggggggggtgtcactttgaaaatatgttgctttttctcctgattgtattgaggctgatatggaagggttatttctttctggccaatactttttggtatttctaaatattgcaatcttgatttttactattaaatttgttaattgtcagttctggcttttttgcataaagagttggtccattaacttgccaatttgaagcttctaactagatattccctactgaaagttttggatttgtttttagtttgtggagcagtcttagctggggacaggtaattgacaacggcagagatactttcttttcctaggattctaagtctgtaatccacatcctcaatgtattcacaggactttaaaattctctccaaatgaggaaggaaatatcctgttgctttctaatgtttactaaaagttgtgtttagaacaacagattttaataggcatcttcctttgttatgtgtcattagccctttgcccgtttaccttagggctctttgaaggagaaatggatgggagaaaacctgtcacttggcgaaagtaaaagggataattaactggctcagagcttatgtgcagagttccaagccccaaagttaatctagaaccactcgataacaccaataaaaatatttatttcacatctgttatatatctggaaaatgttctaagcatcttacacatatttctcattaaatccacaggtgaccattgtgaggtagatattttgttctaattttccagatgaggaagctgagaccctaaaaggttaggtgacaggttatacaacttggagtgtgggaggaggagagaggaacctgaacagggcaagttggggatctgacttttgtttgggtagatgtaggcacattgtatttttggcttagatgctttattcatcatggctgaaggtaataccatttactcactcaccgaaaattgtttacaataatctagatgaatttgctgtctttggacatctgtcttttgactggaccccagtatatagtctgtggaagctcacttaaggagagagctcctttttgtttggttagagaaattttctgtcctaaaagtagaaatagccccttctaggtaaggatggagcatttgatcatactggtttcattatattcctctaacagttggaaccgattgtttttgagtacttgtttcaaacttctgagtattttccttctggaaaatagctcagtgtttaaaatttacatgaacttaaaaggttaatttttttttaaagaatgtttgaggagcaatcaattctgattttgtcttatggatagaaatagaattagccattttcctcaagaaaagtgattcttctgaatcttagcttttcagtaatgagaactggactgtttccacttgacctctatttcctgttagtgggaaaccgcttcccagaggtgctgtgtgaaagattgctggggaaagggtttctagatcccagcataacaagttcaagagtccagcgatattgtcattagaataatggtcttcattaagtactagttttcataatcctgaagcttcattttcaccaatttgaaaggcagctagggaggagaagactatgcagggaaggaggaaaactctggagtgcatcacagagaccttgagtgagttaaggcagggaagaagcagatttgctatccactgaatgaaaataagaagaattccattgtccaaggtcagagcaagaacacaaaggttttagtttacttagttaattccttaggtttggacattacaggagacatgggggtgaccatagcaatttagctgataaatgtatcagaaactctttcatcattttctgtcccctcctatcttaggctgaccggttccctgatgtgttaccttgttttggttccggacccactgcggaaacattttttttttcccaagggcttacgggggtttcaaggggaaaaaaacttttaaaggacacca

SEQ ID NO: 109780 - DNA, 1561 bp, Homo sapiens
ggactcttcatgtgcttttcttaactgattagagttaacacctcagctaaagtgtatagaacatacatggggcttcatcaggcttcagaatcagtttcactagatgtgctatgtaggaggccacggaaaaattactgtagtagtaaaagttatcagttctgatgtaaacaatcattttgtcccatattataaataaattggcctgaaaatatcttttcatatgtgaggaataagtatatgatgcctttctcctttaaagtatgaactgctaaaagacagggataacgtgtattctgtattccagcagccacagtgtgtttctggtctttgtaccaggtgctcaggaagtgttttcactggcttgggttgactacttgccatctgctctctgagcattcatttctgaatgaaaggggagaaagtgaaaggagaggtgggaagaaagaggaagctgcagaaatacgaggaaacagctggaggagggaggtgaagttgaggaggtaaggtcagtaaaacaaaaagctagcagagggcagggtcaggcccttggggtagagggctaattaacttctgtcagctagttgaatagagccttgtgtgctttgttagagaccaaaggtacttcaaaggaaaaaaatctagattcttccctgtgtaccttaataattgttcatcaggtcaaaatctatcctgtcctctaggaattctggtcttccctcaggcctagcagagagctttctgccactactcaggcaaccaagggtgaagtgcttcaagtagtatttgtggacagcagcaggctgaccggttccctgatgtgttacctgcttctgctactgatccaaactgcagaacttctcattcatccccaaggcctccaggcagtatccaatggggaatcagctctaaaaggaaccagaccaacgttttccagccccttcattctggtgactgaggggaggaaagaatgggagggggtattcttgtctagtggatggaaaggaaacacactgtcaaattactatatctccttggttttctattacagtagaattctccagccatatttttattgtctatgggggaagttggagatggtgaccttgattagaagtgtctggagggggataaatggaggggataagattcagttggttttggaaaatgttaaagtcttaaaataatgcgtccatctgaagaattttttctaaaaccagagtttataaaaatatcactgatacagcctgccccctcatttccctgccacaggagatgtcttggactagagacacttgtttaataatagcttgtctctgatattcccagtagcttccctctgtgtgaggaaaggatagaaatgttcaggacatcatcatacaggctcctcatctacaaagttccagtagcagtgacgcctacacggaagacttggaactgcaaacaggctggggtcacctcagtgacatctgacgctgtccaaccagaagttcgatttttgttctgggggtgaaggaggaaacagactgtactaaaggactaaaataatttcttgtctatacta

SEQ ID NO: 109781 - DNA, 2481 bp, Homo sapiens
tcaaggtcaagaaacatcctttaaaaagttaattcccttttctggagcctaagccagatcttatctaggccttgtgttgccatctgttagcattgatttctggaatggagcagctttctcaaagtttggtcttgctagtcatgaggtcatgtcagtgtcttaggtcactgctgctcaccttccttacccagggagtatactgcataggtttctgaacacctgttttcattattcactgttcctctcactgccaagaatggagggaccctcagttgaagatcaaattgactctgaagaaaaactggagatgtttctcttggagtttggatagagtattcacttgataacatgtttttcccctgccttgctcttcacaagaacatctggccaggcattaacaattagtaaatttttttgcatatgaacagtatttttctggtcatgtagatgggtgcacatgacactaaacagcattgtttagtgttatccctcttaactggtgggttgtatttggggtggaggctgtagccgaggagaagacattcacctctgtactcgagaaactttgtgtaggaatttagtttatttttttattttttttaattttttattttttactacttttactgttagcacaatgctataattgagctaatctttgtagtttggtgcaggaccaccaagtttgtgtgacccattacctactttttccatgctcagcccattacccctgtcctggggcatctgagggcagtaaggaacaggtgtccaaaggaggaatgttggtgcctatgagtatgttttccagttgtattgaatttcttacttggtgtatttttgacttgtcttagtttctttccttgtggtctatgctattttacttgcgatttgttggatattctccctgtcattaaagagttgtaaaatggaagttagtttctctatgcaaatgctttaatggatgaagctgataggtttagcattgatttttgctggtgtccttcaacaagcatgaaggtgataaatgtgtttccatggctttagactcatttttgaagtcttggattgtgtgaacattcttagaaacaataaaatgttttaattaaaagccctcgactaccagctgaattcagtgtctactaggaaaatgggtagatttgttacattgtccctttgctctctatgactttgttccagttgtcaaggaacttaaatgggtattcaggaaaaagaattcttgtttccctttcctcaccttgccagttaaataactcctggtgacacttcaggtggtagaattgaaacacaaacctgacttctgaccacatgggtcaaaggcaaaaggcaaatggcttcaaagcccttagtgtgcttatccagttcaggcagtgaggagataacctctgctttcctccctgaggagtttggagtatttaaggggggatggggggggtgtcactttgaaaatatgttgctttttctcctgattgtattgaggctgatatggaagggttatttctttctggccaatactttttggtatttctaaatattgcaatcttgatttttactattaaatttgttaattgtcagttctggcttttttgcataaagagttggtccattaacttgccaatttgaagcttctaactagatattccctactgaaagttttggatttgtttttagtttgtggagcagtcttagctggggacaggtaattgacaacggcagagatactttcttttcctaggattctaagtctgtaatccacatcctcaatgtattcacaggactttaaaattctctccaaatgaggaaggaaatatcctgttgctttctaatgtttactaaaagttgtgtttagaacaacagattttaataggcatcttcctttgttatgtgtcattagccctttgcccgtttaccttagggctctttgaaggagaaatggatgggagaaaacctgtcacttggcgaaagtaaaagggataattaactggctcagagcttatgtgcagagttccaagccccaaagttaatctagaaccactcgataacaccaataaaaatatttatttcacatctgttatatatctggaaaatgttctaagcatcttacacatatttctcattaaatccacaggtgaccattgtgaggtagatattttgttctaattttccagatgaggaagctgagaccctaaaaggctgaccggttccctgatgtgttacctgcttctgctactgatccaaactgcagaacttctcattcatccccaaggcctccaggcagtatccaatggggaatcagctctaaaaggaaccagaccaacgttttccagccccttcattctgtagcttccctctgtgtgaggaaaggatagaaatgttcaggacatcatcatacaggctcctcatctacaaagttccagtagcagtgacccagtgacttcctcatcccggatcctctagatcact

SEQ ID NO: 109782 - DNA, 4041 bp, Homo sapiens
agtttccgggcccgggctgctctcggagccatgagctgcggccgcccccctcccgacgtggacggcatgatcaccctcaaggtggacaacctgacctaccgcacctctcccgacagcttgaggcgcgtgttcgagaagtacgggcgcgtgggcgacgtgtacatcccgcgggagccccacaccaaggcgccccggggcttcgctttcgtccgctttcacgaccggcgcgacgcccaagacgccgaggccgccatggacggggcggagctggacggacgcgagctgcgggtgcaggtggcgcgctatggccgccgggacctgccccgcagccgccagggagagccacgcggcaggtccagaggcggcggctacggacggcggagccgcagctacgggcggcggagccgcagccccaggcggcgacaccgcagccgatcccggggtcccagctgctccaggtcccgcagccgatctcgctataggggttctcgctatagccggtctccctacagccgatctccttacagccggtcgcgctacagccgctctccctacagcagatctcgctacagggaatctcgctacggcggatctcactacagctcatctggttacagtaactctcgctacagccgatatcacagcagccggtctcactcgaagtctgggtcctccactagctctcgctctgcatcaacctccaaatcgagctctgcgcgacgatccaagtcctcctcggtctccaggtctcgctcgcggtccaggtcttcatctatgaccaggagtcctccccgggtatccaagaggaaatccaagtcaaggtcgcgatccaagaggccccccaagtctcctgaagaggaaggacagatgtcctcttaagaaaatgatgcatcaggaagcaacgtgatggaggacttgggggaaaaggatcacatactcagtctatggaagcaacgtccctggaagaagaggctgcctattgaaaaggttgtgtcacacttttctacctttttgccagtttgaagctttgcatcaggtggcaaaattcattctatgtgccgttttgttgttattcacattttattgtaacttaggaggtgaacgacctaagattacgttattgggtttggatatttgaggcaaaaatttatttttatttctatagtgatgactgttttggtttgaaatgaacagattggtaacctaatttgtggcctcctgacttttaaggaaacgtgtgcagccattacacacagcctaacgctgtcaagacattgcttcaacattgccttcattccttaaaaacctacaaaaggtggtgtaaattaatatggataattttatttacctccaggtctaaaaggtagtgtgacccaaatttgtataaagatttttcatgtgaaaggactggggttttagcaaacacaggtctaatctcttttgtgtttttgtgcaccaggcccggctgcgtagcagttgagtgatgctggttagctattaaggtggcctgttgcagtgcagagtgctgagctgcttcctgttttcttctgattgctcctggggaaaacacgccttgtcctgaagaacaaatggctgtccagtttattaaaatgcctgtcaactgcacttccagtcacccaggccttgcagataaataatggagcatgcagtgagcacatctagctgacgataatcacaccttttcccccgtcttttctgaaaaattgtaaatctgatcatatcaacatgtatgaacttaaaatatggagaatgttatggaagaaatagtttataagtttgttaagtacttataacatggtttatctttttgattattaattttttacgctaaccattgtttctgtagttaaaattgttttcttggtgttatcttttctcagaataaaattagaaacttttgatggaaagtaggttgttttattttctgtatgacttttgaatatttgtacttttgagaaaattattagcaccaagtgtttctcaaaatataatttttaaaaaatccttaaaaaaaaaaaaaaaaaactcgagactagttctctctccccaaggagaagcagaggatcaccacgctattctccccgtcatagcagatctcgctctcgtacataagatgattggtgacactttttgtagaacccatgttgtatacagttttcctttattcagtacaatcttttcattttttaattcaaactgttttgttcagaatgggctaaagtgttgaattgcattcttgtaatatccccttgctcctaacatctacattcccttcgtgtctttgataaattgtattttaagtgatgtcatagacaggattgtttaaatttagttaactccatactcttcagactgtgatattgtgtaaatgtctatctgccctggtttgtgtgaactgggatgttgggggtgtttgtggttatcttacctggggaagttcttatgtttatcttgcttttcatgtgtctttctgtagacatatctgaagagatggattaagaatgctttggattaaggattgtggagcacatttcaatcattttaggattgtcaaaaggaggattgaggaggatcagatcaataatggaggcaatggtatgactccaagtgctattgtcacagatgaaattggcagtattgaccttatactaaaaggcaggggttaaaaatgattatatacattttccttaaaacacttgcaaacattttattcagttgtctttagctacaattgctttgctttttaaaccttggcaattgtggcaaaattatattgcccattttgtagcaacttattttgctcccttccccccatttttgttttaatagggactaatgtgggaagaactggctaatttgtcacagtgcttagttacaactgttaatgtgtgacctgctgttggtgtacatgtgggtacagggtgtttttaaatccaacaagatagagtataatatcaatactgctaaatctgcatgtcctctgtgtgactgatagagcgttgctatttcatttttttaagacaaaatgaaagcaaaatatagagttccaatgtattggtgtagataatctagttgggaatacttttaagtctcaccttcccctttaaactaatattcataattggttcatatgtttaaaagactttaatttacaaattaaattgcaaatgggagcattagatttagttttagacttaggtgggtagcaatgccagtaaacttaaattacgtaacttcttgcaaccacgaaacctgtaatacgctgtacagtaacaagtgttggcattatcagttgaactgtaaatacaaaatgcttcttccaattagtctctatgatgattaagtttctaaaatttatctgaacaccattcagaaacttgttttggggaatttgatagttattgatgtgcatctgttaaactgatgacagacataactcatcattccccagaaaccttttttgattacagtatctaacattttgcctcctcttttttggttttgctggttataaaggtttggattggagagggctcactggatcccaatccttggagctggatcattggattcaaatcataatgtggataggatagggaggatgaattaccaggattcatggagcgggatcagattaccaggaacataggagtggattcctgccccaaccaaaccgcattcgtgtggatttttttattcaacttaattggctattccaaagattttttttttcctatttttgacgattggagcccttaagatgcacgatggaattgtgttttgcgttttttggtaaaaggagcaaagcgaggacctggagataaacgctggagcaatctccttggaaggattcagcacgagtagatggtaaacatttaaaggggaaagggggggtttgtttaaaatagtaaatcagtaagtcacttctaaatttaaagaaaacaaaattggagttgaagaataagtaggtttccaattggctattgccgttttctttgaaaaaataaacattttttaaaa

SEQ ID NO: 109783 - DNA, 555 bp, Homo sapiens
cccttttactttctgcgatcccgcagagacgcggaagacgcggtgtatggtcgcgacggctatgattacgatgggtaccgtctgcgggtggagtttcctcgaagcggccgtggaacaggccgaggcggcggcgggggtggaggtggcggagctccccgaggtcgctatggccccccatccaggcggtctgaaaacagagtggttgtctctggtgagtgtactggttgtgtggattgatgtgaagggacgaaaactacctaaaatttttctcttgcgtgacaggtttaataattgcaaatttttcatgctaggtcttaaattgctttagtttttgggtgaatttaataaacgaggattgctgctgtggtgatttaccaaattaggttgcggtactagatacgaagatcgttacaaataattttggactctggattccagaatcttaccagctctctttacctggtatcacttaagtacacctattaagtactttaaagtactctttgtcctaatgtaccttaccagcttaacgtgaaatttaagataattggtact

SEQ ID NO: 109784 - DNA, 2824 bp, Homo sapiens
ttccttcagcttctcttcctctgtctcccccccatatccgtgcgccgagctgataaaggcgccattttggaggggccgcgggagacgtggtgccgctgcgggctcgctctgccgtgcgctaggcttggtgggaaggcctgttctcgagtccgcgcttttcgtcaccgccatgtcgggaggtggtgtgattcgtggccccgcagggaacaacgattgccgcatctacgtgggtaacttacctccagacatccgaaccaaggacattgaggacgtgttctacaaatacggcgctatccgcgacatcgacctcaagaatcgccgcgggggaccgcccttcgccttcgttgagttcgaggacccgcgagacgcggaagacgcggtgtatggtcgcgacggctatgattacgatgggtaccgtctgcgggtggagtttcctcgaagcggccgtggaacaggccgaggcggcggcgggggtggaggtggcggagctccccgaggtcgctatggccccccatccaggcggtctgaaaacagagtggttgtctctggactgcctccaagtggaagttggcaggatttaaaggatcacatgcgtgaagcaggtgatgtatgttatgctgatgtttaccgagatggcactggtgtcgtggagtttgtacggaaagaagatatgacctatgcagttcgaaaactggataacactaagtttagatctcatgagggagaaactgcctacatccgggttaaagttgatgggcccagaagtccaagttatggaagatctcgatctcgaagccgtagtcgtagcagaagccgtagcagaagcaacagcaggagtcgcagttactccccaaggagaagcagaggatcaccacgctattctccccgtcatagcagatctcgctctcgtacataagatgattggtgacactttttgtagaacccatgttgtatacagttttcctttattcagtacaatcttttcattttttaattcaaactgttttgttcagaatgggctaaagtgttgaattgcattcttgtaatatccccttgctcctaacatctacattcccttcgtgtctttgataaattgtattttaagtgatgtcatagacaggattgtttaaatttagttaactccatactcttcagactgtgatattgtgtaaatgtctatctgccctggtttgtgtgaactgggatgttgggggtgtttgtggttatcttacctggggaagttcttatgtttatcttgcttttcatgtgtctttctgtagacatatctgaagagatggattaagaatgctttggattaaggattgtggagcacatttcaatcattttaggattgtcaaaaggaggattgaggaggatcagatcaataatggaggcaatggtatgactccaagtgctattgtcacagatgaaattggcagtattgaccttatactaaaaggcaggggttaaaaatgattatatacattttccttaaaacacttgcaaacattttattcagttgtctttagctacaattgctttgctttttaaaccttggcaattgtggcaaaattatattgcccattttgtagcaacttattttgctcccttccccccatttttgttttaatagggactaatgtgggaagaactggctaatttgtcacagtgcttagttacaactgttaatgtgtgacctgctgttggtgtacatgtgggtacagggtgtttttaaatccaacaagatagagtataatatcaatactgctaaatctgcatgtcctctgtgtgactgatagagcgttgctatttcatttttttaagacaaaatgaaagcaaaatatagagttccaatgtattggtgtagataatctagttgggaatacttttaagtctcaccttcccctttaaactaatattcataattggttcatatgtttaaaagactttaatttacaaattaaattgcaaatgggagcattagatttagttttagacttaggtgggtagcaatgccagtaaacttaaattacgtaacttcttgcaaccacgaaacctgtaatacgctgtacagtaacaagtgttggcattatcagttgaactgtaaatacaaaatgcttcttccaattagtctctatgatgattaagtttctaaaatttatctgaacaccattcagaaacttgttttggggaatttgatagttattgatgtgcatctgttaaactgatgacagacataactcatcattccccagaaaccttttttgattacagtatctaacattttgcctcctcttttttggttttgctggttataaaggtttggattggagagggctcactggatcccaatccttggagctggatcattggattcaaatcataatgtggataggatagggaggatgaattaccaggattcatggagcgggatcagattaccaggaacataggagtggattcctgccccaaccaaaccgcattcgtgtggatttttttattcaacttaattggctattccaaagattttttttttcctatttttgacgattggagcccttaagatgcacgatggaattgtgttttgcgttttttggtaaaaggagcaaagcgaggacctggagataaacgctggagcaatctccttggaaggattcagcacgagtagatggtaaacatttaaaggggaaagggggggtttgtttaaaatagtaaatcagtaagtcacttctaaatttaaagaaaacaaaattggagttgaagaataagtaggtttccaattggctattgccgttttctttgaaaaaataaacattttttaaaa

SEQ ID NO: 109785 - DNA, 2905 bp, Homo sapiens
  misc_feature (2862)..(2862): n is a, c, g, or t
  misc_feature (2871)..(2871): n is a, c, g, or t
  misc_feature (2891)..(2891): n is a, c, g, or t
  misc_feature (2899)..(2900): n is a, c, g, or t
ttccttcagcttctcttcctctgtctcccccccatatccgtgcgccgagctgataaaggcgccattttggaggggccgcgggagacgtggtgccgctgcgggctcgctctgccgtgcgctaggcttggtgggaaggcctgttctcgagtccgcgcttttcgtcaccgccatgtcgggaggtggtgtgattcgtggccccgcagggaacaacgattgccgcatctacgtgggtaacttacctccagacatccgaaccaaggacattgaggacgtgttctacaaatacggcgctatccgcgacatcgacctcaagaatcgccgcgggggaccgcccttcgccttcgttgagttcgaggacccgcgagacgcggaagacgcggtgtatggtcgcgacggctatgattacgatgggtaccgtctgcgggtggagtttcctcgaagcggccgtggaacaggccgaggcggcggcgggggtggaggtggcggagctccccgaggtcgctatggccccccatccaggcggtctgaaaacagagtggttgtctctggactgcctccaagtggaagttggcaggatttaaaggatcacatgcgtgaagcaggtgatgtatgttatgctgatgtttaccgagatggcactggtgtcgtggagtttgtacggaaagaagatatgacctatgcagttcgaaaactggataacactaagtttagatctcatgagggagaaactgcctacatccgggttaaagttgatgggcccagaagtccaagttatggaagatctcgatctcgaagccgtagtcgtagcagaagccgtagcagaagcaacagcaggagtcgcagttactccccaaggagaagcagaggatcaccacgctattctccccgtcatagcagatctcgctctcgtacataagatgattggtgacactttttgtagaacccatgttgtatacagttttcctttattcagtacaatcttttcattttttaattcaaactgttttgttcagaatgggctaaagtgttgaattgcattcttgtaatatccccttgctcctaacatctacattcccttcgtgtctttgataaattgtattttaagtgatgtcatagacaggattgtttaaatttagttaactccatactcttcagactgtgatattgtgtaaatgtctatctgccctggtttgtgtgaactgggatgttgggggtgtttgtggttatcttacctggggaagttcttatgtttatcttgcttttcatgtgtctttctgtagacatatctgaagagatggattaagaatgctttggattaaggattgtggagcacatttcaatcattttaggattgtcaaaaggaggattgaggaggatcagatcaataatggaggcaatggtatgactccaagtgctattgtcacagatgaaattggcagtattgaccttatactaaaaggcaggggttaaaaatgattatatacattttccttaaaacacttgcaaacattttattcagttgtctttagctacaattgctttgctttttaaaccttggcaattgtggcaaaattatattgcccattttgtagcaacttattttgctcccttccccccatttttgttttaatagggactaatgtgggaagaactggctaatttgtcacagtgcttagttacaactgttaatgtgtgacctgctgttggtgtacatgtgggtacagggtgtttttaaatccaacaagatagagtataatatcaatactgctaaatctgcatgtcctctgtgtgactgatagagcgttgctatttcatttttttaagacaaaatgaaagcaaaatatagagttccaatgtattggtgtagataatctagttgggaatacttttaagtctcaccttcccctttaaactaatattcataattggttcatatgtttaaaagactttaatttacaaattaaattgcaaatgggagcattagatttagttttagacttaggtgggtagcaatgccagtaaacttaaattacgtaacttcttgcaaccacgaaacctgtaatacgctgtacagtaacaagtgttggcattatcagttgaactgtaaatacaaaatgcttcttccaattagtctctatgatgattaagtttctaaaatttatctgaacaccattcagaaacttgttttggggaatttgatagttattgatgtgcatctgttaaactgatgacagacataactcatcattccccagaaaccttttttgattacagtatctaacattttgcctcctcttttttggttttgctggttataaaggtttggattggagagggctcactggatcccaatccttggagctggatcattggattcaaatcataatgtggataggatagggaggatgaattaccaggattcatggagcgggatcagattaccaggaacataggagtggattcctgccccaaccaaaccgcattcgtgtggatttttttattcaacttaattggctattccaaagattttttttttcctatttttgacgattggagcccttaagatgcacgatggaattgtgttttgcgttttttggtaaaaggagcaaagcgaggacctggagataaacgctggagcaatctccttggaaggattcagcacgagtagatggtaaacatttaaaggggaaagggggggtttgtttaaaatagtaaatcagtaagtcacttctaaatttaaagaaaacaaaattggagttgaagaataagtaggtttccaattggctattgccgttttctttgaaaaaataaacattttttaaaactaaaaaaaaaaaaaaaaaaaaaaaaaaaaaaaaaaanaaaaaaaanaaaaaaaaaaaaaaaaaaanagaaaaannaaaaa

SEQ ID NO: 109786 - DNA, 2632 bp, Homo sapiens
ttccttcagcttctcttcctctgtctcccccccatatccgtgcgccgagctgataaaggcgccattttggaggggccgcgggagacgtggtgccgctgcgggctcgctctgccgtgcgctaggcttggtgggaaggcctgttctcgagtccgcgcttttcgtcaccgccatgtcgggaggtggtgtgattcgtggccccgcagggaacaacgattgccgcatctacgtgggtaacttacctccagacatccgaaccaaggacattgaggacgtgttctacaaatacggcgctatccgcgacatcgacctcaagaatcgccgcgggggaccgcccttcgccttcgttgagttcgaggacccgcgagacgcggaagacgcggtgtatggtcgcgacggctatgattacgatgggtaccgtctgcgggtggagtttcctcgaagcggccgtggaacaggccgaggcggcggcgggggtggaggtggcggagctccccgaggtcgctatggccccccatccaggcggtctgaaaacagagtggttgtctctggactgcctccaagtggaagttggcaggatttaaaggatcacatgcgtgaagcaggtgatgtatgttatgctgatgtttaccgagatggcactggtgtcgtggagtttgtacggaaagaagatatgacctatgcagttcgaaaactggataacactaagtttagatctcatgagggagaaactgcctacatccgggttaaagttgatgggcccagaagtccaagttatggaagatctcgatctcgaagccgtagtcgtagcagaagccgtagcagaagcaacagcaggagtcgcagttactccccaaggagaagcagaggatcaccacgctattctccccgtcatagcagatctcgctctcgtacataagatgattggtgacactttttgtagaacccatgttgtatacagttttcctttattcagtacaatcttttcattttttaattcaaactgttttgttcagaatgggctaaagtgttgaattgcattcttgtaatatccccttgctcctaacatctacattcccttcgtgtctttgataaattgtattttaagtgatgtcatagacaggattgtttaaatttagttaactccatactcttcagactgtgatattgtgtaaatgtctatctgccctggtttgtgtgaactgggatgttgggggtgtttgtggttatcttacctggggaagttcttatgtttatcttgcttttcatgtgtctttctgtagacatatctgaagagatggattaagaatgctttggattaaggattgtggagcacatttcaatcattttaggattgtcaaaaggaggattgaggaggatcagatcaataatggaggcaatggtatgactccaagtgctattgtcacagatgaaattggcagtattgaccttatactaaaaggcaggggttaaaaatgattatatacattttccttaaaacacttgcaaacattttattcagttgtctttagctacaattgctttgctttttaaaccttggcaattgtggcaaaattatattgcccattttgtagcaacttattttgctcccttccccccatttttgttttaatagggactaatgtgggaagaactggctaatttgtcacagtgcttagttacaactgttaatgtgtgacctgctgttggtgtacatgtgggtacagggtgtttttaaatccaacaagatagagtataatatcaatactgctaaatctgcatgtcctctgtgtgactgatagagcgttgctatttcatttttttaagacaaaatgaaagcaaaatatagagttccaatgtattggtgtagataatctagttgggaatacttttaagtctcaccttcccctttaaactaatattcataattggttcatatgtttaaaagactttaatttacaaattaaattgcaaatgggagcattagatttagttttagacttaggtgggtagcaatgccagtaaacttaaattacgtaacttcttgcaaccacgaaacctgtaatacgctgtacagtaacaagtgttggcattatcagttgaactgtaaatacaaaatgcttcttccaattagtctctatgatgattaagtttctaaaatttatctgaacaccattcagaaacttgttttggggaatttgatagttattgatgtgcatctgttaaactgatgacagacataactcatcattccccagaaaccttttttgattacagtatctaacattttgcctcctcttttttggttttgctggttataaaggtttggattggagagggctcactggatcccaatccttggagctggatcattggattcaaatcataatgtggataggatagggaggatgaattaccaggattcatggagcgggatcagattaccaggaacataggagtggattcctgccccaaccaaaccgcattcgtgtggatttttttattcaacttaattggctattccaaagattttttttttcctatttttgacgattggagcccttaagatgcacgatggaattgtgttttgcgttttttggtaaaaggagcaaccccaaaaggggtaccgagctcg

SEQ ID NO: 109787 - DNA, 2345 bp, Homo sapiens
ttccttcagcttctcttcctctgtctcccccccatatccgtgcgccgagctgataaaggcgccattttggaggggccgcgggagacgtggtgccgctgcgggctcgctctgccgtgcgctaggcttggtgggaaggcctgttctcgagtccgcgcttttcgtcaccgccatgtcgggaggtggtgtgattcgtggccccgcagggaacaacgattgccgcatctacgtgggtaacttacctccagacatccgaaccaaggacattgaggacgtgttctacaaatacggcgctatccgcgacatcgacctcaagaatcgccgcgggggaccgcccttcgccttcgttgagttcgaggacccgcgagacgcggaagacgcggtgtatggtcgcgacggctatgattacgatgggtaccgtctgcgggtggagtttcctcgaagcggccgtggaacaggccgaggcggcggcgggggtggaggtggcggagctccccgaggtcgctatggccccccatccaggcggtctgaaaacagagtggttgtctctggactgcctccaagtggaagttggcaggatttaaaggatcacatgcgtgaagcaggtgatgtatgttatgctgatgtttaccgagatggcactggtgtcgtggagtttgtacggaaagaagatatgacctatgcagttcgaaaactggataacactaagtttagatctcatgagggagaaactgcctacatccgggttaaagttgatgggcccagaagtccaagttatggaagatctcgatctcgaagccgtagtcgtagcagaagccgtagcagaagcaacagcaggagtcgcagttactccccaaggagaagcagaggatcaccacgctattctccccgtcatagcagatctcgctctcgtacataagatgattggtgacactttttgtagaacccatgttgtatacagttttcctttattcagtacaatcttttcattttttaattcaaactgttttgttcagaatgggctaaagtgttgaattgcattcttgtaatatccccttgctcctaacatctacattcccttcgtgtctttgataaattgtattttaagtgatgtcatagacaggattgtttaaatttagttaactccatactcttcagactgtgatattgtgtaaatgtctatctgccctggtttgtgtgaactgggatgttgggggtgtttgtggttatcttacctggggaagttcttatgtttatcttgcttttcatgtgtctttctgtagacatatctgaagagatggattaagaatgctttggattaaggattgtggagcacatttcaatcattttaggattgtcaaaaggaggattgaggaggatcagatcaataatggaggcaatggtatgactccaagtgctattgtcacagatgaaattggcagtattgaccttatactaaaaggcaggggttaaaaatgattatatacattttccttaaaacacttgcaaacattttattcagttgtctttagctacaattgctttgctttttaaaccttggcaattgtggcaaaattatattgcccattttgtagcaacttattttgctcccttccccccatttttgttttaatagggactaatgtgggaagaactggctaatttgtcacagtgcttagttacaactgttaatgtgtgacctgctgttggtgtacatgtgggtacagggtgtttttaaatccaacaagatagagtataatatcaatactgctaaatctgcatgtcctctgtgtgactgatagagcgttgctatttcatttttttaagacaaaatgaaagcaaaatatagagttccaatgtattggtgtagataatctagttgggaatacttttaagtctcaccttcccctttaaactaatattcataattggttcatatgtttaaaagactttaatttacaaattaaattgcaaatgggagcattagatttagttttagacttaggtgggtagcaatgccagtaaacttaaattacgtaacttcttgcaaccacgaaacctgtaatacgctgtacagtaacaagtgttggcattatcagttgaactgtaaatacaaaatgcttcttccaattagtctctatgatgattaagtttctaaaatttatctgaacaccattcagaaacttgttttggggaatttgatagttattgatgtgcatctgttaaactgatgacagacataactcatcattccccagaaaccttttttgattacagtatctaacattttgcctcctcttttttggttttgctggttactagtatactaagctcttgcggccctctat

SEQ ID NO: 109788 - DNA, 5454 bp, Homo sapiens
ttccttcagcttctcttcctctgtctcccccccatatccgtgcgccgagctgataaaggcgccattttggaggggccgcgggagacgtggtgccgctgcgggctcgctctgccgtgcgctaggcttggtgggaaggcctgttctcgagtccgcgcttttcgtcaccgccatgtcgggaggtggtgtgattcgtggccccgcagggaacaacgattgccgcatctacgtgggtaacttacctccagacatccgaaccaaggacattgaggacgtgttctacaaatacggcgctatccgcgacatcgacctcaagaatcgccgcgggggaccgcccttcgccttcgttgagttcgaggacccgcgagacgcggaagacgcggtgtatggtcgcgacggctatgattacgatgggtaccgtctgcgggtggagtttcctcgaagcggccgtggaacaggccgaggcggcggcgggggtggaggtggcggagctccccgaggtcgctatggccccccatccaggcggtctgaaaacagagtggttgtctctggactgcctccaagtggaagttggcaggatttaaaggatcacatgcgtgaagcaggtgatgtatgttatgctgatgtttaccgagatggcactggtgtcgtggagtttgtacggaaagaagatatgacctatgcagttcgaaaactggataacactaagtttagatctcatgaggtaggttatacacgtattcttttctttgaccagaattggatacagtggtcttaacagtggaatttcaaggtaaggattcaggcaaggttgtccaagtaaattgccagatttctggttttagttacattgtattcattcagcatgtctgaagatagatgaaagcttagatctttcaatggaaagttctgtctatccaatagggagaaactgcctacatccgggttaaagttgatgggcccagaagtccaagttatggaagatctcgatctcgaagccgtagtcgtagcagaagccgtagcagaagcaacagcaggagtcgcagttactccccaaggagaagcagaggatcaccacgctattctccccgtcatagcagatctcgctctcgtacataagatgattggtgacactttttgtagaacccatgttgtatacagttttcctttattcagtacaatcttttcattttttaattcaaactgttttgttcagaatgggctaaagtgttgaattgcattcttgtaatatccccttgctcctaacatctacattcccttcgtgtctttgataaattgtattttaagtgatgtcatagacaggattgtttaaatttagttaactccatactcttcagactgtgatattgtgtaaatgtctatctgccctggtttgtgtgaactgggatgttgggggtgtttgtggttatcttacctggggaagttcttatgtttatcttgcttttcatgtgtctttctgtagacatatctgaagagatggattaagaatgctttggattaaggattgtggagcacatttcaatcattttaggattgtcaaaaggaggattgaggaggatcagatcaataatggaggcaatgataaaggtttggattggagagggctcactggatcccaatccttggagctggatcattggattcaaatcataatgtggataggatagggaggatgaattaccaggattcatggagcgggatcagattaccaggaacataggagtggattcctgccccaaccaaaccgcattcgtgtggatttttttattcaacttaattggctattccaaagattttttttttcctatttttgacgattggagcccttaagatgcacgatggaattgtgttttgcgttttttggtaaaaggagcaaagcgaggacctggagataaacgctggagcaatctccttggaaggattcagcacgagtagatggtaaacatttaaaggggaaagggggggtttgtttaaaatagtaaatcagtaagtcacttctaaatttaaagaaaacaaaattggagttgaagaataagtaggtttccaattggctattgccgttttctttgaaaaaataaacattttttaaaaaactatgcatggttgtcctttttcctcttcatgtaagattctaactgggtctatcagttaatctttaaattgttaagtaagataagattttgactcttgtgttaatgtgttagcaaattaaaagttcttaaaaggcaatctaatggtattagccatcttttattgttaattgtaaaagtcttcaggggaaagcaaaaggggagaataaggcatttgtgtatgtaacttggtaaatgacggtgggggatggatctagcatctgaaagataagcttctctactttgttataaagtggttaaaaaactatagatgctgcttattttctggtggtcatagacaacataggcttttgtgcaaaattggttgatggctactaatgttcacttggagatagcttttgatattctcaatgaaactcatctcaaaaaaaggtaagtattaaatgttaacatcagcacagatgtattagaactgttttttgtttttgagacagagtctcgctctgttctccagactggagggcagtggtgtgatctaggctcactgcaacctccacccctggatttgagtgattctcgtgcctcagtctcccaagtagctgagactacaagtgtgtgccacccttgcccggctaattttgtatttttagtagagatgtggtttctctgtgttacccaggctggtcccaaaactcctggcctcaagtgatctgcctgccttggcctcccaaagtgttaggattacaggtgtgagccaccatgctcagcctgtagaacttttaacccaagtctcatttcttttttgaaagggaagagtgcacaagattaactgcttctttggatgaatcattgttaataaaaagctgggcatttagaattttgccttataagcccttctccaaccataagattattttgtaccaaaaactttggtgttctctaccaaagcagttaaaaacttttagcctgctacttcttgtatttgtctactgacagccccttggtactatttaggttgggggaggggacctaaaataaatagactttaacatttcccttgggtgctaatcatagttggaagttgaatttaaggtgattatttgggtgacaattaaaaacctaaggaaaaccagaaatcttggtagtggaagaaatgtgtaaggtcaccccaatcggtagattttaatgaacgttgtggaatgttgggaagaggggatgttaagttgaatgcagaatttcactaagtacttagtgtaagtttaaggatgtagctctttttatctaagaattcaatgtaatggccaaaaggcagatttactgtttaaaaatttgaataattttacatgacattcttgaaattctaagaagttttatgtgtagaacattttaaaaattcatcagattattaaagggaaaataaatgattaatgataattttggaaggttaatgtgagctagacttaagtaaactttggttcatttgtgttcattgaatgttttggaaatgaccaaaaaatgtaaatggccttcactcaagtttgagtgtttaaagttgaaagatgtgctctactaaaagttatagtaattctaacctcacattgaaatgagacagtattccttgttatacaggctgaatttgaagattagagaggatctaatgtttacttaggtaaaggggcataggttttgtagttaagatgaccagacagctaaaagctgtgatgggaagtatggactgctcctatttatagtctcagaaaatggacctttaggtctctatccgtattggcaattattagaagaaagttacacccttttgaaactacaaaagctgtcttggaatttccccctcttctccctatttatgtccccttagaatattttagggagcctataattattttctaaccaaggaaaaacttaagtctctttaagaagcaattacttttcataacatcagattgaataacccaccttgctgttcagcccacatcctactggaaacaaaaggtaagaaacccattttctggttcttgattgtttgggtctgaattttgtttttaaaactaagctaagtttaatgttttttaaaatgctgtttggaatatgaatagattccccgtaaaatgatttttcctaagttttatgctttagtaaatattcagtgctcacgtctgtgcatcatagtgcttgcgtttaatatgatttattgtagaatctcaacttttcttggtgtttgttgtctttgaaacattgtcttggtcattagggctggtgttttcacatttctgtggtcaaggtggatttcttatgtgtgcctttttgcttactttgtatatgaattttgtaatttaaattgcaagtaagttatatatatgtatttaccataaatagtattaaaagatgagaaactgttagactgaagttctgttgtaacataaccattatttccatcacagtatgaagactgcaaacgcagaaaacagattacagtctcttatccattttttgaaatccaaaaactacgaaaacaaaagattttctgttgttgagctaattaaatgtgaaccctgaccagaattgctgccttcattttgcacttagtgtgactaaactgtttcctgttgaacttcattattcattgcacagttgccacagactttgctgagggttttatgtaatacagggtatatatgtacctcataaagtgcatacagctctgaatcccagatatgtctgtctccaaagagttcatataagggattgtaggaactgtactagcatacacaggcctaatgcttttgtctgtaactggggtgtcttgactgaaaaacctgttattgtgaatcctttgttgattgaattttaagttcccccatctttttaggctgaagcagccacaagaaaaaaaggtatggcccacatttctttacattctgttgtaatagtggactcaacaattatatcccattgaagcaaatactcaggcatcctagagtgtacaatacaacattcttttgagttattgtttctgtatcagtacttaaaggaacattgaccaattagatcctataggaaaagctgggattggcatgaagtaaagagattatcaggaaacatctgttcattatgtctatcgtgattgtctattgaatgaatagtaatgctgccaaaagtaacttgctttaaacaaaccccaagagattatagtatacttaaaccagtacttattcctgttattgagaccttcacggtgcttcttggtagctttgaaagctaatgcctaacaaccctgagggttcttgtgagcttgtagtgattaaaggaaggattttttaattattat

SEQ ID NO: 109789 - DNA, 2109 bp, Homo sapiens
ttccttcagcttctcttcctctgtctcccccccatatccgtgcgccgagctgataaaggcgccattttggaggggccgcgggagacgtggtgccgctgcgggctcgctctgccgtgcgctaggcttggtgggaaggcctgttctcgagtccgcgcttttcgtcaccgccatgtcgggaggtggtgtgattcgtggccccgcagggaacaacgattgccgcatctacgtgggtaacttacctccagacatccgaaccaaggacattgaggacgtgttctacaaatacggcgctatccgcgacatcgacctcaagaatcgccgcgggggaccgcccttcgccttcgttgagttcgaggacccgcgagacgcggaagacgcggtgtatggtcgcgacggctatgattacgatgggtaccgtctgcgggtggagtttcctcgaagcggccgtggaacaggccgaggcggcggcgggggtggaggtggcggagctccccgaggtcgctatggccccccatccaggcggtctgaaaacagagtggttgtctctggactgcctccaagtggaagttggcaggatttaaaggatcacatgcgtgaagcaggtgatgtatgttatgctgatgtttaccgagatggcactggtgtcgtggagtttgtacggaaagaagatatgacctatgcagttcgaaaactggataacactaagtttagatctcatgaggtaggttatacacgtattcttttctttgaccagaattggatacagtggtcttaacagtggaatttcaaggtaaggattcaggcaaggttgtccaagtaaattgccagatttctggttttagttacattgtattcattcagcatgtctgaagatagatgaaagcttagatctttcaatggaaagttctgtctatccaatagggagaaactgcctacatccgggttaaagttgatgggcccagaagtccaagttatggaagatctcgatctcgaagccgtagtcgtagcagaagccgtagcagaagcaacagcaggagtcgcagttactccccaaggagaagcagaggatcaccacgctattctccccgtcatagcagatctcgctctcgtacataagatgattggtgacactttttgtagaacccatgttgtatacagttttcctttattcagtacaatcttttcattttttaattcaaactgttttgttcagaatgggctaaagtgttgaattgcattcttgtaatatccccttgctcctaacatctacattcccttcgtgtctttgataaattgtattttaagtgatgtcatagacaggattgtttaaatttagttaactccatactcttcagactgtgatattgtgtaaatgtctatctgccctggtttgtgtgaactgggatgttgggggtgtttgtggttatcttacctggggaagttcttatgtttatcttgcttttcatgtgtctttctgtagacatatctgaagagatggattaagaatgctttggattaaggattgtggagcacatttcaatcattttaggattgtcaaaaggaggattgaggaggatcagatcaataatggaggcaatgataaaggtttggattggagagggctcactggatcccaatccttggagctggatcattggattcaaatcataatgtggataggatagggaggatgaattaccaggattcatggagcgggatcagattaccaggaacataggagtggattcctgccccaaccaaaccgcattcgtgtggatttttttattcaacttaattggctattccaaagattttttttttcctatttttgacgattggagcccttaagatgcacgatggaattgtgttttgcgttttttggtaaaaggagcaaagcgaggacctggagataaacgctggagcaatctccttggaaggattcagcacgagtagatggtaaacatttaaaggggaaagggggggtttgtttaaaatagtaaatcagtaagtcacttctaaatttaaagaaaacaaaattggagttgaagaataagtaggtttccaattggctattgccgttttctttgaaaaaataaacattttttaaaa

SEQ ID NO: 109790 - DNA, 1483 bp, Homo sapiens
ttccttcagcttctcttcctctgtctcccccccatatccgtgcgccgagctgataaaggcgccattttggaggggccgcgggagacgtggtgccgctgcgggctcgctctgccgtgcgctaggcttggtgggaaggcctgttctcgagtccgcgcttttcgtcaccgccatgtcgggaggtggtgtgattcgtggccccgcagggaacaacgattgccgcatctacgtgggtaacttacctccagacatccgaaccaaggacattgaggacgtgttctacaaatacggcgctatccgcgacatcgacctcaagaatcgccgcgggggaccgcccttcgccttcgttgagttcgaggacccgcgagacgcggaagacgcggtgtatggtcgcgacggctatgattacgatgggtaccgtctgcgggtggagtttcctcgaagcggccgtggaacaggccgaggcggcggcgggggtggaggtggcggagctccccgaggtcgctatggccccccatccaggcggtctgaaaacagagtggttgtctctggactgcctccaagtggaagttggcaggatttaaaggatcacatgcgtgaagcaggtgatgtatgttatgctgatgtttaccgagatggcactggtgtcgtggagtttgtacggaaagaagatatgacctatgcagttcgaaaactggataacactaagtttagatctcatgaggctgaccggttccctgatgtgttacctgcttctgctactgatccaaactgcagaacttctcattcatccccaaggcctccaggcagtatccaatggggaatcagctctaaaaggaaccagaccaacgttttccagccccttcattctggtgactgaggggaggaaagaatgggagggggtattcttgtctagtggatggaaaggaaacacactgtcaaattactatatctccttggttttctattacagtagaattctccagccatatttttattgtctatgggggaagttggagatggtgaccttgattagaagtgtctggagggggataaatggaggggataagattcagttggttttggaaaatgttaaagtcttaaaataatgcgtccatctgaagaattttttctaaaaccagagtttataaaaatatcactgatacagcctgccccctcatttccctgccacaggagatgtcttggactagagacacttgtttaataatagcttgtctctgatattcccagtagcttccctctgtgtgaggaaaggatagaaatgttcaggacatcatcatacaggctcctcatctacaaagttccagtagcagtgacgcctacacggaagacttggaactgcaaacaggctggggtcacctcagtgacatctgacgctgtccaaccagaagttcgatttttgttctgggggtgaaggaggaaacagactgtactaaaggactaaaataatttcttgtctatacta

SEQ ID NO: 109791 - DNA, 1087 bp, Homo sapiens
ttccttcagcttctcttcctctgtctcccccccatatccgtgcgccgagctgataaaggcgccattttggaggggccgcgggagacgtggtgccgctgcgggctcgctctgccgtgcgctaggcttggtgggaaggcctgttctcgagtccgcgcttttcgtcaccgccatgtcgggaggtggtgtgattcgtggccccgcagggaacaacgattgccgcatctacgtgggtaacttacctccagacatccgaaccaaggacattgaggacgtgttctacaaatacggcgctatccgcgacatcgacctcaagaatcgccgcgggggaccgcccttcgccttcgttgagttcgaggacccgcgagacgcggaagacgcggtgtatggtcgcgacggctatgattacgatgggtaccgtctgcgggtggagtttcctcgaagcggccgtggaacaggccgaggcggcggcgggggtggaggtggcggagctccccgaggtcgctatggccccccatccaggcggtctgaaaacagagtggttgtctctggactgcctccaagtggaagttggcaggatttaaaggatcacatgcgtgaagcaggtgatgtatgttatgctgatgtttaccgagatggcactggtgtcgtggagtttgtacggaaagaagatatgacctatgcagttcgaaaactggataacactaagtttagatctcatgaggctgaccggttccctgatgtgttacctgcttctgctactgatccaaactgcagaacttctcattcatccccaaggcctccaggcagtatccaatggggaatcagctctaaaaggaaccagaccaacgttttccagccccttcattctgtagcttccctctgtgtgaggaaaggatagaaatgttcaggacatcatcatacaggctcctcatctacaaagttccagtagcagtgacgcctacacggaagacttggaactgcaaacaggctggggtcacctcagtgacatctgacgctgtccaaccagaagttcgatttttgttctggggattgaaacgcacgtggacattgaacgggtaccgatgct

SEQ ID NO: 109792 - DNA, 367 bp, Homo sapiens
ggtcccagctttcataagaggcacgaatctaagaagaagacacggtttgagtcccagcctgaccatgcctggctgacgcagcatgatccatccatttcactcatgctgggaagatcttgccaggaaaacttgaaataattgaggctgtcacctaaaaccccatcttagttagaaatggtttggttgtgtggaacatagctctactcatcaaggctcacgtgaaaaatgaaagctatttagaagcagagcgaagcttcgtggaaccagaaatttagtagatggcattctcgctctcttccttcttttctctctcactctctctcctctcctactcttatctcttcttttctataaatatcttatttat

SEQ ID NO: 109793 - DNA, 416 bp, Homo sapiens
ggtcccagctttcataagaggcacgaatctaagaagaagacacggtttgagtcccagcctgaccatgcctggctgacgcagcatgatccatccatttcactcatgctgggaagatcttgccaggaaaacttgaaataattgaggctgtcacctaaaaccccatcttagttagaaatggtttggttgtgtggaacatagctctactcatcaaggctcacgtgaaaaatgaaagctatttagaagcagagcgaagcttcgtggaaccagaaatttagtagatggcattctcgctctcttccttccctctctcacgtccttcacctggtctctggccctggttcttattttctctcaattccctactgcctgtttcttactttgaacctggaggcagcctgcagccccatcccatctcc

SEQ ID NO: 109794 - DNA, 1174 bp, Homo sapiens
ggtctgcaggtcctccggcatgtagtatttatctagcaaggcggggtggtggaggcagcaccctggcaaagcagctcacacactgcagccacactcatcagctgtggtgaggcggctggagcaaagtcaaagtcatgcagcaaaatgaaaactctgggactcttcggcaaaatcctcattaagccgagcagctttggccaagtaatttttgcctccttccctcgcgtggcctgagtttaggagcaagggtggccagagtcccttacccacagataagcctcccctcatgaaatgccactcaccccgggctaccattgacatcagggctgcatttccagccagcctggaagtaaaatttgagaggaagacaatattaatctgtgtccccacctagtgagctgtggacaggtttaagttgggtctccttcttcttcaccacaaaaacaggctctaagaaatcatgttactaaaaaatcagtgtaaagtctgtttaaaataaaaaagaatgttttctatgtctgtatatcttttgtgaatatttattaggatttcttattaaaaaagtgcaatattaataattgtacattgtcatccagaaacaaaactattggggggactttattaactaacttcctgcagttgtgttcctgtaaactcagtagtgattattatatttttcctatttttaatagaacctggtgtttaactctggatccattcactgtacaggatgtgttgtaaaaactaacatgggatgctgaggcagtaagagggaattcatttgtggcataatagttatgcatggaatgataaagacagacaaattccatactactactaatgtggttaattatttctagttcgatagtgattgaaaatcagtggtcactatttacatttcctaaagagcaagcatcctccagctccatgttgggttggagcagttggcagtgggtctcagtgagctggcagaacctaggtttgggtgggaagcagaatgctcgttgcatgaaatgaatgtacatttaatgtttgttctgtgaattgcaactcagcagcaccacaagacaatgaaggctgctggctaatgtggaaggaggcactttctcctctaaaacacaaaactgtatttgtattttttgtacagataatacagcttatttatttaaatctt

SEQ ID NO: 109795 - DNA, 249 bp, Homo sapiens
gctcaagtgttcctcctgcctcagcctcctgagtagctaggactacaggcacaggctataggactatgccaccatacttagctaatcctgtgtattttagattactggtggggattaaaaaaaactcgagagccatataggtatttaaaattacagttatttcattatttttacatcttattttatgtttactttcatcagatttctctattccaacttgataatgttgctacaatttgtgacaaatga

SEQ ID NO: 109796 - DNA, 296 bp, Homo sapiens
  misc_feature (192)..(192): n is a, c, g, or t
  misc_feature (224)..(224): n is a, c, g, or t
  misc_feature (259)..(259): n is a, c, g, or t
cttggagcccctccccactctgacttcaggactgggggcacagagggggctctggggtggtggacagaagcccccaggaccacagacaccctgggcccccagcccactcctgaagccacagcaggaaagtctctgtgtgtctgaggccccctccagcaaagccctggtgggcttcacccagatgaccatctnggccaagggcaagcaccgcagctacctgaagnagttccgggactacccgcccctgcgcatgcccatnatccccttcctgctctgagcgctcacccctgttgagg

SEQ ID NO: 109797 - DNA, 379 bp, Homo sapiens
gctccccaatgccagcctggccccagggcctcggggcctcgattccgccctgtatctggggccaccacctgcttcacagggacctgggacccactctgtccctgagcccattttagaatctgtcctgggtttatgagacatgcttttcggatttgcatcagaactgcattgagtttaacaggtgaatttaaggagaattcaaagtcctgttactttgagctgacccagtaggagcttatctccaacacgacttctgaggctcaggcacgtgtagctagatgtatttcttagatacctagtgtttttttgtttttttgttttttttaatttttttgaaacagagtcttgctctgtcacccaggctggagggggccgcgcg

SEQ ID NO: 109798 - DNA, 720 bp, Homo sapiens
tacaagagatttacttcacaagcttagaaaagatcctctcacttttagaaaagcagcaaataatttgaaagtgaagtatgcaagagatattccatgccaatagtaatcaaaagagagcggaaatggctatgctattatcagatgaagtatcctgaaaaaaaaattacaagagacaaaagcactatatattggtaatatagtcaatccataaaatctttaaaatttacaaacatatacctatctaacaacagtctcttaatagatcaaacaaaaactgcaggactgaaaggataaatacattgttttacaatagtatttgtaaactttaatactccactttcaataatggatagaaaaactcaatagcaaaaagaaaatggaagacttgaacaatgctataaacaaactagacctaacacatacacacatatataggacagtccatcaaacaacatcagaaaatgtattttcctcaggtacacatgaaacagtatccaggatagaccacattttaggccaaaaaacaagtctcaaaacaattaagaagactgaaataatacaaggtaactttttcaagttactttgaataaaatgaaactagaaataaaaaaaattttgcaaatatgtgggaaaaatatccttaaacaagtaataggtcacaaaaagaaatttttttaaggtaaattagttgagatgagtggaaacaaaaacacaatatat

SEQ ID NO: 109799 - DNA, 408 bp, Homo sapiens
aaaagatgtttaaatcaactaggaaatttttcattaggaaaagctgttgaacattgctgtgtgattaatatgcaagaaagcagagaggcctcagtaacactgcatgttgatcaaggatgctgttacccagaaatcagagcccctggatctccagaaggataattatacttaaaagcaagacaagctcaaactataccagctgtcagattttttttacaatgagtgtatgtatatttaaatcgtagctattcattgcaggatttgtgatcccaaacagaaggacagcatgaacagagcccaaaccaagtaacaacaaatggaatgggaaaatgacaggccttttcataggctccatagttcagtggtctgataacatagattttctgaaatgcaaagagtagggtcagc

SEQ ID NO: 109800 - DNA, 301 bp, Homo sapiens
atatattaaatgattatttatgataacagtagaagctcttaataggttttcatgtcattgccattaatttgttctagattttctgtttggtagaatataaatttgttttccttgagaacgtctgtaagctagcaggcaggctcagttttagttaaggactgatgagtaaaatttgtaactgctgaaagaccttgtatgatttttgatatttgaagtaattaaaacaacctgtatttattcttattggctgtgcaatataacttcacaaaatctacagcaaaataacattagatactcttta

SEQ ID NO: 109801 - DNA, 218 bp, Homo sapiens
ttgaattctagaatctacacattaaactgcttgaactgcttgggttgaacccaagctctgccacttactggctgcgcaacattgaccaagttatttaatgtcccagtgtctcagttccctcttttgtatatagccataataataatcatacctatacttcacagagtgttgtggaaattaaataagtacatatatagaaagtgcttcacagggacagg

SEQ ID NO: 109802 - DNA, 619 bp, Homo sapiens
tcacctgcggacaattcaaaaccagcctgggcaatatagtgagaccacatccctactaagaagaattaaaaatatatatataaactggggccaggtacgatggctcacgcctataatcccaacactttgggaggccaaggccggtggatcccttgagcctaggagtttgagactagcctggacaacatggcaaaactccatctctctaaaaataacaacaattttttaaaaaccgactggcttaagctgatcagaactcacaactgaggctagggtcaccttcagaaaccatactgttgctgcacaatagggaaaaagcaaaacagctgttgcagaatcaaccgctgcatggcttacagtgcactattgcatacataatcttttctgatcttacaaaagaagtattagaaaaatccaaatgatatacacatgggaaaagggattttgtcttctcattttaaaactatgttaaagctttctgcatattttggacaaagaggtcatattcagagactgttcacatgtaagctttcttagcaaaacatctacagggtgtggtcatcagatattattaaaaaggaccaataggccaggcgtggtgactcacccatgtaatccc

SEQ ID NO: 109803 - DNA, 157 bp, Homo sapiens
ttcatatatagatccatatctatatatatggataaaaaaagacaaattggaaataattacctttgtaattttaagtattatatttgatttttttaaatgaataaattactcaatacctataaaaagctcaaagtaatacttgacccatgtttattgt

SEQ ID NO: 109804 - DNA, 450 bp, Homo sapiens
ggcagaggtttccatttactggaatgtcacaggaggtgcagaacatctgccatggccttgtgctcttgaaatattatgccatataatgttcttagatggggctcagagagaacatgctgtggttgattatgatatctgcataggtgcaagactaaagaatgtgtatcatacatatgccattcatgctcttcactgttctgaaaggataattattgacagcccaaggagaaggccagtcatgtgtacattggttttctgaagtctaacaactaccagggctaataaagctattggggcatgatcaggaagtatgctaaaaccaaaccaaaatgttaccttcttatcaaaaccctgatggtgagtcttgaaatcagagtgcccagcccttggggcaactcaaggtgggtgtatgagaatagaagacggtccagggtatggtctctaagatga

SEQ ID NO: 109805 - DNA, 671 bp, Homo sapiens
tgttagtccatggcaaattagtaaagtttgtaaaaagaatgtctttctctggtattgttgacaccaacatagtaagaatgtttaagtgctttgcattaagcatctcagggaataaggaaagggagctgtataaaataattctttgtctagtaggacaaactgtgtagttaactgagtctcgtatagaggtgcctgcctcacatgattattgggagcattagatgagtttatgcattataagtcattttgacctagtgcctagcacttagtaaatgtaagctattaatagaaaatttattgctataaaattataaaaataataaactttaaactttataatcatttttgttataactcttcacttggctttcttgataccattcttcccaacattttctctgcctgatttttctgacttattctaaattcttcatcctcaggtctcctctctcttacctttttttcattattccctgtgtcagtgtcagcaccttctgctgaaactcactacagcgtatctctacaaaatctcttgcctttcttagggaggaaagtgacacgattcagccagtttttaggaagctagccaagtttgttaccactgtgaaatacagtttagaaaggcttagccaggcataaggcctgtaatactagagtcttgagaggttgag

SEQ ID NO: 109806 - DNA, 578 bp, Homo sapiens
aacaccagttctgagaaccctgagctgccatgtaagacattcagggcactatgctgtgaagaagctcaagacatacggagaagccgaagtaggtgtttcagttaatggtcccagctgagccctgtctttgaaacatcccacttcaggtggctgacacaagagtaaagaaccacggattggccaggcgcagtggctcacgcctgtaatcccagcactttgggagtgaagaattactatatcaaggtagctacaaaaactgtaaatagtgcagcttagatctgcagtgattgtgtttggaaaattaaaatggcattttcagtttagaaataacatttataaagttataacactataactgcctccccttccaccagctgttaaattctggaaatctcactaaaggcagtctttgcaatcgccataacagtgtctccaatgtaagtcctcaatgtttgtcttctgatgtatacataatatcaacacatacatacattatatattctgatgtatacataatatcaacacatatttataaatctgtaatactgatgtaattggaagcataacctgccaatttc

SEQ ID NO: 109807 - DNA, 468 bp, Homo sapiens
cctgataggcatagatgcaaataatccttaacaaaatacgaataaagcaaatccaattgcacatcaaaaagacagtacacgattaagggaatttatccctaggatgcaagggtctttcatcacatgcaaatcaataaatgtgacacatcatgtaaacagaatgaaggataaaaccatatgatcatctcaatagaagcagaaaaggcatttggtaaaattcaacattccttcatgataaaaattctcaacaaactaggcaaagaaagaaatactgcaatattaataaaggctatatatgacaaacccacagctaacataaatctgaatgggggaaaagtgaaagaaagccttccctctaagaactggaacaagataagaatgcccgctgatatgatttggctgtgtccccacccaaatctcatcttcaattgtggctcccataattcccacaggttgtgggagggactc

SEQ ID NO: 109808 - DNA, 633 bp, Homo sapiens
gtgtgtatgtgtggtaagagtatttaatatgagacctaccctctcagagaattttaagtatacaatacagaattgttagctatatgcactatgtgtatagagatctccagaatttatttatcttgcataattaaaacttcataccctttgaccatcacctctagattgttttttgatattgtcgttttgttttgttttgacaaggtcttgctctgtcacccaggctggagtgcagtggtgtcatcatggctcactgcagcctcaacctcctggactcaagccatcctcccacctcagcctcctgagtagctgggactacaggcatgcaccaccacacccggctaatttttgtactttttatagagacagggtttgccatgtggcccaggctggtcttgaccctccgggctcaagtgatccaccagcctcggcctcccaaagtgctgggattacaggtgtgagccactgtgcccaggctagatggttagttatctcacccaagcatctatcttcttgtttctctgtatggatgtaggcttaacttttatttttaaacacattccagacctcctttccagaatcctctcttgttattggttgacatattattggatctcacttcagactgactcc

SEQ ID NO: 109809 - DNA, 439 bp, Homo sapiens
aagtctttgatccatactgagttaatgttgtatataggtgtgaggtaggggtccagattcattcttttgcatgaggttagccaattgtcctggcattatttgttgaaagggctattcttttcccatgaatagccctggcacccttgccaaaaatcaactgatcataaatcacaacttttttttaatacccacatgcaagtaatctttcagccaaagtctttcattttaagatactaaatacattttaagtaatttaccaggctcaataaaaacaattccagggttttggataacaatgtcattactttctgaaaaactgaagaaatggcaattctttatgcattccacttaggaagttagtttctactgctacctctgatagatgaaaaagttgaaatcctgttacgataattaatgttgctaggatcttggcccagac

SEQ ID NO: 109810 - DNA, 1765 bp, Homo sapiens
atgtctgatttgcatggagaattatcaagagaagcaacaatgccaagcagactattccaggtcaaaatagtcaaattaataattcataaattattatatgttttgaaggtattgcaaaattaaagttgcaagaacagtacagataacttttttcctgaaccatttgagagtaggttgcagacctggtgccccatcatttctgaatattttagtgtgcattttctacaaacaaggacattttccagcataaccacaatgcacccatcaatgtcgtgaaattaatgttggtacattactaccacctagtcctcagaccctattcaaattataccagttatcataatagtttcttataatttatagcaaaatgatccaaaccaggagcatgcattgcatttttatgaatttttaaaacaattaagtctgtgtagtgagtgaagccacagtgataggaatatataaaggctttgcatctagaatttgttctgaaaaccctgagattcaagtagtacattatttcatttactattttacacagagaagccctcatttttaagagtttgcctttctgatttccaccggaaatgatactatcagtatcatactcagaatcttaattacatacaaggcactaacctctcacctgttttcagctttgtgtaaagacaagggatcaaaacatccctttctgctatttcatacttaagtgtgggagctgatccaaaggaagaatagtttcaaaagtttgtagcaaaaaaaatttaaaaggtgaagattttttccttgaatgattctcacctggcagatctatggaaagattagctgactctttggatccctgaatatagttaatagaaatttggaaggaccatgtcaaaattaactaatgtgaactgacaaagatttggtgttcaaagcaaaaattaaactttggaaaagtgagcaagtacttaatcagaaacaaaaaaaaaaaaagaaaggaaaagttaggtgaaaatggtttccaggtgttgttgctgttatagtttgaatcataaaagttgttaaaagtctgctgtaacaaaccatcatagactgggtgacttataaagaacaaaaatgtatttctcacagttccagaggctgggaagtctaagatcaaggcatcagcagattcagtgtctggtgagggcccactttctggttcatagatggcaccttctcactgtctccccacgtgatggaaggggcaagaggtctctcttggtactcttttattaagggcactaatcccatccatggggctccaccttcatgacctattcatctcccagaggccctacctgcagataccatcgtatgggggatttgatttcagcctgtgaatttgggggaagcgggacaaacattcgttttgtagcaaaaggagtagagtaatatctgccaataactggaggaaagaattgttcttttaaaactattaaattgtttaatgggatttaaatgatttcaggaatgaaatggaaatcctggtaatgggtagaaacataggtaaattctccttttccacttaccaccacctgtgtgaacaacaatcatttctcattaatagtcaagaatttgaagagatcatgagtaaaaagtcttgatcagaaattgtgtatagctgtttccagcataaaaccttatataaaatgcatattcatagaagatgctcaagtatgtcatgaaaaatatgaagtttatttaaatatttatacaaattaaagatttactgtattctcta

SEQ ID NO: 109811 - DNA, 2172 bp, Homo sapiens
atgtctgatttgcatggagaattatcaagagaagcaacaatgccaagcagactattccaggtcaaaatagtcaaattaataattcataaattattatatgttttgaaggtattgcaaaattaaagttgcaagaacagtacagataacttttttcctgaaccatttgagagtaggttgcagacctggtgccccatcatttctgaatattttagtgtgcattttctacaaacaaggacattttccagcataaccacaatgcacccatcaatgtcgtgaaattaatgttggtacattactaccacctagtcctcagaccctattcaaattataccagttatcataatagtttcttataatttatagcaaaatgatccaaaccaggagcatgcattgcatttttatgaatttttaaaacaattaagtctgtgtagtgagtgaagccacagtgataggaatatataaaggctttgcatctagaatttgttctgaaaaccctgagattcaagtagtacattatttcatttactattttacacagagaagccctcatttttaagagtttgcctttctgatttccaccggaaatgatactatcagtatcatactcagaatcttaattacatacaaggcactaacctctcacctgttttcagctttgtgtaaagacaagggatcaaaacatccctttctgctatttcatacttaagtgtgggagctgatccaaaggaagaatagtttcaaaagtttgtagcaaaaaaaatttaaaaggtgaagattttttccttgaatgattctcacctggcagatctatggaaagattagctgactctttggatccctgaatatagttaatagaaatttggaaggaccatgtcaaaattaactaatgtgaactgacaaagatttggtgttcaaagcaaaaattaaactttggaaaagtgagcaagtacttaatcagaaacaaaaaaaaaaaaagaaaggaaaagttaggtgaaaatggtttccaggtgttgttgctgttatagtttgaatcataaaagttgttaaaagtctgctgtaacaaaccatcatagactgggtgacttataaagaacaaaaatgtatttctcacagttccagaggctgggaagtctaagatcaaggcatcagcagattcagtgtctggtgagggcccactttctggttcatagatggcaccttctcactgtctccccacgtgatggaaggggcaagaggtctctcttggtactcttttattaagggcactaatcccatccatggggctccaccttcatgacctattcatctcccagaggccctacctgcagataccatcgtatgggggatttgatttcagcctgtgaatttgggggaagcgggacaaacattcgttttgtagcaaaaggagtagagtaatatctgccaataactggaggaaagaattgttcttttaaaactattaaattgtttaatgggatttaaatgatttcaggaatgaaatggaaatcctggtaatgggtagaaacataggtaaattctccttttccacttaccaccacctgtgtgaacaacaatcatttctcattaatagtcaagaatttgaagagatcatgagtaaaaagtcttgatcagaaattgtgtatagctgtttccagcataaaaccttatataaaatgcatattcatagaagatgctcaagtatgtcatgaaaaatatgaagtttatttaaatatttatacaaattaaagatttactgtattctctaacagcgcgtattttcttttttgtaataactatatgaaataaatacaaagtaacacgtttttaccaagcccccttcccatccttctcatcaccctcaaactccctccaaatagagtcagagaaacagccagagggatgtctccactgagacacagggaggtcttgcacccaggcagttcagcagttcctgggcgggtggcccttcccatctgagtacccctcaatgtgcctgctcctcctgggatcctttctgctcccttgggcctctgtttttggtctgcaatggttggttatgtagagggatcagtattggggttgtcccaagccaggctacaggttgagcaggtagccacataggccacatagcaggacgggcccagctggggactctgatgtctgcaattaggg

SEQ ID NO: 109812 - DNA, 315 bp, Homo sapiens
gttctatatcaaatatttagacctcaacctacaggttgaggttccataacctgtggttatttatgtattttcatttgaaatactttcttctttgagcatttcattgggaatacatgaaatcatttaatgaatattcattgaatttttaatctgaatatgcaaaagcaaatatactattagacacttgaaaaagaaaaaaagaatcttaaattctacaagcctacaaagagtttacaatcctatttggggagctaaagtaaataccttgcaatgggactttgcaagtttgcttctgtcagggtggaatcaagaggt

SEQ ID NO: 109813 - DNA, 538 bp, Homo sapiens
ttggaactgattctgggctaggtatagatcccaggagaacccgtgttctacaaacctcactctgggcaaaactgacccagactgggttttggggatgcttgatgtaatgaggcaagtggcgcgatcttggcttactggcaatggagcggctccttctgcctgctgccgtcagattctctgctatctggctggcaggacaattcgctatggcctggctttggcaactgattctgggctaggtataggatcccaggagaacccgtgttctacaaaccccactctgggcaaaactgacccagactgggtttggggatgcttgatgtgaatgaggcaagtgatatgtctactgaacttactgctccaagtaggacatggtaactttgagttcccctcatccctttcatatgggaggagtggtctgggcagcaggagctacggcaggccagggtggctctagtcttaagccagagctagcaggtaagtgcctcccaatgatatgcagattaaagataagtaatcctggcccatttctgctcaa

SEQ ID NO: 109814 - DNA, 292 bp, Homo sapiens
atccagttttcccagcaccattttgttgaagagactgtcctttccccattttgtagtcttggtacccttgtcaaaagtcattggccatatatgcaagggtttatttccaggctctctattctgttccatcggcctatataagtttctgtgccactaccacactgtctgattactgtcattttgtagtatgttttgaaatcagggagtatgaggcctcagctttgctctttttcaatattttttggctatttggggttccttgagattgcatttgaattttatgggttttttt

SEQ ID NO: 109815 - DNA, 252 bp, Homo sapiens
aacatggaggaaacaatctaactttcctgcaattagtgtcccacaaggagaagagggagtgattttaaataaatactggctgagaatttcctacaactagtgaaagacatcacaaacacatatccaacctcattcaaaagcactaaaaacctcaggcaagataaatataaggaaaatcacacctgggaacatcatgattttgctcctgaaaattgaagagcaatagaaaatctttttttttatttttatttt

SEQ ID NO: 109816 - DNA, 371 bp, Homo sapiens
tgcctcttctggcacaagaatctgcaactccaatctggtctctccaccaaccacagcgcccccagaccttggagaagcgcgttgtctgctccaggggcccagagccacctgctcggaatcttacctacaaccttttgcttcctacccaaatacctgatcaagagtaaagggacagtggcacagcccctcctctccagaaaccacaatctgcaatggagcactccatcaacccggacatcctcaggcctccactaaataagcccggcattggaggagggtatcagggcctagaaacaggttctgggcagagggccccctgcacgtcctgggggtgtctgaatggaaaacagaaacttgaactgatagtaggg

SEQ ID NO: 109817 - DNA, 567 bp, Homo sapiens
agtaattttgcggtgcctttccagcatttagcaatggaaatacaaataacgtcattttccgacagggcagagagtcctagtctaatttagtgtcacaactagcagttctgttatactttaatccttaaatattagaccaaagcagggacaatagaaaatgtgtttacaaaccctcctgattaaggtgactaaaaagcaaaagcgaaacaaaggaggttgaggtaaagagcagtcttacacgtaagcttccagctttgggactgatttacaaaccacaactgaaatgggtattatatatatgctgatgaaagtagctatgtaacatagtttggatctgtgtcgctgcacaaatctcctgttgaactgtaatccccagtattggaggtggggcctggtggaaggtgatgggatcatggaagcggatttctcatgaatggtttagcgccatcctcttagtgctgtcctcacgacagtgattgacttctcaggagatctgcctatttaaaagtgtggcgcctggctctttctcttttgctcctgctcccaccatgcgagacccctcctccc

SEQ ID NO: 109818 - DNA, 572 bp, Homo sapiens
atccgctttcgatgttttctctcttaaacaaaaacactatgctgaatgtgcagcaagtaggtgtggtgtagttattgctgatgcacagacatcatagacatttcaagtaaaaggcagcaacctgagaagttgcaatccacttgagaagtcatgattaataccaacatttttaaattagtagttgtctaaacaaaaattgtataaatgccatgaaaatatacttccattcttactgaaactgcctttgcaaaattataactgaggaaattatgacagtgaaaaaaaatcagacctaaccgactccatcttgcttctaacctttaagctgtgcttgttcattcttgggcataggccgagctaactttgggaaggaattcagttcatggtttgactctgaaacaaaattgataacagccctttcccaaaaagactcccttcttgcctggtgaccagtctgcctttgcaggactaacctattagctacaaggttagaaattacagtttaggggttatgcaccctctggctccaagtctgaaccgccccacattgcttctggggataacatcactat

SEQ ID NO: 109819 - DNA, 133 bp, Homo sapiens
tcttatctgggactacagtaaaaaacatggggaaagaaacataatcatggatgccattctgagcagaagactaagaagcaagaagattatcagacatcaataaatattctttaaatactctcatgaatgcata

SEQ ID NO: 109820 - DNA, 575 bp, Homo sapiens
cactgctaaaaactggtgaggccaggagttgacctcagctactgggaaccagaagaaatgggacttggaaattctgtccagcctctcttcttctagtttaaagcttaataatatctataaaaaaaagtaacgattttgaaataggaataaggttcaatttgctcatctacaattagagatcataacacttatcctccctatcaaaaagaattattttgaacatcaattaagttaatgtgaactactataaaatatattacattttgcattctctatactgtaatataactaaaagaacatcgagttgggagctcacagacattcaaatgttggccctttttattagtcttatggccttgggcaagtcattctgcattgcctttcttatctataaaataagaaaaattatatgacttttggggttacgataatcacaaatgagtttaaaatgtgaaataacccaaaaaacattgctaagcacatatagggtaggcaagaactaaatgccatctctttttatgtggagtggtttgatggtcggtgccgatgattaattaatcagtgtatgctttagt

SEQ ID NO: 109821 - DNA, 364 bp, Homo sapiens
ctgcccccagggagagctgcttgtggtcacccctccagtgaagcaggcctgtttcattgtctgggatcccacagtctccctcattgcctcagctactttcccacctggtgtccccgactgggtgctgttatccttcatagtgtagcctttgatgccaacatgaaaggtcaatgtggcagggatgaggttgtgagatgaggtctggagcatattctctttatgtagaaccttctggttacttgggggactggggggcggggagcgggaaaactaaaaatccaaaaacgggcgtcacagactggagagccccgtgttttacttccggctctgttttctgtaatagcatcttggcactctcagacga

SEQ ID NO: 109822 - DNA, 448 bp, Homo sapiens
ccaaggtggaaggactgcttgagcccaggagtttgagaccagcctgggtaacacagcaagaccccatctctggaaaatatttttgggctaggacagagtcacaagaaataagactatttcttatttgtcttaagactgtttcttagtccttaatactgaggtggcctcggtgtaaggatatggaggaaggaagctcctaactgaaggcccttggaggagaatcgtaaatattgaaacttactgaaggaaaattaaaacccaggaagtaggagagtgttgaatatggaaagtgaatgtggggattgattgatggagagctttgcatattgttctgaaaaatgtgagtttttatgttttcacaaagcatggaccacttttcccacatctgcattttatataatatcgatggtaatgtagtaaccaagacgactccttttgttgcctatca

SEQ ID NO: 109823 - DNA, 358 bp, Homo sapiens
gataatagaaaagcaagccataatacctaaaaagtattacctcctactcaaacatatacctctcccccaaagtaagccataatacctaaaaatgtcactctctccccttttccttgaagaccctcagctccagcggggtcctgccctatacccaggaagaaggaatgctgcacagagtccaagaagaatctgaacagacaggccttgctgggtccccctgccccacccagtctattaccattagataacaccctttgtctactaacatttctacaggcctctccctttcttcattcttcattgagcctaagcataaaaacagttttccctaggtctttgggtcttcatttctgaaagc

SEQ ID NO: 109824 - DNA, 189 bp, Homo sapiens
aagagttctgagataagtgaaatagagcttctgtgctattttccagccagagagaggggacaacccatgtttctgtcttcatgttaatgacaaatgctttttaaagataaggataaaagaagcagtcttttcttgagagtcaagaagtgtattagttaagagctcaactaaagggtcatgttgtttcca

SEQ ID NO: 109825 - DNA, 681 bp, Homo sapiens
taaatcctgcatagaggcagggttaatttggaattcattctggagatggcagagctctggcaatggcagtagggccagaggctgcagccagcgtctgttgtggtggcagtggctgctcccaagccagggtgggctgaggtcctgcctggtttttttgtttgtttgtttgtttgtttgtttgtttgtttgttttgagacagagtctcgctctcttgcccacgatggagtgcagcagcacaatcttggctcactgtaacctctgcttctggggttcaagcgatgctcctgcctcagcctcccgagtagttgggactacagacacccaccaccacacccagctaatttttccatttttagtagagacgaggtttcgccaccttggccaggctggtctgaaacacctgacctcgtgatccgccctcatctgcctcaaagtgctgggattacaggcgtgagccaccgcacccagccgtcctgcctatttgacgagcctggctctgcaggcttccctaaggtgcatgagcttcttgccatcctgtgagcaattgcccccgtgtctacagtaaccttagatgacgtcttctttaatcaaagtgcccttgctggtaccagggatgtgtaacaagtgattacagaaacgtgaagggaatgtgaattggaaatctggcctcattaaacttg

SEQ ID NO: 109826 - DNA, 549 bp, Homo sapiens
atcaaaagcagcaaccactgaagatatgcagagcagatctagcatacggataacaggagtcactgaagaaggaaaccaaagcaagaaagcaagccaacactaaaaattataactccaaaaaacttcactgaaatacaagaaaaatgtagaactacattttggaagaccagacagtatacctgagaatatggatctagaatgacaaatacctattgatattctagtgaaaacaatactgcactttaaagaaaaagaaaaaaggatctagcccaggtgcagtggctcacatctgtaatcccagcactttgggaatccaaggtgggtggatcgcttgatcccaggagttcgagaccagcccaggcaacatagtgagaccctgtatccatttttaaaaaaaattatccaggcatgatgtcacacacctgtagttccagctacttgggaggctgaggtggtaggacaaactgagcccaggagtctgaggttgcagtgagctgtgatcacatgactataatccagcctgggcaacacagtgagaccttgtcccaa

SEQ ID NO: 109827 - DNA, 565 bp, Homo sapiens
tggcccccccattcatatgtcaaaacctaaccctcaatgcaaggtggggcctgcaggtgaccaggtcctgaagcagagacctcatgaacgcgatgagtgcccttacacaaaagcctggagggagcccgtcttccaccatgagatgacacacagaaggcaccatctgtgaggaatgggcctcaaccagacactgattctgctggaggcttgatgctggacttcccagcctccacagctgtgaacaatacatttccgtggttttataaatgaccctgtctaaggcgttctgttacagcagcacaaaggaactaagacagtgggcacccgtatttccatttagaggcggaaactgactctgaagtgagaaccggtccactctgagagcacatcgccaggggaagaggactgtagccaggaagttgttatgtcatggggtcatgggaggacccagcaatgttgtttctgatgatttctgaaaggcggctcttttctggaagtggacagatgatgggggaggggcaggaagctgaattcaccacagtgtccgagaacactgtctaccagc

SEQ ID NO: 109828 - DNA, 851 bp, Homo sapiens
gtactagacataccaccattgcaataaaaataacaaatagtaacaaactctacaaagatgggtgtgggacaaatctgatttgcagagttgccaccttatattatttaaattttccagttttcaacaacaacaaaagatgtgaagaaacagcaattacagccgcctatatatgggggaaaaaacttagaaaacagaaaccatccctgagaaaacccagacattagatctattaaacaaaaagtttgtcaacctttaaatatgctttaaaaactaaagtaaaccgtggacaaagaacaggagaaaggaaaataatgtataaacaaagtgaaagtatcagtaaatagaaaacatgaaaaattctggagctgaaaaatttcttagaggggtttacagatttaaacaggcagaagaatcagcaaatttgaaaataggacaaatgtaattatccagtccgaggaacagaaagaaaaaagaatgaagagtgaacagagcttgagggatctgtggcattttatcaagttaccaacatacgcattaaaggagttccagaaaatgaaaagaaaaaggcagaaataatatttgaggaaataatggctgagacttcccaaattcaatgaaatacatgagctacacattcaagaagatcaacaaattataactaggataaactcagagatctattactaaacacattacaatcaagctgtcaaaagccagagacaaagacagtcgttaaagcagcaggagaaaaacaacttatcacatacaagggatcctgtgtaagattaaatgcctaccactcatcagaaactacagaggtcagaaggctgtagaatgacatattcaaagtg

SEQ ID NO: 109829 - DNA, 920 bp, Homo sapiens
gtactagacataccaccattgcaataaaaataacaaatagtaacaaactctacaaagatgggtgtgggacaaatctgatttgcagagttgccaccttatattatttaaattttccagttttcaacaacaacaaaagatgtgaagaaacagcaattacagccgcctatatatgggggaaaaaacttagaaaacagaaaccatccctgagaaaacccagacattagatctattaaacaaaaagtttgtcaacctttaaatatgctttaaaaactaaagtaaaccgtggacaaagaacaggagaaaggaaaataatgtataaacaaagtgaaagtatcagtaaatagaaaacatgaaaaattctggagctgaaaaatttcttagaggggtttacagatttaaacaggcagaagaatcagcaaatttgaaaataggacaaatgtaattatccagtccgaggaacagaaagaaaaaagaatgaagagtgaacagagcttgagggatctgtggcattttatcaagttaccaacatacgcattaaaggagttccagaaaatgaaaagaaaaaggcagaaataatatttgaggaaataatggctgagacttcccaaattcaatgaaatacatgagctacacattcaagaagatcaacaaattataactaggataaactcagagatctattactaaacacattacaatcaagctgtcaaaagccagagacaaagacagtcgttaaagcagcaggagaaaaacaacttatcacatacaagggatcctgtgtaagattaaatgcctaccactcatcagaaactacagaggtcagaaggctggtctcaaactcctgacctcaagtgatctgcctcccttggcttcccaaagtgctgggattacaggcgtgagcctctgagcctggcataaca

SEQ ID NO: 109830 - DNA, 509 bp, Homo sapiens
atttcagcggtgcctttccaagaagcactcagcagcttcttctcccccagtacttgggtcttcccagtgtcaatccagagcatatcagaattgaaataccagataaaagtgaaatgcaaagtgatatttcggtgccgttacattcggttttgtaatatcagcaacttttagataacattaatatgagcaaattaacctctcataggttttattatttttcataagtaataaaagaatgctcagcagaaagcccccagctcttgagtgttacataaaagtgacctcaaatttttaatatggcgcaaagcttgttaatcctgcttggatttcatgcttaaaccttcattagtacattagtcttccaaatataatttatttagacttaagtactccaattcttatgatgaagtggcaaaagctgtgccgtattttgcaaattgcagatggcattttctagactagaattaagggattcagtgctaaagttcaatttttcatggttttgtcaa

SEQ ID NO: 109831 - DNA, 355 bp, Homo sapiens
accacacatggcttcgctgccctgcctctaaccccacacaaattctagccaggagaccctgcacccaccccaacaggctgagcagcaacaaccacgaccacccaacaccaaatgttgctgccgggtgtgaagtggccggtccagaacacggggtccctgactggactcacagggccagggctgggaatcttccccgcacctctctcagctggcacaggagagagggcacacaagagagagcttcagggtgacagggcacagaagtcacccaaatctctgactctgttcatggccatcatggtttccagcttcccttgagggaggcagaaaaaggggagaaactgaaggcctgact

SEQ ID NO: 109832 - DNA, 556 bp, Homo sapiens
tactgatgagtgtgtatttgatttataatttttctcataacaaacagtgttgctatatcttgtacaaatatcacaatgaattaatagtttcactcctatggggtatattcccaaacgtgaggtttctgtgtaaaagcgtgcgtacttttcatttaaatagatattgccagttttctaaaaagtctcttactgcacacttcttcctgcagcatgtgagactgttttcttgtttcccatttgtagctggtgttactatttttttgtttagttggtctgataaatatagactgatgttaccttaattgaataggcagcttttcatgtccgccatttggatttgctttcataggaattgcgtattcatatcctttgtccatttttcaatttttagcagtttacactattcagaattttcccctacaaaatatcctttgcctaccagcaagtgtgacatcttttttcttgtaaaagttactgtttatataaacaaacatacataattttctgttgcatctagtcttggtcaagaccctagattatatacggattctagagg

SEQ ID NO: 109833 - DNA, 878 bp, Homo sapiens
gcactccagcctggccagtaagagtgaaactccgtctccaaaagaaaaaaaaagagcacagactccagaattaaattccttgtatttgaatcctggggctctaacaagtattagatgtgggaccaaacaagttacttacttaatctctctgtacctcagtttcctcagctgtaaaatggggataataaaaatatcaacctcacaggggtgttgagcatgaaattatgcttagaatggtgtctagccttagtaagagctgtattagctcactagtacgattacagggattcattaagatggctaaagtcaaaaagacagaaaacagcatgaggaggaggtagagaatttagaaccttcatacattgctgttgggaatgttaaatggtgtgaccatttggaaaagtctggtagctcctcaaaatgttaaatatagagttaccacatgacccagcagttccactcataggtaaacacccaagagaaataaaaacatagatccatgtacaggatccacaaaaacatgtacaggaatgttcatagcagcattaatcataacagccaaaaagtagaaacaatccaaatgtccatcaactgagaatggataagcaaaaatgtgggccgggcgtggtggcttacacctataatcccagcactttgggaggccgaggcaggaggatggcttgagctcaggagttcgagatcagcctgggcaccatagtgagacctagtctctactaaaattaaaaaaaattagctgggcatggtggcatgagcctgtagtcccagctacttgggaggctgaatcaggaggatcgtttcagcccaggaaatcaaagctacagtgaggtctgattgtgccactgtactccagcctgggt

SEQ ID NO: 109834 - DNA, 827 bp, Homo sapiens
gagaatgaacatatgagcacatttagactgctcctttcaattctccctctcacacaacaacctcgctaacaggttggcgagtggagggatcttactcttactcaactctcatttgggtaagagaatttgctacttgttccaggaagccttctcataagccctggccaggtctgtgaagaatctttctactttcctcttataccaggttataaggttatagatttatcagaatcaatcgcatcatcacccaagctgtcaaaaatgtgaacattcgtggatttttttctatttgcaagccaaaaaatgaagactgtcaacttcatggatattagaagaaggcatgagattcctaggcctgatgaaaaatatttgatggttcatcacacaaatggaagcaagagctccatatctgtatctgttccccacgtccactccaagtgacagggatgatcaaagagacccaactggatgctttctgctcagtagattttgatcacagctgaggaatctcaaggttaagaaatcccagtgctttggcagggcacggtggctcacgcctgtaatcccagcacttttggaggccgaggcgggcagatcacgaggtcaggagattgagaccatcctggctaacacggtgaaaccccgtctctactaaaaatacaaaaaaaaaaagaaaattagccaggtgtggtggcgggtacctgtaggcccagctactctggaggctgaggcaggagaatggcgtgaacccaggaggtggagcttgcagtgagccgaaattgtgccactgcactccagcctgggtgacagagtgagactccgtctca

SEQ ID NO: 109835 - DNA, 370 bp, Homo sapiens
ctcggcctaccaaagtgctgggattacaggcttgagctaccatgcttggccttcaaacactttttctgtttgtgctttcagtaaaattttattaagagtcttccctgtgtttggtgctgaggatacaatgagaaatcagatgatgttgttggccttttgggggatctctgctgtcacacttggctgattttactggaattgtttttgaaatttttttttatgcttccttccgtttgtgattagaggatatagaacatgatctcttaataaccaagtaattatgaacaacatttttcttgcacttaggaaccccgaggcaatgagtctgccccctccacccctccacgctgctgtgctatcgcaggtggtc

SEQ ID NO: 109836 - DNA, 603 bp, Homo sapiens
atgatatcaagtgaacatttgaatccaaaagaaaggagggaagagcactaagaatagtatatatgaaaagctatattttcatttctcaaatgttataaaatgtaatggactgtttagagcacaaataataacaaaatgatggtttctaacaaaggaaaagtaaaacatgtgatgattgcagaaatagaggatgagaagatgctatttacagctcttaacgtggtatatgaagtgatataatgtcaattcagtatcgatgtagacaagttaagtaaggatgcttactgttattattagagcaaccattgaaaaagaggaataaaagcaaaacagccatagaagagataagttgaataactaaacaaaaaaaccaacagcatgattatcccaagagaagacaggaaacgtggagtaaaaatactaagaactaaaagcacagataaacaacaaatagcaagctgctatatttaatccaaattacattaatacttacattaaatgttaatgaactaaacattccaatcgaaaagcaggggttgtcacactggatataaataaagaattaagtacttttttttaaaagagatatacattacctataaa

SEQ ID NO: 109837 - DNA, 381 bp, Homo sapiens
  misc_feature (330)..(330): n is a, c, g, or t
gttgttccctctcttatttatttttttctattaatttttcatttgtgtgggtacataatgaatgtatttctcttgttatttctgacacaagataaatcttaagttcgtttctactatacttttatgaggtttctgcaggcctttatgaccttgtgacaagggatttcttggccattggctaccaggcagcaagtggttcatcagtttcccatctgaagctgaagggcacaactgtttggagattccctgagtgaggggacatactcagagacctagaaggagattaggcagctctgcatagtacttgaaaataattcctcttcattcccnagattgtgccattgcactccagcctgggcaacaagggggaaacgctgtctc

SEQ ID NO: 109838 - DNA, 115 bp, Homo sapiens
tatgatataccacttaatggtccagacccacaattccttttggtgaagaagttttcatgaggctgggtgcagtagctcatgctcgtaattccagcactttggaaggccaaggcgg

SEQ ID NO: 109839 - DNA, 378 bp, Homo sapiens
aggtccaagtcacagaacctctcccagccatttttctaggatgattccttctctctctctctctctttctttcaacagagtcttgctctgttgcccaggctggaaagagaggagaggagaggagaggagaggagagaagagaagtaggggaattggcaaagcagcagtagagaggagcaccatgagaagcgagagaagtcacagtgtagcaccctaggggattctggattggaggcactgctagcttggaagtgaaggtagaggcaaatgggctaacagtcagatcctcatctaaatcctgtgcagccaggtgaatgctgcttctcgtaccctttcagaatatggaagatttactttctattaagattgcccagagat

SEQ ID NO: 109840 - DNA, 510 bp, Homo sapiens
ccaagtaacctataaaggaaaacctatcagattaacagcagatttctcagcagaaactctacaagctagaagggattggggcccgatcttcagcctccttaaacaaaacaatcatcagccaagaattttgtatctagcgaaactaagcattatatatgaaggagagatacagtctttttcagacaaacaaatggtgagagaattcgccattaccaagccaccactacaagaactgctaaaataagctctgaatcttgaaacaaatcctggaaacacatcaaaacagaacctctttaaagcataaattcacacaggatctataaaacataaatacaagttaaaaagcaaaagcaaaaaacaaataaacaagaacccaaagtacacaggcaacaaagagcacgatgaatgcaacagtacctcacatttcattactaacattggacttaaatgctccacttaaagacacagaactgcagaatggataagaactcactaaccaactatctgatg

SEQ ID NO: 109841 - DNA, 7301 bp, Homo sapiens
  misc_feature (1011)..(1011): n is a, c, g, or t
cagccgggtgacccaggccgaggccggcagaagacagcctgatgccttgaagacttcctcttgcacttttgttggagggtgctggtttgctaaaagcagagagtatttttctttttatttattttgtttttaattttttaattttagctccagctcagttgcccagactggagagcagtggccaatcatagcttactgcctcctggaactcctggctcaatcgatcctcctggataagcctcctccgggtactatagcttcatggcggctgaagagatgcattggcctgtccctatgaaggccattggtgcccagaacctgctaaccatgcctgggggcgtggccaaggctggctacctgcacaagaagggcggtacccagctgcagctgctgaaatggcccctgcgctttgtcatcatccacaaacgctgcgtctactacttcaagagtagcacctctgcctccccgcagggcgccttctccctgagtggctataaccgggtgatgcgggcggctgaggagaccacgtccaacaacgttttccccttcaagatcatccacatcagcaagaagcaccgcacgtggttcttctcggcctcctccgaggaggagcgcaagagctggatggccttgctgcgcagggagattggccacttccacgaaaagaaagacctgcccttggacaccagcgactccagctcggacacagacagcttctacggcgcagttgagcggcctgtggatatcagcctttccccgtaccccacggacaatgaagactatgagcacgacgatgaggatgactcctacctggagcctgactccccggagcccggaaggcttgaggatgccctgatgcacccaccggcttacccaccacccccagtgcccacgcccaggaagccagccttctctgacatgccccgggcccactcctttacctccaagggccccggtcccctactgccacccccgccccctaagcacggcctcccagatgttggcctggcngctgaggactccaagagggacccactgtgcccgaggcgggctgagccttgccccagggtacctgctaccccccgaaggatgagcgatccccctctgagcaccatgcccaccgcacccggcctccggaaacccccttgcttccgggagagtgccagccccagcccggagccctggacccctggccacggggcctgctccacttccagtgctgccatcatggccactgccacctccagaaactgtgacaaactcaagtccttccacctgtccccccgaggaccacccacatctgagcccccacctgtgccagccaacaagcccaagttcctgaagatagctgaagaggaccccccaagggaggcagccatgcccggactctttgtgccccccgtggctccccggcctcctgcgctgaagctgccagtgcctgaggccatggcgcggcccgcagtcctgcccaggccagagaagccgcagctcccgcacctccagcgatcaccccccgatgggcagagtttcaggagcttctcctttgaaaagccccggcaaccctcacaggctgacactggcggggacgactcggacgaggactatgagaaggtgccactgcccaactcggtcttcgtcaacaccacggagtcctgcgaagtggaaaggttgttcaaggctacaagcccccggggagagccccaggatggactctactgcatccggaactcctctaccaagtcggggaaggtcctggttgtgtgggacgaaacctctaacaaagtgaggaactatcgcatttttgagaaggactctaagttctacctggagggcgaggtcctgtttgtgagtgtgggcagcatggtggagcactaccacacccacgtgctgcccagccaccagagcctgctgctgcggcacccctacggctacactgggcctaggtgatggcagtccatgtggctgccaggccaaggcagtcacaggggccctgaccccaggccacacagacggacatgggcccacatgggagggtgagcaggagcaaggctgtgcttgcctagggcctctgtgatggacatctcgtaggacccagccagtctcatccagcaggttgggttctagggctgaaccaggcgccaggctccagaggacgaagggactctgttgccccacactaacttgccctgtcccaatcccagaaacccaggaccaagctgtgcctgggctccaaggacaggaacactggtccccccatcacactcacccctaagtgggctgggagccaggcagggccagggcagctgggtgggggccggggctggccctgggacccccaggaacgctaagacacaggctccagtaggggctgttgcctccaataaagcagcagtgagctttgccttggtggctggggcttgattgggaaggaggggattaccagcttactgggtgcccatgctgatgtctaagtggtgaccgcagcagtacccgggaaccccaacagttggttgtcttgtcttccagggtgcaggtcactgagtgacttccccagggtgcacagcgagtaacagatcaggacccaaacttgggcagtctgggctgggagcccacaccccactcaccagttctgctgcctcaggtcaggccagggcagtgctgctgcagagctagaaggccctgcagctacagctgcttcattccctgcattagtgcctggttactgggtacctcctgagtggctgtccccgttccagaacttgcatacactgagcgggctacagagctagaaggccctgcagctacagctgcttcattccctgcattagcgagcagttattgggtacctcctgcatgcctggtcccattccagacaggggcctctggcctggctgagttcacagcccagtctggggacagctgggtatgaggtgcttacggcacagtgtccagggcagctgggtgtgcagggactgggggctcccggaagattttttggaggaagtaacagctacgatgggatgggaacagtggaccctaagcaggccaagggtgcgtagggacggtggtacccagatgcccaagtcttccaggcaatacctggctcaggcccagccccaatccatccccttactttctgccatggagttccagcaggtcactctccctggcacaccttccaggctggatttttaatgaaacagactcagggaggtaggggctggcagggaccctagaatccttgtgatttttcttagcaccttatgtcagggaaacctaaactgaggtcagcacttgggcccactgacagtgactgactgggggagaaggtcctgcagcccccttcccctgggtgtgttctggggacctgtggtttgctggcggaaacaagtgatgaggctggttagcggatgtgggaggctgtgaccccagggggccatagggtgcggtggaactgcaggccctgcagatgacggcagccagctgcttccaggaaccaggtgtccaaggccacctctgcaggggtttcctcttcagcctgcctggggtgagaggtcagtgcaccacagccgaggctggagcacagggagcttctgttgttctgatctatctctggaaaaccagccattcctcctccctgcagtcagaattctttgccctgtctgacctgaacttgcttagggagtcatgccactccccactgtggccatagtttctcttcctgtaaaattttattattttagttttttgtttttgagatgtagtctcaccctgtcgcccaggctggagtgcaatgccgtgatctccgctcactgccacctccgcctctctagttcaagcgattttcctgcctcagcctcccgagtagctgggattccaggcgcccgccaccacgcctggctaattttttgtatttttagtagagacgggattttatcatgttggccaggctggtctcgaactcctgacctcaggtgatctgcccaccttggcctcccaaagtgctgggattacaggcatgagccactgtgcctggccccttcctgtaaaatttttaaatggagaattgggtgcgagatgtggtttccagcctggtgcctggggtgctgtgctagtgagtggtgcagtccaggacacctttgctttatgtcacttacacggtcacctggagccggctcaagtggctaaagcatcctggggcccagagccaggtgatagtccctctggccaactggacagttgaggcttgtggttaacccgaagcccagctggggccttggtccagcttcgcttcccagattctgcacctgctagcacagctgtccacgtctgtgtgagctgttctaggccgagggcctcagtttcaagagtgtgttggggtgggatggggcaggccgtggtcctccagcatgaagaaggagccatgaggagttcccatgacctcccgagacttgccataagtgttctagtccacatataagggtagggttgggattaccatttactgaccacatctgtgaggtgccgagctgggtgcttgacatcatttgcttggagaagcagctgttagtagacccattttacaggtgagagaaccaagtctcacagaggcctgggttcaagtcccacctctgccactaactggcatgtgaccctatctatccttcactgctctgagcctagaccctggcccctgcctggctccctgccaggctccctgccacccctcacgacctctgatggtcgttgtgggggtctcttgcctggctcccagggctagggttagggctctggaggtgctttcactcaaccaagggggccacagcactggggagtgaaactgccccgcctcaccctgcgttgccctctgggtctgtgagggtgggctggcaggaggcctaggccttgccctaggggcagtcctgcttcctcattttatagatagggaaactgaggctttgggaggactcactgacatacctaccttcaagatgagttcaggtgggctcagttctggggcttgggaaaagggccccagtggctttgggaagcacccccagcccagggtgaaacatgcttcttctcttcctgtggttccatccgaaggattgtggtgagccccgtgccttcagttaataaagatttgtattgtgaaaagattttttcttttttttttgggacacagtctcactctgtcgcccaggctagagtggattggcgtgatctcggctcaatgcaaatctccagggttcaatcgattctcctgcctcaccctcccatgtagctgggattacagctgcctgccaaatttttgtatttttagtggaaccggggtttcaccatgttggccaggctggtcttgaactcctgacctcaactgatccgcccaccttggcctcccaagtgctgggattacaggcgcgagccacggcgcccagccttgaaaagatgtttttagaaccagaagaaacctcggttcccactgatccttctgggccacgttgtgcggagctcccctgctggttggggctcagcgcagccccagggaggtgcttcctgcacctcaggatgggcgagggtgggcattgggggagagggggacctgggacctgcggcttagttccctgaggcaggcagggcttattggggccatttcatagaaaggcagattgaagctcagcagggaagaagcttttgagggtgatccaggcgctggagggatggcctaggacaccagggtcacaccaggaacatgggagggccgtgcttgtctctagacgaggggaatgggggaagggccacaacctctgtttctgtgacccagcagcatcaagcccctcgctgggcacctcgcacacaccccctgccttatctctgcctgcacgccctgttccctccacctagactgcctgctgagggggcagtgccaggaggttgcctgtccttggggaagaggggcagtgaccctgtgaagatgcttgacagacaacccccaccacctcagaagtgtgtgtgagtggtgaacccttttaagccatcttccagccattctcactggagggagatttgatgggtacagagcagacccctacctgtctaccctccttcggacccctaggaagcttcgcaggccttccaggctgccagacagctgccctggcgttgccgtctgcttcttccctggccccactctgaggggctcagagctgaggcagaatccctttttcattcatttcctgcagaataaaacaacatacagaaaagtgaataaaacataaatgcacaacctaacacactgttaggaagtaaacgatctgcaaccaccatcaggaaatagttttgccagcacccaagtgccctcccctcacagtgtcacttccggcctctctgccctggcttatgtgagtcttgtgttcttgtttttctaaaaagtcttcagcacccaattatgcaagcattgcagtattttcctgtttctgtgctttatccccttgaatcatacagatgcaaattctggcagctggcttctttggctcgttattatgtctgtgagatttattcatgttgctgtgcgtagtatagtttgtgcatgttcattgctaaaaacttccattgtttggctgtatcgtagttcacagattcatttcactgtcagtcaagcttgtccaatgcatgcagcccaggatgcctttgaatgtggcccaacacaaatttgtaaactttcttaaaacattataaagatttttgtttgcgatttttttttttagctcatcagctatagttagtggtagtgtattttatgcgtgacccgagacagttcttccggtatggtccatggaagccaaaagattggacatgcctgctgtagatggacagttggtttgtttctagtttggggtaactacacacaatgctgctagcaacagttttgtccatgtctctgatgcacgtgtgttttttgcaaatggtgcacaaatttttctagggtttgtactcaggagtctgactcctgggttctagggtatgaagatctttctaaatattgttctagtttacgtgcccaccagcagtaaaacagaattcccttgccttcccatccttggcagacatttcacttttgccagtctggtggggtgtatagttatggccttaatttgcatttagctaattaccaaggagattgagcatatttttatgtttttattaaccattttgattttgtctcctgtgaagtgtctatcatcttttgcccattttttaacttgttgtctttttctttttcttttctttttttttttttt

SEQ ID NO: 109842 - DNA, 7248 bp, Homo sapiens
  misc_feature (958)..(958): n is a, c, g, or t
ggggaggagccggcggctgccaggccagggccggcgggcatggcgggctccgggccggccgcggagctggggccggcgggaggcgggcgcccgggacgaggcggcggcggccgggggacgcggcccggggccgtgccggtgctcgcaggggaggcgggcgtggatcgccccggggaagccggccatgcccgccgcgtggacgcccttcatggcggctgaagagatgcattggcctgtccctatgaaggccattggtgcccagaacctgctaaccatgcctgggggcgtggccaaggctggctacctgcacaagaagggcggtacccagctgcagctgctgaaatggcccctgcgctttgtcatcatccacaaacgctgcgtctactacttcaagagtagcacctctgcctccccgcagggcgccttctccctgagtggctataaccgggtgatgcgggcggctgaggagaccacgtccaacaacgttttccccttcaagatcatccacatcagcaagaagcaccgcacgtggttcttctcggcctcctccgaggaggagcgcaagagctggatggccttgctgcgcagggagattggccacttccacgaaaagaaagacctgcccttggacaccagcgactccagctcggacacagacagcttctacggcgcagttgagcggcctgtggatatcagcctttccccgtaccccacggacaatgaagactatgagcacgacgatgaggatgactcctacctggagcctgactccccggagcccggaaggcttgaggatgccctgatgcacccaccggcttacccaccacccccagtgcccacgcccaggaagccagccttctctgacatgccccgggcccactcctttacctccaagggccccggtcccctactgccacccccgccccctaagcacggcctcccagatgttggcctggcngctgaggactccaagagggacccactgtgcccgaggcgggctgagccttgccccagggtacctgctaccccccgaaggatgagcgatccccctctgagcaccatgcccaccgcacccggcctccggaaacccccttgcttccgggagagtgccagccccagcccggagccctggacccctggccacggggcctgctccacttccagtgctgccatcatggccactgccacctccagaaactgtgacaaactcaagtccttccacctgtccccccgaggaccacccacatctgagcccccacctgtgccagccaacaagcccaagttcctgaagatagctgaagaggaccccccaagggaggcagccatgcccggactctttgtgccccccgtggctccccggcctcctgcgctgaagctgccagtgcctgaggccatggcgcggcccgcagtcctgcccaggccagagaagccgcagctcccgcacctccagcgatcaccccccgatgggcagagtttcaggagcttctcctttgaaaagccccggcaaccctcacaggctgacactggcggggacgactcggacgaggactatgagaaggtgccactgcccaactcggtcttcgtcaacaccacggagtcctgcgaagtggaaaggttgttcaaggctacaagcccccggggagagccccaggatggactctactgcatccggaactcctctaccaagtcggggaaggtcctggttgtgtgggacgaaacctctaacaaagtgaggaactatcgcatttttgagaaggactctaagttctacctggagggcgaggtcctgtttgtgagtgtgggcagcatggtggagcactaccacacccacgtgctgcccagccaccagagcctgctgctgcggcacccctacggctacactgggcctaggtgatggcagtccatgtggctgccaggccaaggcagtcacaggggccctgaccccaggccacacagacggacatgggcccacatgggagggtgagcaggagcaaggctgtgcttgcctagggcctctgtgatggacatctcgtaggacccagccagtctcatccagcaggttgggttctagggctgaaccaggcgccaggctccagaggacgaagggactctgttgccccacactaacttgccctgtcccaatcccagaaacccaggaccaagctgtgcctgggctccaaggacaggaacactggtccccccatcacactcacccctaagtgggctgggagccaggcagggccagggcagctgggtgggggccggggctggccctgggacccccaggaacgctaagacacaggctccagtaggggctgttgcctccaataaagcagcagtgagctttgccttggtggctggggcttgattgggaaggaggggattaccagcttactgggtgcccatgctgatgtctaagtggtgaccgcagcagtacccgggaaccccaacagttggttgtcttgtcttccagggtgcaggtcactgagtgacttccccagggtgcacagcgagtaacagatcaggacccaaacttgggcagtctgggctgggagcccacaccccactcaccagttctgctgcctcaggtcaggccagggcagtgctgctgcagagctagaaggccctgcagctacagctgcttcattccctgcattagtgcctggttactgggtacctcctgagtggctgtccccgttccagaacttgcatacactgagcgggctacagagctagaaggccctgcagctacagctgcttcattccctgcattagcgagcagttattgggtacctcctgcatgcctggtcccattccagacaggggcctctggcctggctgagttcacagcccagtctggggacagctgggtatgaggtgcttacggcacagtgtccagggcagctgggtgtgcagggactgggggctcccggaagattttttggaggaagtaacagctacgatgggatgggaacagtggaccctaagcaggccaagggtgcgtagggacggtggtacccagatgcccaagtcttccaggcaatacctggctcaggcccagccccaatccatccccttactttctgccatggagttccagcaggtcactctccctggcacaccttccaggctggatttttaatgaaacagactcagggaggtaggggctggcagggaccctagaatccttgtgatttttcttagcaccttatgtcagggaaacctaaactgaggtcagcacttgggcccactgacagtgactgactgggggagaaggtcctgcagcccccttcccctgggtgtgttctggggacctgtggtttgctggcggaaacaagtgatgaggctggttagcggatgtgggaggctgtgaccccagggggccatagggtgcggtggaactgcaggccctgcagatgacggcagccagctgcttccaggaaccaggtgtccaaggccacctctgcaggggtttcctcttcagcctgcctggggtgagaggtcagtgcaccacagccgaggctggagcacagggagcttctgttgttctgatctatctctggaaaaccagccattcctcctccctgcagtcagaattctttgccctgtctgacctgaacttgcttagggagtcatgccactccccactgtggccatagtttctcttcctgtaaaattttattattttagttttttgtttttgagatgtagtctcaccctgtcgcccaggctggagtgcaatgccgtgatctccgctcactgccacctccgcctctctagttcaagcgattttcctgcctcagcctcccgagtagctgggattccaggcgcccgccaccacgcctggctaattttttgtatttttagtagagacgggattttatcatgttggccaggctggtctcgaactcctgacctcaggtgatctgcccaccttggcctcccaaagtgctgggattacaggcatgagccactgtgcctggccccttcctgtaaaatttttaaatggagaattgggtgcgagatgtggtttccagcctggtgcctggggtgctgtgctagtgagtggtgcagtccaggacacctttgctttatgtcacttacacggtcacctggagccggctcaagtggctaaagcatcctggggcccagagccaggtgatagtccctctggccaactggacagttgaggcttgtggttaacccgaagcccagctggggccttggtccagcttcgcttcccagattctgcacctgctagcacagctgtccacgtctgtgtgagctgttctaggccgagggcctcagtttcaagagtgtgttggggtgggatggggcaggccgtggtcctccagcatgaagaaggagccatgaggagttcccatgacctcccgagacttgccataagtgttctagtccacatataagggtagggttgggattaccatttactgaccacatctgtgaggtgccgagctgggtgcttgacatcatttgcttggagaagcagctgttagtagacccattttacaggtgagagaaccaagtctcacagaggcctgggttcaagtcccacctctgccactaactggcatgtgaccctatctatccttcactgctctgagcctagaccctggcccctgcctggctccctgccaggctccctgccacccctcacgacctctgatggtcgttgtgggggtctcttgcctggctcccagggctagggttagggctctggaggtgctttcactcaaccaagggggccacagcactggggagtgaaactgccccgcctcaccctgcgttgccctctgggtctgtgagggtgggctggcaggaggcctaggccttgccctaggggcagtcctgcttcctcattttatagatagggaaactgaggctttgggaggactcactgacatacctaccttcaagatgagttcaggtgggctcagttctggggcttgggaaaagggccccagtggctttgggaagcacccccagcccagggtgaaacatgcttcttctcttcctgtggttccatccgaaggattgtggtgagccccgtgccttcagttaataaagatttgtattgtgaaaagattttttcttttttttttgggacacagtctcactctgtcgcccaggctagagtggattggcgtgatctcggctcaatgcaaatctccagggttcaatcgattctcctgcctcaccctcccatgtagctgggattacagctgcctgccaaatttttgtatttttagtggaaccggggtttcaccatgttggccaggctggtcttgaactcctgacctcaactgatccgcccaccttggcctcccaagtgctgggattacaggcgcgagccacggcgcccagccttgaaaagatgtttttagaaccagaagaaacctcggttcccactgatccttctgggccacgttgtgcggagctcccctgctggttggggctcagcgcagccccagggaggtgcttcctgcacctcaggatgggcgagggtgggcattgggggagagggggacctgggacctgcggcttagttccctgaggcaggcagggcttattggggccatttcatagaaaggcagattgaagctcagcagggaagaagcttttgagggtgatccaggcgctggagggatggcctaggacaccagggtcacaccaggaacatgggagggccgtgcttgtctctagacgaggggaatgggggaagggccacaacctctgtttctgtgacccagcagcatcaagcccctcgctgggcacctcgcacacaccccctgccttatctctgcctgcacgccctgttccctccacctagactgcctgctgagggggcagtgccaggaggttgcctgtccttggggaagaggggcagtgaccctgtgaagatgcttgacagacaacccccaccacctcagaagtgtgtgtgagtggtgaacccttttaagccatcttccagccattctcactggagggagatttgatgggtacagagcagacccctacctgtctaccctccttcggacccctaggaagcttcgcaggccttccaggctgccagacagctgccctggcgttgccgtctgcttcttccctggccccactctgaggggctcagagctgaggcagaatccctttttcattcatttcctgcagaataaaacaacatacagaaaagtgaataaaacataaatgcacaacctaacacactgttaggaagtaaacgatctgcaaccaccatcaggaaatagttttgccagcacccaagtgccctcccctcacagtgtcacttccggcctctctgccctggcttatgtgagtcttgtgttcttgtttttctaaaaagtcttcagcacccaattatgcaagcattgcagtattttcctgtttctgtgctttatccccttgaatcatacagatgcaaattctggcagctggcttctttggctcgttattatgtctgtgagatttattcatgttgctgtgcgtagtatagtttgtgcatgttcattgctaaaaacttccattgtttggctgtatcgtagttcacagattcatttcactgtcagtcaagcttgtccaatgcatgcagcccaggatgcctttgaatgtggcccaacacaaatttgtaaactttcttaaaacattataaagatttttgtttgcgatttttttttttagctcatcagctatagttagtggtagtgtattttatgcgtgacccgagacagttcttccggtatggtccatggaagccaaaagattggacatgcctgctgtagatggacagttggtttgtttctagtttggggtaactacacacaatgctgctagcaacagttttgtccatgtctctgatgcacgtgtgttttttgcaaatggtgcacaaatttttctagggtttgtactcaggagtctgactcctgggttctagggtatgaagatctttctaaatattgttctagtttacgtgcccaccagcagtaaaacagaattcccttgccttcccatccttggcagacatttcacttttgccagtctggtggggtgtatagttatggccttaatttgcatttagctaattaccaaggagattgagcatatttttatgtttttattaaccattttgattttgtctcctgtgaagtgtctatcatcttttgcccattttttaacttgttgtctttttctttttcttttctttttttttttttt

SEQ ID NO: 109843 - DNA, 3691 bp, Homo sapiens
  misc_feature (958)..(958): n is a, c, g, or t
ggggaggagccggcggctgccaggccagggccggcgggcatggcgggctccgggccggccgcggagctggggccggcgggaggcgggcgcccgggacgaggcggcggcggccgggggacgcggcccggggccgtgccggtgctcgcaggggaggcgggcgtggatcgccccggggaagccggccatgcccgccgcgtggacgcccttcatggcggctgaagagatgcattggcctgtccctatgaaggccattggtgcccagaacctgctaaccatgcctgggggcgtggccaaggctggctacctgcacaagaagggcggtacccagctgcagctgctgaaatggcccctgcgctttgtcatcatccacaaacgctgcgtctactacttcaagagtagcacctctgcctccccgcagggcgccttctccctgagtggctataaccgggtgatgcgggcggctgaggagaccacgtccaacaacgttttccccttcaagatcatccacatcagcaagaagcaccgcacgtggttcttctcggcctcctccgaggaggagcgcaagagctggatggccttgctgcgcagggagattggccacttccacgaaaagaaagacctgcccttggacaccagcgactccagctcggacacagacagcttctacggcgcagttgagcggcctgtggatatcagcctttccccgtaccccacggacaatgaagactatgagcacgacgatgaggatgactcctacctggagcctgactccccggagcccggaaggcttgaggatgccctgatgcacccaccggcttacccaccacccccagtgcccacgcccaggaagccagccttctctgacatgccccgggcccactcctttacctccaagggccccggtcccctactgccacccccgccccctaagcacggcctcccagatgttggcctggcngctgaggactccaagagggacccactgtgcccgaggcgggctgagccttgccccagggtacctgctaccccccgaaggatgagcgatccccctctgagcaccatgcccaccgcacccggcctccggaaacccccttgcttccgggagagtgccagccccagcccggagccctggacccctggccacggggcctgctccacttccagtgctgccatcatggccactgccacctccagaaactgtgacaaactcaagtccttccacctgtccccccgaggaccacccacatctgagcccccacctgtgccagccaacaagcccaagttcctgaagatagctgaagaggaccccccaagggaggcagccatgcccggactctttgtgccccccgtggctccccggcctcctgcgctgaagctgccagtgcctgaggccatggcgcggcccgcagtcctgcccaggccagagaagccgcagctcccgcacctccagcgatcaccccccgatgggcagagtttcaggagcttctcctttgaaaagccccggcaaccctcacaggctgacactggcggggacgactcggacgaggactatgagaaggtgccactgcccaactcggtcttcgtcaacaccacggagtcctgcgaagtggaaaggttgttcaaggctacaagcccccggggagagccccaggatggactctactgcatccggaactcctctaccaagtcggggaaggtcctggttgtgtgggacgaaacctctaacaaagtgaggaactatcgcatttttgagaaggactctaagttctacctggagggcgaggtcctgtttgtgagtgtgggcagcatggtggagcactaccacacccacgtgctgcccagccaccagagcctgctgctgcggcacccctacggctacactgggcctaggtgatggcagtccatgtggctgccaggccaaggcagtcacaggggccctgaccccaggccacacagacggacatgggcccacatgggagggtgagcaggagcaaggctgtgcttgcctagggcctctgtgatggacatctcgtaggacccagccagtctcatccagcaggttgggttctagggctgaaccaggcgccaggctccagaggacgaagggactctgttgccccacactaacttgccctgtcccaatcccagaaacccaggaccaagctgtgcctgggctccaaggacaggaacactggtccccccatcacactcacccctaagtgggctgggagccaggcagggccagggcagctgggtgggggccggggctggccctgggacccccaggaacgctaagacacaggctccagtaggggctgttgcctccaataaagcagcagtgagctttgccttggtggctggggcttgattgggaaggaggggattaccagcttactgggtgcccatgctgatgtctaagtggtgaccgcagcagtacccgggaaccccaacagttggttgtcttgtcttccagggtgcaggtcactgagtgacttccccagggtgcacagcgagtaacagatcaggacccaaacttgggcagtctgggctgggagcccacaccccactcaccagttctgctgcctcaggtcaggccagggcagtgctgctgcagagctagaaggccctgcagctacagctgcttcattccctgcattagtgcctggttactgggtacctcctgagtggctgtccccgttccagaacttgcatacactgagcgggctacagagctagaaggccctgcagctacagctgcttcattccctgcattagcgagcagttattgggtacctcctgcatgcctggtcccattccagacaggggcctctggcctggctgagttcacagcccagtctggggacagctgggtatgaggtgcttacggcacagtgtccagggcagctgggtgtgcagggactgggggctcccggaagattttttggaggaagtaacagctacgatgggatgggaacagtggaccctaagcaggccaagggtgcgtagggacggtggtacccagatgcccaagtcttccaggcaatacctggctcaggcccagccccaatccatccccttactttctgccatggagttccagcaggtcactctccctggcacaccttccaggctggatttttaatgaaacagactcagggaggtaggggctggcagggaccctagaatccttgtgatttttcttagcaccttatgtcagggaaacctaaactgaggtcagcacttgggcccactgacagtgactgactgggggagaaggtcctgcagcccccttcccctgggtgtgttctggggacctgtggtttgctggcggaaacaagtgatgaggctggttagcggatgtgggaggctgtgaccccagggggccatagggtgcggtggaactgcaggccctgcagatgacggcagccagctgcttccaggaaccaggtgtccaaggccacctctgcaggggtttcctcttcagcctgcctggggtgagaggtcagtgcaccacagccgaggctggagcacagggagcttctgttgttctgatctatctctggaaaaccagccattcctcctccctgcagtcagaattctttgccctgtctgacctgaacttgcttagggagtcatgccactccccactgtggttagctgtttctctgggggatcctctggagacgactat

SEQ ID NO: 109844 - DNA, 3646 bp, Homo sapiens
  misc_feature (958)..(958): n is a, c, g, or t
ggggaggagccggcggctgccaggccagggccggcgggcatggcgggctccgggccggccgcggagctggggccggcgggaggcgggcgcccgggacgaggcggcggcggccgggggacgcggcccggggccgtgccggtgctcgcaggggaggcgggcgtggatcgccccggggaagccggccatgcccgccgcgtggacgcccttcatggcggctgaagagatgcattggcctgtccctatgaaggccattggtgcccagaacctgctaaccatgcctgggggcgtggccaaggctggctacctgcacaagaagggcggtacccagctgcagctgctgaaatggcccctgcgctttgtcatcatccacaaacgctgcgtctactacttcaagagtagcacctctgcctccccgcagggcgccttctccctgagtggctataaccgggtgatgcgggcggctgaggagaccacgtccaacaacgttttccccttcaagatcatccacatcagcaagaagcaccgcacgtggttcttctcggcctcctccgaggaggagcgcaagagctggatggccttgctgcgcagggagattggccacttccacgaaaagaaagacctgcccttggacaccagcgactccagctcggacacagacagcttctacggcgcagttgagcggcctgtggatatcagcctttccccgtaccccacggacaatgaagactatgagcacgacgatgaggatgactcctacctggagcctgactccccggagcccggaaggcttgaggatgccctgatgcacccaccggcttacccaccacccccagtgcccacgcccaggaagccagccttctctgacatgccccgggcccactcctttacctccaagggccccggtcccctactgccacccccgccccctaagcacggcctcccagatgttggcctggcngctgaggactccaagagggacccactgtgcccgaggcgggctgagccttgccccagggtacctgctaccccccgaaggatgagcgatccccctctgagcaccatgcccaccgcacccggcctccggaaacccccttgcttccgggagagtgccagccccagcccggagccctggacccctggccacggggcctgctccacttccagtgctgccatcatggccactgccacctccagaaactgtgacaaactcaagtccttccacctgtccccccgaggaccacccacatctgagcccccacctgtgccagccaacaagcccaagttcctgaagatagctgaagaggaccccccaagggaggcagccatgcccggactctttgtgccccccgtggctccccggcctcctgcgctgaagctgccagtgcctgaggccatggcgcggcccgcagtcctgcccaggccagagaagccgcagctcccgcacctccagcgatcaccccccgatgggcagagtttcaggagcttctcctttgaaaagccccggcaaccctcacaggctgacactggcggggacgactcggacgaggactatgagaaggtgccactgcccaactcggtcttcgtcaacaccacggagtcctgcgaagtggaaaggttgttcaaggctacaagcccccggggagagccccaggatggactctactgcatccggaactcctctaccaagtcggggaaggtcctggttgtgtgggacgaaacctctaacaaagtgaggaactatcgcatttttgagaaggactctaagttctacctggagggcgaggtcctgtttgtgagtgtgggcagcatggtggagcactaccacacccacgtgctgcccagccaccagagcctgctgctgcggcacccctacggctacactgggcctaggtgatggcagtccatgtggctgccaggccaaggcagtcacaggggccctgaccccaggccacacagacggacatgggcccacatgggagggtgagcaggagcaaggctgtgcttgcctagggcctctgtgatggacatctcgtaggacccagccagtctcatccagcaggttgggttctagggctgaaccaggcgccaggctccagaggacgaagggactctgttgccccacactaacttgccctgtcccaatcccagaaacccaggaccaagctgtgcctgggctccaaggacaggaacactggtccccccatcacactcacccctaagtgggctgggagccaggcagggccagggcagctgggtgggggccggggctggccctgggacccccaggaacgctaagacacaggctccagtaggggctgttgcctccaataaagcagcagtgagctttgccttggtggctggggcttgattgggaaggaggggattaccagcttactgggtgcccatgctgatgtctaagtggtgaccgcagcagtacccgggaaccccaacagttggttgtcttgtcttccagggtgcaggtcactgagtgacttccccagggtgcacagcgagtaacagatcaggacccaaacttgggcagtctgggctgggagcccacaccccactcaccagttctgctgcctcaggtcaggccagggcagtgctgctgcagagctagaaggccctgcagctacagctgcttcattccctgcattagtgcctggttactgggtacctcctgagtggctgtccccgttccagaacttgcatacactgagcgggctacagagctagaaggccctgcagctacagctgcttcattccctgcattagcgagcagttattgggtacctcctgcatgcctggtcccattccagacaggggcctctggcctggctgagttcacagcccagtctggggacagctgggtatgaggtgcttacggcacagtgtccagggcagctgggtgtgcagggactgggggctcccggaagattttttggaggaagtaacagctacgatgggatgggaacagtggaccctaagcaggccaagggtgcgtagggacggtggtacccagatgcccaagtcttccaggcaatacctggctcaggcccagccccaatccatccccttactttctgccatggagttccagcaggtcactctccctggcacaccttccaggctggatttttaatgaaacagactcagggaggtaggggctggcagggaccctagaatccttgtgatttttcttagcaccttatgtcagggaaacctaaactgaggtcagcacttgggcccactgacagtgactgactgggggagaaggtcctgcagcccccttcccctgggtgtgttctggggacctgtggtttgctggcggaaacaagtgatgaggctggttagcggatgtgggaggctgtgaccccagggggccatagggtgcggtggaactgcaggccctgcagatgacggcagccagctgcttccaggaaccaggtgtccaaggccacctctgcaggggtttcctcttcagcctgcctggggtgagaggtcagttatttggaggaaaaaaatcacacagggagagcttatgacgatgtgatcgaactcgggaaagcagccactcgatactacctagcaagtcacagttcggagccccgtgatgacctgaactcagacttagggtgctcatccc

SEQ ID NO: 109845 - DNA, 7480 bp, Homo sapiens
  misc_feature (555)..(555): n is a, c, g, or t
  misc_feature (1190)..(1190): n is a, c, g, or t
cagccgggtgacccaggccgaggccggcagaagacagcctgatgccttgaagacttcctcttgcacttttgttggagggtgctggtttgctaaaagcagagagtatttttctttttatttattttgtttttaattttttaattttagctccagctcagttgcccagactggagagcagtggccaatcatagcttactgcctcctggaactcctggctcaatcgatcctcctggataagcctcctccgggtactatagcttcatggcggctgaagagatgcattggcctgtccctatgaaggccattggtgcccagaacctgctaaccatgcctgggggcgtggccaaggctggctacctgcacaagaagggcggtacccagctgcagctgctgaaatggcccctgcgctttgtcatcatccacaaacgctgcgtctactacttcaagagtagcacctctgcctccccgcagggcgccttctccctgagtggctataaccggcagcccagaccccagccagcccaggccctgtcccaaacagaggctgggccctangattccctgctccagggtcctcccaggccgggatcagtttccagcttcacgcatgtcctgggctgggctctatccagtgatgggccatgagctgccctggagggccttctgcactaacaggcagggtgatgcgggcggctgaggagaccacgtccaacaacgttttccccttcaagatcatccacatcagcaagaagcaccgcacgtggttcttctcggcctcctccgaggaggagcgcaagagctggatggccttgctgcgcagggagattggccacttccacgaaaagaaagacctgcccttggacaccagcgactccagctcggacacagacagcttctacggcgcagttgagcggcctgtggatatcagcctttccccgtaccccacggacaatgaagactatgagcacgacgatgaggatgactcctacctggagcctgactccccggagcccggaaggcttgaggatgccctgatgcacccaccggcttacccaccacccccagtgcccacgcccaggaagccagccttctctgacatgccccgggcccactcctttacctccaagggccccggtcccctactgccacccccgccccctaagcacggcctcccagatgttggcctggcngctgaggactccaagagggacccactgtgcccgaggcgggctgagccttgccccagggtacctgctaccccccgaaggatgagcgatccccctctgagcaccatgcccaccgcacccggcctccggaaacccccttgcttccgggagagtgccagccccagcccggagccctggacccctggccacggggcctgctccacttccagtgctgccatcatggccactgccacctccagaaactgtgacaaactcaagtccttccacctgtccccccgaggaccacccacatctgagcccccacctgtgccagccaacaagcccaagttcctgaagatagctgaagaggaccccccaagggaggcagccatgcccggactctttgtgccccccgtggctccccggcctcctgcgctgaagctgccagtgcctgaggccatggcgcggcccgcagtcctgcccaggccagagaagccgcagctcccgcacctccagcgatcaccccccgatgggcagagtttcaggagcttctcctttgaaaagccccggcaaccctcacaggctgacactggcggggacgactcggacgaggactatgagaaggtgccactgcccaactcggtcttcgtcaacaccacggagtcctgcgaagtggaaaggttgttcaaggctacaagcccccggggagagccccaggatggactctactgcatccggaactcctctaccaagtcggggaaggtcctggttgtgtgggacgaaacctctaacaaagtgaggaactatcgcatttttgagaaggactctaagttctacctggagggcgaggtcctgtttgtgagtgtgggcagcatggtggagcactaccacacccacgtgctgcccagccaccagagcctgctgctgcggcacccctacggctacactgggcctaggtgatggcagtccatgtggctgccaggccaaggcagtcacaggggccctgaccccaggccacacagacggacatgggcccacatgggagggtgagcaggagcaaggctgtgcttgcctagggcctctgtgatggacatctcgtaggacccagccagtctcatccagcaggttgggttctagggctgaaccaggcgccaggctccagaggacgaagggactctgttgccccacactaacttgccctgtcccaatcccagaaacccaggaccaagctgtgcctgggctccaaggacaggaacactggtccccccatcacactcacccctaagtgggctgggagccaggcagggccagggcagctgggtgggggccggggctggccctgggacccccaggaacgctaagacacaggctccagtaggggctgttgcctccaataaagcagcagtgagctttgccttggtggctggggcttgattgggaaggaggggattaccagcttactgggtgcccatgctgatgtctaagtggtgaccgcagcagtacccgggaaccccaacagttggttgtcttgtcttccagggtgcaggtcactgagtgacttccccagggtgcacagcgagtaacagatcaggacccaaacttgggcagtctgggctgggagcccacaccccactcaccagttctgctgcctcaggtcaggccagggcagtgctgctgcagagctagaaggccctgcagctacagctgcttcattccctgcattagtgcctggttactgggtacctcctgagtggctgtccccgttccagaacttgcatacactgagcgggctacagagctagaaggccctgcagctacagctgcttcattccctgcattagcgagcagttattgggtacctcctgcatgcctggtcccattccagacaggggcctctggcctggctgagttcacagcccagtctggggacagctgggtatgaggtgcttacggcacagtgtccagggcagctgggtgtgcagggactgggggctcccggaagattttttggaggaagtaacagctacgatgggatgggaacagtggaccctaagcaggccaagggtgcgtagggacggtggtacccagatgcccaagtcttccaggcaatacctggctcaggcccagccccaatccatccccttactttctgccatggagttccagcaggtcactctccctggcacaccttccaggctggatttttaatgaaacagactcagggaggtaggggctggcagggaccctagaatccttgtgatttttcttagcaccttatgtcagggaaacctaaactgaggtcagcacttgggcccactgacagtgactgactgggggagaaggtcctgcagcccccttcccctgggtgtgttctggggacctgtggtttgctggcggaaacaagtgatgaggctggttagcggatgtgggaggctgtgaccccagggggccatagggtgcggtggaactgcaggccctgcagatgacggcagccagctgcttccaggaaccaggtgtccaaggccacctctgcaggggtttcctcttcagcctgcctggggtgagaggtcagtgcaccacagccgaggctggagcacagggagcttctgttgttctgatctatctctggaaaaccagccattcctcctccctgcagtcagaattctttgccctgtctgacctgaacttgcttagggagtcatgccactccccactgtggccatagtttctcttcctgtaaaattttattattttagttttttgtttttgagatgtagtctcaccctgtcgcccaggctggagtgcaatgccgtgatctccgctcactgccacctccgcctctctagttcaagcgattttcctgcctcagcctcccgagtagctgggattccaggcgcccgccaccacgcctggctaattttttgtatttttagtagagacgggattttatcatgttggccaggctggtctcgaactcctgacctcaggtgatctgcccaccttggcctcccaaagtgctgggattacaggcatgagccactgtgcctggccccttcctgtaaaatttttaaatggagaattgggtgcgagatgtggtttccagcctggtgcctggggtgctgtgctagtgagtggtgcagtccaggacacctttgctttatgtcacttacacggtcacctggagccggctcaagtggctaaagcatcctggggcccagagccaggtgatagtccctctggccaactggacagttgaggcttgtggttaacccgaagcccagctggggccttggtccagcttcgcttcccagattctgcacctgctagcacagctgtccacgtctgtgtgagctgttctaggccgagggcctcagtttcaagagtgtgttggggtgggatggggcaggccgtggtcctccagcatgaagaaggagccatgaggagttcccatgacctcccgagacttgccataagtgttctagtccacatataagggtagggttgggattaccatttactgaccacatctgtgaggtgccgagctgggtgcttgacatcatttgcttggagaagcagctgttagtagacccattttacaggtgagagaaccaagtctcacagaggcctgggttcaagtcccacctctgccactaactggcatgtgaccctatctatccttcactgctctgagcctagaccctggcccctgcctggctccctgccaggctccctgccacccctcacgacctctgatggtcgttgtgggggtctcttgcctggctcccagggctagggttagggctctggaggtgctttcactcaaccaagggggccacagcactggggagtgaaactgccccgcctcaccctgcgttgccctctgggtctgtgagggtgggctggcaggaggcctaggccttgccctaggggcagtcctgcttcctcattttatagatagggaaactgaggctttgggaggactcactgacatacctaccttcaagatgagttcaggtgggctcagttctggggcttgggaaaagggccccagtggctttgggaagcacccccagcccagggtgaaacatgcttcttctcttcctgtggttccatccgaaggattgtggtgagccccgtgccttcagttaataaagatttgtattgtgaaaagattttttcttttttttttgggacacagtctcactctgtcgcccaggctagagtggattggcgtgatctcggctcaatgcaaatctccagggttcaatcgattctcctgcctcaccctcccatgtagctgggattacagctgcctgccaaatttttgtatttttagtggaaccggggtttcaccatgttggccaggctggtcttgaactcctgacctcaactgatccgcccaccttggcctcccaagtgctgggattacaggcgcgagccacggcgcccagccttgaaaagatgtttttagaaccagaagaaacctcggttcccactgatccttctgggccacgttgtgcggagctcccctgctggttggggctcagcgcagccccagggaggtgcttcctgcacctcaggatgggcgagggtgggcattgggggagagggggacctgggacctgcggcttagttccctgaggcaggcagggcttattggggccatttcatagaaaggcagattgaagctcagcagggaagaagcttttgagggtgatccaggcgctggagggatggcctaggacaccagggtcacaccaggaacatgggagggccgtgcttgtctctagacgaggggaatgggggaagggccacaacctctgtttctgtgacccagcagcatcaagcccctcgctgggcacctcgcacacaccccctgccttatctctgcctgcacgccctgttccctccacctagactgcctgctgagggggcagtgccaggaggttgcctgtccttggggaagaggggcagtgaccctgtgaagatgcttgacagacaacccccaccacctcagaagtgtgtgtgagtggtgaacccttttaagccatcttccagccattctcactggagggagatttgatgggtacagagcagacccctacctgtctaccctccttcggacccctaggaagcttcgcaggccttccaggctgccagacagctgccctggcgttgccgtctgcttcttccctggccccactctgaggggctcagagctgaggcagaatccctttttcattcatttcctgcagaataaaacaacatacagaaaagtgaataaaacataaatgcacaacctaacacactgttaggaagtaaacgatctgcaaccaccatcaggaaatagttttgccagcacccaagtgccctcccctcacagtgtcacttccggcctctctgccctggcttatgtgagtcttgtgttcttgtttttctaaaaagtcttcagcacccaattatgcaagcattgcagtattttcctgtttctgtgctttatccccttgaatcatacagatgcaaattctggcagctggcttctttggctcgttattatgtctgtgagatttattcatgttgctgtgcgtagtatagtttgtgcatgttcattgctaaaaacttccattgtttggctgtatcgtagttcacagattcatttcactgtcagtcaagcttgtccaatgcatgcagcccaggatgcctttgaatgtggcccaacacaaatttgtaaactttcttaaaacattataaagatttttgtttgcgatttttttttttagctcatcagctatagttagtggtagtgtattttatgcgtgacccgagacagttcttccggtatggtccatggaagccaaaagattggacatgcctgctgtagatggacagttggtttgtttctagtttggggtaactacacacaatgctgctagcaacagttttgtccatgtctctgatgcacgtgtgttttttgcaaatggtgcacaaatttttctagggtttgtactcaggagtctgactcctgggttctagggtatgaagatctttctaaatattgttctagtttacgtgcccaccagcagtaaaacagaattcccttgccttcccatccttggcagacatttcacttttgccagtctggtggggtgtatagttatggccttaatttgcatttagctaattaccaaggagattgagcatatttttatgtttttattaaccattttgattttgtctcctgtgaagtgtctatcatcttttgcccattttttaacttgttgtctttttctttttcttttctttttttttttttt

SEQ ID NO: 109846 - DNA, 7194 bp, Homo sapiens
  misc_feature (904)..(904): n is a, c, g, or t
caaggccctcagaaaaggggtttccttgcctgtcatggccctaccctccaagctgtgtcctggatcttggcagtgtccccctgagcgccctggctcagacatctcctgcctgaccgtagctgagccacgtgcctttgtcctttattgcagcttcatggcggctgaagagatgcattggcctgtccctatgaaggccattggtgcccagaacctgctaaccatgcctgggggcgtggccaaggctggctacctgcacaagaagggcggtacccagctgcagctgctgaaatggcccctgcgctttgtcatcatccacaaacgctgcgtctactacttcaagagtagcacctctgcctccccgcagggcgccttctccctgagtggctataaccgggtgatgcgggcggctgaggagaccacgtccaacaacgttttccccttcaagatcatccacatcagcaagaagcaccgcacgtggttcttctcggcctcctccgaggaggagcgcaagagctggatggccttgctgcgcagggagattggccacttccacgaaaagaaagacctgcccttggacaccagcgactccagctcggacacagacagcttctacggcgcagttgagcggcctgtggatatcagcctttccccgtaccccacggacaatgaagactatgagcacgacgatgaggatgactcctacctggagcctgactccccggagcccggaaggcttgaggatgccctgatgcacccaccggcttacccaccacccccagtgcccacgcccaggaagccagccttctctgacatgccccgggcccactcctttacctccaagggccccggtcccctactgccacccccgccccctaagcacggcctcccagatgttggcctggcngctgaggactccaagagggacccactgtgcccgaggcgggctgagccttgccccagggtacctgctaccccccgaaggatgagcgatccccctctgagcaccatgcccaccgcacccggcctccggaaacccccttgcttccgggagagtgccagccccagcccggagccctggacccctggccacggggcctgctccacttccagtgctgccatcatggccactgccacctccagaaactgtgacaaactcaagtccttccacctgtccccccgaggaccacccacatctgagcccccacctgtgccagccaacaagcccaagttcctgaagatagctgaagaggaccccccaagggaggcagccatgcccggactctttgtgccccccgtggctccccggcctcctgcgctgaagctgccagtgcctgaggccatggcgcggcccgcagtcctgcccaggccagagaagccgcagctcccgcacctccagcgatcaccccccgatgggcagagtttcaggagcttctcctttgaaaagccccggcaaccctcacaggctgacactggcggggacgactcggacgaggactatgagaaggtgccactgcccaactcggtcttcgtcaacaccacggagtcctgcgaagtggaaaggttgttcaaggctacaagcccccggggagagccccaggatggactctactgcatccggaactcctctaccaagtcggggaaggtcctggttgtgtgggacgaaacctctaacaaagtgaggaactatcgcatttttgagaaggactctaagttctacctggagggcgaggtcctgtttgtgagtgtgggcagcatggtggagcactaccacacccacgtgctgcccagccaccagagcctgctgctgcggcacccctacggctacactgggcctaggtgatggcagtccatgtggctgccaggccaaggcagtcacaggggccctgaccccaggccacacagacggacatgggcccacatgggagggtgagcaggagcaaggctgtgcttgcctagggcctctgtgatggacatctcgtaggacccagccagtctcatccagcaggttgggttctagggctgaaccaggcgccaggctccagaggacgaagggactctgttgccccacactaacttgccctgtcccaatcccagaaacccaggaccaagctgtgcctgggctccaaggacaggaacactggtccccccatcacactcacccctaagtgggctgggagccaggcagggccagggcagctgggtgggggccggggctggccctgggacccccaggaacgctaagacacaggctccagtaggggctgttgcctccaataaagcagcagtgagctttgccttggtggctggggcttgattgggaaggaggggattaccagcttactgggtgcccatgctgatgtctaagtggtgaccgcagcagtacccgggaaccccaacagttggttgtcttgtcttccagggtgcaggtcactgagtgacttccccagggtgcacagcgagtaacagatcaggacccaaacttgggcagtctgggctgggagcccacaccccactcaccagttctgctgcctcaggtcaggccagggcagtgctgctgcagagctagaaggccctgcagctacagctgcttcattccctgcattagtgcctggttactgggtacctcctgagtggctgtccccgttccagaacttgcatacactgagcgggctacagagctagaaggccctgcagctacagctgcttcattccctgcattagcgagcagttattgggtacctcctgcatgcctggtcccattccagacaggggcctctggcctggctgagttcacagcccagtctggggacagctgggtatgaggtgcttacggcacagtgtccagggcagctgggtgtgcagggactgggggctcccggaagattttttggaggaagtaacagctacgatgggatgggaacagtggaccctaagcaggccaagggtgcgtagggacggtggtacccagatgcccaagtcttccaggcaatacctggctcaggcccagccccaatccatccccttactttctgccatggagttccagcaggtcactctccctggcacaccttccaggctggatttttaatgaaacagactcagggaggtaggggctggcagggaccctagaatccttgtgatttttcttagcaccttatgtcagggaaacctaaactgaggtcagcacttgggcccactgacagtgactgactgggggagaaggtcctgcagcccccttcccctgggtgtgttctggggacctgtggtttgctggcggaaacaagtgatgaggctggttagcggatgtgggaggctgtgaccccagggggccatagggtgcggtggaactgcaggccctgcagatgacggcagccagctgcttccaggaaccaggtgtccaaggccacctctgcaggggtttcctcttcagcctgcctggggtgagaggtcagtgcaccacagccgaggctggagcacagggagcttctgttgttctgatctatctctggaaaaccagccattcctcctccctgcagtcagaattctttgccctgtctgacctgaacttgcttagggagtcatgccactccccactgtggccatagtttctcttcctgtaaaattttattattttagttttttgtttttgagatgtagtctcaccctgtcgcccaggctggagtgcaatgccgtgatctccgctcactgccacctccgcctctctagttcaagcgattttcctgcctcagcctcccgagtagctgggattccaggcgcccgccaccacgcctggctaattttttgtatttttagtagagacgggattttatcatgttggccaggctggtctcgaactcctgacctcaggtgatctgcccaccttggcctcccaaagtgctgggattacaggcatgagccactgtgcctggccccttcctgtaaaatttttaaatggagaattgggtgcgagatgtggtttccagcctggtgcctggggtgctgtgctagtgagtggtgcagtccaggacacctttgctttatgtcacttacacggtcacctggagccggctcaagtggctaaagcatcctggggcccagagccaggtgatagtccctctggccaactggacagttgaggcttgtggttaacccgaagcccagctggggccttggtccagcttcgcttcccagattctgcacctgctagcacagctgtccacgtctgtgtgagctgttctaggccgagggcctcagtttcaagagtgtgttggggtgggatggggcaggccgtggtcctccagcatgaagaaggagccatgaggagttcccatgacctcccgagacttgccataagtgttctagtccacatataagggtagggttgggattaccatttactgaccacatctgtgaggtgccgagctgggtgcttgacatcatttgcttggagaagcagctgttagtagacccattttacaggtgagagaaccaagtctcacagaggcctgggttcaagtcccacctctgccactaactggcatgtgaccctatctatccttcactgctctgagcctagaccctggcccctgcctggctccctgccaggctccctgccacccctcacgacctctgatggtcgttgtgggggtctcttgcctggctcccagggctagggttagggctctggaggtgctttcactcaaccaagggggccacagcactggggagtgaaactgccccgcctcaccctgcgttgccctctgggtctgtgagggtgggctggcaggaggcctaggccttgccctaggggcagtcctgcttcctcattttatagatagggaaactgaggctttgggaggactcactgacatacctaccttcaagatgagttcaggtgggctcagttctggggcttgggaaaagggccccagtggctttgggaagcacccccagcccagggtgaaacatgcttcttctcttcctgtggttccatccgaaggattgtggtgagccccgtgccttcagttaataaagatttgtattgtgaaaagattttttcttttttttttgggacacagtctcactctgtcgcccaggctagagtggattggcgtgatctcggctcaatgcaaatctccagggttcaatcgattctcctgcctcaccctcccatgtagctgggattacagctgcctgccaaatttttgtatttttagtggaaccggggtttcaccatgttggccaggctggtcttgaactcctgacctcaactgatccgcccaccttggcctcccaagtgctgggattacaggcgcgagccacggcgcccagccttgaaaagatgtttttagaaccagaagaaacctcggttcccactgatccttctgggccacgttgtgcggagctcccctgctggttggggctcagcgcagccccagggaggtgcttcctgcacctcaggatgggcgagggtgggcattgggggagagggggacctgggacctgcggcttagttccctgaggcaggcagggcttattggggccatttcatagaaaggcagattgaagctcagcagggaagaagcttttgagggtgatccaggcgctggagggatggcctaggacaccagggtcacaccaggaacatgggagggccgtgcttgtctctagacgaggggaatgggggaagggccacaacctctgtttctgtgacccagcagcatcaagcccctcgctgggcacctcgcacacaccccctgccttatctctgcctgcacgccctgttccctccacctagactgcctgctgagggggcagtgccaggaggttgcctgtccttggggaagaggggcagtgaccctgtgaagatgcttgacagacaacccccaccacctcagaagtgtgtgtgagtggtgaacccttttaagccatcttccagccattctcactggagggagatttgatgggtacagagcagacccctacctgtctaccctccttcggacccctaggaagcttcgcaggccttccaggctgccagacagctgccctggcgttgccgtctgcttcttccctggccccactctgaggggctcagagctgaggcagaatccctttttcattcatttcctgcagaataaaacaacatacagaaaagtgaataaaacataaatgcacaacctaacacactgttaggaagtaaacgatctgcaaccaccatcaggaaatagttttgccagcacccaagtgccctcccctcacagtgtcacttccggcctctctgccctggcttatgtgagtcttgtgttcttgtttttctaaaaagtcttcagcacccaattatgcaagcattgcagtattttcctgtttctgtgctttatccccttgaatcatacagatgcaaattctggcagctggcttctttggctcgttattatgtctgtgagatttattcatgttgctgtgcgtagtatagtttgtgcatgttcattgctaaaaacttccattgtttggctgtatcgtagttcacagattcatttcactgtcagtcaagcttgtccaatgcatgcagcccaggatgcctttgaatgtggcccaacacaaatttgtaaactttcttaaaacattataaagatttttgtttgcgatttttttttttagctcatcagctatagttagtggtagtgtattttatgcgtgacccgagacagttcttccggtatggtccatggaagccaaaagattggacatgcctgctgtagatggacagttggtttgtttctagtttggggtaactacacacaatgctgctagcaacagttttgtccatgtctctgatgcacgtgtgttttttgcaaatggtgcacaaatttttctagggtttgtactcaggagtctgactcctgggttctagggtatgaagatctttctaaatattgttctagtttacgtgcccaccagcagtaaaacagaattcccttgccttcccatccttggcagacatttcacttttgccagtctggtggggtgtatagttatggccttaatttgcatttagctaattaccaaggagattgagcatatttttatgtttttattaaccattttgattttgtctcctgtgaagtgtctatcatcttttgcccattttttaacttgttgtctttttctttttcttttctttttttttttttt

SEQ ID NO: 109847 - DNA, 7138 bp, Homo sapiens
  misc_feature (904)..(904): n is a, c, g, or t
caaggccctcagaaaaggggtttccttgcctgtcatggccctaccctccaagctgtgtcctggatcttggcagtgtccccctgagcgccctggctcagacatctcctgcctgaccgtagctgagccacgtgcctttgtcctttattgcagcttcatggcggctgaagagatgcattggcctgtccctatgaaggccattggtgcccagaacctgctaaccatgcctgggggcgtggccaaggctggctacctgcacaagaagggcggtacccagctgcagctgctgaaatggcccctgcgctttgtcatcatccacaaacgctgcgtctactacttcaagagtagcacctctgcctccccgcagggcgccttctccctgagtggctataaccgggtgatgcgggcggctgaggagaccacgtccaacaacgttttccccttcaagatcatccacatcagcaagaagcaccgcacgtggttcttctcggcctcctccgaggaggagcgcaagagctggatggccttgctgcgcagggagattggccacttccacgaaaagaaagacctgcccttggacaccagcgactccagctcggacacagacagcttctacggcgcagttgagcggcctgtggatatcagcctttccccgtaccccacggacaatgaagactatgagcacgacgatgaggatgactcctacctggagcctgactccccggagcccggaaggcttgaggatgccctgatgcacccaccggcttacccaccacccccagtgcccacgcccaggaagccagccttctctgacatgccccgggcccactcctttacctccaagggccccggtcccctactgccacccccgccccctaagcacggcctcccagatgttggcctggcngctgaggactccaagagggacccactgtgcccgaggcgggctgagccttgccccagggtacctgctaccccccgaaggatgagcgatccccctctgagcaccatgcccaccgcacccggcctccggaaacccccttgcttccgggagagtgccagccccagcccggagccctggacccctggccacggggcctgctccacttccagtgctgccatcatggccactgccacctccagaaactgtgacaaactcaagtccttccacctgtccccccgaggaccacccacatctgagcccccacctgtgccagccaacaagcccaagttcctgaagatagctgaagaggaccccccaagggaggcagccatgcccggactctttgtgccccccgtggctccccggcctcctgcgctgaagctgccagtgcctgaggccatggcgcggcccgcagtcctgcccaggccagagaagccgcagctcccgcacctccagcgatcaccccccgatgggcagagtttcaggagcttctcctttgaaaagccccggcaaccctcacaggctgacactggcggggacgactcggacgaggactatgagaaggttgttcaaggctacaagcccccggggagagccccaggatggactctactgcatccggaactcctctaccaagtcggggaaggtcctggttgtgtgggacgaaacctctaacaaagtgaggaactatcgcatttttgagaaggactctaagttctacctggagggcgaggtcctgtttgtgagtgtgggcagcatggtggagcactaccacacccacgtgctgcccagccaccagagcctgctgctgcggcacccctacggctacactgggcctaggtgatggcagtccatgtggctgccaggccaaggcagtcacaggggccctgaccccaggccacacagacggacatgggcccacatgggagggtgagcaggagcaaggctgtgcttgcctagggcctctgtgatggacatctcgtaggacccagccagtctcatccagcaggttgggttctagggctgaaccaggcgccaggctccagaggacgaagggactctgttgccccacactaacttgccctgtcccaatcccagaaacccaggaccaagctgtgcctgggctccaaggacaggaacactggtccccccatcacactcacccctaagtgggctgggagccaggcagggccagggcagctgggtgggggccggggctggccctgggacccccaggaacgctaagacacaggctccagtaggggctgttgcctccaataaagcagcagtgagctttgccttggtggctggggcttgattgggaaggaggggattaccagcttactgggtgcccatgctgatgtctaagtggtgaccgcagcagtacccgggaaccccaacagttggttgtcttgtcttccagggtgcaggtcactgagtgacttccccagggtgcacagcgagtaacagatcaggacccaaacttgggcagtctgggctgggagcccacaccccactcaccagttctgctgcctcaggtcaggccagggcagtgctgctgcagagctagaaggccctgcagctacagctgcttcattccctgcattagtgcctggttactgggtacctcctgagtggctgtccccgttccagaacttgcatacactgagcgggctacagagctagaaggccctgcagctacagctgcttcattccctgcattagcgagcagttattgggtacctcctgcatgcctggtcccattccagacaggggcctctggcctggctgagttcacagcccagtctggggacagctgggtatgaggtgcttacggcacagtgtccagggcagctgggtgtgcagggactgggggctcccggaagattttttggaggaagtaacagctacgatgggatgggaacagtggaccctaagcaggccaagggtgcgtagggacggtggtacccagatgcccaagtcttccaggcaatacctggctcaggcccagccccaatccatccccttactttctgccatggagttccagcaggtcactctccctggcacaccttccaggctggatttttaatgaaacagactcagggaggtaggggctggcagggaccctagaatccttgtgatttttcttagcaccttatgtcagggaaacctaaactgaggtcagcacttgggcccactgacagtgactgactgggggagaaggtcctgcagcccccttcccctgggtgtgttctggggacctgtggtttgctggcggaaacaagtgatgaggctggttagcggatgtgggaggctgtgaccccagggggccatagggtgcggtggaactgcaggccctgcagatgacggcagccagctgcttccaggaaccaggtgtccaaggccacctctgcaggggtttcctcttcagcctgcctggggtgagaggtcagtgcaccacagccgaggctggagcacagggagcttctgttgttctgatctatctctggaaaaccagccattcctcctccctgcagtcagaattctttgccctgtctgacctgaacttgcttagggagtcatgccactccccactgtggccatagtttctcttcctgtaaaattttattattttagttttttgtttttgagatgtagtctcaccctgtcgcccaggctggagtgcaatgccgtgatctccgctcactgccacctccgcctctctagttcaagcgattttcctgcctcagcctcccgagtagctgggattccaggcgcccgccaccacgcctggctaattttttgtatttttagtagagacgggattttatcatgttggccaggctggtctcgaactcctgacctcaggtgatctgcccaccttggcctcccaaagtgctgggattacaggcatgagccactgtgcctggccccttcctgtaaaatttttaaatggagaattgggtgcgagatgtggtttccagcctggtgcctggggtgctgtgctagtgagtggtgcagtccaggacacctttgctttatgtcacttacacggtcacctggagccggctcaagtggctaaagcatcctggggcccagagccaggtgatagtccctctggccaactggacagttgaggcttgtggttaacccgaagcccagctggggccttggtccagcttcgcttcccagattctgcacctgctagcacagctgtccacgtctgtgtgagctgttctaggccgagggcctcagtttcaagagtgtgttggggtgggatggggcaggccgtggtcctccagcatgaagaaggagccatgaggagttcccatgacctcccgagacttgccataagtgttctagtccacatataagggtagggttgggattaccatttactgaccacatctgtgaggtgccgagctgggtgcttgacatcatttgcttggagaagcagctgttagtagacccattttacaggtgagagaaccaagtctcacagaggcctgggttcaagtcccacctctgccactaactggcatgtgaccctatctatccttcactgctctgagcctagaccctggcccctgcctggctccctgccaggctccctgccacccctcacgacctctgatggtcgttgtgggggtctcttgcctggctcccagggctagggttagggctctggaggtgctttcactcaaccaagggggccacagcactggggagtgaaactgccccgcctcaccctgcgttgccctctgggtctgtgagggtgggctggcaggaggcctaggccttgccctaggggcagtcctgcttcctcattttatagatagggaaactgaggctttgggaggactcactgacatacctaccttcaagatgagttcaggtgggctcagttctggggcttgggaaaagggccccagtggctttgggaagcacccccagcccagggtgaaacatgcttcttctcttcctgtggttccatccgaaggattgtggtgagccccgtgccttcagttaataaagatttgtattgtgaaaagattttttcttttttttttgggacacagtctcactctgtcgcccaggctagagtggattggcgtgatctcggctcaatgcaaatctccagggttcaatcgattctcctgcctcaccctcccatgtagctgggattacagctgcctgccaaatttttgtatttttagtggaaccggggtttcaccatgttggccaggctggtcttgaactcctgacctcaactgatccgcccaccttggcctcccaagtgctgggattacaggcgcgagccacggcgcccagccttgaaaagatgtttttagaaccagaagaaacctcggttcccactgatccttctgggccacgttgtgcggagctcccctgctggttggggctcagcgcagccccagggaggtgcttcctgcacctcaggatgggcgagggtgggcattgggggagagggggacctgggacctgcggcttagttccctgaggcaggcagggcttattggggccatttcatagaaaggcagattgaagctcagcagggaagaagcttttgagggtgatccaggcgctggagggatggcctaggacaccagggtcacaccaggaacatgggagggccgtgcttgtctctagacgaggggaatgggggaagggccacaacctctgtttctgtgacccagcagcatcaagcccctcgctgggcacctcgcacacaccccctgccttatctctgcctgcacgccctgttccctccacctagactgcctgctgagggggcagtgccaggaggttgcctgtccttggggaagaggggcagtgaccctgtgaagatgcttgacagacaacccccaccacctcagaagtgtgtgtgagtggtgaacccttttaagccatcttccagccattctcactggagggagatttgatgggtacagagcagacccctacctgtctaccctccttcggacccctaggaagcttcgcaggccttccaggctgccagacagctgccctggcgttgccgtctgcttcttccctggccccactctgaggggctcagagctgaggcagaatccctttttcattcatttcctgcagaataaaacaacatacagaaaagtgaataaaacataaatgcacaacctaacacactgttaggaagtaaacgatctgcaaccaccatcaggaaatagttttgccagcacccaagtgccctcccctcacagtgtcacttccggcctctctgccctggcttatgtgagtcttgtgttcttgtttttctaaaaagtcttcagcacccaattatgcaagcattgcagtattttcctgtttctgtgctttatccccttgaatcatacagatgcaaattctggcagctggcttctttggctcgttattatgtctgtgagatttattcatgttgctgtgcgtagtatagtttgtgcatgttcattgctaaaaacttccattgtttggctgtatcgtagttcacagattcatttcactgtcagtcaagcttgtccaatgcatgcagcccaggatgcctttgaatgtggcccaacacaaatttgtaaactttcttaaaacattataaagatttttgtttgcgatttttttttttagctcatcagctatagttagtggtagtgtattttatgcgtgacccgagacagttcttccggtatggtccatggaagccaaaagattggacatgcctgctgtagatggacagttggtttgtttctagtttggggtaactacacacaatgctgctagcaacagttttgtccatgtctctgatgcacgtgtgttttttgcaaatggtgcacaaatttttctagggtttgtactcaggagtctgactcctgggttctagggtatgaagatctttctaaatattgttctagtttacgtgcccaccagcagtaaaacagaattcccttgccttcccatccttggcagacatttcacttttgccagtctggtggggtgtatagttatggccttaatttgcatttagctaattaccaaggagattgagcatatttttatgtttttattaaccattttgattttgtctcctgtgaagtgtctatcatcttttgcccattttttaacttgttgtctttttctttttcttttctttttttttttttt

SEQ ID NO: 109848 - DNA, 371 bp, Homo sapiens
ctctcactagcttccgtgttggggagttgctggcacaagttcatggccctgcgtgcagcagaaaccagaggagtggacctccctgctctgtcccatgcccagctggcaccctggctggccagggctctgctgggctgcttctgtcagcctcacggcagcccgacgtgctcagctcctgagacctacaacagcgagaggacagaaagccaggcttgggagcggggcgggaaggtccgtgtgaaagctgcccgaggaggactcacccgctaatatgactgtcttattttaggttgttcaaggctacaagcccccggggagagccccaggatggactctactgcatccggaactcctctaccaagtcggggaag

SEQ ID NO: 109849 - DNA, 494 bp, Homo sapiens
gctcctcatatgctattatctgtcagaatgtgaaccatagatctgatattgcaaaagaaatgtgttttatgcaactttattaatacatttatttaatgtgactccatattcaacagaaacaatccaagatactctcttatttataatagaatacttacttcttttgtgctttctttatggacatagatacatttttcatgataaaaacctagaataaaaattacctttgtttttaaaatctggcaaatcatttcaaaatgaagattttaaaggaatttaaataattggacatgttaacaaaattatctgacttactatattgacaagaaatgcttttacttggttgaatgcaaacagaattgctttgtttcttaaatcagtttaagatatgaacaatgatttcagacagtaccaagtcctagtaacttagaagaaaagtagtattattaatgactgaagccatgtgaagacataaatgattataaaatacaatt

SEQ ID NO: 109850 - DNA, 866 bp, Homo sapiens
gaatgactttggaaaatttacatgaagctcaagtgttaggattgacttatgaaaataaattttatttctatccaaatttgaatgtccaaaccattttttagttacttctttctaatcctagttattcagacaaaatttggaaacttattttatgaccacatctaatattctggctgctttggatacaatactcttgatttatgataattagttaaaatatattaaaaatattattagtaaaataaaatttcacacaataaaaaacaacatagagtacacatatttatatgtatttttaaagataaagaatatctaaaatgtgtttttttcttagctttttagttgtctagaacatttagagaaagagtatgaatatattaaatccacaaacacactatatacttcctcaccactgactattttatcaaatttgccttaaaataatgaaaaagaaaagtatagttaatggtttcaaatatgctaagaaattgactctgcggaggggatcttaaaatgcctgtttactcatgttttcgtatttttcttgtctctaatacttttgtctttgtctgccttgtgtgttcttttctgaatttcatttcagcaatttatgctgctaaatagaatcccgcatgtctgcattcatttacattcaacttattgtaaattttgagattttatttagaaatgaattgtctaattaatttatgtagagtccttttttccaaagagctcaaaacactacatccacattattgacttttggaaaccaaccaaattacttaagaaatggaaaagtagtcacagagaaatttagtaatttgcaaaagccacaacagtagtggaagaattaaaattcataaagt

SEQ ID NO: 109851 - DNA, 782 bp, Homo sapiens
tcagccatttgctatgtttatatttaacaatatgaagccacactggaagcactgtctcaagatttatttcagtaaataattacttggcaagtaattccttactcaaagacaatagttgttaaattctctcaatcccactaaagagtttataaaagtacaacacaaatatacagtataggggttttgttaaaacttctcatgtgatctaacttttatctcattaagaaaacagttaatatatagttttagaaatagctgttgtagctttccagctggtgacatgtggtgctggcattgatctgacttgaggcatcatgctgccagttcacagaatggccagaactggggcttagcactcttcaattctggccaagtgggctcctgctagatctttgtttctgtgtccagcacattttagaatttttgtaacatgaaggccttagtccctcccctgttgctggatacaattgcccaactaatcacctcagcaatgaaaacacatggaccaatagagggcacactttgcattcttttccctgtgctttgttctctgaaattttgtgggatttgtgcttcctttgctttgccctattggttcaggggcgaaacctgctctgctccccccatggacactgtggtcatcttgatgtcatcacagagagaacaaaggaacaaataaaaagaactttcagtcttactgagcatttcttgttttgatcgctaatctccttttgacaagacctcaccaagaggcaaactgaaccaacctcactgttttagta

SEQ ID NO: 109852 - DNA, 475 bp, Homo sapiens
gtctagtaagtccaatgcctgggcttcctcatagacagtttctattaatttgtctttttttcctgtgaatcaaccatattttcttgttttcctgcatgcctcataattttttgttgaatactagacatttggagcactgtaatgtggcaactgtggacataagattctcctccttctccatggtttgttgttgctgttttttataagttgttgttgttggcttatttcatgacttttctaaactatctgtaaaatctgcatttttttcttatatgttgccactgacatctgtgtcttattaccatagtggttagctagtgtttgacagagttatcttaaatgtctgaggaaaaaaaaaaaaagaaggaaagaaaggaatgaaggaagcaagaaaagaagagaagataaaagaaatatttaaaaagaaaaccatgggcgaggcatggtgactcatgcttgtaatcccagcacttcg

SEQ ID NO: 109853 - DNA, 329 bp, Homo sapiens
ttaataatcagataaaatgatatagatgaatattcaatgacacgagaagatatttataaatattttattataaaaactattttaattggttacattatatgtcgctatgccttcagagtagagagaagtgacagtttcaacacaaactgaaaaatttgtaagataatggctgctatttctaggcctgtaaaaattcatttacccaaagaaaatcatagtttttttttttttttctggagatggagtttcgctcttgttgcccaggctggagtgcagtggcgcaaccttggctcactgcaacgtccgcctcccaggttaaagcaattctc

SEQ ID NO: 109854 - DNA, 423 bp, Homo sapiens
gcttcagtggtgaaatatgaaactatagacggactgcgtttcaagaaggagaactgctgaataagtgacaggcatttcaggcagcgcccgaccagatggacagctcatgagtcttcttattttctcaaatattggcaatgggaaaccagattttgctgatctaaagcttttggagactctctgagcctgttccacctccatgctgtcccctggatgccgctattgtccggaccagttagctttgggacagaggttcagctttggcctcttggatttccagagtggaggatgcctgaatcctgaccacagcagcaggccgcccttatccttaacacatcagcatcagggaacgacatctgcagagatgttcagtgccctcagaattggctctaggaacccaaagtaaaattctccaaactgatg

SEQ ID NO: 109855 - DNA, 687 bp, Homo sapiens
aagttggcagtttatcccaacaataagccaggagccagtgatatgtctgatagtactaattatttccaaatattgggaatccagcatgaggcagagtgtagaaagagacattgagttttatttaactgaatttttccatatatttttgatcaagaacactttgggaaatgctactttaagattaccattcattttcttttcccctcacccccttccttggagaaccatcaatgctcacagttccagctgccatcttagtgctaaagtctctcttgtctcagcgcaagcccctctctaccccagctctaggacacccctgcccatagcacaccttcacctagatggctcacagtggggcagagtaggaatctacagaggttcagaggaagttctgaattcattaattcttcattcaacaaatatgaaaaaatgaaactgatggaatggaagaggctctacttctgcaatttttattaaaccaccttgagaactgaaccccaaactcagtgaatctttggttcctaaaggtgtagaatctttactgatctattgccactagaaagatagtaacaacaacaacacaaatctctagtacaccagtgaacaatgaaatcccagtacacctgggaataatgcaatctaggtttaaataatccccccatcatttattacagcatgacttggaca

SEQ ID NO: 109856 - DNA, 375 bp, Homo sapiens
ttgcacgcacatcagtctattagcttattttaccatatcaaaagcccctacacagacaatttttttttcactcctactgtatatgtatgtgtctgtctctatctgacatactgtacctaggaagacaaggatctataaaaagtttgataaacatggtactaacaagaacaacttcatgaatcggtaactttagggtcataatgtttccagcaagaggaaggtcattaatagtagtggttaaatgtttatttaaataagactattccagtaactatgttggaggatggatttgagaaagaagatcagatagggcactaatttaacaatccaaaggatagactaggaagtaataggaggcataaaacaatggggatt

SEQ ID NO: 109857 - DNA, 366 bp, Homo sapiens
agccaatgggaacactaaggtcctgccttcaaatgggatggtcttgctacaattcaagtccacagattcaggttgcaccactggaaatgatatgaactgcacccctcctaccagattgctgagacacatgactgagctcaatttgtatagtactccgttttagcctgaatctttgaattgttttcctcctgatggtgctacaattcatatagaaattaactgtatattgctcatgtttgtggctggctctgtagttccaaccacccccaccccacccccaatattgttatagctactagaaagtaagccaaatgcactttctgagattgtcccaaatatctgttggtcaggtaacagccattataa

SEQ ID NO: 109858 - DNA, 397 bp, Homo sapiens
cacagcccccatcccacacctgcctctcatggggcagctccaagtaagcagctccagagtaagaagcacagagttttaattattaagacttacaaatcgcctgagtggcacctgggagagcagttcgtttaatcatttataaaccttttaatccccccattacaaaaaggataactgttcctcataaactgagaacaatacagaaatgcagggcatggagaggggaagtcctacattatctggtccccacctgccgtggcatttccaccttgaaatgtcatgtgactgctaaatggtgtcatgactgcattcaagaaccctcccttccccaggcagataaggctcttagacatcaaggactgtgttggaaacgaaccaaagcaggggttcttgaact

SEQ ID NO: 109859 - DNA, 347 bp, Homo sapiens
aggaggaaaggcggaatagctggagcaaggggatttttaggccagtgaaactattctgtgtgatacagtaatggtggatacatgacattaggcatttgtcaaaacgtgtggaactgtgcaacatgatgagtgaactctaatgtaaactataaactttggctaataaggtatcaatataattttgtagcaaatgtacaatacccgtgcaagatgtcaataatagatgaaactgcaactgcatgtggtgaggggaggtatgtgggagctctctgcacattctgttcaaattttctgtaaacctaaaactgctctagaaataaagtcaattaattttttttaaaaaaggt

SEQ ID NO: 109860 - DNA, 276 bp, Homo sapiens
agaagccaaaaaaagagagcagagtagctatacttaatgtcaggtaaaataggtattaagataaaaattattaaaaagagacaaggtcattatataatgataaaaaggtcagacaatataaaaattatgtatgtgtgtatctatctatctatctatctgtctccacacatacctaacactggagcacccagatatataaagcaaatattatctgagctaaagagagataccatcacaaagaaggcaagaaaacaaacaaaaacggaaaagagccag

SEQ ID NO: 109861 - DNA, 130 bp, Homo sapiens
aactgaatgaagccaacaagtaacaacataaaggctaatgtgtggtttgttgtgggtttctactgcttttattccttaggaaacaaattactctctcatatggtttccctgactccattttccctaatca

SEQ ID NO: 109862 - DNA, 733 bp, Homo sapiens
tgacctagggaaaaaaaggcatgtagagtattatgtttatactttaaacttgatatttttagtgtattatttaaagataaaggttcttgggtttaaaatacattagaacttaatgcagacatataaagtaacattgagaatgacaactaaaacattccattgttatggtcctgaattttttatgcttcatttcatgtatttattctttgtataattatagcatacatgttatgtaatataacttatgaaaagtacagtgaattttgctttattgcaaagctttaaatataaatttcagagtgcttcagtaaaaagctactatatattgttgtttgttattgtgtaggtaatattttcaattatgaaagtgaaatgcaaatgtctgttatctaactacaaattgtcagatttcttaaaaggacactgtcaggcaaatttgaaaatatacacattgagaataattttttattattatatcctattttaatattaacagctattatgaacaaaatttttcctgttaaatagcgacttcagtattgtgttatgttttacagcgttaaaacaactatgaagatctgcagctattcttttacttaacatgcatatgtactacagagggatttttaaattaattgcaaaatgtgcattagctattgacttagagtgaattgccttttgtatcctgattcacaacacctattcctgttcagtattctttgtcttgaataga

SEQ ID NO: 109863 - DNA, 207 bp, Homo sapiens
ttgtgggtgactctagacgatctttggagatcaggataaggagaacatgactcagtgtcactagataaggacttggtagaggcagagaagagtggagaatgagggcgggaaggaaagtgaagctgttatgtttagggtggttgttcattagttgcttgatgtaaagttatgcttgcctccttaggtcccagaaacacaggcctgggt

SEQ ID NO: 109864 - DNA, 460 bp, Homo sapiens
tcttgctgaatcactaaacctgttctctcctagaaggctctttattgggacctgacagatcacctctccagagccttcagacgtcctagctctctaattcttctccataatgagttttgtgctgcatgataaaatattcatgttcaaataggttctaaactaattatctgtggccagcagttgccactgcagtcatttgctgttagcttggctcaagttaatggcttgtatttcagtacaaatagtcccttctggctgtttcctgtcctgattcttatcctaaatggaatttccatacatatctagagttaagtcttcttcttttgaaaggagattttttgccctaccttttttcatctcattttattaagattagcttattttagtgttcagttccttattgtttcttatccatcttaaatcctacatccctgccaaattcatgactcccacactgtcc

SEQ ID NO: 109865 - DNA, 357 bp, Homo sapiens
tccttaaccctcataagttcatagttggggacagacctttgtgacaaatgacagattaacaagcgaaaaacaagcaggtgtatattcacgtgtgcagtgcacatgatgcaggagaaacctcagtgagaagtaattcaaagcagtggcttagaacacttgcctatgtagcatcttcaacaaagagcaatgaattttccagaagtgacaagacaaagaaaagcaggttaacacttctaaaggtggggaactatgggaaggaaaagtaaatatgtggcagtaaactagtggagtaagatttgtgatccctctggtgccatatctgagttgataagttgtctccagtaaaggagaatttat

SEQ ID NO: 109866 - DNA, 573 bp, Homo sapiens
gaggaaatcaaaagggaaatttcacactgtattgtaaagagaggagacttttatgccaaaatacagtaagtcttttagtcagataaaattaataatcttaaattccattcatgttaaagaagaaagacaattaagaaatctgacactaatcagaagaaattagaaaacgaataagtaaaagaatctgaaaaggagaaataaaagcagaaattaatgaaacaaaaaattctacaagggataaacaaacccagatgctggttcttttattaataaaaagaaaacaaacagtgaacaaggtaattaataaaccgtaatgcattaagttaaaaatactagcgaaaatatacaagatgagaaatgagaaaggagaaataaaacacaaatacaggatatactacaagaataataagagaatcttatatggctatctatggcaaagagaaaagaaaaaattagagtaaattgatgttttcctagcaaaattatctcaagaagtggaaaaatttgattaattgattgtttttgaaagagactaaaaagttattaaagattcaccattgaaaagacaccaga

SEQ ID NO: 109867 - DNA, 347 bp, Homo sapiens
cagaaatgaaaaaggagacattgcaactgatgccacagaaatacaaaggatcattaagtgactattataaacaattatacgccaacatattggctaacctgaaagaaactgatagatttctagaaacataacaagactgaataatgaagaaatagaaaatctgagcagacccataagcagtaaggaaattcaattagtaagcaaaaatctcctagcaaagaaaagcccaggaccacatggcttcattggggaattctaccaaacatttaaaggagaattgataccaattcttcttaaactcttccaaaaaatggaagaggaaggaacacttccagactcatttaatg

SEQ ID NO: 109868 - DNA, 335 bp, Homo sapiens
ggaaaccgaggctctggtgccttggctaactcagggtttaggtttaaagccagatggactggtcttcaaagcccggctgccctgcccctgccagtccttcctgggccacacagcactggcttcatctctgcttcctggaattggagaggcttggctggtccttccgtcctcactcgctccctgagctgtgtgggctccccgggcctcagcagccggtgccaactcagctctcactgtcacctggtgtcatgcgctgtctggccgggtcccagcaaatgcccaggaggactctcagctgtccttgggtgggtacagccgcacggccaccaccggcc

SEQ ID NO: 109869 - DNA, 662 bp, Homo sapiens
ggaggacaggctggcagaggagggaggagggtttctagctgagagagactgcggctgtgggcctgcagcctacccctcttcaagctctccggagccgttcctgcgaaaccagcccccacaaataaggaagctgggattcagagaaattaagggacttggtgaagcagagaatgccaagggaattgattcagtagtggacggggagtccctgaagactgttgagcagtgaagagacctgatcgcatactaaaaaagtacatgcaatggcaagaagatcaactaagagattcttcttatgttgctattttaaactcctgaactcaagtgatcctcctgccttggcctcccaaagtgctgggattacaggtgtgagacactgcaccctgcccaagcacctctgctccgtgccatgctcttggctaattggagttgtgaaaggcatgaggattctggtcatggactcagctctcccatagggttctgacaccaaagcaatggtcacaacagtgaaaggaagaatccatctggccaggctcaggtggttcaaggccttcagaatctgccttgagactctcactggctttagactgaaaaccatcttggccccgtccatccgtgtaagcaatttaacgacagcttgcaaagcaccgagctttaacaga

SEQ ID NO: 109870 - DNA, 342 bp, Homo sapiens
cgatcgagccggtcggggcacctagtagaggagctgttggcattgaagggtctggggccgtctgtggactactgaacaggacagggaaccctctgttaacacacacacacacacacacacacacacacacagaacctgaagtatttgttgcaagttgcagatgtttacagttactgctaaggatatgtgtttccatttaatttacataaaatactgttcattgaattgattttatgactcacattatttcatcatgcagtttaacaaatactgagcactggtgtcacagaactttgtcgttcatgctctttagcaacagtcagcttttctgctcatgactga

SEQ ID NO: 109871 - DNA, 374 bp, Homo sapiens
gtgcaatgtatttgtcaaggaaaagctaaaggcattctaaattagcttggctctcgcaacaagactgtgatgtatcccctcctacccaaaataaaaattatggcttggacatggtggctcatgcctgtaatccgagcactttaggaggccaaggcaggaggattgcttgagcccacaagattgaaaccagcctgggcaatatggcaagatcccatctctacaaaaattgttttttaaaaattagccagacatggtagcatgtgcctgtagtcccagcacctcaggaggctgaggtgagaggattacttgagcctgagagattgaggctgcagtgaaccatgatcgtgtcactgcactccagcatgggagagagt

SEQ ID NO: 109872 - DNA, 310 bp, Homo sapiens
tatccactggaatccacccaacccagaaacccttcccaatccccgccccaacatccacctccagggtcttctgcaaccactccatcccatgccggttccctgcctgcctcgactccggtggtcctaaacgtccatgggatttcctggcacttatttgctcactgtcttgccttgctacttaacgtcagatggaggttcaagtggtttccaatggggagaggtgcatttcacaatgtctggagacatcgttggttgtcacagctggggtgatggtgctactggcgtctagtgggtagagccccgggatgct

SEQ ID NO: 109873 - DNA, 801 bp, Homo sapiens
ctgagatcggttgcttcattagttgttcaaaaaatatttattgagcacttagaatgtgcaaaacactatgctgcatgctgggataagctaaatctacaaggtcccctgccctcatagaatttaccctgtttctttaatacagaggtggcaaaggattggccacatctgactcacagccatgttttattttgcttacacagcatcagaaatgttttttgagcattcacaaatgagaatattcatctgaatacctatatttccacctgctttaatatacatctggccaccctgggcctttattttcccatggcattctactcgtaaaagcagctgcccctttttgataggactacatgtaccggtttgcttccattctctaaaaatccctgaaaccaagaccaaattcaacaggcatttattgttacaattgtactattcttttttcttataaaatagttaagatgagctgcatctttaggcatctgagtttgtgacccatgcatactgattatagtcagcctgctaattatctcatagcctctagaagaagcagaagagaaaaagccttacttacatacttcactttcaacaaaaacagtagtagatatgcacattgtaatactactcctcaaattcattctaacaaaatgatatcgaatccagatttataaatgtaatgatagttctgatgtaacatttgatatttattgttgtatgttgtcatagctgtgtgaattggcattttccagcttatttcaatattgctgtagtaaaattttgtttacaatcagctaacattta

SEQ ID NO: 109874 - DNA, 203 bp, Homo sapiens
ggcctatatcttaaaattcttcacagcctgagcataaagcaaataccctgacacaaagaatttaaaaagtctgaacaaacggatgaatagatgaacaaatggatgaatagatgaacaaatggatggttgaatagatgaataaacggatggttgaatagatgaacaaacggatggttggatagatgggaaacaatttaaatggc

SEQ ID NO: 109875 - DNA, 148 bp, Homo sapiens
agtagcacaccagacagaggaaaacattaaaataaaaataaaaatgtagtccaataaattgtggtttctggggcctgatttgatggcttcagccaattcttaaccacagcccaagaagatttagtcaaacaagttaattcttccctcg

SEQ ID NO: 109876 - DNA, 342 bp, Homo sapiens
actgagggcacagtaaaggaggagggagacaaattgtgaaaattacttatgtccactagttttactttaataaatcctgcttaaatactcagaatttatgaatacaatttatgatatataagtgggatattttaggtcgcccatttaaatttatataatgtctataaatggtcaattttatactataatattcattaataagcataagaaacatcatcttgattggtcatttgctactgagtcccaagtaagtagcttgatagaaactgcatttttcagaaaatttgcttattttattctttgtatttgtgaattctgttctgatgttgttgcttgaataaa

SEQ ID NO: 109877 - DNA, 1021 bp, Homo sapiens
gtgcagctgccttggcgaccatttgtcctacagtttgtccggacccaggctgtccttctgtgtgctggaatgaggcgaacatgtctttgagcccagcagggaggaatcctccagcctattcctcgctggtgcatcaggtcgttggcgggccctgacacacaacaggaacgtcggagcaggaggagtcagtggagccatcaggacacccaggcccatggggcaggaggcctcggtcaccacaggactggggcggaagacgagaggcggccggccgtgagggaggcgccctccctccccgcgcttacgtcgcgcggccatgcggtttgggacaggacacccctgagagtgcaggcacctccccctcccgcccctccatccctctgggggctggcgcctggccccccacctggtccccctgggcaggctgaattggggctccctgcagggcggtcccgatggccgggcgtgggtggggcgcgctgtgggtgtgcgtggcggccgccaccctgctgcacgctggcggcctggcccgcgcagactgctggctgatcgagggcgacaagggcttcgtgtggctggccatctgcagccagaaccaacccccctacgaggccatcccacagcagatcaacagcaccatcgtggacctgcggctcaacgagaaccgtatccgcagcgtgcagtacgcctcgctcagccgctttggcaacctcacgtacctcaacctcaccaagaacgagatcggctacatcgaggacggcgccttctcgggccagttcaacctgcaggtgctgcagctgggctacaaccggctgcgcaacctcacggagggcatgctgcgcggcctgggcaagctggagtacctgtacctgcaggccaacctcatcgaggtggtcatggccagcagcttctgggagtgtcccaacatcgtcaacatcgacctgtccatgaaccgcatccagcagctcaacagcggcaccttcgccggcctggccaagctgtcggtgtgcgagctctacag

SEQ ID NO: 109878 - DNA, 611 bp, Homo sapiens
tatttaaaacaacagcacaaggggcgtcaaaccacctgctaaattggaggcaatgttatcctctcccctcctcccccggccccggatattagagacaacaacacagaggtgatgtacacccactgctttattgtgagtaatatcatcctctcccttcttggatagtaggaacagtatcacactgtgcgtgtaggcctgtcgcgaaattcaatggaatgtcatcctgcgcctccctggatatgacgaacaatatcacgggggatgtacaacttctgagatattgggagtgatgtcatcctctcccctctggaagttagggacaatatcacaggggtagtgtacaccctctgggatgttgggactaatatctcacaggtgtctgagaattcctcctcctgggactctcagaggatccagaactgcagccggccctcgctttgctgtccctgtccctgtccatgtatctggtcacggtgctgaggaacctgttcagcatcctggctgtcagctctgactgccccctccacacccccatgtacttcttcctctccaacctgtgctggcctgacatcggtttcacctcggccatggttcccaagatgattgtggac

SEQ ID NO: 109879 - DNA, 400 bp, Homo sapiens
gatctgcacaatagtaacatctctgcatggcagaaatgtcatccaagttaaaggtgacaaaaagatacctttcacggcaatgcagaaaacactgaccagtcacaaggagcaggtgagcagcgtttagagtgcgctgttgcggccaaacgcccgaaaacaggcctcattcatggcgaaggaagcgcaaagcaaaccacggtgctcagctcttcccacccacagaccgcacgctggaggcggggaccactgtcaccggcgggggacccacatcaggcaccaccctcgacatgcaggacgctggctcctgaccagcagtgccatgtgcagaccctgcacacgcctgtgcacacatacagaccccgtacatgcctgcgtgcacacgtgcagaccccccacctgc

SEQ ID NO: 109880 - DNA, 613 bp, Homo sapiens
gccctctgcgcggtcgactctaacgatccctaaaggcgagtcagggtaacaatgcagtaatggtacagaggaggaaagatgcaggcttgtgcggtcttgggatacctggaatctactgaagactgacttgcaggcagcaacacgtgccttagaaattgcatccatggctgaatctttacttcccaaggattctttttgcctgagtaccaggctatggttctgcatcagggtggtctatatatgtgtttacagcaaggccctagtacagtagctgctaaactatcttctgcagagtcctagggtttctggagttatcttaaaggcatccatagcacctgcaaagagagctgtttgacttttgtcatatctttaagttctacataagattttgtttggagaagaggttcattcggagggaaggggaaaaaaagaaaatgtgaaaacacactaattttatagagaacttatgctgaaacccaaagaaggagatggacttacccagggtcaaaggcggcatagcgacagagcaagcccctggaatgcagactttaaaaaacttaagtggagagaaccggataaggcaccctatgtataacacccagatccaacatga

SEQ ID NO: 109881 - DNA, 219 bp, Homo sapiens
ggaatagtcaaggaattaataactggtggacaagtgagggattttacagggggttgagaggatgggatgaagtgatggtgatgggctttgagaagctgcccgcacatcctgggttgaccacagggcactcacatgcacaacagagataggagcatagtcctggtcttcagaacccatgtgctcttttgtacccagcagacgtgagaggtgagcaaacct

SEQ ID NO: 109882 - DNA, 462 bp, Homo sapiens
tcctataatactgtcttaatttagatcctcaacgtcaccaacctcgaccagctaccagaaatgtccttcttacattcatcctctcaacagccacctaagactgaaatctgacccaacagcatttaaggatctccctatttgacccctgaatgtagtccctgcttccacgtgctgcatacaaatccccccagtggtctctgcttgccccacaacctcatcttacactgctctttgcctttcactttatgctccaagaacactaaactgcctcactttttcttgtgaatgggtctatgtatgctcaggctgttttcaccatcggtaatgccattttctacccttcttcctatttacctagtaaccactactttattgtttaagtctcagcccagaagtcgactactccaaaaactctccctgaattacatttctccccaacgctctccatataatctggattaa

SEQ ID NO: 109883 - DNA, 391 bp, Homo sapiens
agatagattaagatatggaacaagataacaccaggctgtggtaagcaagactaacccccagtgatcctcactcttgtataatactctcccctttgagtgtaggtgaaacctgtaaataggatgaagatatcactcttgtgattatgttatgtggcaaaaagagactatcctggtgaacgtaatctaatcacacataccctttaaaaacagagagttttctctgtctggtggcaaaagaattcagagatgcatgaaagagggtcaatatgtcattgctggtttgaagttggaaggaatcatgtgagatgcaaggcaggcagcctctaggaacagagagtggcctcaggttgacagccagcaaggaaacgggaacctcaaactcacaaccatg

SEQ ID NO: 109884 - DNA, 863 bp, Homo sapiens
ggaggcgtctagaaagcgccaggctccttcctcctgcgtgagccactgcaagctgtcggcgcctcagtgctatggagaccttgggtggattattccttgttggcggggggagggtcccagctgtcctgtgcattataggatatttagcagcatccttgctagatgccatttacaacaatcaaaaatgtctccaggcattgctaagtgtccaggtggggagcggaataggcagaaccgcctccagtcgagaagggctgaactgtacttaggatttgtgattctgcagaaatgggttctgtgaatgcactaaagcatgagaacatccaaaaatcagtgtggcacagaactgaattcaaatttacctggatccaggtaaataagcacaattttgaaagtaccaaacagaattcaagaaaaacaacaacaacaacaaaaaacacattaaaaacagaaaagttggccgggcgccgtggctcacgcctgtaatcccaacactttgggaggccgaggtgggcggatcacctgaggtcagaagttcgagaccagcccgaccaacatggtgaaaccctgactctacaaaaaatacaaaaattagccgagcgtggtggtgggtgcctgtagtcccacctactcgggaggctgaggcaggagaatcgctcgaacctggagggcggaggttgcagtaagccgagatcgcaccattgcattccagcctgggcaaaaagagtgaaactccatatccaaaaaaaaaggggggaaaggtcagaaagacgttctttttcactaggtgatgaattaatctttcccatctttgtcatgttaaaaatgtgcctgtggctgtttctccactaaatgaagacact

SEQ ID NO: 109885 - DNA, 719 bp, Homo sapiens
aacaaggaaaatattttgaaagaatagtaactaaagggagaaaagccaactgtagtggcttacacctgtaatcccagcactttgggaggctgaggcgagaggatcatttgagcccaagagttgaagaccagtctgggcaagatggtgagaccccatctctacagaaaatttaaaaattagctgggtacagtggcatgcgcctgttgtcccagctattctgaaggttgagatgggaggagttcccttgagcctaggaattcaaggtggcagtaagctgtgatcatgccattccactccagcctgggtgacaaagtgagaccccttctctttagaaaaaaaaaagaagaagaagaagaaggagaccaattcaaaagcaatgattttagcaaaaaaaaagaaagaaaaaaaaaagaaactagactaaggcactgggagaatggaagtcaagggacagatttgaaagacctaataattaaagatttgacaggactcagttactaaatgtgggaggaatgagaaggccttgcctgaatcattgggtctcatttagattggtaatagtaggtctctccaccagatggcaatgatgctcttttcttagtttttaatttgccatgctaagagatttacaattacagcaatttaaagatcagatagatagacaagtttctaacaactgccagagaaacttgctaaacaacagtaaaaagcctgaaaaa

SEQ ID NO: 109886 - DNA, 268 bp, Homo sapiens
aggtaactcttaggcttatggccagatctcaggtcttaactactttcctgtggtctaagcaattcttcttgcattgcctgtgaaacccactatcctaccaccagttgcatgtggaatgtcccctgtgggtaaaggtgtgtaacctacagcagccttctctccaccccaatctcatgctgccacctcctttcttcccttccacaaattctctcgtacccacctggcttcctagctgttccccaataaggccaagcatgccacccactca

SEQ ID NO: 109887 - DNA, 369 bp, Homo sapiens
aagctgggctggagtggaaatgagaggatctcttccttttccaaatgagagagctggagaaagaagaaactacctttgcttgaggagctgcacaagggctctgaatattccctataggctcgatatctacaaactgcaccactgctctggattcagagcagtagcatttctagtttgagtttaagatctggcagcacatggcatttgagagtcttcatattttggagacccagcaggaagtggtagatgacatggactctgatgacgctgtttctacagagactatctgtggacaactttcagatttacactttttataaactctaagaatatgatagttctttttttcaaaacctcttctagattttt

SEQ ID NO: 109888 - DNA, 474 bp, Homo sapiens
gacgagggaagcggacggaaagcaggagagaaaaactgaggttccgatttgattgagaatgaaccctctctcgggaggaggggccaggtagtttagtttggtgctggtagtgctgagtttgagaagctgaccccaaaatctggtcttgaccgcaacacggagtggggcctgagctcctcggtgcagccccagctccgctactcgctgctgaacgaccttggacgagcccatgtctaaatcagacttgataaaggagtcgcctctaaggaggaactgggatcccctccttcccaggctggtgctcgggagggtggaggatggaaggagcgggtccttcccccagggagctcggggtctacagcagggcggggaagcggcccttccagaagaggcaggagagggtcgctccctcggccagcctcgggccgcctgggctttactgggaaaagcagccgaggtcctggaagagtcgcg

SEQ ID NO: 109889 - DNA, 470 bp, Homo sapiens
gcaaagtcataagctcatgttaaggtttttcaagagtctgcctcctactacacaaaggaaagcaagggaaaggaaatgaccctggcaaacagtagggaagggtgtattcaaacatttcattttcaaaaccttcgggttagaataccacttacacatgtattctgagagacagaattcatgaggaactcatctctctttataactggaaacacaccagcttgatatattgctaatccatactaaaatcatattattgggttttttctgaatcaggcctgtattaatggtacagtatttattcagaatggaattctaaaattactaacaaacttgttgaaaatttgaatacctccacaccaacctaaaaatggaccttaagttcctagaacctctgatgttcttttaaattaatggaaaaataatttgtgaactgtatatagagagtgcattcataaatgtgattatgtatt

SEQ ID NO: 109890 - DNA, 311 bp, Homo sapiens
gtcgcatagccaaggctctaatccctgcccttagtcacaaaaacaaaactgcttcaatctccctattccactccataatattcagcacatcataagtcctgccatttttaactcctaaatatttttcgttgttttcatccctattaccacagccccaattcggacccacatcagctcttgcctagacaatgatcacttcctcttgatgggtctgactacatctagcctttctctagttaagcctgtcttagatggtggtcaaagtgatatgcttgaaaggctgcaagtcttcttgttgactatcagacact

SEQ ID NO: 109891 - DNA, 352 bp, Homo sapiens
taattatgtaataacttaaacaatgtcataaaccttcaaatcagtttaagtctaaatgtgtcatatttaataacaagagcaagaaacatacgttatgatgaagagctcttatattttctttggataaaagtcagtaggcggggcgcggtggctcatgcctgtgatcctagcactttgggaggctgaggtgggcagatcatgaggtcaggagatcgagaccatcccggctaacacggtgaaaccctgtctctactaaaaatacaaaaaattagctgggcgtggtggcgggcgcctgtggtcccagctactcgggaggttgaggcaggagaatggcgtgaatccgggaggcgga

SEQ ID NO: 109892 - DNA, 398 bp, Homo sapiens
aatacaaataacacaaaaggagttgctataggctattattgacatccatcgtttccattcaacttggggagcctaagtttatcctgaatagggtgagggagaagatcagatctgtattttaccctgactgaattctactagcatattcaaactgaaaattatctaaccatagcagtaggaaaatcagatatttaaattgatcaaaagaaattcactatgtgcccattcttccctagtcagtatgtttgtcagtgtagaaatactttttctccacatgatgaactgactctctaattgtgaaaataagatctacaagaaaaataactaagacagaataatatgaatgctaaataaatggaatggacaaatactacattttttgaccaaaaaacatatac

SEQ ID NO: 109893 - DNA, 199 bp, Homo sapiens
atgaagaggcatttcctagaagggaaaattaggctttaaagtcaggcagatgggtttgcctgggaaacaatcaagagcgctgagtctgagccagggagctggtggggagtgagccaaagtgtgtcaggtaaggcagagaaccaaaaccagatatcaggtgacaagtcaagaatgagtaacatagagtacatgaataggt

SEQ ID NO: 109894 - DNA, 750 bp, Homo sapiens
agaccccatctctaaaaaaattaaaaaaaaaatggtttgctcttcactccattgagctgcaaaaacgctggtctagatggaatttgggacatatggagggcagcgaaccagtgagcgaggcagtgagcaggcatgtgggtggctatgcacacaccccagggacctgggattatttctggagtcagagtgatcattaggagctgaccacagccacccagcccatagcaagggccaccctccagccgctcactcagcaaatatttagcaggcacatactgtgtgccaggccaggcgccgaggcacatgttgggaagacagaggagacgaggcaggttcatcccttactcttggagctgatacctgctcgcactagtccccaagggtcattccagaagggaaatttcaatgtggctctggggaggagcgggcaaggggagcaaggagcagcttttccatcctacctggtccattgctcccacagaccccccaggaagggcctggcttggggaggcagcaacgggggaaggacagggaacagaacttgggtcagcaaccatggccccagctctgtcacctctgtttatgccattgtcctggggagcctgtcgtctccgagctccagcttccacatctgcatggtggggatcctggggtcctcctgcctcacccaacagaggtctggattagaaggagcttgggagaggacagtgggctgacttgtgatcacagtccaagtttccagagtgcacc

SEQ ID NO: 109895 - DNA, 709 bp, Homo sapiens
aaaataaaataagccttgtttatctgtattgagtctagaatgtctcaaaattatttggctatggaaaggcaaacttatttggccacagaatcttttgtttggtttaacagaagaactaattcataaccaaagaactagtatcctgtgtcctcctcccaccctggaaaatgctgaatgactattctgggccttataagactcagtgaggctctactattgcagctgacttggatctccaggactcttggctaagggactgacatattcctcaagaccccagactttctgaaaggatcagaggtgtggcccattaacatccaacagtttaaaagtggtgctgctaggcattgatagtaaatggctgtaaccaaagatagctagaattaaaacagcatccaagaaagcctgcaagaatgatggtcctttatgcttttgcactcagatcctgatatctcttgcatggttagttccagaagatagcttttcagaggtgaatagagcataaaactctttttggaagcagcatggtatagtggaaagaacataggctttgaaatcagagaaccattggagtcaaacctgtcactcatagctgtgtgacgttgtacaaactccttgagcctcagtttccttatccataatacaggaatatgccaccaaaaataaaataagtaaaagtgcctagcaggatgtcaaacacacaagatgg

SEQ ID NO: 109896 - DNA, 272 bp, Homo sapiens
ttatccaaggcatgattattgctaataaaaagcttatattaggaaaaaatatctgtaatcaatcatctatgcttccatctcaagaagctgccagcctgggcaaaatggtaaaaccccatctctacaaaaaaataaaaaaaattagctggcatggtggcacatgcctgtggtcccagctacttgggaggctaaggtggaaaaatcgcttgaacctaggatgtagaggctgcagtcggccatgttcatgctactgtactccagcctgggtgaca

SEQ ID NO: 109897 - DNA, 273 bp, Homo sapiens
cttcagtgaagagttagacaattcacaagattttcaccagggagatcctccaccagcacagtggagtgggagcatggagacctgccttgcctctctggacctctgtctcctcctctgtaaaacagcgctggcctagatggtttctaagggctcctccagtttgatgtcttagatcttcaaatccaatttagctgagtgcatgatggaggaaagaaagacgagaatggcttatgatgtggctccagatgagcatggtggggagagcactggact

SEQ ID NO: 109898 - DNA, 369 bp, Homo sapiens
gattttagagatgatcctcataatcagaatcacactcaggaaatggtctccagcatcttcataaatttccgagagctggaaaactcattgctctgtgtggttgttctgctgtagtataatcatagttccaaatgacagacacagactcctacagtccagccgagttattttctgagtttttcaaacagatttccccctcttatatttataaataatgcttttgatacttggaattgaaatgtgtcatatttcttttctattagcttatagtaatattagatttttttgcctttaggagctagtctgtggttctgttaaatatctgggaattcaagagatgcatgaacttacctcaataaatggtcaaaa

SEQ ID NO: 109899 - DNA, 226 bp, Homo sapiens
ggaagggaatggggggagctagccaggtttgtgacccattttacttctgggaaacagactcagagagctctagggacttgtccaaggtaatacaggtaacagccagaatctaaaccaatgtctagtttttctacagagtgtgtttttactactgataattcagtgcctccaaagtcaggcagagtctctgctatgggaaaggcaagatgtaaaccacgatgacttt

SEQ ID NO: 109900 - DNA, 129 bp, Homo sapiens
aacccccaaaaccctctcataagagctgcaatatacgctagtcaaagaggcaatggctgcaccaatttaggagtgtttcatttttctttatcagtgatctacagtctctatttcctagcttttacacat

SEQ ID NO: 109901 - DNA, 288 bp, Homo sapiens
aaatggagactctctgggcatcggctaagggggcccggggccttcccaggcctgctggagtccgggaagccgggggcacccagaaggaaggacccgtcggactctgcctggggacagcctgctccgcgccagaagggtccgctgctcaggcagcatccccgtgcctctcctccagtgggtccctcaggtagaatcggggcaggccccactggacgtgcagggaggaggctcggaggatgcatcctttgcaggacccggtctggtacagcagcagacggagccatctcc

SEQ ID NO: 109902 - DNA, 367 bp, Homo sapiens
actttggtatgcttgatcaacagggagaagaccagtgtggcttagaatagaataaaagggtactttcttttctgcctacttccaaagtgcacttggagttcagagaaggcagaacttgtacaaagttcagcgaaggaagagactgcatcctataccgaagagatatgtcaccatgacagaaggcttgaattggtggagagggaaattgtgtgagtaattctattgagtcttggctggttaggtggcatgtcattgtcttacatgtgtggactggcatatgccaagtcgggcacaccaggaagaaagtttctcctccatttctgtgtggctttgagcatgctgattaacttctctgaatcttggttgt

SEQ ID NO: 109903 - DNA, 310 bp, Homo sapiens
aagctgaaaagcaggtaaacaagcagtgatcgacttggccatcctaagaaagctaaagtttaagccagcattaagaggcaacaaaacaacctgctataccctgaagcatctaccatatgtctctgcaatttggtacagtaggtacttctggaagtgaggatggaaacaggtatgaaagcagcaggtgaaagtctgttagtgaagcactgagccctcctgacctctcctgatgcctgcagtggggtgcctgcccttccttcccctagcacaagtgctcgctatggagactgtatgaaagtgggggagtagc

SEQ ID NO: 109904 - DNA, 421 bp, Homo sapiens
cttattaatgatcgccattctaactggtgtgagatggtatctcattgtggttttgatttgcatttctctgatggccagtgatgatgagcattttttcatgtgtctgttggctccataaatgccttcttctgagacgtgtctgttcatatccttcggccacttgttgatggggttgtttgtttcttgtaaatttgtttgagttctttgggctttacaactttcaaagtgaattggatttttaccgtaagcaaaatagaacagagggtttatctcaaccagaaacaaatggagtgtgtaaaattcagtctctctcttcagccccatgctactgacttctgaatagcattccagctgtatttatctggggcttgggaaattttcttggttcctgggaagaaagttaactaaaacatatgacatc

SEQ ID NO: 109905 - DNA, 381 bp, Homo sapiens
cacacgagtgtcactaaatctcatttcctgttcctgtaaatgtcgtaatagtctcagattccggctgccacactcccaggtcaccaccatgtcaccctagctggctgacctgactctctttgcggttatcctgccatccttgcccctttaggctccctgaaactccactgtcactacatcctctcctgccccgagacttacacattgctcttcaccctcctcccagtcattgtaagttggatttgcctcagtgcagttctcgggttctgcccatttaaaataatccaatttcccactatggccaacttgcctgtactctaggcaggccgacatcaaaactggcctgcaaaggggaacaccctgtctgtgcactctcaatgc

SEQ ID NO: 109906 - DNA, 542 bp, Homo sapiens
gtaacagacttcatcaaaggaatactctcttcagtaatggtgattttaaaatactcggcaatttttgtttttcattgactcagacacagttctgtctaattctgaccttatctattcctatcatcctgttgttcaaagtaaatgtatttttaccaactgtttgagagaggaaatcctgggataattagctgaaggatatagtgtaataaaaaaataccaagttttgatattttgaagcctctgatctactagggatgtttagatacagtacaagcctgagtcagagctgaacttctcaaagttctttttcagacttgggattctgtggtatattctgaaactgaaaatagcttctaggagattcacagtccccaccaccactgcccattggcgccactggggccaaagtgaaggggcctagaacagctcacacctttttctgagagctatagcacagctttagaagagagattgtcgcagccagtgacccatatcgggtactcatagagaggggttttgtttaataggattacccttgacca

SEQ ID NO: 109907 - DNA, 167 bp, Homo sapiens
ctttctaagaacttagaagctcaaatgacttcatttgaattaaatttatttttttgttcacctaacttgtattatttttcctattttcggaagaggctaacttacacaaatttattacacagtttctgtttattagattgaggtcacagtcaatttttattatctag

SEQ ID NO: 109908 - DNA, 151 bp, Homo sapiens
aagagacagggtcttgccatgttgtccaggctagactcaaactcctagactcctacctcctagtaatcctcctacctcagcctccagagcagccagactacaggtgcatgccatcgcagccagctctctcaaaactgttatacctctagtg

SEQ ID NO: 109909 - DNA, 158 bp, Homo sapiens
caattcagatgaacagaataacagattaaaaagcctgggccttggggaaatgtacttcctcattcttttgtttttttttgttttgttttgttttgttttttgagacggagtctcgctctgtcgcccgggctggagtgcggtgggtggcgcaatctcag

SEQ ID NO: 109910 - DNA, 232 bp, Homo sapiens
gaatacgcattccaagcatctgtctaagagggcctagctgatgcctggcttgtaacaggcccccaggcaacatttgctgaatgagtgcttaaaggaatcctgtgaaggtgcccacatggcagatgctgtcggcagaacccagccctgaagcctgcccgcagcagctggcaatgagaccccgtagcacccgggtcaccctgcggcagagcccagcagcttccaaagcaaagca

SEQ ID NO: 109911 - DNA, 361 bp, Homo sapiens
tattacacacataaatatttaggattgttatgttctcttgatgaatcgagcccttattcattaggaaataaacttatttactttggttatatccttttcactttaatctgctttatctaatattaacatagccactccatttttcttttactctgtgttagcatggtatgagttttttatccttttagtcttaacctctttgtttctttatatttaaaatgtgttactgacagatgacacgtagttgggtcttgcttttgtattcaaactgaaaatctctgacttttaattggagtgtttagaccatttacatttaatctgatgattgatagtatattattaaattaaatcagtcaccttg

SEQ ID NO: 109912 - DNA, 415 bp, Homo sapiens
agtagtaaccactgtattaaccaatatctaatcagccagtgagaataatgaagatcaaaattagggaaggaaaataacatttattgaacaattattgcatgccaagtattcatgtaatgttcacagcagccttgcaaaataaatattcctttgcagagttcacaaataagaaaagtgagacatgtggaggctagtaatggaggtaaataatggaagtgagtagaaaactccaagctgtcttggagacaaaaagaggccttttcaaatggccctttttggtcctaattatgctaactgttcagcagaacatttgtagcttagatgcagtcactaccagccctctcttccaaatcatctctttgggttttgcttcagtgtgaaactatcactataaatgagtatttgtttgtcttca

SEQ ID NO: 109913 - DNA, 297 bp, Homo sapiens
ctgcacttagcttcactggccatccaaaagctattattctaactgaagtcactagctgaataataagtgacccaacttgtccagtcttttctaagaaaggcctgagttaaaattttttatccagtgtgagtaacatctgagaacaaaaatgttcctacaaacttgagaaacagattgttatgtgcccataataacaagtagctttcaaaactggttccaagcctgagcagtgaatcaatgacaactcatttcagaataaacttggcaagctaaccaatcagtgtcagcctcatgctt

SEQ ID NO: 109914 - DNA, 577 bp, Homo sapiens
tgacccagtaaccagagcacctgctaaaggacaggcgactccgccctctatgctccagcctcatctgctgagctcgttccctggcagaggaagcagagagccagagggtgatatggggcaagtgcccacttagcagatttagccagcaggtcaactaattttaagtttcacttggctttctgtctcgttgtacttgaaaaaagtctttataatttgctggctgggaaaatagttgcttaaagaatggtttatggatgctctgccttagaatccatggggaacatcttgagattgcagattcctgggctgcgcaccagacttgctgagtcagaacctcaagggctggggccctgggatctgccattttgacaggctctccagggatttggattgagggacgttggcgattgcaattgggaatactttgtgggatgcttgattccgtaaactaggccaattagctcagtttaggaggtggttatgacccagagcatcggagcttcctccttacctgtcagttctcttctttccctctctaagcacaataaacacagtggccctgagaggtgtcttgaaa

SEQ ID NO: 109915 - DNA, 388 bp, Homo sapiens
aaaacagattgttcctctggaattgactgtcttgagggaaacaaataaataatatttgatacatgtgtgttacattttggttgaagttttaggttagatagttactgttatatttgttgctttgatttcactgttactaccaggttttttataatatatatgagttgggctgttttttatttgaatgcttcacaagcaaatcttctctctcaataacattcggttttaaaaatcactttattgctacctatgtttagtttttatatagaaatcaactctgtttaggtgagtgagttgataaatatgtaagtttttcagcataggaaaatagccattgccatttatagagttacagtttattagttgatggtcaatgcccatgtgaagt

SEQ ID NO: 109916 - DNA, 291 bp, Homo sapiens
tagaacttgaattttctgatgcctccttggcatctctgtcattttgtttctaagaatattctaatattagctttagggtctctcttttagatgttctgagctcactgtttatgcacctgcactaaccaaggcctctctcttctcaaatggtttttccctcaccatccctttcctcccctggttccagcctcggtgacatatgcagaggctatctgcctcaagcctctttcctgtagatctgcggtagcatttccttgccttggtaccatgcagggtcataatctttgtctt

SEQ ID NO: 109917 - DNA, 477 bp, Homo sapiens
gccattttgcaagttactgtttttgaaaacaagatattaatttaatcaaagcttactttggtagtgattgtacctacttccaaacttgccgtaggtttccatattccattgaagctacttttgatccttaagatgctacatgactggtatgaaatctctcatagttgtggggaaaagatgatataagaagcttcaggctggacatagtggctcacacctgtaatctcagcactttgggaggctgagggggacagatcacttgaggccaggagttcaagatcagcctggccgacatggcgaaactgtctctactaaaaatacaaaaactagccgggtgtgacggtgcacacctctaattccagctactagggaggctgaggcaggagaactgcttgaacctgggaagtggaggttgcagtgagccgagatcgtgccactgcattccagcctgggcaacagagcaagactccatctcaa

SEQ ID NO: 109918 - DNA, 424 bp, Homo sapiens
tccccctcaaaacagagggtccctgaccctcaagaagctaagtggatgaaagatatagaaagatacgcatagaagatcaaggatccgccttggacactatgatgtttgcctgggaaacatagctaggctggtaacaccttagatacagagttggaagagtatttcaggtagagaagccagcatgtgcaaaggcctcaggtgaaagagcatgaagctgggtagaggactgaaggaatttaggttgggatggattagaggatggtagacggggattagtcagagagggtggcaggagccagcacatgaacatctgggaagctacataaaaggattaggctccaccttggaactaaaaagtgttttgatcaagaagcgatcacaatcagcaatgctgagtgctgggtgtgacatgtctagatgaaag

SEQ ID NO: 109919 - DNA, 830 bp, Homo sapiens
gaccaagtctgtctttagagataagaaattgagctgctgctatgctgatttcctggggatgacaaagctattaaatggcaagcaattcaaaaccaaatccagttatatcctactaacattatttgtttttctttttaatttgggccttcctacaattctgtgagttagacagggcatagacaattatctgcattttacagaagagccccctgagacagtgagttaagtagaagagctaaaattagaacctggggatttcatgactcccttccttttaccctattacttctcttccccttcaagttaagacttcatagaaagtaaaaatagcttctccatccaaaacagctgggaacccctgttctgccaaggacgtgatccttctgtaaatctttactcctggggcccacagtgcacagctatttagaagggatcaatgccagcttctacccagcagcttaaattcatgtatatttctttaacatacagccaaatgtatgtgacacatgagaagaaaatatgcttttattttcataattcttggaatcaaaaatataaattccaaggatgttttaatagtcaaaatgcctttccccaactactgcatacaaaatttgccaataataatggtggaagctctttataaaaagtactaaatttaaaaaaaagtttactgagatatatttcacataacatacaattaacccatttaaattgtacaattcaggccaggcgtggtggctcacacctgtaatgccagcactttgggaggccgaggtgggcggatcacttgaggtcaggagtttgagaccagcctggccaacatggtg

SEQ ID NO: 109920 - DNA, 359 bp, Homo sapiens
gtatatagcaacttctggttgcctgtagctatctttactgaaatattccatcatatcttcaccatatcacattaacttaaataggatctcttttccttttatcaagtatagtaatagctaacattagtgagtgtttattatgtatccagcactgtgcccatatgtaatactttgcaaggatcaatgtgctgtatatgaggaaactgcaagttaaggaacttccatgtatactttgaagttcattctcttaaataaggaagctatattgccttccactgccttgcatttttgttttcagccctgtccttcaaaaccttactgtgtttgtgtaaattctgtcttcccatgttccttctccc

SEQ ID NO: 109921 - DNA, 273 bp, Homo sapiens
tcggtccgcagaagccggggtcttctgggtggttggttgggggtgagctccctgtaccccgatgcccatgtgggggccccaggctttagggaacctgcgaaaaggcctctttctttcctcctatggtattcacagacagccacaggaagagccttccgtgcgtgggcgggggttggagagggttcattcttaaactttctttcccaggtctacccctaccctagggccccacttcgggaacaaattccgtgagaataaaatcatagctaggct

SEQ ID NO: 109922 - DNA, 423 bp, Homo sapiens
tagagtgtacttacacaaccctagatggtatagcctgctacatacctaggctatatggcatagcctattgctcctaggctgcaaacctgtatagcatgttactatatggaatactgtaggcagatgtaacacaagacgaatatttgtgtatctaaacatatccaagccataaacgtagagaaggtacagccaaattatggtataaccttatggttatagttatgggaccaccatcatgtatatatggttaatcattgactgaagtgtcattgttcaacacatgcctgtactctttctaaaccaaaatagtgtcatcttgctttgtacataaatcatacctgctttttttgtcattgctcaaaaggtttattctggaatgtccttcgaccaccttgtagatttatatattctttattcaaattt

SEQ ID NO: 109923 - DNA, 299 bp, Homo sapiens
ccttccactgcctgcctgcccttcagccctcactttgctggcacaggggcactgctaagcatttgggctctgtagcgactggaaggcagttctggcggatcccagacagaagagacaggcaaggctgtgcgctccgggagctatgtgtggcgtgcttggaggaaagggcttggtgggcttttcctccattccattgtgtcccacccccaactatgtgggtggccctggggtgacaatgaacagtctcctcagggtctgatttgtcagtcagccccactcggggcatttcacttttgggg

SEQ ID NO: 109924 - DNA, 488 bp, Homo sapiens
cccatagcttagtgtttggtgacatttctcagtgcactgtggtgctattttgtatgctgctgttctttgtcaatgaagctccaagcagagggcttgtgaatacggagctaaggtttgttgcaatggggaagaaatatgagtcaattagtgatgaaaatgagaaaatgcactgttcgatatcataggcatgatcttgtcaaattgaaaaaagttctctttacactgtgagaccattctgtcttttgttattatatgcatacttctctctctttgattagagtcattttttttccctcccagccagttaacatgttcataaacagaggtccttctaactcagttaccttttgtaatgcccataggaaaatgctcattttggggttaaaatcttatcgtctcccctgcttccatctcagtttctttaccttaccagaaaattaggtaattatctgttagatttaaaatgtgaggatcagatttaactcctg

SEQ ID NO: 109925 - DNA, 338 bp, Homo sapiens
ttctggttcacacagctctgatagtaatctgctcactaagtgttagttgccgtgttctctgccacaactccctcctgttgcacccctgcctttgagtcctgctaaacaacagtattggaacccatcattttctctcatgcctttacccaaactgttaattttctgcaattcccttctctccacatttttccttctcagatcactgaagatcgtccagtcttccctgcccatcccttcccgaccccatcctccattatttgtactctcttagcatccagtgcacttttttcagtacttatcacacaacattataattgtttttttggtttattttgatc

SEQ ID NO: 109926 - DNA, 454 bp, Homo sapiens
aatcacagtgaactccacccttacactgtttcttggtgctggtcattctccatgtgctcccctcccctgatgccttctccgtcctgtctgtaccccaagcgactgccctttctggctggctcctggctggttcagcctgtgggaggcattccttgcaggaaacaggacagagggcatagaaagggatgggtcgttctctcccatccctccctgcttcagagctgtgtcccagtagagctgcatccctccagaccaacaagcgacccatccctcaggccacagctccagctctcaccagtctcctcctttgcccttccatcccttgtttgctgccttaagcctgcccatgcctctctaagtagtctctaaatttggtctttattgaaacatctgctgtgaattgttttctgccaggactctgatacatcccggactcccaaaatgcacacacgta

SEQ ID NO: 109927 - DNA, 343 bp, Homo sapiens
tagatatccaaatgagccataaaaaattgtgcaaaatgttattccttaatacataatattttaatttattaaaaaatgagttttacaaatgagtatcaaaagcttagcaccccatcatccctgtcaatgttcacaaaataataaattctaaaatctttaagatgtatatttaattactcatccaagatcagttattgcatgcttaatcagaaaaatacctattaacgtttaacacttagttactttacagattaaaaaacatattatacctgccatctagggagccagcatcctcggtgtatcaaaagtgtttagggcagaaagcagtgatgtgtcatagtgt

SEQ ID NO: 109928 - DNA, 300 bp, Homo sapiens
gtgatccgaatgtgcttggtagaaacaatattacttcagtgcttagggtggcatttgaataacgcacgagtaaaaattctgaatgctccattctcatttcttttttgtaaagaggtaagatgcggtcagagaatggactccatgcctctggtaatgaagctgagctactggcctccgagtcttgcccagctctgtaagtgactgttaccctgggagacacgctagtgtgatgagcaatggtccaggcacaaccttagggcaggctctgaggcttccaggatgtaggagcaggatctcagg

SEQ ID NO: 109929 - DNA, 108 bp, Homo sapiens
tgtttactgccagtattttaaactagttaaaaacttaactctactggtgaccacctaaagatcaagtttcagcaaagtgggacttcattcatttattgggcaactgag

SEQ ID NO: 109930 - DNA, 431 bp, Homo sapiens
aatggagggtgtgaatgttggataggtatgcccatcacagaatgaactggggaggaaatgagtcagttttagttccagccacttgacagctgtgtgacactgggcaagtgaatgtgcctgtaatggctttttaatatgtcaacctagctagggtgaactatatagcctagtcattcaatcacacaccaatttaggtggtgctgtgaagaaatttttagaggaaattaaagtctctaataatcagactttaagttaatcagaaggtatattattttacaaaaggcaaaatttagaccaaaaaggcattgtataatcatcctgggttcaacagagaagcagtaccactaccagtaagatgtaggatagctggatggatggttagataaaaaggttgcaactggcctgttctgatttattatagacacccctat

SEQ ID NO: 109931 - DNA, 126 bp, Homo sapiens
agccagataaaatgacttcctcattcaaggtttaccagctcaccagcgctaccttcctggaagagtgccatcggccttccgggacgtaataaaacctgctgcatgcctcactcacccttcgcagcc

SEQ ID NO: 109932 - DNA, 162 bp, Homo sapiens
cctctgccaccttccagatgcctgctccgtcccataaggagacaaggacagaaggtgagaaacactgagaaaggctgggctgtggcccaaatcctttgaggcctgaaaacaacctgtctcggctacccaagcccagactaagcaagtctgctgggtgagtag

SEQ ID NO: 109933 - DNA, 795 bp, Homo sapiens
gatgcccaatgtcttaaaagctattatttcatctattttatttgagattatttcaagcaggggtataattctggttcctgtaactcttctatgaccagaaatagaagactgtccttcagttttcttcatatctaagtattttcccttttttaaattaagttttcttcttaacccaggaattctttagaaatgcattaatttccaaatgtattttaattttgacttctatcttaattacatcatgttctgtgcagagggcattgtgccacactgtccggattcctcttcagattttctccccgcaaccacctcactagaggggcaggccaaaagccttcaaatgtcagccttctctgggaactatcctcagctttaatctacctcacccactttaagcccaggacaaatcccacaatcctccttgctgtcttccattgctgctggctgacttttttctaatgcatactttcactgagggtgtagccctgtaagcatctgggcttcttgtggagacctgtgccaactttccccctcttgcaagcccaaggactcaaatcctcttctgcatggctgataaaattcaagtccattggataccaaatcaccaaactgcctcttggcaaccaaagacagcatccacacacttacctttctaacttccatttcatcttcatttttggctctaaggatttatttcactttcttgaaaatactttaaaaggacgtttaaattttattcagcatttctgtgtgtttgtagccaaagggctttatgaatacccagcttgtcatgtt

SEQ ID NO: 109934 - DNA, 372 bp, Homo sapiens
aaataaatacactgttcaaacttatgctaaaacaaagaacattcctaataagtctttgagaactgagttattaacttttattgtaatattctaatggtttcttacatatatatgcaaaattcagagtattatggaaaaagttattagaataactcagtgatgatcactatggacattaaagaatggtaagattatttttttcattgtaatggctttataaagaaataaggccaggcgcagtggctcacacctgtaaacccagcactttgggcatcagaggcaggagaatggcctgaaccctgaaggcggaggttgcagtgagccgagatcgccccactgcactccaccctgagtgacagagcaagactctgt

SEQ ID NO: 109935 - DNA, 676 bp, Homo sapiens
catctcaagaagatgcagctccatggcaaaggatctcaagatcccagcaccaaggtccacataaaagctttgcaaactgtgacctcctttcttctgttatgtgccatttactttctgtccatgatcatatcagtttgtaattttgggaggctggaaaagcaacctgtcttcatgttctgccaagctattatattcagctatccttcaacccacccattcatcctgattttgggaaacaagaagctaaagcagatttttctttcagttttgcggcatgtgaggtactgggtgaaagacagaagccttcgtctccatagattcacaagaggggcattgtgtgtcttctagcagaaaacaaactggtggtgtatgaaacattttatatttcttactgggttttctgtaatatatgtatatgaataatttccacatgtatacctagaaaagtcttttacctaaagttagtctagaaaagtacatatatatagatgtgtgtgtgtgtgtgtgtgtgtatgaaaaactgaagaacattgacaataacatgctttttattgttttttcacaaaaactgccaaattatagaaaatatgacaaaaattcctcaattatgaagccatgtttatttcatacatgtattttatatttcatttgtagaatttatatctatttataatta

SEQ ID NO: 109936 - DNA, 327 bp, Homo sapiens
aaccttaatttaggaggacccactgtatagagaatatgtcaaatatttgagaaaaggcagatagctcacttcagaaaaggtagttggatcaggtgatctctcttttcaggctaggcaaccttctggaattctgtaggatagactttgtcaaagtgagtgtataagtcagaatcctgctgagaaacagatggtatactcaaggagtttagctgagatgagcttagtgaagggacaatttatgatggcgtgtgcagggttaagggaacttaccagtgattgtgaggcatagaaagactatgaacagtgaggggctgttattattattac

SEQ ID NO: 109937 - DNA, 339 bp, Homo sapiens
aggctcttcttgaaaatctggcaggcagtattccttgactaacacttagctgcctgtggcgcccaggctatggtattttcttgcctaccttgctccctccctccttctatagacagctccatgcaggatacacataggaatttgttgtagtttctcctttcaacctctaatgacccttggcttttgtgtgctttgcaagattctgtctcctcatacttaatctaataaaacctgtgaaatgggtggggtactcattactacccctattttacaaatgaaggaattgactcagagaggatcatcttttttgtttttttttttgagatggagtttcgctct

SEQ ID NO: 109938 - DNA, 231 bp, Homo sapiens
gtgaaacgggagcttgcatgtcacatggcaaagcaggagcaagagagaaagagtgaggggggaggtgtgacacacttttaaatgaccagattgtgtgagaactcactatcatgcagacagcaccaagctatagagtcctatgggaagtaaaacagagactgtgtgtatagacaatactatcagtgggtttgaaggaaccgagaaagagataagaaggtaggatggaagaag

SEQ ID NO: 109939 - DNA, 256 bp, Homo sapiens
gtgtcaaaaaaaaaaaaaaatccaaaacacgctctctgttttcccattcggaggagaattacatccttctggaaagaggcctccatgtctgctggcgccacgtccgtcctatgtcccctctctctgctctgcctccttcaaaccccagtgagtgggtcaccaagaccccgtaggattgacggggaggtggaggttgcagtgagccgagatcacaccactgcacaccagcctgggcaacagagtgaggctccgtctc

SEQ ID NO: 109940 - DNA, 716 bp, Homo sapiens
atagttcactaattaaactttatatattgtttatatttgaaacatcttaagatgcaatattttgtattatgtatggtaaataatctttgtaattatgttggtattaatgccaaatcaaatgtagattcatattctactaactacatctttatgttccaggaaatacactgagttttattacaatcactatcctgtttagtcagacaaataaccctacaatttagatattatcatatctaaatccaaggtgagaacttaggtctaaggcagcgaagtaagtctccagcatcacaggtgtatacatgtattacaaatgaatctaactttctcatttcttttcacggtttcatatagcacacagaaaattatatggtatagctatgcggtaggagtacagacagaaagaggaaagaatttcctgtgaaaccttaccccaaagactagcataattgcttcatcaaatctacttctgtttaatcttagcacaatttatccaatgagcttacaaatgtgctcataagattagttatatctcacagatatttttatttttaaatgttgaaagttatgaatttgggagtgaaattttttatcatttattcacccattgaccatctatacaaaaaaaattacagctaactctacaaggaaagaattttagtctgacaaaagtgaagctcactcagagaaactaaattatttgtctaacgtcacaa

SEQ ID NO: 109941 - DNA, 363 bp, Homo sapiens
tggcacatggtaagcactcatgtatactagctattatttatctagcacaatttagtgagagcataccagttgcctttactgcttgcagaagatataaaaatgagtaagaaactttcctgaccttcacaaagcttccagattaggacagagcaaccactaagcaattctagcacacggctgaatataatccaccctgacactagaagaaaaatagtcactgctcttatgaagcatacatattctttacctaaatttggatgtgaatggcaaaaactgaaattcagagagataaagtcacttgcccaagatcatacagcaaattagaggcagagctaggagttgcggccgcagctgtcgggctcc

SEQ ID NO: 109942 - DNA, 671 bp, Homo sapiens
gtgtatcaattttagtattcaaactagctttatagagtagctaaaatagttcctatatcagagagtctgaagaatatgaagggctggagaattcatagataagagctcactgatagggaatcctctacatgctgatgtagaatatattgttcagtgaaaggaaagggcagaaaagtacagtatcatacttcttgtgtcagaaaggaggcggatattagaatacagactctgctgatatttgcacaaagaaactctaaaaaaaactagaagaaataataaaagaaaatacctatagaagcaggtagaaatggggtggaagaggacggggtgaaaaataaggcttctcagtatatgtctttttatgttgtattcatttttgaactatctggatatttcatctataaaactttggccttgcgtgccactgcaagggagtagcagtgaaatgactctgatttcttgttgctccatgtatcaaattcactccttagtctactgtttagatgtttctaccttgtgccttggcatgatctgtttaactgaaatgaactatatctatgtccctaaatcactttcaaacttcaactcaaaatatatcacttcctcctcaattggctatttatttcattctgccttttagcataatgtatttatgttgtatatttgtatat

SEQ ID NO: 109943 - DNA, 220 bp, Homo sapiens
tccaatacatatacacatgccaggcagccagagtcttgatagcatcaaaatttcaagagcaatacccacagttattgtggatggcttttgaatggcatggctgatctggaaactgacttcagttgtgacattggtgaggacctcgttagagatttctgaaacaatggtcaagtactaattgaagaatgccagtagtgagtgccttggtgggccccagcca

SEQ ID NO: 109944 - DNA, 201 bp, Homo sapiens
ttttcacatcactttcttctctgcgtgtctatgtcttctcttctgttcaccctgtctctaccaattagcccaggataaatgccatcagaaaaggtatggctttcaagatctagtcattgataaaaagaaatataacttttggaagcccttttgtataaagaaaaagcactcaacttgaagttaaaaggcataggtatgagt

SEQ ID NO: 109945 - DNA, 536 bp, Homo sapiens
tttttagtagaaacagcatttcactatgttagccagactgttctcaaactcctgacctcaggtgatccaccgcctcggcctgccaaagtgctgggattacaggtgtgagccaccacgcctggcctaggggcagattttcagttgaattattaactggaattcatgttcctgttcccatttctccagttctaccgtcagccattttagtgatagtaaactcttaatctagagcaccattcttaaccccaggtacaggtttgtctgaggaacttttaaaaattattgatgctttaactagagattctgatttatttgttctgaaagtaaggccttagcattagtattttttggaaaagctcctcaggtgacattactctgtagctaaggttgggaactactgatgtgcagtatgggtaggtacaaagaaaagttgtaaattcttgttggtctctacctctgataaaaggaaaggaattacattttactcttgaacaacacagtggcgagggttgccagcccccaccccactgtgcagt

SEQ ID NO: 109946 - DNA, 433 bp, Homo sapiens
ctttcccagggaaatccactttcacgtccaccggtatccaatagacaccctccccacatccaaggaggaccttcaactctggtgccacaaacggtgggaagagaaagaagagaggctgcgttccttctatcaaggggagaagaatttttattttaccggacagagtgtcattccaccttgcaagtctgaactcagggtccttgtggtcaaattgctctctatactgtattggaccctgttcagccctgcaatgtgcctactcatatatttgtacagtcttgttaagtggtattttataatcaccattgtaatctttgtgctgcaagagagaatatttggtggactggagatcatagaacttgcatgttaccgacttttacacaaacagccacatttaaattcaaagaaaaatgagtaagattataaggtttgc

SEQ ID NO: 109947 - DNA, 852 bp, Homo sapiens
aaatcagccaggagtggtggtacacatctgtagccccagctactcaggcggctgaggtgggaggactgcttgagcccaggagtttgaggctgccgtgatctatgaccatgccactgaactccagcctaagtgacagagcaagaccccatctctaaaataaacaaaaacaagtttaaaaaaagaaaataatttcaggctgagcgcggtggctcatccctataatcccggcacttcgggaggccaagacaggaagatcgcttggggccaggagttcgagaccagcctgggcaatacaagacaaaaaaattaataataataaaaaaaaattcatgaccccagcagtgcaacattaaactaacctccaggtccctccaagcagggctgccgtgagactgcccgtttcacaaatgcatgaagccagccctaagtctttagtgagtggagcctcttttgataagagcccaacacctggctagcagactccagttttggagcccaagtctgcccagatttgaaagccccagctctgcagcttctgagctgggtgactctgggcaagtcactcaacctctctgggcctcagcttccccatctgcaaaacagggataataagtatggacttcataagtcatggtgaggaccccatgagtgataaacatgatcacgacagagctgctgctgtctttgccaaggcaaaggataacggaaacgtgggtgtctcacaccaggaccccagtgtccgcccgatgtggtggcgctcaccacttcgagacaggcggcgagtgatgtcctgttttgtcccctccctatacacacatacacacataccagccactctttcccatcaggccc

SEQ ID NO: 109948 - DNA, 473 bp, Homo sapiens
gagtaaaagaagccagacacaaaagaccatgtgtcgtatgattccatgtacatgcaatgtgcaaaaagccaaatccgcagaggagggaagtagattagcagctgcctggggctgggcgtgggaacagggagtgactacagctgagcaaaacggaggttttggggtgatgaaaatgttctaaacttgaattgtggtgatggttgcacaactctgtaaatttcctaaaagtcattgaattgtacgcttcaaacaaatgagttttctggtatctaaattatacttccgtagagctatttttttaaaaaaggaagaacagaggcttggggatctgagaggcccagctccagttctggttccttactcccatgcctcagacaggtggctccaggcctcagtatccacatctgtgaaatggggtctctaccaaagctttggaggccatgaggatccaatgagacgtgtttaaaggcctg

SEQ ID NO: 109949 - DNA, 533 bp, Homo sapiens
tggcgtatatgtacaccaaaatctagatagtcagccatacttttcacatgacttttgtaaccatttcaccctgaccctctccagccctcctcccctgatccttggcaaccactgttttgcttactgccactagagattagtttgtattttctagaactttatataaagggagcaatatcatatgtattctgttaggtctagcttctttcattcagcataattattttgagactcatccatgttgtagaatgcatcaatagtttgtttctttttattgataaatggtattctacttatgactatgccacaatttaaactaattggtatggatgctcatttgaattattaggtttgttttcagttttgggatattacagataaagctgttctaaacattcatatgcaagtctttgtatagacatgagcttttatttctcttgagtaaatacctgggatttaaatggctgaatcttatggtaggtatactttttactttatagttaagtgccaaactgtttttcttttacatttct

SEQ ID NO: 109950 - DNA, 760 bp, Homo sapiens
agcctggttctggagccactgcactccagcctgggcaacagagggaaaacttatctcaaaaagtaaataaataagtacccatgtagttaaaatgtttaaagactagcaaatagatgttggctggtttgatggagaaagtaaatccattctttttcttaaaaatgatctcttcaccaccagtcccagcaccccccttaccagcctcccagggcactgtccatggctacattgtccatgggccatcatgtcccctcggcttctcttctggttgtaaatgctcttgcacttttctcccttgtggctgccgtccacactcccagctgccttccctctgcacttaagatctaagatcttagagacgagatgagacatctcttgccttcgtgcatctaagacagctcatcaacaggtccaggtgaactgctaacactgctgtgttgcttggaggcccctgtcccaccctggctgcctcagctttggccatggtacccacggtctccagctacatcagatgcctgaagaacaaatctctccttagctctccctgccccctctccaggaataggagcagtgggacccccttcaagaatcccccatttcccatatactttcctgcaaagccacagggcgtgcaaagtgggattccagggctccagcctgctccccatgggcctctggatccaggggtgactctttgcctgtttgggtgcctctttagattttccaccagcttcctgtggccaggagccagaccacgccc

SEQ ID NO: 109951 - DNA, 688 bp, Homo sapiens
catttttggtgaatgttttttgttgttgttgctaatgtatatggtattattttaatttctaatttcagttgttcattactgatacataggaaggaagttgacaatttgtatattaaccttgtatcctgcaacctttctacagtagtttattagttccagtgattttgttgttattttgggattttctacgtgcataatcatagcatactattgggacaaagaatgatgagaaaaggtatataaagaatgataaaaatataataaaacagtgtatttgagcctatttcttcatagttgatcatcaattattgtcccattgatagccttttaactttggggagtaaaagggattgcagaaaaggatgaaggtagggtaccaaagttctaagccatataatgctgtcttttttaagcccccaaccccctaatttttagctctccttttcccacccaaaaagcacaactgtctaaaaatcctatttcattgtaaatgtcaactgacatttccatttatccttgcaagattacctaagcatgctgatggggggatggacaacatattcattagcaaaacagaattggagaatatcgtttcgttgactctagaatttagtctcctgtgctttttgcataagctgaagggtctcattagaaacaatgtattattcctaaaagtttttagggaaaa

SEQ ID NO: 109952 - DNA, 343 bp, Homo sapiens
aattcgcccaccctccccacacacttgcttttccgacactaacagggttttagtgactgcatctgctgcacagtattcttgtgactgctccaagcagaaagtaacttgaggaatgagtccctgatttttggcatcagaatcctctgggggtgaggttcctgttttttttgaacaggccttaaattataacccacaaacgatctaatttatagtatgatgcctgttgtaggagaaaattggctcaacaaacggttgtttaagaatttttttctgtgtaactgtcattgaagtttaacacacttttctctgggacatttagtaactttgtcagtgatattttttg

SEQ ID NO: 109953 - DNA, 594 bp, Homo sapiens
tatactctttaggtcgtttgttaattatgttcgtatcttttatatctttacttgttctgttttcgtgtattttgcttattcagactgctactgaaatctgtattaaaaatttatggcataattgtagatgacatttttgccttataaatttttttaattttaatttatttgtaattcacaaataataattgcatgtatttatggggtacagtgtgatgttttgatacatgttcacattgtgaaacaaatcaaggtaattaatatatccatcaccttggccaggcaaggtggcttacgcctgtaatcccagcactttgggaggctgaggcaggcagattacatgaggtcaagagctggagaccagcctggccaatgtggtgaaaccccttctgtactaaaaatacagaaattagctgggcatggtggtatacatctgtaatcccagctattcaggaggctgaggcaaaaggaacactcaaacccaggaggcagaggttgcagtgagccgagattgcgccgctgcactccagcgtaggtgacagagcaagtctctctctctctctctctctctctctctctctcaatctctctctc

SEQ ID NO: 109954 - DNA, 384 bp, Homo sapiens
gatttcctttcctgtcttcccttttcaaacaagcacatccctaggccactttttggggaatagcctagaagaacagaattcccagttgaagttataacaaagaaacatgagacccagtgcctgagcccaaagtgtgggtgctgctccgagggactgcagggaacataactctactgtcttcttatcttaagagagagcagtgtgcaggaggagactagaacgtgggacctggaaggaaactggtgcagcctcacatggactcacagaagcaggaactcttggctcccaagtgaacaagactttttcagtccacccaaaggctcaaggctagctgaaaattcatgacacgataattctcctacattctcatttttctctgttaaa

SEQ ID NO: 109955 - DNA, 485 bp, Homo sapiens
atgtctttttcaagcacacattttggtcagggttgatggctgcaagaaggagaaacctattcaccaccaaaatagctctgaaagggaatattctctcattaggcatttttatagacaaggagcctcacggttttggtacttgcctcgtgacctcaagtggcttggacttgccgggatccagttttgatcctattgtcacaggactttttagctgcagaaccctttatggatggctggtctctttcattcagttcaaattctgaagacagcctgattggctcactctcacttgtgggttggttctccttatctcttcccacccagtccaatcatagtatccagaagatgaagtcatgtggttcatatcattacttttctaaggagaagtagatggatttaaacaaagcaaaacactgctggactgttagatatgtgtgtttttaacctgcaattgtagtatagtataacacccttcaccaagtttc

SEQ ID NO: 109956 - DNA, 890 bp, Homo sapiens
gaacttcagacatctcaggagaccagtacgcatgaatgaacatgtagggacccctctaatacgtttcacatccattatgatacaacaatgaccatacactttagtagttctcagtgtgtgttctccagatcagtagacagcttcagcagcttgggaacatgttagaattgaaaatttttgagtcccacctcagagctgccagttcagaaactcttcacgtaacctgtgttacaacaagtccttcagataattttgatgtttactagtttcagagccactgcactaaatgaaactattggtagcatttgtgcactgtaaattgatgctgtttaattttcattcacttgtgctctgttggaagcttttttgtgtttccttcacttgggatttcaaggaagtatctaatttttttttttttttttttgctcaattacatgtaattgagaataagataggtatctgattctccaaaagttcagcatctttattttatgatttaaacttgtcgagttatgcctctgggtcctgtcattctcccagcgaataaaaatgtggatgcttggggaagtggaggtggatggtaaatgggaatactcttgtttgaatttttaaaaatttacattgtaaataacattaaataccatttgttgtgcccatgataacttcatccaaaatatatatattagtctgctaagatatgccataacaaaataacacaggcttggtgccttaaacaacagaaatttttcttctggttctggaagctggaagtctaagatcaagctgttggtggatttgatttcccctaaggcctctctccttggcctgcagaccaccaccttctctctgtgtcctcacctagccttttctctgtgtcctcacctagcctt

SEQ ID NO: 109957 - DNA, 434 bp, Homo sapiens
tggcagtaacaagtgttggtgaggatggagaggaatcagaacccttacacaatgctggtgagattgtaaaatggtacagccatgtgagaacagcctggaagtccttcagaaggttaaacatggagttaccatacgacccagcaattccactcctaggtgtatacccaagagaaatgaaaacatatgtcacacaaagacttgtagggaatgtttgtagctgcattactcttaatagccaaaaactggaaacaagtcaacccagatctttcccctcacagatcccacaggaggtctacagggaggtgtgactagctctgcatccctggagtcacacagtaggctggtggcagagccaattctagtgttctttctattggaataatttgcctccagtaacaatgtgaggaacaataagaggaagagattgaaaacag

SEQ ID NO: 109958 - DNA, 431 bp, Homo sapiens
tcaaggttacagtaagctatgatcatgccactgcactctagcccaggcaacagagcaagaccctctctaaaaaaacaaaaaaagaaagaaaaagaaatctgtttatattggtaaatggatttatatctgtaaatatctataaatagattactgcaaaatagcataatccctactccaccttgaatctggtaccacatttacaggcttccataacacacactattttctttcctataatttatcagagttttttgggagaacgaatattcctttaatgcctgtccccctaactagactatgagctgtggaagggcaggaaccatttccatgtaagggcctatttctaccacctgccaaaatgcctacacatagaagatgttcagaaaatatttgcactttgaatcaatgaatatgttattctgatttaatca

SEQ ID NO: 109959 - DNA, 620 bp, Homo sapiens
gacacgtgcctgtaatcccagctactcaggaggctgaggcaggagaatcgcttgaacctgggaggcagaggttacagtgagccgagatggcgccactgcactccagcctggggacagagtgagactctgtctcaaaaaagaaaaaaagaaaaagaaatacaaattgcccatgaatacatgtacaacaagtacaaagctattctgtgtggtggtgttcatataagctaaaaattagtctcagtgtaaatgtttactaacaggattatcaattaacaaatcccctgagaccagagcctctttgccaaagtggagctgatggttgaggaggagattttggcctcagcccagtcactggcagaggagaacgttctactcaggccccatgcagtatgacctcacgccctgagataagagtctgggatctgatctctcctcacctgaaggagagcaagaaagagaagaaaagaaatggcctctccagagggcaaggaaaggaaatattgtcccactgaagtacagtgagcagggcatgtgtgttcccaaaatacttcccagggctgtttaacctctgatagcagagtctcaaagatattaggatgcactttctttatcagaagaaa

SEQ ID NO: 109960 - DNA, 1165 bp, Homo sapiens
tttaattaaatgcaagctgagtcatttcaacctgcaaccttcaggtaacaggagttacccaagctccaggaattatgattgtggggtaaacccattctcttgttttcttgcggttctattttataacgcactagaggagacagagacgtcattgcttcacccagggcaagaggacaaaggaggatgcatggaaatacaaacagcccttctcctccaggccataccgactgtccaactagcaacagacttcacctggttttggagcaatctgaatttggaatatgccagagaaaacttctatcaggcaagatggaagactcctaggataggtctctctcatggagggattggcacgatggtaagagtccagtggatggaaaaggcctcctccttaaagatggtgatggaaacgagcactgcacagggaaacacaaatcaggtcccctgaaatccagcccaacctggccagaccctccagtgcccatcagggcttatgaacagggtgcttcagtgtctttgttaggggtggttaaaaaggagcacgtgcttataggggatgctgctgagctccatgattttgacttcctgtctaacctgttgatgctacaaaactcttttaaaaacagttaccatgggaacttttccctagcaagcattcttcaagaaacgttacaggtgctggtgaattcaatgcccttggtgtcaataagcttttgctgagtcttagaatgtgtggcttgaactgagaggactttcaaacagataatgcgaagtttccaatgcaaatgtcttcggggttaagtgtcagtgaagtgcagtggaaggtagggggataaaatgatctcagtgtatatggaggccccacttaagcattcaaaaaattctatatacagtgttttcaatgtattatgtatcagcaaaacaaaataccccatagggctataatcagctcagggggtcacctcagcaagagatgctctggctatcactcctactacgggatttcctctctcatcagaaccagtaggtggtcaaaaccacaataatgcataaatgaaggcagggaattgggtatccaatgtgagcaactgaaaaggtgccatgtattagctatttgccattatggttctgcaagtgctcagatgactcataaaatgaccagaac

SEQ ID NO: 109961 - DNA, 1014 bp, Homo sapiens
tttaattaaatgcaagctgagtcatttcaacctgcaaccttcaggtaacaggagttacccaagctccaggaattatgattgtggggtaaacccattctcttgttttcttgcggttctattttataacgcactagaggagacagagacgtcattgcttcacccagggcaagaggacaaaggaggatgcatggaaatacaaacagcccttctcctccaggccataccgactgtccaactagcaacagacttcacctggttttggagcaatctgaatttggaatatgccagagaaaacttctatcaggcaagatgggagctgttgttgggacaggacaagagtccacatcccctgcccagtgcctggttctgggtcatgtcaccgaagcgcatcagcccatctgtcagccaaaccccactagccttgtgccttctcttctaaatccccgcggaggaaaacaacttctgccttctacagtacgaacagcgagggtctgctgggaaccaatacaacttcgcgtcccagtgcagcaatgttgccaggtaacaaatgtagaaacatactccaaaaactgtatgtgacaatatacaacctccgctctgcagctgataaccgagggagtgttaaaacaccgcgttctcttaacacttgggtttttggtgtgaaagtaaaattaaacgggatacttcctcttgtaaatataagacaggcatacaactcacacacgtatccactaatcggaaatagtagaggggtttgcaatagctatctgcagtgcatcccagccttcactcttaccctcaagatgaattccagaaaacctacagaaacgataactgaggaagagcctttcttctgtcggggacaagctctcctctaacaattgtgaggaagctacccacaagaaagacaccagcagaaattaaggaaaagctcatgcattgttattaaaaaaaaatgtgcttccattccactccattttaaaggtctacctttaaaactcattggctaaccaa

SEQ ID NO: 109962 - DNA, 551 bp, Homo sapiens
tttaattaaatgcaagctgagtcatttcaacctgcaaccttcaggtaacaggagttacccaagctccaggaattatgattgtggggtaaacccattctcttgttttcttgcggttctattttataacgcactagaggagacagagacgtcattgcttcacccagggcaagaggacaaaggaggatgcatggaaatacaaacagcccttctcctccaggccataccgactgtccaactagcaacagacttcacctggttttggagcaatctgaatttggaatatgccagagaaaacttctatcaggcaagatggaagactcctaggataggtctctctcatggagggattggtaataaaaaaatcatgggaaaagaaataagggagggtggaaaaaacacaccttagaaaacaacttctgatgtcccggggctacacaatgggggagctgagcacttaggaaggagagggaaaatattctgtttccggagacagctccaagaatcatgagtaggtgtgagaaacaaggaagcttacagatttaaaaaaaaaa

SEQ ID NO: 109963 - DNA, 460 bp, Homo sapiens
tttacactgccctcaagaccaatactccacatacaccctccctccctgccattcttatccttcaaacattccagcacagtagataatttttgaatttctttcattcattcaacatttatttactgagcacttactgctctgggcactgggaatacagaggtgaacaagaggaaacaaagcccctgtttaacaaatcttccaggctaaagcggaaaacacagcacagaaaggaatagggcagggggtagatccagaaagcacttgcagcccagcataaaaactggatgttattctaggtgagatggaaaggcaatggaggactctgaagagagaagtaacactgacctgcaaacctttgctcgagctgttgccaactgtgcctagaacaacactcttttccatcatttgtcaaattcttcaaagcccaactcaaaagtcactacctccatggtgccgtctc

SEQ ID NO: 109964 - DNA, 234 bp, Homo sapiens
ggaccagtagtcattcttcaaggttcttcacctcttaccaattttttaaccaactgttaactgttttcaagcccagtcactctatcctggtaaaggaacatgagccaataactttcatgatgtaaaatcaatggctgaactctgtatttttagttttctgaaaccctttctcttggttgctttatatatatatgtatattttttcccattctccattgcagtgttgtcattcta

SEQ ID NO: 109965 - DNA, 484 bp, Homo sapiens
taataagggttggtgggcctgaagtgaacatcctctcagggaagggatagacatcaagtgagaggatgccaggcaaagggccacccctagtaacagctgcttgcatgtgcagagggagtgcccgaggaggtgggagctctcgggggtcactagggggcgctgtgactatgactggatgccgtgttctgcctgtcttcttgccggattgtgagatcccagagccgcagatggcatccagttgtgtctgggttcccggcaccccatgctccctctgtgaccttggtaaatcgtagtttagtaaatgttgagtaagcggcagggggtggggctcatccccattgttccacttcatagggcaccgtgttttcccttctaaccccctactctgacactcgtccatccttcgaggctcaaaacggacttgatccctactgggaacaacccccattatcagttggttctcagactctaccctagtgtccag

SEQ ID NO: 109966 - DNA, 293 bp, Homo sapiens
gggagattgaggctgcagtgagccatgattgtgcctctgcactccagctagggcaacagagcaagaccctgtcccccttcccccccagaaaaaccacggaaatactgaaagaatgggactgatgggaaaggctcttttaggtaaaaagataataaatatctgtaaaacagataattctgtatattggtgttacagccacttttgttttaatattcaccatgatgttgttttgtgataacaaatcatccaaaattaatacaagaactctcaactattattatagataaactatt

SEQ ID NO: 109967 - DNA, 601 bp, Homo sapiens
atgtcaactgtggatgatctgtgatgtgtataaaaaaaattcacgcgcttttttccaaagatggttttgggaacatcactagttaaagaggaaggagctagcaggaggggcaaaaaagggaggttaggcagtgaggaggcaaatgattacattcttgtgagtcggtgattagcctcagtaaatctgcattttacctgtgaaaagagggagcagaggaaaattttatgtatgcattcatctcagggtaggtagagggattatggttattattactgttattttttagacggagtctcgctctgtctcccaggctggagtgcagtggcgcggtctcggctcactgtaacctccgcctcccgggttcacaccattctcctgcctcagcctcctgagtagctgggactacaggtgcccgccaccacgcccggctaattttttgtacttttttgtatttttagtagagacggggtttcaccgtgttggccaggatggtctcaatctcctgacctcgtgatccgcccacctcggcctcccaaagtgctgggattacaggcgtgagccaccgcacccggccgatttctggtcttttacttgtgaagat

SEQ ID NO: 109968 - DNA, 1084 bp, Homo sapiens
cccctttccactgcaaccccttggcatactctgcctcctataaaggggcattagagtagcctgtggcaactttaggatatagaaaaggggaaattgaaatgggagtacattttatttgggtttagtgagagtttatgtgctttgcagtctttttgtaaatagctaagtaattgttaagtatggcaatgtcagttctattcctaactgctcgccatgaagtttacttagtatcataatgtgaacctgcagggccagagttattctgctatatataaaagtgccctatagcatctacaattgggagtacgtaatggaaaagaagatagtagctattaatacgaatattgttatttttctgaattttgtgatgtttgtggtatccatcagcacttttatatttgtaaatttttcccatttcttttcttcattttctaaacacttttcatacaatttatttgttactttgcattccttttttcttagtgcggtgtccaaaattgtaagaatcctttatcccacaaaaaattgatcctgtcttttacagaattgcccagcagatgtctttttcatttcctttgcttgtggtttgcccatctgtcagctgtgaatgacccaaacaacgtgacacgctatttctaactcaacagtcctggaactttcttgacctttgacaaagccatcagatcaccatcaccatcattattgtttatagaaacatgaaaattcaaccataaaaagtcatcttgggctgagcatggtggctctaacatgtaatcccagcactttgggagcctaagatctttaccatgctggattggaagagaaaagaccatcactaaagcaaatggatcaaatggagttataaatcaactctgtactctacaggattgactcaactgcagacatctccaatacactccctcatggctttattttttctgcttatgtggaaaaataacagtaaatacagttaactatcccaagacagaagagtattattaaaaaagaatacaacgttattgatttttcaagacataatcagatatttttaaactctgatttaataaaacataatgtaatttca

SEQ ID NO: 109969 - DNA, 563 bp, Homo sapiens
atgccaaagttcatgagttgagagatgaagaagaccaaaaagaaaatcttaaagacatgataaattggggcaggagggaggagatggcttctttgctgcattttctccaaaaaacatttctgattttatttccaatttgcttagcaggtatgctcactctttcactaaccttgagagacattgtcagatgtgcataagggaagaacatgaaggacgacggataaactgtacacagacacagcacatggagtctgagtcatttgttttctctgacagatctttaccatgctggattggaagagaaaagaccatcactaaagcaaatggatcaaatggagttataaatcaactctgtactctacaggattgactcaactgcagacatctccaatacactccctcatggctttattttttctgcttatgtggaaaaataacagtaaatacagttaactatcccaagacagaagagtattattaaaaaagaatacaacgttattgatttttcaagacataatcagatatttttaaactctgatttaataaaacataatgtaatttca

SEQ ID NO: 109970 - DNA, 521 bp, Homo sapiens
ctctggaggctggaaatccaacaacagagtgccagcatgatcaggttctggagaggaccctcttcctgtttgcagactgctgacttcttattgtatattccaatggtagaaagagagcaagagaactctctggagtcttttttttataagggtgctaaccccatttaaggaggtttcccctcataatctaattatctctcaaaagccatacctttcaacaccattgcattgaagatctttaccatgctggattggaagagaaaagaccatcactaaagcaaatggatcaaatggagttataaatcaactctgtactctacaggattgactcaactgcagacatctccaatacactccctcatggctttattttttctgcttatgtggaaaaataacagtaaatacagttaactatcccaagacagaagagtattattaaaaaagaatacaacgttattgatttttcaagacataatcagatatttttaaactctgatttaataaaacataatgtaatttca

SEQ ID NO: 109971 - DNA, 204 bp, Homo sapiens
cagtgcctggtacgtggtgagaagtgatgaccatgagctattgtaattatgagacaaataatgtaatttcaatgtttgctgagaggagagatcccttcaattaagctatcaggaagcccagatccatctcgattttcccagtgctaggggattccacgtgctaatgctcagagcccaggacagaggtggtgtctcagagggagg

SEQ ID NO: 109972 - DNA, 151 bp, Homo sapiens
ctgagatcccctcctcggctgagaccttgcatggctttccagccttctaatggagagtctatagttctaagattttatgatttcaaaagtataagggtgtagagtacatgcatataatttttcaggccaagatcgattctatctctctacc

SEQ ID NO: 109973 - DNA, 202 bp, Homo sapiens
caacaccagtgacccacaaagatctctcttcagtgggtgtttgcctccttcctggtgctctgtgggttgcttttgcatttcttgtggacagaggcctctctctctcaggtgaagagcttccttagaggaagatagaatacagcccagagagcaggccagagaccccttgctccctcccgcaaagactgggaaaggagccatt

SEQ ID NO: 109974 - DNA, 345 bp, Homo sapiens
tgcggggactgacaagggtgctgctgaggtcacgggcagaaaacatctcggcccacgcaggggaggagccactgggccgactgtcccttgcagttcttttcgtccgcggcaggtcacgtgctcatcttgcagctctcactgcactctgcccacattgcttcgagaatccgaatgtgttgctgaggtcccctgaggcattcgttgctgtcccaagggtgtagggcgtcacacgcagcccgggggcgcgagcatctgccactcaggagccctgctgtccctagcaggtggctgcggctctgagccgctctccttacccacatggggccttgcagctctccttaccca

SEQ ID NO: 109975 - DNA, 496 bp, Homo sapiens
ccagcctataaacaagtttttttgtttatttttcatttcattattttcattcagagttctttatgtcacttgtcccaaactgcactacacattcctgtcaaaggccaacactcaatagttcacacaccaaagtgatgccaacagttaacaaactccaactaataacatcacacttacccacacacatcactcactgtcctcttaccctgctttacttgttttttgcacataacccttacatttgacagtttgcattctgtcaatctctccaaaatataagctccataagggagaggagtgttttatttgctgctgtatccccagcatctcgcacagtagacttaacagacagaaataaatgaaccattaaacgtctacacatggagccctttgcttttcagaagcctatttttgtgtaagcctgaaaatgcaagaataactgcagaagtcccttttaatactctaaatgaatctttgtgaaatcttattcttggtt

SEQ ID NO: 109976 - DNA, 248 bp, Homo sapiens
cagtcattgattagatttggatttaataaatttaagcctggccaataattagtgggaaccaaaccaaggcaacctatagtaaatggagcattgcatcgaagatctcagttcttcaaataaggcacagataaaggatctctatgtattaccctcctgttcttggatttaattgttcaaatgtttcacccaaaacctcaatttcaggctaatatttaggcattctcttctatgttatacctcaggtaatt

SEQ ID NO: 109977 - DNA, 352 bp, Homo sapiens
gggacagaggcacaacatccagtgttaaaaacagaagaaaccaaacagagcaaacttaagacattaaacctgtacaaatgcatggagtctatgtctaggacaacagtaatggcttgttttgttttcctccatttgtctgtgatgattcttgtcagatttcatactacacacactatctatggtgtcttagataaggctgtgatgacagactatttttcctgattacttctggtacacttttaagagcttaagatagcaccatgcatctatcagatgtgctgtttggatcgtactgtttgaaaacaaaattaaacggcagctgaataatggggtggctgccagagacaccttg

SEQ ID NO: 109978 - DNA, 402 bp, Homo sapiens
tagtgacacccgggtcctgtcgctgtgcccgggtggtgctgctggggcatcagctttcctcactcctggcagccagccccagtctcttccctttgcctggatgtttgcagtagctaccttgctgacctcgttgctcttggtcttttcattgtctccagttgacttggaacgctactgccaggatgatctttctgaaatactgttttcatctgtcgcctggtcagaagtgttaatgtcatattgcctctgtggcttgagtctcacaggctcaccctcttttataaccttttataacctgctgtcgacggatcatctgtgactcatctacacacctctggctcctgttattatttgcctgccttttcatcactgcggtgaattgcatatttcattattttgtct

SEQ ID NO: 109979 - DNA, 4112 bp, Homo sapiens
  misc_feature (4)..(7): n is a, c, g, or t
ggannnnggcccccgccccctactcccttccctcaggccccaggaagttgcaagagtaccatttgtcgcacactcggggaccgcgggtggccggaggagatgaaaccgtcttggctgcagtgtcgtaaagtcaccagcgccggggggctcggagggcccttgcctgggtcctctccggcccggggagccggtgcggccctcagggctttagtggtcccgggcccgcggggcggtctcgggggccggggatgcagggcactgtcctccggcagtggcagcgagtacaagacccacttcgcagcctcggtgaccgaccccgagaggttctggggcaaagctgccgagcagatcagctggtacaagccctggaccaaaacgctggagaacaaacactcgccctctaccaggtggtttgtggaaggaatgcttaacatttgttacaatgccgttgatcgtcatattgaaaatggtaaaggggataagattgctatcatctatgacagtcctgttacaaacactaaagcaacctttacctataaagaagttctggagcaggtctccaagctggctggtgtcttggtcaagcatggcatcaagaaaggtgacactgtggttatctacatgcctatgatcccacaggcgatgtataccatgttggcatgtgcaaggataggtgccatccacagtctcatatttggaggatttgcttccaaagaactaagtagtcgcattgatcatgtaaagcccaaggtggttgttacagcatcatttggcattgaacctggaaggagggtagagtacgtaccacttgtagaagaagcgctaaaaataggacaacacaaaccagacaaaattctcatttataatcgtccaaatatggaggcggttcctttggctcccggtcgtgaccttgattgggatgaagagatggcaaaagcccagtcacatgactgtgttcctgttctttcagaacacccactgtatattctttacacatctggcacaacggggttacctaagggtgtgattaggcccactgggggatacgctgtcatgctacactggtcaatgtcttccatatacggacttcaacccggagaggtgtggtgggcagcttctgacttaggctgggttgttggacattcctatatctgctatggacctcttcttcatgggaacacaacagttttatatgaggggaagcctgtgggaacaccagatgctggcgcttatttccgtgtgcttgcagagcatggagtagctgccttgtttacagcaccaactgcaattagagcaatccgtcaacaggaccctggggcagctttggggaagcagtactctctgacaaggttcaaaacattatttgtggctggagaacgatgtgatgtagagaccctggaatggtccaaaaatgtcttcagagtacctgtcttagaccattggtggcaaactgagactggatctccaattactgcgtcatgtgttggattaggcaattctaaaacacctccaccagggcaagcaggaaaaagcgtcccaggatacaatgttatgattttggatgacaacatgcaaaaactgaaggctcggtgtttaggaaatattgtggtaaagttaccattgccacctggggctttttcaggactctggaagaatcaggaagcattcaagcatttatactttgaaaaatttcctggatattatgataccatggatgctggttacatggatgaagaaggctatttgtatgttatgtctcgagtggatgatgtaataaatgttgcaggtcacagaatttctgcaggcgccattgaagagtcaatcctttcccatggtaccgtggcagactgtgctgttgttggcaaggaagatcccttaaaaggtcatgtccccttagcactctgtgtattgagaaaagatataaatgcaacagaggagcaagttttggaagaaattgtgaaacacgttagacagaacattggccctgtggctgcttttcgaaatgcagtgtttgtcaaacagctacccaaaaccagatctggcaagatcccccgatcagctttatctgccattgtcaatggcaagccatacaagataacttctacaattgaagaccccagcatttttggccacgtagaagaaatgctgaagcaagcataatgagtttgtcttattcctattttgagttgatttaatttcttaattgaaattaaattatttgagttgtttctcagaaataaatatttcagtagaaattacttgcaaaatgaaatgtgaattgtaaaacttggcctaaacaaatctaatgaaaacatgtgaaagacctgtgccttttttttggtttgaccctgttagcattgttattagttatctataacatggcttattgaatgtcatctactgctttaggaaaaacgtatctagtgtattatttttaaaattgtacctcccaagaagaacactttaattgaaagcaacactaatatagagccacttcctgaaaccaagaatctgtagttttgatccaaaatctaaaacttaaagtcagaaaataattaaaatttttcttgtagaaattttagatattttctagtattctttagatgctcacattgttttaaataaaatagatgaaatgggaagtttaggtaatcatctagacagatgaaattattatctaggtaggagggcttttctatacattttctgagggaaagcagaacaccggggttatagctataccttcaggtcttttgacttaggcaaggaaaaccacatgtctgacctggttcagcatgtaatccgagcactttgggaggctgaggcaggcggatcacttgaggtcagcagtttgagacgagcctggccaacatggtgaaaccctgtagctactgaaaatacaaaaataagccaggcgtggtggcgggaggctgaggcaaggagaatcacttgaatacaagaggcagaggttgcagtgagccaagttcccccactgtactccagcctgggtgacagagtaagactccatctcaaaacaacaaaaacaacaaaaaaaccacatgcctggcggagaacaaagagatcatttagtccaatctcttcatggagatgagggctcctgggagcccctcttcatgtctcaggttcttagttgactatgtttatccaaatgattccagattcctgtggaaacaaggaatcgatgtacaaatggggtagggtggcaaggaaaactcttaagagagaaacatcaaggttttcacattaggttaaagacaagaaggtttctaggcaggtagtgtaatgtctaggtgattttgaagtgaacttaagccactaggtttgagggacaaaggacagtagaaaatggtgaagactgcagatcacctgctatacctcaaggagcagcggacccagcagaatatggcccaaaaaggaggcaggtctcctgttgcaagagcctctgtttttttaaagagaaaacaaagaatcctggtttttatgtgaaatctctaattttaaaataataactcattaaaaatattgtaatgtccaaaagtatctttccatttaacttctaaaaatctcttaaatgttttttttaaataattgtaaagtgagtttttgttaagcttataggaatgggccagttaactaaggtagacagatgtaggaaattaaatatttgatttacttagggatctatatgacatcagttatcaaagaatacattttaacccaaaagtataccatgctcattgtatctttgatcgttcttcaagtatttctcaatcttttaatctatcaggaacattactatcaagagcagattgttgtaacataatactcaggatacatgaaatgtatgtgagagataaatagataatagaaagtttattgttataaaaatgacctacaacttatataaaaaaattctgaaaatgttgactttttttggactgaaggctgcaaaataaatggcttctcaaagtaaattcctatttacttaaattgccttcttgattgttacacctggaaaaatatattcatctactttttccttttaattatgttagtagactgaattaaaccagctacatagacactctctc

SEQ ID NO: 109980 - DNA, 3834 bp, Homo sapiens
  misc_feature (101)..(101): n is a, c, g, or t
ggcgatgtgcatgtgcctcgtggttacagcagtcaggctgttacgcctgaatataccgagcgtatagcggagcccaacgcgttgcgactcaaaactcagcnctgctaccaggtgtagctgtgtccacgcaggctcaacgctatgtcagtaaggccgtatataggcatatcttccaagctgcgaaaagggtgctagatagcatatcagtctatgagcacggcctgttccaaagcatctcaaagtcaaacttcacctatagaagaagttctgacgcagagtctccaagctggctggtgtcttggtcaagcatggcatcaagaaaggtgacactgtggttatctacatgcctatgatcccacaggcgatgtataccatgttggcatgtgcaaggataggtgccatccacagtctcatatttggaggatttgcttccaaagaactaagtagtcgcattgatcatgtaaagcccaaggtggttgttacagcatcatttggcattgaacctggaaggagggtagagtacgtaccacttgtagaagaagcgctaaaaataggacaacacaaaccagacaaaattctcatttataatcgtccaaatatggaggcggttcctttggctcccggtcgtgaccttgattgggatgaagagatggcaaaagcccagtcacatgactgtgttcctgttctttcagaacacccactgtatattctttacacatctggcacaacggggttacctaagggtgtgattaggcccactgggggatacgctgtcatgctacactggtcaatgtcttccatatacggacttcaacccggagaggtgtggtgggcagcttctgacttaggctgggttgttggacattcctatatctgctatggacctcttcttcatgggaacacaacagttttatatgaggggaagcctgtgggaacaccagatgctggcgcttatttccgtgtgcttgcagagcatggagtagctgccttgtttacagcaccaactgcaattagagcaatccgtcaacaggaccctggggcagctttggggaagcagtactctctgacaaggttcaaaacattatttgtggctggagaacgatgtgatgtagagaccctggaatggtccaaaaatgtcttcagagtacctgtcttagaccattggtggcaaactgagactggatctccaattactgcgtcatgtgttggattaggcaattctaaaacacctccaccagggcaagcaggaaaaagcgtcccaggatacaatgttatgattttggatgacaacatgcaaaaactgaaggctcggtgtttaggaaatattgtggtaaagttaccattgccacctggggctttttcaggactctggaagaatcaggaagcattcaagcatttatactttgaaaaatttcctggatattatgataccatggatgctggttacatggatgaagaaggctatttgtatgttatgtctcgagtggatgatgtaataaatgttgcaggtcacagaatttctgcaggcgccattgaagagtcaatcctttcccatggtaccgtggcagactgtgctgttgttggcaaggaagatcccttaaaaggtcatgtccccttagcactctgtgtattgagaaaagatataaatgcaacagaggagcaagttttggaagaaattgtgaaacacgttagacagaacattggccctgtggctgcttttcgaaatgcagtgtttgtcaaacagctacccaaaaccagatctggcaagatcccccgatcagctttatctgccattgtcaatggcaagccatacaagataacttctacaattgaagaccccagcatttttggccacgtagaagaaatgctgaagcaagcataatgagtttgtcttattcctattttgagttgatttaatttcttaattgaaattaaattatttgagttgtttctcagaaataaatatttcagtagaaattacttgcaaaatgaaatgtgaattgtaaaacttggcctaaacaaatctaatgaaaacatgtgaaagacctgtgccttttttttggtttgaccctgttagcattgttattagttatctataacatggcttattgaatgtcatctactgctttaggaaaaacgtatctagtgtattatttttaaaattgtacctcccaagaagaacactttaattgaaagcaacactaatatagagccacttcctgaaaccaagaatctgtagttttgatccaaaatctaaaacttaaagtcagaaaataattaaaatttttcttgtagaaattttagatattttctagtattctttagatgctcacattgttttaaataaaatagatgaaatgggaagtttaggtaatcatctagacagatgaaattattatctaggtaggagggcttttctatacattttctgagggaaagcagaacaccggggttatagctataccttcaggtcttttgacttaggcaaggaaaaccacatgtctgacctggttcagcatgtaatccgagcactttgggaggctgaggcaggcggatcacttgaggtcagcagtttgagacgagcctggccaacatggtgaaaccctgtagctactgaaaatacaaaaataagccaggcgtggtggcgggaggctgaggcaaggagaatcacttgaatacaagaggcagaggttgcagtgagccaagttcccccactgtactccagcctgggtgacagagtaagactccatctcaaaacaacaaaaacaacaaaaaaaccacatgcctggcggagaacaaagagatcatttagtccaatctcttcatggagatgagggctcctgggagcccctcttcatgtctcaggttcttagttgactatgtttatccaaatgattccagattcctgtggaaacaaggaatcgatgtacaaatggggtagggtggcaaggaaaactcttaagagagaaacatcaaggttttcacattaggttaaagacaagaaggtttctaggcaggtagtgtaatgtctaggtgattttgaagtgaacttaagccactaggtttgagggacaaaggacagtagaaaatggtgaagactgcagatcacctgctatacctcaaggagcagcggacccagcagaatatggcccaaaaaggaggcaggtctcctgttgcaagagcctctgtttttttaaagagaaaacaaagaatcctggtttttatgtgaaatctctaattttaaaataataactcattaaaaatattgtaatgtccaaaagtatctttccatttaacttctaaaaatctcttaaatgttttttttaaataattgtaaagtgagtttttgttaagcttataggaatgggccagttaactaaggtagacagatgtaggaaattaaatatttgatttacttagggatctatatgacatcagttatcaaagaatacattttaacccaaaagtataccatgctcattgtatctttgatcgttcttcaagtatttctcaatcttttaatctatcaggaacattactatcaagagcagattgttgtaacataatactcaggatacatgaaatgtatgtgagagataaatagataatagaaagtttattgttataaaaatgacctacaacttatataaaaaaattctgaaaatgttgactttttttggactgaaggctgcaaaataaatggcttctcaaagtaaattcctatttacttaaattgccttcttgattgttacacctggaaaaatatattcatctactttttccttttaattatgttagtagactgaattaaaccagctacatagacactctctc

SEQ ID NO: 109981 - DNA, 1970 bp, Homo sapiens
  misc_feature (4)..(7): n is a, c, g, or t
ggannnnggcccccgccccctactcccttccctcaggccccaggaagttgcaagagtaccatttgtcgcacactcggggaccgcgggtggccggaggagatgaaaccgtcttggctgcagtgtcgtaaagtcaccagcgccggggggctcggagggcccttgcctgggtcctctccggcccggggagccggtgcggccctcagggctttagtggtcccgggcccgcggggcggtctcgggggccggggatgcagggcactgtcctccggcagtggcagcgagtacaagacccacttcgcagcctcggtgaccgaccccgagaggttctggggcaaagctgccgagcagatcagctggtacaagccctggaccaaaacgctggagaacaaacactcgccctctaccaggtggtttgtggaaggaatgcttaacatttgttacaatgccgttgatcgtcatattgaaaatggtaaaggggataagattgctatcatctatgacagtcctgttacaaacactaaagcaacctttacctataaagaagttctggagcaggtctccaagctggctggtgtcttggtcaagcatggcatcaagaaaggtgacactgtggttatctacatgcctatgatcccacaggcgatgtataccatgttggcatgtgcaaggataggtgccatccacagtctcatatttggaggatttgcttccaaagaactaagtagtcgcattgatcatgtaaagcccaaggtggttgttacagcatcatttggcattgaacctggaaggagggtagagtacgtaccacttgtagaagaagcgctaaaaataggacaacacaaaccagacaaaattctcatttataatcgtccaaatatggaggcggttcctttggctcccggtcgtgaccttgattgggatgaagagatggcaaaagcccagtcacatgactgtgttcctgttctttcagaacacccactgtatattctttacacatctggcacaacggggttacctaagggtgtgattaggcccactgggggatacgctgtcatgctacactggtcaatgtcttccatatacggacttcaacccggagaggtgtggtgggcagcttctgacttaggctgggttgttggacattcctatatctgctatggacctcttcttcatgggaacacaacagttttatatgaggggaagcctgtgggaacaccagatgctggcgcttatttccgtgtgcttgcagagcatggagtagctgccttgtttacagcaccaactgcaattagagcaatccgtcaacaggaccctggggcagctttggggaagcagtactctctgacaaggttcaaaacattatttgtggctggagaacgatgtgatgtagagaccctggaatggtccaaaaatgtcttcagagtacctgtcttagaccattggtggcaaactgagactggatctccaattactgcgtcatgtgttggattaggcaattctaaaacacctccaccagggcaagcaggaaaaagcgtcccaggatacaatgttatgattttggatgacaacatgcaaaaactgaaggctcggtgtttaggaaatattgtggtaaagttaccattgccacctggggctttttcaggactctggaagaatcaggaagcattcaagcatttatactttgaaaaatttcctggatattatgataccatggatgctggttacatggatgaagaaggctatttgtatgttatgtctcgagtggatgatgtaataaatgttgcaggtcacagaatttctgcaggcgccattgaagagtcaatcctttcccatggtaccgtggcagactgtgctgttgttggcaaggaagatcccttaaaaggtcatgtccccttagcactctgtgtattgagaaaagatataatgcacacagagcgtttggagtgtgcgtagacgatccccatcacttt

SEQ ID NO: 109982 - DNA, 1275 bp, Homo sapiens
  misc_feature (4)..(7): n is a, c, g, or t
ggannnnggcccccgccccctactcccttccctcaggccccaggaagttgcaagagtaccatttgtcgcacactcggggaccgcgggtggccggaggagatgaaaccgtcttggctgcagtgtcgtaaagtcaccagcgccggggggctcggagggcccttgcctgggtcctctccggcccggggagccggtgcggccctcagggctttagtggtcccgggcccgcggggcggtctcgggggccggggatgcagggcactgtcctccggcagtggcagcgagtacaagacccacttcgcagcctcggtgaccgaccccgagaggttctggggcaaagctgccgagcagatcagctggtacaagccctggaccaaaacgctggagaacaaacactcgccctctaccaggtggtttgtggaaggaatgcttaacatttgttacaatgccgttgatcgtcatattgaaaatggtaaaggggataagattgctatcatctatgacagtcctgttacaaacactaaagcaacctttacctataaagaagttctggagcaggtctccaagctggctggtgtcttggtcaagcatggcatcaagaaaggtgacactgtggttatctacatgcctatgatcccacaggcgatgtataccatgttggcatgtgcaaggataggtgccatccacagtctcatatttggaggatttgcttccaaagaactaagtagtcgcattgatcatgtaaagcccaaggtggttgttacagcatcatttggcattgaacctggaaggagggtagagtacgtaccacttgtagaagaagcgctaaaaataggacaacacaaaccagacaaaattctcatttataatcgtccaaatatggaggcggttcctttggctcccggtcgtgaccttgattgggatgaagagatggcaaaagcccagtcacatgactgtgttcctgttctttcagaacacccactgtatattctttacacatctggcacaacggggttacctaaggtactcactctcttagagataactatctatagcagtagatttactttgcaccaagaatgtttgatcactgactggaaatgtttgcagactttactttgaagtttagagagttacttcatttgcttttatttttttttcctgtgcccagtctggagtgcagtggcgtgatctcacctgacacagttactccatatcttaaagagattttgtgtttagtgctaaatataaaaacatttattatttaacatcaaatat

SEQ ID NO: 109983 - DNA, 829 bp, Homo sapiens
gacctctttatcttctcttctttgtttcttatatctggtaagttactaagtctcagattttcctttgaagtgtctgttgggttcattccaccttcagtattccccttgcctttgagctctggcagctgcattatcctctgtcctgatttaaagtttcctaatcactcatctctattctctctgctttttgatacacactgcacactgctcccagagtccttttatgaaggcttgttcctctcataggactctctggccaccttcttgtgttctataatatctaatatattctgcctagcattaaaggcagagaaatttatttttcttcaaaacaattgtcattacatatgtaatttgttcatttaatttattttgtttattccctatagtcctccctctaagtgttccctgggaaacaaattttcatattaaatggatcaactataaactttggaataagcagacaaccaccacaacaataactctatctgctgcttcttttgagggatggctatatatatgagaatgggtacattgtctagaagccatttacctcctcacaaagtacagagattttaaaaaatttgactcactgaaagcagctatgagccatgggagccctacaacctttatatgtacatattttattttagtcccacttagttcaatgaattagatcaacctttttatatacatattttcagtattctcaccttctctgcatctggggcagaatatcaaatttgggttaaaaattagtgagattactttgcaaaaaattagctctgattgtaaaaatgattttcatgtaaaagattaactgaatgac

SEQ ID NO: 109984 - DNA, 509 bp, Homo sapiens
cattctttctacagaaatatatagaagactcttaagaggaactccaactctagagaaaataccatctaggtccaatagttttgctaactgaactgtttatttttttactctggaaagctacagatgagtattaatatattaggttcaaagttccctatttttaaactttccatatgaatattacaagacaatggggaaaacaacattgcatataattgtttaattatagaaagagtagaagaaattcaaggaagagtattcacctgaccctaattttttttccagataacttctacaattgaagaccccagcatttttggccacgtagaagaaatgctgaagcaagcataatgagtttgtcttattcctattttgagttgatttaatttcttaattgaaattaaattatttgagttgtttctcagaaataaatatttcagtagaaattacttgcaaaatgaaatgtgaattgtaaaacttggcctaaacaaatctaatgaaaacatgtg

SEQ ID NO: 109985 - DNA, 2323 bp, Homo sapiens
  misc_feature (4)..(7): n is a, c, g, or t
ggannnnggcccccgccccctactcccttccctcaggccccaggaagttgcaagagtaccatttgtcgcacactcggggaccgcgggtggccggaggagatgaaaccgtcttggctgcagtgtcgtaaagtcaccagcgccggggggctcggagggcccttgcctgggtcctctccggcccggggagccggtgcggccctcagggctttagtggtcccgggcccgcggggcggtctcgggggccggggatgcagggcactgtcctccggcagtggcagcgagtacaagacccacttcgcagcctcggtgaccgaccccgagaggttctggggcaaagctgccgagcagatcagctggtacaagccctggaccaaaacgctggagaacaaacactcgccctctaccaggtggtttgtggaaggaatgcttaacatttgttacaatgccgttgatcgtcatattgaaaatggtaaaggggataagattgctatcatctatgacagtcctgttacaaacactaaagcaacctttacctataaagaagttctggagcaggtctccaagctggctggtgtcttggtcaagcatggcatcaagaaaggtgacactgtggttatctacatgcctatgatcccacaggcgatgtataccatgttggcatgtgcaaggataggtgccatccacagtctcatatttggaggatttgcttccaaagaactaagtagtcgcattgatcatgtaaagcccaaggtggttgttacagcatcatttggcattgaacctggaaggagggtagagtacgtaccacttgtagaagaagcgctaaaaataggacaacacaaaccagacaaaattctcatttataatcgtccaaatatggaggcggttcctttggctcccggtcgtgaccttgattgggatgaagagatggcaaaagcccagtcacatgactgtgttcctgttctttcagaacacccactgtatattctttacacatctggcacaacggggttacctaagggtgtgattaggcccactgggggatacgctgtcatgctacactggtcaatgtcttccatatacggacttcaacccggagaggtgtggtgggcagcttctgacttaggctgggttgttggacattcctatatctgctatggacctcttcttcatgggaacacaacagttttatatgaggggaagcctgtgggaacaccagatgctggcgcttatttccgtgtgcttgcagagcatggagtagctgccttgtttacagcaccaactgcaattagagcaatccgtcaacaggaccctggggcagctttggggaagcagtactctctgacaaggttcaaaacattatttgtggctggagaacgatgtgatgtagagaccctggaatggtccaaaaatgtcttcagagtacctgtcttagaccattggtggcaaactgagactggatctccaattactgcgtcatgtgttggattaggcaattctaaaacacctccaccagggcaagcaggaaaaagcgtcccaggatacaatgttatgattttggatgacaacatgcaaaaactgaaggctcggtgtttaggaaatattgtggtaaagttaccattgccacctggggctttttcaggactctggaagaatcaggaagcattcaagcatttatactttgaaaaatttcctggatattatgataccatggatgctggttacatggatgaagaaggctatttgtatgttatgtctcgagtggatgatgtaataaatgttgcaggtcacagaatttctgcaggcgccattgaagagtcaatcctttcccatggtaccgtggcagactgtgctgttgttggcaaggaagatcccttaaaaggtcatgtccccttagcactctgtgtattgagaaaagatataaatgcaacagaggagcaagttttggaagaaattgtgaaacacgttagacagaacattggccctgtggctgcttttcgaaatgcagtgtttgtcaaacagctacccaaaaccagatctggcaagatcccccgatcagctttatctgccattgtcaatggcaagccatacaagataacttctacaattgaagaccccagcatttttggccacgtagaagaaatgctgaagcaagcataatgagtttgtcttattcctattttgagttgatttaatttcttaattgaaattaaattatttgagttgtttctcagaaataaatatttcagtagaaattacttgcaaaatgaaatgtgaattgtaaaacttggcctaaacaaatctaatgaaaacatgtgaaaga

SEQ ID NO: 109986 - DNA, 4164 bp, Homo sapiens
  misc_feature (4)..(7): n is a, c, g, or t
ggannnnggcccccgccccctactcccttccctcaggccccaggaagttgcaagagtaccatttgtcgcacactcggggaccgcgggtggccggaggagatgaaaccgtcttggctgcagtgtcgtaaagtcaccagcgccggggggctcggagggcccttgcctgggtcctctccggcccggggagccggtgcggccctcagggctttagtggtcccgggcccgcggggcggtctcgggggccggggatgcagggcactgtcctccggcagtggcagcgagtacaagacccacttcgcagcctcggtgaccgaccccgagaggttctggggcaaagctgccgagcagatcagctggtacaagccctggaccaaaacgctggagaacaaacactcgccctctaccaggtggtttgtggaaggaatgcttaacatttgttacaatgccgttgatcgtcatattgaaaatggtaaaggggataagattgctatcatctatgacagtcctgttacaaacactaaagcaacctttacctataaagaagttctggagcaggtctccaagctggctggtgtcttggtcaagcatggcatcaagaaaggtgacactgtggttatctacatgcctatgatcccacaggcgatgtataccatgttggcatgtgcaaggataggtgccatccacagtctcatatttggaggatttgcttccaaagaactaagtagtcgcattgatcatgtaaagcccaaggtggttgttacagcatcatttggcattgaacctggaaggagggtagagtacgtaccacttgtagaagaagcgctaaaaataggacaacacaaaccagacaaaattctcatttataatcgtccaaatatggaggcggttcctttggctcccggtcgtgaccttgattgggatgaagagatggcaaaagcccagtcacatgactgtgttcctgttctttcagaacacccactgtatattctttacacatctggcacaacggggttacctaagggtgtgattaggcccactgggggatacgctgtcatgctacactggtcaatgtcttccatatacggacttcaacccggagaggtgtggtgggcagcttctgacttaggctgggttgttggacattcctatatctgctatggacctcttcttcatgggaacacaacagttttatatgaggggaagcctgtgggaacaccagatgctggcgcttatttccgtgtgcttgcagagcatggagtagctgccttgtttacagcaccaactgcaattagagcaatccgtcaacaggaccctggggcagctttggggaagcagtactctctgacaaggttcaaaacattatttgtggctggagaacgatgtgatgtagagaccctggaatggtccaaaaatgtcttcagagtacctgtcttagaccattggtggcaaactggtataaagcactaaagacctctttatcttctcttctttgtttcttatatctgagactggatctccaattactgcgtcatgtgttggattaggcaattctaaaacacctccaccagggcaagcaggaaaaagcgtcccaggatacaatgttatgattttggatgacaacatgcaaaaactgaaggctcggtgtttaggaaatattgtggtaaagttaccattgccacctggggctttttcaggactctggaagaatcaggaagcattcaagcatttatactttgaaaaatttcctggatattatgataccatggatgctggttacatggatgaagaaggctatttgtatgttatgtctcgagtggatgatgtaataaatgttgcaggtcacagaatttctgcaggcgccattgaagagtcaatcctttcccatggtaccgtggcagactgtgctgttgttggcaaggaagatcccttaaaaggtcatgtccccttagcactctgtgtattgagaaaagatataaatgcaacagaggagcaagttttggaagaaattgtgaaacacgttagacagaacattggccctgtggctgcttttcgaaatgcagtgtttgtcaaacagctacccaaaaccagatctggcaagatcccccgatcagctttatctgccattgtcaatggcaagccatacaagataacttctacaattgaagaccccagcatttttggccacgtagaagaaatgctgaagcaagcataatgagtttgtcttattcctattttgagttgatttaatttcttaattgaaattaaattatttgagttgtttctcagaaataaatatttcagtagaaattacttgcaaaatgaaatgtgaattgtaaaacttggcctaaacaaatctaatgaaaacatgtgaaagacctgtgccttttttttggtttgaccctgttagcattgttattagttatctataacatggcttattgaatgtcatctactgctttaggaaaaacgtatctagtgtattatttttaaaattgtacctcccaagaagaacactttaattgaaagcaacactaatatagagccacttcctgaaaccaagaatctgtagttttgatccaaaatctaaaacttaaagtcagaaaataattaaaatttttcttgtagaaattttagatattttctagtattctttagatgctcacattgttttaaataaaatagatgaaatgggaagtttaggtaatcatctagacagatgaaattattatctaggtaggagggcttttctatacattttctgagggaaagcagaacaccggggttatagctataccttcaggtcttttgacttaggcaaggaaaaccacatgtctgacctggttcagcatgtaatccgagcactttgggaggctgaggcaggcggatcacttgaggtcagcagtttgagacgagcctggccaacatggtgaaaccctgtagctactgaaaatacaaaaataagccaggcgtggtggcgggaggctgaggcaaggagaatcacttgaatacaagaggcagaggttgcagtgagccaagttcccccactgtactccagcctgggtgacagagtaagactccatctcaaaacaacaaaaacaacaaaaaaaccacatgcctggcggagaacaaagagatcatttagtccaatctcttcatggagatgagggctcctgggagcccctcttcatgtctcaggttcttagttgactatgtttatccaaatgattccagattcctgtggaaacaaggaatcgatgtacaaatggggtagggtggcaaggaaaactcttaagagagaaacatcaaggttttcacattaggttaaagacaagaaggtttctaggcaggtagtgtaatgtctaggtgattttgaagtgaacttaagccactaggtttgagggacaaaggacagtagaaaatggtgaagactgcagatcacctgctatacctcaaggagcagcggacccagcagaatatggcccaaaaaggaggcaggtctcctgttgcaagagcctctgtttttttaaagagaaaacaaagaatcctggtttttatgtgaaatctctaattttaaaataataactcattaaaaatattgtaatgtccaaaagtatctttccatttaacttctaaaaatctcttaaatgttttttttaaataattgtaaagtgagtttttgttaagcttataggaatgggccagttaactaaggtagacagatgtaggaaattaaatatttgatttacttagggatctatatgacatcagttatcaaagaatacattttaacccaaaagtataccatgctcattgtatctttgatcgttcttcaagtatttctcaatcttttaatctatcaggaacattactatcaagagcagattgttgtaacataatactcaggatacatgaaatgtatgtgagagataaatagataatagaaagtttattgttataaaaatgacctacaacttatataaaaaaattctgaaaatgttgactttttttggactgaaggctgcaaaataaatggcttctcaaagtaaattcctatttacttaaattgccttcttgattgttacacctggaaaaatatattcatctactttttccttttaattatgttagtagactgaattaaaccagctacatagacactctctc

SEQ ID NO: 109987 - DNA, 1870 bp, Homo sapiens
  misc_feature (4)..(7): n is a, c, g, or t
ggannnnggcccccgccccctactcccttccctcaggccccaggaagttgcaagagtaccatttgtcgcacactcggggaccgcgggtggccggaggagatgaaaccgtcttggctgcagtgtcgtaaagtcaccagcgccggggggctcggagggcccttgcctgggtcctctccggcccggggagccggtgcggccctcagggctttagtggtcccgggcccgcggggcggtctcgggggccggggatgcagggcactgtcctccggcagtggcagcgagtacaagacccacttcgcagcctcggtgaccgaccccgagaggttctggggcaaagctgccgagcagatcagctggtacaagccctggaccaaaacgctggagaacaaacactcgccctctaccaggtggtttgtggaaggaatgcttaacatttgttacaatgccgttgatcgtcatattgaaaatggtaaaggggataagattgctatcatctatgacagtcctgttacaaacactaaagcaacctttacctataaagaagttctggagcaggtctccaagctggctggtgtcttggtcaagcatggcatcaagaaaggtgacactgtggttatctacatgcctatgatcccacaggcgatgtataccatgttggcatgtgcaaggataggtgccatccacagtctcatatttggaggatttgcttccaaagaactaagtagtcgcattgatcatgtaaagcccaaggtggttgttacagcatcatttggcattgaacctggaaggagggtagagtacgtaccacttgtagaagaagcgctaaaaataggacaacacaaaccagacaaaattctcatttataatcgtccaaatatggaggcggttcctttggctcccggtcgtgaccttgattgggatgaagagatggcaaaagcccagtcacatgactgtgttcctgttctttcagaacacccactgtatattctttacacatctggcacaacggggttacctaagggtgtgattaggcccactgggggatacgctgtcatgctacactggtcaatgtcttccatatacggacttcaacccggagaggtgtggtgggcagcttctgacttaggctgggttgttggacattcctatatctgctatggacctcttcttcatgggaacacaacagttttatatgaggggaagcctgtgggaacaccagatgctggcgcttatttccgtgtgcttgcagagcatggagtagctgccttgtttacagcaccaactgcaattagagcaatccgtcaacaggaccctggggcagctttggggaagcagtactctctgacaaggttcaaaacattatttgtggctggagaacgatgtgatgtagagaccctggaatggtccaaaaatgtcttcagagtacctgtcttagaccattggtggcaaactggtataaagcactaaagacctctttatcttctcttctttgtttcttatatctgagactggatctccaattactgcgtcatgtgttggattaggcaattctaaaacacctccaccagggcaagcaggaaaaagcgtcccaggatacaatgttatgattttggatgacaacatgcaaaaactgaaggctcggtgtttaggaaatattgtggtaaagttaccattgccacctggggctttttcaggactctggaagaatcaggaagcattcaagcatttatactttgaaaaatttcctggatattatgataccatggatgctggttacatggatgaagaaggctaatttttaatttaaacagctcgagatatgagttctgcaaaatggtggtccgcatccttggccctctggatatactca

SEQ ID NO: 109988 - DNA, 423 bp, Homo sapiens
cccccagcacttttaagttccattgtcttctggtcttcattgtttctaatgagagctcagccattatttgtattgttcctttgtatgttttttgttgttgctttcaagattttatctttatcgtagatctttagaagtttgattatgataggccgggtgtggtgcctcatgcctgtaacccagcactttgggaggccgaggtgggcagatcaccaggtcaggagatcgagaccatcctggataacacggtgaaaccccgtctctactgaaaatacaaaaagttagccgggcatggtggcaggcgcctgtagtcccagctactcaggaggctgaggcaggagaatggcatgaacccaggaggtggagcttgcagtgagccgagattgcaccactgcattccagcctgggtgacagagcgagaca

SEQ ID NO: 109989 - DNA, 697 bp, Homo sapiens
ggccagatttttcttgaaaaccagatttttaaggcaaatatgtttagttaaaactaggaattgattgatgtttaaaattttaaaataccctggactgggaatcagtaagcctggaatctcgttttgactctcccaataaattagtagtgtgacatgttaactagccatttagcctctctcgatcttattttccatgtatgttaaatgaagcaatctttaagaacccctttagctgtgaaactatcattctgtgattctattcagatgattaaagtgtactggatgatagaagcaatgtctattcatagctccatgtatgttttctctttggccattggcttattcagaatttttcttggggtaagtttaaaggtttttattgacactggattggcaaaagtaatgtctaacaataaacactgtaatataggtgctgacatttggtaggcttttaaaattgtatatagcagctgaattttggacaattaaaaatctgtttctcttttgtacaaagtatttcaattctcagatacacatctttttacattttaacttctccgaaatcaatatattatttataatagatagtgtattagagtttaattgacagcgtttgttctttcttagtagttcataaaataatagtaactcttacaattaagaccattggattagaggaaatttagtaactttaata

SEQ ID NO: 109990 - DNA, 563 bp, Homo sapiens
aaactttcatgctaaatatggagtatcatgtccgccctgttaccaaaatgaaaactttggccgtaccttcggcagttaattaaggtgctcctacttccatctcagagctgagctgaggggaggcagggcacaccaggcctgtcatgtgcagttctcagccagagccagtgagttccccacagaagcaggcagcgttttcattcacgcctgccttgcctgcttctcgtttcttgctagatgaatggcatcatatgccgcaggtgtattagtaatttctgagtttgttccccactaaaaatgacctcattgttttgtgcttcttttccataattatacagtaacaggaaaataaaccagctctgagtacagcccacagcagaaatcttgtgctctttatgcaagtttgatttatagacgtgtactgcagagcagagtgactatgaaacattcatcttcccattgctagttgccatggaaatcgagtacacagagcagtgtcattccagtcctggtgatgcctgcagtagtttattcctttgttgttcccgtttcttaagcaactg

SEQ ID NO: 109991 - DNA, 161 bp, Homo sapiens
cactccagcctgggcaagagagcaagaccttgtctctgaatgaatgaatgagtgcttaagtgtctgtttttcatttaacactttgtgacagtttaagttgacaattcctttagtgttagtgacatttaaatgtttttagacattaaatgtttgttatatgc

SEQ ID NO: 109992 - DNA, 519 bp, Homo sapiens
aggagatgaagaagatttagcctcacacaaacatataaatggaaaagaggagtattttaatagccttttaagataattgtggatattcctttatgattgagaaaatcaacaagtaatttcttaaaggttggtagattttgaaactgtatcgatgacttttgtactccattgcattacaattcattggtctctcttatgcattggttgttttgaaaatagtgattcactaagttatgcagatcttgcaaatgctaacacattcattataccatatcaaataatcactttcattacacttatactgatttaatcataaaattcttgtgtgtgtgtgtgtgtgtgtgtgtgtgtgtgtgtgtgtgacagagtttcgttcttgttgcccaggctggagtgcacaatctcagctcactgcaacctctgcctccgggttcaagcgattctcctgcctcagtctcccgagtagctgggattacaggcatgcgccaccattcctggctaattttgtatttttattaa

SEQ ID NO: 109993 - DNA, 294 bp, Homo sapiens
gggttaccgtcttagccggtctacaggaaacacattccattgcctgcattctgctgtgttcatattgatctcagtaggatatgtgtaggttctattaccaagcaaaagaaaaaacatacagcataaagtgagctgtgtctgtggagcaaattttaaagggtatgttatggatgacttctgatgaaaggtgttttagttgtgccattattttgatcctcagccaaacaacatcagcccatgtgtcaagagaagaaaggattgtctgagggaatagtcccagagggtaacaccgaa

SEQ ID NO: 109994 - DNA, 247 bp, Homo sapiens
ccacgtttacagaagaatccaatttgagacttactctaatacagactgttttttaaggtttgaagaagacattagggagtggagaaacagaacaagatcttactttttattctagagacacagaataacaaagccttcttaacaaaagaaacttcagagaactttttttttttttttttttttgcctaaaaaataaaaagaagaaaaacaaagccataacttttattttggcaagtattttttgaat

SEQ ID NO: 109995 - DNA, 640 bp, Homo sapiens
ctcttctccattcttcctctgctccttgacgagagatctgtagacttccttgagtgcagcatctcagacatctggtattgactagaattccttattggacttccttgggtgtagcatctcagacatctagtataggctagaattccttagtagtagtatcagtgtccaggccttcctattttgtaaatgatagaggtttgtaaaaggagtatggcctttggaatgtactgttcataatcttaagtagttatggaagcatagtgaaaaggtcagggcagttctcattttgcatcaggaagcttttgacaaagtcctgttagttatcagatgatgatagccagcagtaaccattaagacagtcttttttttttttttaagtagaaatccagttaaggaagcatagcttgtcttttattaaagaggcactcagcaaaggggtgatgagacagaatgctgttattactgatgcttttgttttacattttcagtaattaacgtgctttgctcagtagtgacacattacctgaacttcaaaggatccccttagtacatcggtattgcagaggcattaaagcaatgagagcctgccaggatcttaatcacctctgtcctacatttggtcagagcctctccactttta

SEQ ID NO: 109996 - DNA, 440 bp, Homo sapiens
ggacagacaagacacaacgcacacaatcaccaatgtcaggattggggacggttgctatggaggacagacaagacacaacacacacaatcactgatgtcaggattggggatggttgctacagacaaagaagagatgaagagggtgcaggcttgggggcaggttcagtgacagcagagtggagtgtggatcattgcaatgacgagagagcctcttttggccactctgttgacctcgaacatccccccaagcagactacacactgtcaatgtgttcaaaaacagagatgacggctgttgcatggaacagacatacacagcctcagcgaccccccgggggcccctcgaaatgtgtttgtcaggctgcctccacgcagcccacaggcatggagcaaacacacgctccagcgaataggacaagcacgctgaagggaaaagggggtt

SEQ ID NO: 109997 - DNA, 321 bp, Homo sapiens
atttcacttccagggtcgtcgctgcactcctgcattgttctgattgtgtcgttatatcaccaggtcgtgactggcacacacccagccacttctcagttgcttctgctgcccacccccacctggaggggaggggtatccacgagggagctgcccacccctgactggaggggaggagtatccacgagggagctgcccatccctgcctggaggggaggagtatccatgagggagctgcccatccctgcctggaggggaggagtatccacgagggagctgctcctgagacggaaacagctgaagcacacacagtaaggatgagga

SEQ ID NO: 109998 - DNA, 801 bp, Homo sapiens
ttctaggccgagggaacagtgtagaaaaaaaagcatgaaggtgtgaaagagcccaaggttttctcagaatgatgaggatctttgtgtggctgaagctgagagatgttctgggttgaggggtgacaggtgggtggggctagctgagggaccacaaatgtaagaaaggtgtgcagacagacccaggatggtggggatgggatctagatccgaatcactggatggcaagcatgaatgggggatgccccaccagggtggagcaccaaggccagccaaaaagtggggaagggcttaggcagggacacctcagggcagcgtgatgtgggctaaggcaggctcttcccatgacccacaccattggtccacccagccccatgcagctccccagtgacaaatcatttggtggccagattgaatgacgtgagcaggatttggggcttatcttgtctcaccagagctagctccatgagcagggcaagcagtcctctccacaccaccaccctaagatttctggaggcaccgaatcagggccagcggagtccagggagagtggggtagtgacaggagctgcacaagatagggcagtgccaccgcccctccccaaggctggaggtgtgcctggggaagagcagaacaccagcttgagcccaggcaatctctagtctgagggaggagacccagctttgggctgggtaaatcccaaatcagagacgggaggtatggctctggtttcaagcatctaaggaggactggagccctccccttgggcagcccccagtctgcagggtcatgggggtgggaagc

SEQ ID NO: 109999 - DNA, 578 bp, Homo sapiens
caatgcagtgtttgctgttgctgtttggatggcatcagagcgatctctgtcttactacaatttttctcaggctgggtttgtccctgttgctcacgctgcagtgagcaacactgcacatctgccacacagcacagcagtgtcagctctcccaggtctgtccaaggttgtcttaaagtctttgctcagatttaggatgaccagctgccctggtttgcccaagtctgtcctggttttagcacaaaatgtccctagtcctgggaaacacctcaatcccaggcaagccaggacaatcgcttgccctatttggagtcttctgtgaacacgcttccctccctggcatcaggggggaaagccagcagtatctttcctgatgagtaattaaacatctgataagaaaggcctgcaggctgacttaaggttaggcccaagtgtgctaacgcaggaaagggtttttagctgttttgacacagcttgagttaatgggatgtaactggaaacaaaatgatttctcagcttgctgcttcagttaaatcctgtgcttctagaagttaattaacaaatagttcattgcctgcctg

SEQ ID NO: 110000 - DNA, 502 bp, Homo sapiens
ggtttcgtcatgtagcccaggctggtcttgaactcctgagctcaagcaatccactcaccttagcctcccaaagtgctgggattacagacaagagccactgtgcctggctgtttccccccatctttcaataataataataataataataataataataataataatagagagagagaggtattcgaagatttaaaattaatgaaacaaaaattaatgaaacaaaataaatttacagagaacaaaaaataaatttaaacgttgtaaaaatgaaaactcaatagatggattggaagagaaggttgaagacatctcccagaaagaaagaaaacagcatgtaaaataacaggtaaaacataggcaaattaaaaggccagtcctgaagaagttcctcaaagatagattagaaaaagcaattatttcatcaatgaaataatttaagatttctgaaaattgaaggatacatgtctgcagtgtgaaagggttcactgagtatccagcaatg

SEQ ID NO: 110001 - DNA, 335 bp, Homo sapiens
ggtaagcaatgaaaagccaggtggaatatgaagagcagattaggttagccgtgtgactgatcccaagctgtttgccgagtctctgtgtaaatttcatgcaggttgtctgattgaggacacctggaatgccgcgggcttggtggttatgaaagtcccactgtttcattccttagccccgctcaccagttatgtgcaagttgaaccgtaccatcaaccccattcccagcagctcctgtgcatgtcggaggcaggggatccttgtgtcaggcaccagcagatgcacctactttttccctaggagatgaaaaaaggaagaatgtgagtccgtgccttca

SEQ ID NO: 110002 - DNA, 428 bp, Homo sapiens
gcttgactcctcaccttccactgcaccctccagctccatctagaccctttccctcagcatggcagcttcacccacacatgtttatttaaagcacaggcaaagaatgccagtggtaaggccagagggcgggcagctcagcacggcagaccacagatcccttctcagcccaggaaatggctctgtggcccatatcagccaggaaaatgaagggtcacagacgccctgctgggagctaaagagaaatgtgtgcaaatctaaggagaaatgtgcaaggctcgtgccttccctgtggtgtgtgcctgctctttaatgagagttgcattctcctgagggagaccctgcgcaggccctgccccacgtaacggctttacacaaactctaaaaagtcatcccagccatgcatggacccagggatgctgacaccattc

SEQ ID NO: 110003 - DNA, 407 bp, Homo sapiens
gagtgttaatattctatattgattcatgattagcatatattataaataaaataatttctgactatggctaagagaacttttaatttttcacatggacctaagcatttcaatttataatagcagtgtagaataattcttgtgtatttgacttctgaaatgagggagaggaaaaatacaggcaatgcatattttaagcataatgaacagtattgtttctttcagagctccttgcaagaaacaaactctattctaggatttttaggcagaaagatatcttatggtaggcaatttggtacttacaaaatcattgcatggtctggaagagctggaatcagagggttatcactagattaatatattcaagaacataagcccatagctgtgactgagaggtcaggaaacaaact

SEQ ID NO: 110004 - DNA, 339 bp, Homo sapiens
aaaaagatcaatgtatggaccaaaggcaaattatacaggcacaccttcccaggtgtgctatcctcccacctctgtttttagtcatagaatctgaatggaagcagccactgccctcatcctgatccccaaaccacgtgagagttcaaacgttgtgcacaagacccagtccagccagtaagaatccttaccaagaacttttattaaaacattgccatcggccgggcgcggtggctcacgcctgtaatcccagcactttgggaggccgaggcgggcagatcacgaggtcaggagatggagaccatcctggctaacacggtgaaaccccgtctctactaaaaa

SEQ ID NO: 110005 - DNA, 460 bp, Homo sapiens
tgggcaggggagaggtgtggagaggccagaccagggatggggcagagctgtggagtccagggagctgatgatcccccgatcgtgaggttggaggagggttgggagtgattccaagtcagcaggtcgggtgatgagcagctgctccattaaatgtctacctgtggagcgaccccatgaggactgaggactgtgcttcctttaaagacaaaaacacgggaccccgggggtgggggcagagaacaggccaaagtgccacaaaaccacactcgccttgcaatccaactctttgaatgccatgtacatacttgcctcttgggtttcatgttaacattagtccacttcagagtcagcactaagcaaaccgcttctccagggcccatgcctggatgcttgaactaaattgcccccaaggagccatctgggtctgattcaagttcccaccccatcctgtggtttcagc

SEQ ID NO: 110006 - DNA, 258 bp, Homo sapiens
cgttttcctcctcctaaaggatgatccttgaacctcggaagggaggttcattcttacatttacagaggaggaagctcagaaaggtgaagtcacttgcccaaagtcacacagctaagaagtggcagagcccaggccgggtgcggtggctctcacttgtaatcccagcacattgggaggccgaggtgggcagatcacgaggtcaggagatcgagaccatcctggctaacatggtgaaaccccatctctactaaaaataca

SEQ ID NO: 110007 - DNA, 441 bp, Homo sapiens
caaggcagttcttgatttccatatctggtttgttaacacatatattactctctttctctcttactggttcaaaaattgcaaatcttatgaccccctatgtcctggagtcaaaacaactctggatagaaagtgattatgcgaagtttattctaaaatcaaaagcgaaataagacctcctacgttttttgtttagttaaaaacaacttactgaatcccatttctgatgaggaatttgaaagtgcaaaatgccaacatcctgtgttgggatcaaaatttccaatttgcacaggaaaaatttgtatctaaaacactgaaaaataatttctcctccgcctaagaatacccttccctttctcatagtgggcccctgctatttctgtagctatcacctccatctcctcctctccaaactttcctgtcttctgtttcattgcccagctt

SEQ ID NO: 110008 - DNA, 384 bp, Homo sapiens
acccatcccagctgacattctctgagtgctcacgacattccaggttctgtgccaagtgctggaagaacctcagctgaggccccttggccagccagcccaggctccaggagaaccccctgcaatgctaccttcagcacccatcccctgctatgccatctgccctaggcccagtccttcctcagtgggaacacagaatgatgctgtctgtcctccctcttctccctctcccttccttctggatgtttgctaatgagtaatgggtggcagtataacactttctttgctaattccactgtctaacattcaaagggctttttgtctgtggtgttacctttctgcccctccctgtatgcattttttatatttatttattcatttatttta

SEQ ID NO: 110009 - DNA, 259 bp, Homo sapiens
tgaccctgtcagccattgggagaacattttagtgacttgagagcctgtggattccaaagtaaaggaagaatcgacactgcaaagagctgagataaccctgggaacatcactcaggcatcaggctccaggcatggtccccttccttactccctatgctgtgttgagttggtggcactggctggaagttctcagagatctcctgggtaacagactgcattttaaaccacgcatattagcaggcaataaatgtagcacagtg

SEQ ID NO: 110010 - DNA, 405 bp, Homo sapiens
aaaaggtgtaccacatttgagaaataatgagaagttcttcataagtaaagtctatctccagtgaggggcaggatgatctctgtgtgtgagatgcctggtatttccagatgtagatttgtttgtttgttttgagacagggtctcaccctatcacccaggctggagtgcagtggtgccatctcggctcactgcagcctccacctcccaggttcaagcgattctccagcctgagcctcccaaatagctgggaccacaggtgcatgctaccacacccagctaatttttgtatttttttgtagagacggggattcaccatgtttcccaggctggtctcgagctcctgaactcaaagtgatccacctgccttggcctcccaaagtgcagggattacaggtgtgagccacca

SEQ ID NO: 110011 - DNA, 314 bp, Homo sapiens
actgtatttgcattaagaggttcaggctgaaatctgcttatgtgaatctgcagaaatcataagctggtgtgtctgtgaggcaccacagagctctctgggaaggccacagccacaggcccaggagcgaaggccacctgccttactttttgtccagtcacctttggggtctcaggttaacaagaggtgcccagatgtagacacacctccacacctaaaaggtggaccagcagagctctcctagaccgcagagctctcctagaccgggcctggggtccgcaggaggccactgtgctccagccacccagggaattttt

SEQ ID NO: 110012 - DNA, 317 bp, Homo sapiens
cttggaaatgtagacttgtgaatggggaacaattcaagcacgtttctgatatcatcttactaaattagtgcatctttataaaatatgatctggcagaattatttgatataggaaatagggttgatcttctgcaaacaaaaatataactaatgcaatcatctctatcagaggtttcaaaccaatactcatgagcaaaatcagcctggagacatgttttgagtttttttgacccatgctgtgtttcatatattttgaattaagtttcagtatttcaaaagtttgatttttcatattaaaaatcatatttctgtaacaac

SEQ ID NO: 110013 - DNA, 361 bp, Homo sapiens
gatgcttagatttgtcagatgaaaaatgttggaaagagagccaacaatgtttaaggctcctttttcctttagaaatggaaggtccagcccccttgaggcttgtgtgaggaacctaggagctggagaaggtgtgaaattgtcattgcagagaggggtcagaagaacactaagcttggggacatggtgagattactggagttgacaggcctgctgcgggggatgaagacactgatattacggtgctgtgacttttctcaggagatgttcagctgcttcagtgacaatacagagaagccagatggctgtgttcattccagagtgaaggatttgccttaaggccaggtgcggtggctcatgccta

SEQ ID NO: 110014 - DNA, 450 bp, Homo sapiens
ctgtgtctcaagtgatccacccaccgtggccctccccaaagtgctggggattacaggcaagatgctcaaaatcttttatcaattgttgaccccctttaaaatcccccacaatatatcttgacggtaaactaaaatggtatttagtttataatggaaagcattaataggatatgtagaatattagatttagaacccgggcgtatgaatcttagcataatgcttcctgggaaattctgaaattgattccatttctgccgttacaaacacacacgaagttcctagttcactgggacttcctgatttgttcttttagcttgctccttctcacctagaagctctgtttatttctgagcaaccctggggcttgtctcataggacaggatttatttatctcatcaaggctgagtgtgccttaggaagtcataaacataaaaagagaagaaaaaaaaa

SEQ ID NO: 110015 - DNA, 479 bp, Homo sapiens
acagacttgataatcaaattgcatgggtttaaattttggctttgctactccagctatatgattttagaaatacttactttagcatctttttgctattttggcatctacaaaataatggcagtagtggtactcacctcattctggggtaattctgagggttaaatgagataatgcccataagattgttagctattataacatatgctcgatagacaagtatttttaaaataaaaattccagtttggcatactgctacatagcatgccaaatgcaattttgaattttcaaaattttgaatttttgtaccttgtatatgtaaggtagttctgcttttgtgagaagattggccagatacattaggttgtttctgatagaaataggatgtgtgcatcacttagaaaattataaccacttgacgtgatttttcataaacttcattttacctgttagttgttgcctttagttaagttgttgcagtg

SEQ ID NO: 110016 - DNA, 317 bp, Homo sapiens
gttttttcctgcacatgtgaacacacacacacatacacacagagagagtaaatacatacacatagtaaatcaaatctgttcacatgcccacaaaaaacgcttttatagctttcaaatatacctaatcttgtttacattaacatttcttaatttgatctttctaacttgcagaacgttaagaacacaaatctgaacattaagtttatcttcagtgaacactattgcatatggtaattataatttccagataaaaagttgactgtcatttgccccaaacttatgaaacagtatgtatgattcaaaaagttttgctcagt

SEQ ID NO: 110017 - DNA, 256 bp, Homo sapiens
gaattggctcacatgattccaaggtgaagttccatgataagccttccgtaagctggggaatagagaagccaatagtggctcagtccaagtccaaaagcccccaaacaaaggaagctgacagtacacgctttagcctgcagccgagctcgagtccctgggaagccactggtgcacctccagagtctaaaggccgaagaatctggagtctgatgtccaagggcaggaggagcagaagcaagcatctggcgcagaaaga

SEQ ID NO: 110018 - DNA, 345 bp, Homo sapiens
ggaatttgaaatgaaaaaaatacaaacaacacaattttaatcacagcacccccaaaatgaagttcttacatcatttgttaaatctaacaaaatatgtcaggatttataggctgaaaactacaaaacattgatgaaataaatgaaaaaagatctggataaataggaaatactaggttcatgaatcaggagactcagtgaggtacaaatgctctccaatttcatctaatagattcaataacataccaaccaaaatttcagcaacgtcttcttgtagctattgccaaatttattcaaaaatttaagttaaaaagcaaagaaattagcgaaaacaatcatgaaaaataa

SEQ ID NO: 110019 - DNA, 235 bp, Homo sapiens
tgcttgatgctcagtgcgtcctctacagctggggtaacgacagctctgccactgctactgaatatgaagctgaacagaaacttcagaaatatacagaaatttagtgtatgccaacgggtagcatttttaaaacatgaaattcaataaactattggggcaactggttatttcacgtggaaaaattttaaagctcaatctctatgttcccaaacataaacaataatatcctccaata

SEQ ID NO: 110020 - DNA, 382 bp, Homo sapiens
agaggctttctttgcaatatatctgtaaagtaacactcccttccaccctgaaactgtccaattcagtgctttattatctttaaggcagtcgtgactatctgaattttttaaaaatctggctgtcccaactggagcctaataagttttgtgagaatagggatcttgcctgcatgttcagcaccacattcctggtgctttgaactgtgtctggcacatgataaatgttgattgaataaatatcaattgtgtgaatgcaattaattcattcatttaaaagggatcttatttatttattacacctcatacctccaaaaagtaagttgtggcaccttctgataaaaggcataaataggataaagccataaaaccatgttaaggctaa

SEQ ID NO: 110021 - DNA, 164 bp, Homo sapiens
tggtgaggactaataaggaagtgaggagcgtgatagagaaagcctgtattatcctagagaatacatatattgtcgtaaagaggatgttaatagaaagatgaatgttaaagctgatgctagtgcagacttagaaggaaatgagacatatgattttgtaaactccg

SEQ ID NO: 110022 - DNA, 1080 bp, Homo sapiens
atgtaatatggacccgaggacctcagcccacagctctgcctcctcaggttcttttcaaggcacctccaggattcagtatctccactccatagagggaagcagcatgatttagcacagcagttcccacaagtgtggtccgtggtcccttgcaggggtcgactcttccaaggaaacccatgaggtcaaaacaattttcataatactttgacaaatagtagagttttccaggggttacatgatgtgtgataccaccacacactgaatgcagaagcagagctgggaatccagctgttttctattaagccagacataaaagagatacgcaaaaataaaaaagaatgccactcttctaactggtttttgttttggaagatttttgtttaattacaatatgttatttatgttaggatgcaatgggtttataatattttaaaacacatgtattttaaattattttctctattttcagttcttggatggtaagtatcaataaatgtaattcacataaacaaaaagctctttaagatcctcaataatctttaagagtataaaggggtcacgagatcaaaaagtttgccaaccagtgatttagcataacgcctgacatatagtaaatgtgtggcaaatggacaaactgatggattaaagggttttaataactgctttcaaatgttcagagttcaataaatgaatatggccagtaaagatctttggataaccatcttcaggtcctccacacctgcttacacatgatttaaaagcaaatgatggtaagaagacaaaaccgtaggctgggtgtggaggctcacgcctgtaatcccagcactttgggaggccgaggtgggcagatcacctgaggtcaggagttcgagaccagcctagtcaacccagtgaaacccgtttctactaaaaaaaaaaacaaaaaaaaaatagctgggtgtggtggtgcatgcctgtagtcccagctaccgaggaggctgtggcacgagaatcacttgaacccaggaggcagaggctgcagtgagccaagatcatgccactgcactcgagcctgggcaacagagcaagactccatctcaa

SEQ ID NO: 110023 - DNA, 355 bp, Homo sapiens
catttaactagtctttcagaacttgaactatattaagtggtacttccactgttcagtgtctgtttttcttattacactgattttgcttcagaatcagtgagattatatagacgtcattcagaatatttgtttttatccttcaactcgaagagttttctcacctctttattttcaagttgaaaacattattataagagtatgttagcgggtcatttgactctgaaaaaaatagctttttaaaggttgatcacactttaatcttcaatttcaggatagtaaagaaccattataatttaggccccagtgactgtcataaaacagcttttaccagaccaccatcttaatactgatattt

SEQ ID NO: 110024 - DNA, 641 bp, Homo sapiens
ggaggtgaaggaactagttgaatttctaggagttctaattcttcaagatcttacaatcttaaagtggttaatatgaaaacatttacacttccgcttctggcaagcctaaataatttgcctgtgatttttaataaaaaccggatccttccctcatctctcatccaaagcttcatcctcttattaattctaaggacacttttttgaaatggaaaacagcacagaggtggagcagaaatacaggctgtgggctaattctcttaacagtcctcacccactaaaatgatctgtggaccaaggaagttttggtgtcatcacaccatgttcctgtgactataaatatgttgtctttttagtgttctgggcttgctatagagggatgtaaatgcattttcaagttttaatgttctaagttatttccaatcttttaccatgaatccagtttatttagttggggaatatttcttgagtgacatctattcaatgagcagtagcagatcttcagaatgccatcggagctcatggaaagaaatgatgggttcctttgcctggtaagcttttatgacttaatctggatttcttgttattttgacccatttctgcacatcttacttcatgcagctgggttttgtgaccgcacagtt

SEQ ID NO: 110025 - DNA, 177 bp, Homo sapiens
agtttcaaccttgtgagaagaatgcacccatcacaaagaagtttctcagaatgcttctgtgtagtttttacgtgaagttatttccttttccaccataggacacaaacggcttcaaatacccacttccagattctacgaaaagaaagtttcaaaactgctaaatgaaaacaggttcaa

SEQ ID NO: 110026 - DNA, 556 bp, Homo sapiens
tcactcaaaatggagtcactttgctcaaaagcctctgacagttttagatggagatgaggaaccttttgggaaatggagcaaaggttacttatgctgtgctttagcaaagatacaggcagcattttgcctctgccctacagatctgtggaactttgaacttgagagagatgatttagggtatctggtggaagaaatttctaagcagcaaagcatttaagaggtggcctggctgattctgaaagcattcagctatatgcactcacaaacacgtggttcaaacttggaacttaggctgggcgcagtggctcatgcctgtaatcccagcactttgggaggccaaggcaggtggatcacgaggtcaggagatcgagaccatcctggctaacatggtgaaacctgtctctactaaaattagccaggtgtggtggtgggcgcctgtagtcccagctactcaggaagctgaggcaggagaacggtgcgaacctgggaggcggagcttgccgtgagccgagattgcgccactgcactccagcctgggcgacagagccagactctg

SEQ ID NO: 110027 - DNA, 283 bp, Homo sapiens
actgtagactccctgttctaggcagaggatgccagctctccacctgaatctgttctccccttcttcctgggaacacacagatgttctacatttccagcatccttgcagttaggtgtgactgcatcctggccattatacatgagcagaagtgatgtggttactcctaggcctggcttccaggattccttctcttgctacccttctaagctcatttcccttttctggttgattgggatgggaccactttggaattcccatgtagaatatggtagaatccctgcag

SEQ ID NO: 110028 - DNA, 273 bp, Homo sapiens
taaatttatactgatttattgatcaaataaactagcattacttccactttatggttaaagattatgaaaaatataaatttgtatttggccaaattggttcattattctgattttcaacaaaagttttatgtcagtttgaagagaatttcagtgatctctatttttccttttcagcactgtgttgaatatgaatgttataagcagaaaaccttccctgtttcagatcttagagggagaggattcaatctcactaagtataatgtttgctgtagg

SEQ ID NO: 110029 - DNA, 4696 bp, Homo sapiens
atgctgaagcggaggcggccgctgctcgaggatcaaacagagcatactgaatcagcaggactggctggtggtgcagcagacatcatgagtaagcaccgagaagtctgttccttatcacgtgtgtaaggggaaaaaggtttaaacaagtctcttaagtggtgtttcctcaccgatggagaattacttccaagcagaagcttacaacctggacaaggtgttagatgaatttgaacaaaacgaagatgaaacagtttcttctactttattggatacaaagtggaataagattctagatcccccttctcaccggctgtcatttaaccctactttggccagtgtgaatgaatctgcagtttctaatgagtcacaaccacaactgaaagtcttctccctggctcattcagctcccctgaccacagaggaagaggatcactgtgctaatggacaggactgtaatctaaatccagagattgccacaatgtggattgatgaaaatgctgttgcagaagaccagttaattaagagaaactatagttgggatgatcaatgcagtgctgttgaagtgggagagaagaaatgtggaaacctggcttgtctgccagatgagaagaatgttcttgttgtagccgtcatgcataactgtgataaaaggacattacaaaacgatttacaggattgtaataattataatagtcaatcccttatggatgcttttagctgttcactggataatgaaaacagacaaactgatcaatttagttttagtataaatgagtccactgaaaaagatatgaattcagagaaacaaatggatccattgaatagaccgaaaacagaggggagatctgttaaccatctgtgtcctacttcatctgatagtctagccagtgtctgttccccttcacaattaaaggatgacggaagtataggtagagacccctccatgtctgcgattacaagtttaacggttgattcagtaatctcatcccagggaacagatggatgtcctgctgttaaaaagcaagagaactatataccagatgaggacctcactggcaaaatcagctctcctaggacagatctagggagtccaaattccttttcccacatgagtgaggggattttgatgaaaaaagagccagcagaggagagcaccactgaagaatccctccggtctggtttacctttgcttctcaaaccagacatgcctaatgggtctggaaggaataatgactgtgaacggtgttcagattgccttgtgcctaatgaagttagggctgatgaaaatgaaggttatgaacatgaagaaactcttggcactacagaattccttaatatgacagagcatttctctgaatctcaggacatgactaattggaagttgactaaactaaatgagatgaatgatagccaagtaaacgaagaaaaggaaaagtttctacagattagtcagcctgaggacactaatggtgatagtggaggacagtgtgttggattggcagatgcaggtctagatttaaaaggaacttgcattagtgaaagtgaagaatgtgatttctccactgttatagacacaccagcagcaaattatctatctaatggttgtgattcctatggaatgcaagacccaggtgtttcttttgttccaaagactttaccctccaaagaagattcagtaacagaagaaaaagaaatagaggaaagcaagtcagaatgctactcaaatatttatgaacagagaggaaatgaggccacagaagggagtggactacttttaaacagcactggtgacctaatgaagaaaaattatttacataatttctgtagtcaagttccatcagtgcttgggcaatcttcccccaaggtagtagcaagcctgccatctatcagtgttccttttggtggtgcaagacccaagcaaccttctaatcttaaacttcaaattccaaagccattatcagaccatttacaaaatgactttcctgcaaacagtggaaataatactaaaaataaaaatgatattcttgggaaagcaaaattaggggaaaactcagcaaccaatgtatgcagtccatctttgggaaacatctctaatgtcgatacaaatggggaacatttagaaagttatgaggctgagatctccactagaccatgccttgcattagctccagatagcccagataatgatctcagagctggtcagtttggaatttctgccagaaagccattcaccactctgggtgaggtggctccagtatgggtaccggattctcaggctccaaattgcatgaaatgtgaagccaggtttacattcaccaaaaggaggcatcactgcagagcatgtgggaaggttttctgtgcttcctgctgtagcctgaaatgtaaactgttatacatggacagaaaggaagctagagtgtgtgtaatctgccattcagtgctaatgaatgtggctcagcccagagagcagaggcgagtttggtttgctgatgggatcttgcccaatggagaagttgctgatgcagccaaattaacaatgaatggaacttcctctgcaggaaccctggctgtgtcacacgacccagtcaagccagtaactaccagtcctctaccagcagagacggatatttgtctattctctgggagtataactcaggttggaagtcctgttggaagtgcaatgaatcttattcctgaagatggccttcctcccattctcatctccactggtgtaaaaggagactatgctgtggaagagaaaccatcacagatttcagtaatgcagcagttggaggatggtggccctgacccacttgtatttgttttaaatgcaaatttgttgtcaatggttaaaattgtaaattatgtgaacaggaagtgctggtgtttcacaaccaagggaatgcatgcagtgggtcagtctgagatagtcattcttctacagtgtttaccggatgaaaagtgtttgccaaaggatatctttaatcactttgtgcagctttatcgggatgctctggcagggaatgtggtgagcaacttgggacattccttcttcagtcaaagtttccttggcagtaaagaacatggtggattcttatatgtgacatctacctaccagtcactgcaagacctagtactcccaaccccaccttacttgtttgggattcttatccagaaatgggaaactccttgggctaaagtatttcctatccgtctgatgttgagacttggagctgaatatcgactttatccatgcccactattcagtgtcagatttcggaagccattgtttggagagacggggcataccatcatgaatcttcttgcagacttcagaaattaccagtataccttgccagtagttcaaggtttggtggttgatatggaagttcggaaaactagcatcaaaattcccagcaacagatacaatgagatgatgaaagccatgaacaagtccaatgagcatgtcctggcaggaggtgcctgcttcaatgaaaaggcagactctcatcttgtgtgtgtacagaatgatgatggaaactatcagacccaggctatcagtattcacaatcagcccagaaaagtgactggtgccagtttctttgtgttcagtggcgctctgaaatcctcttctggataccttgccaagtccagtattgtggaagatggtgttatggtccagattactgcagagaacatggattccttgaggcaggcactgcgagagatgaaggacttcaccatcacctgtgggaaggcggacgcggaggaaccccaggagcacatccacatccagtgggtggatgatgacaagaacgttagcaagggtgtcgtaagtcctatagatgggaagtccatggagactataacaaatgtgaagatattccatggatcagaatataaagcaaatggaaaagtaatcagatggacagaggtgtttttcctagaaaacgatgaccagcacaattgcctcagtgatcctgcagatcacagtagattgactgagcatgttgccaaagctttttgccttgctctctgtcctcacctgaaacttctgaaggaagatggaatgaccaaactgggactacgtgtgacacttgactcagatcaggttggctatcaagcagggagcaatggccagccccttccctcgcagtacatgaatgatctggacagcgccttggtgccggtgatccatggaggggcctgccagcttagtgagggccccgttgtcatggaactcatcttttatattctggaaaacatcgtataaacagagaagacttcatttttttctgttcagacttgttgcaacagcagtcatacccaaatcatttgcactttaaaactggaagattaagcttttgttaacactattaatggggtggggaatagggtgggagtgggggtttgggagacgggtgggaaagggtggttggggggaccgatgttccataattctaagtcttctatgcattgtccaccaagaagatctgggcagcttctgttcctgcacaacagttatgctatccttgcagctaatccccttctgttactgtttagacaagaattccgctcctctctcaagatttacttatggtcatgtgctcagaaatgctcaaatgggtacaaccatcaccaagggtgggatgggagggcagaggggaaataaaatataaagcatcagttcttgcac

SEQ ID NO: 110030 - DNA, 4283 bp, Homo sapiens
atgctgaagcggaggcggccgctgctcgaggatcaaacagagcatactgaatcagcaggactggctggtggtgcagcagacatcatgagtaagcaccgagaagtctgttccttatcacgtgtgtaaggggaaaaaggtttaaacaagtctcttaagtggtgtttcctcaccgatggagaattacttccaagcagaagcttacaacctggacaaggtgttagatgaatttgaacaaaacgaagatgaaacagtttcttctactttattggatacaaagtggaataagattctagatcccccttctcaccggctgtcatttaaccctactttggccagtgtgaatgaatctgcagtttctaatgagtcacaaccacaactgaaagtcttctccctggctcattcagctcccctgaccacagaggaagaggatcactgtgctaatggacaggactgtaatctaaatccagagattgccacaatgtggattgatgaaaatgctgttgcagaagaccagttaattaagagaaactatagttgggatgatcaatgcagtgctgttgaagtgggagagaagaaatgtggaaacctggcttgtctgccagatgagaagaatgttcttgttgtagccgtcatgcataactgtgataaaaggacattacaaaacgatttacaggattgtaataattataatagtcaatcccttatggatgcttttagctgttcactggataatgaaaacagacaaactgatcaatttagttttagtataaatgagtccactgaaaaagatatgaattcagagaaacaaatggatccattgaatagaccgaaaacagaggggagatctgttaaccatctgtgtcctacttcatctgatagtctagccagtgtctgttccccttcacaattaaaggatgacggaagtataggtagagacccctccatgtctgcgattacaagtttaacggttgattcagtaatctcatcccagggaacagatggatgtcctgctgttaaaaagcaagagaactatataccagatgaggacctcactggcaaaatcagctctcctaggacagatctagggagtccaaattccttttcccacatgagtgaggggattttgatgaaaaaagagccagcagaggagagcaccactgaagaatccctccggtctggtttacctttgcttctcaaaccagacatgcctaatgggtctggaaggaataatgactgtgaacggtgttcagattgccttgtgcctaatgaagttagggctgatgaaaatgaaggttatgaacatgaagaaactcttggcactacagaattccttaatatgacagagcatttctctgaatctcaggacatgactaattggaagttgactaaactaaatgagatgaatgatagccaagtaaacgaagaaaaggaaaagtttctacagattagtcagcctgaggacactaatggtgatagtggaggacagtgtgttggattggcagatgcaggtctagatttaaaaggaacttgcattagtgaaagtgaagaatgtgatttctccactgttatagacacaccagcagcaaattatctatctaatggttgtgattcctatggaatgcaagacccaggtgtttcttttgttccaaagactttaccctccaaagaagattcagtaacagaagaaaaagaaatagaggaaagcaagtcagaatgctactcaaatatttatgaacagagaggaaatgaggccacagaagggagtggactacttttaaacagcactggtgacctaatgaagaaaaattatttacataatttctgtagtcaagttccatcagtgcttgggcaatcttcccccaaggtagtagcaagcctgccatctatcagtgttccttttggtggtgcaagacccaagcaaccttctaatcttaaacttcaaattccaaagccattatcagaccatttacaaaatgactttcctgcaaacagtggaaataatactaaaaataaaaatgatattcttgggaaagcaaaattaggggaaaactcagcaaccaatgtatgcagtccatctttgggaaacatctctaatgtcgatacaaatggggaacatttagaaagttatgaggctgagatctccactagaccatgccttgcattagctccagatagcccagataatgatctcagagctggtcagtttggaatttctgccagaaagccattcaccactctgggtgaggtggctccagtatgggtaccggattctcaggctccaaattgcatgaaatgtgaagccaggtttacattcaccaaaaggaggcatcactgcagagcatgtgggaaggttttctgtgcttcctgctgtagcctgaaatgtaaactgttatacatggacagaaaggaagctagagtgtgtgtaatctgccattcagtgctaatgaatgctcaagcctgggagaacatgatgagtgcctcaagccagagccctaaccctaacaatcctgctgaatactgttctactatccctcccttgcagcaagctcaggcctcaggagctctgagctctccacctcccactgtgatggtacctgtgggagttttaaagcaccctggagcagaagtggctcagcccagagagcagaggcgagtttggtttgctgatgggatcttgcccaatggagaagttgctgatgcagccaaattaacaatgaatggaacttcctctgcaggaaccctggctgtgtcacacgacccagtcaagccagtaactaccagtcctctaccagcagagacggatatttgtctattctctgggagtataactcaggttggaagtcctgttggaagtgcaatgaatcttattcctgaagatggccttcctcccattctcatctccactggtgtaaaaggagactatgctgtggaagagaaaccatcacagatttcagtaatgcagcagttggaggatggtggccctgacccacttgtatttgttttaaatgcaaatttgttgtcaatggttaaaattgtaaattatgtgaacaggaagtgctggtgtttcacaaccaagggaatgcatgcagtgggtcagtctgagatagtcattcttctacagtgtttaccggatgaaaagtgtttgccaaaggatatctttaatcactttgtgcagctttatcgggatgctctggcagggaatgtggtgagcaacttgggacattccttcttcagtcaaagtttccttggcagtaaagaacatggtggattcttatatgtgacatctacctaccagtcactgcaagacctagtactcccaaccccaccttacttgtttgggattcttatccagaaatgggaaactccttgggctaaagtatttcctatccgtctgatgttgagacttggagctgaatatcgactttatccatgcccactattcagtgtcagatttcggaagccattgtttggagagacggggcataccatcatgaatcttcttgcagacttcagaaattaccagtataccttgccagtagttcaaggtttggtggttgatatggaagttcggaaaactagcatcaaaattcccagcaacagatacaatgagatgatgaaagccatgaacaagtccaatgagcatgtcctggcaggaggtgcctgcttcaatgaaaaggcagactctcatcttgtgtgtgtacagaatgatgatggaaactatcagacccaggctatcagtattcacaatcagcccagaaaagtgactggtgccagtttctttgtgttcagtggcgctctgaaatcctcttctggataccttgccaagtccagtattgtggaaggtaaagaatgaattgttcagtcctcataataaggactgaacttatgtacataaagggaatcctttacacttctgctgtagatgtctgactcctactgttttttcagtagcatctcttcagcaaattaaaactgccatgagagtgcttagttctctgaagaaaggagtaagtggtagggataccatgtgacaatgacattaaaactaggagatggcctttcagagctctgggataaggtacctgagggcatgtagtctgagttcaaatatatcattgggtggaaatattaatatctaaatgtgtagatgaaagtcctgtccacaagaatgctgtggtcatcatttggagtacaaaatggcatgtgcttgctgctagtgtgctataattagacatgacacatatgttgacaaaagttaattaaactaaaagctaattggcaca

SEQ ID NO: 110031 - DNA, 3991 bp, Homo sapiens
atgctgaagcggaggcggccgctgctcgaggatcaaacagagcatactgaatcagcaggactggctggtggtgcagcagacatcatgagtaagcaccgagaagtctgttccttatcacgtgtgtaaggggaaaaaggtttaaacaagtctcttaagtggtgtttcctcaccgatggagaattacttccaagcagaagcttacaacctggacaaggtgttagatgaatttgaacaaaacgaagatgaaacagtttcttctactttattggatacaaagtggaataagattctagatcccccttctcaccggctgtcatttaaccctactttggccagtgtgaatgaatctgcagtttctaatgagtcacaaccacaactgaaagtcttctccctggctcattcagctcccctgaccacagaggaagaggatcactgtgctaatggacaggactgtaatctaaatccagagattgccacaatgtggattgatgaaaatgctgttgcagaagaccagttaattaagagaaactatagttgggatgatcaatgcagtgctgttgaagtgggagagaagaaatgtggaaacctggcttgtctgccagatgagaagaatgttcttgttgtagccgtcatgcataactgtgataaaaggacattacaaaacgatttacaggattgtaataattataatagtcaatcccttatggatgcttttagctgttcactggataatgaaaacagacaaactgatcaatttagttttagtataaatgagtccactgaaaaagatatgaattcagagaaacaaatggatccattgaatagaccgaaaacagaggggagatctgttaaccatctgtgtcctacttcatctgatagtctagccagtgtctgttccccttcacaattaaaggatgacggaagtataggtagagacccctccatgtctgcgattacaagtttaacggttgattcagtaatctcatcccagggaacagatggatgtcctgctgttaaaaagcaagagaactatataccagatgaggacctcactggcaaaatcagctctcctaggacagatctagggagtccaaattccttttcccacatgagtgaggggattttgatgaaaaaagagccagcagaggagagcaccactgaagaatccctccggtctggtttacctttgcttctcaaaccagacatgcctaatgggtctggaaggaataatgactgtgaacggtgttcagattgccttgtgcctaatgaagttagggctgatgaaaatgaaggttatgaacatgaagaaactcttggcactacagaattccttaatatgacagagcatttctctgaatctcaggacatgactaattggaagttgactaaactaaatgagatgaatgatagccaagtaaacgaagaaaaggaaaagtttctacagattagtcagcctgaggacactaatggtgatagtggaggacagtgtgttggattggcagatgcaggtctagatttaaaaggaacttgcattagtgaaagtgaagaatgtgatttctccactgttatagacacaccagcagcaaattatctatctaatggttgtgattcctatggaatgcaagacccaggtgtttcttttgttccaaagactttaccctccaaagaagattcagtaacagaagaaaaagaaatagaggaaagcaagtcagaatgctactcaaatatttatgaacagagaggaaatgaggccacagaagggagtggactacttttaaacagcactggtgacctaatgaagaaaaattatttacataatttctgtagtcaagttccatcagtgcttgggcaatcttcccccaaggtagtagcaagcctgccatctatcagtgttccttttggtggtgcaagacccaagcaaccttctaatcttaaacttcaaattccaaagccattatcagaccatttacaaaatgactttcctgcaaacagtggaaataatactaaaaataaaaatgatattcttgggaaagcaaaattaggggaaaactcagcaaccaatgtatgcagtccatctttgggaaacatctctaatgtcgatacaaatggggaacatttagaaagttatgaggctgagatctccactagaccatgccttgcattagctccagatagcccagataatgatctcagagctggtcagtttggaatttctgccagaaagccattcaccactctgggtgaggtggctccagtatgggtaccggattctcaggctccaaattgcatgaaatgtgaagccaggtttacattcaccaaaaggaggcatcactgcagagcatgtgggaaggttttctgtgcttcctgctgtagcctgaaatgtaaactgttatacatggacagaaaggaagctagagtgtgtgtaatctgccattcagtgctaatgaatgctcaagcctgggagaacatgatgagtgcctcaagccagagccctaaccctaacaatcctgctgaatactgttctactatccctcccttgcagcaagctcaggcctcaggagctctgagctctccacctcccactgtgatggtacctgtgggagttttaaagcaccctggagcagaagtggctcagcccagagagcagaggcgagtttggtttgctgatgggatcttgcccaatggagaagttgctgatgcagccaaattaacaatgaatggaacttcctctgcaggaaccctggctgtgtcacacgacccagtcaagccagtaactaccagtcctctaccagcagagacggatatttgtctattctctgggagtataactcaggttggaagtcctgttggaagtgcaatgaatcttattcctgaagatggccttcctcccattctcatctccactggtgtaaaaggagactatgctgtggaagagaaaccatcacagatttcagtaatgcagcagttggaggatggtggccctgacccacttgtatttgttttaaatgcaaatttgttgtcaatggttaaaattgtaaattatgtgaacaggaagtgctggtgtttcacaaccaagggaatgcatgcagtgggtcagtctgagatagtcattcttctacagtgtttaccggatgaaaagtgtttgccaaaggatatctttaatcactttgtgcagctttatcgggatgctctggcagggaatgtggtgagcaacttgggacattccttcttcagtcaaagtttccttggcagtaaagaacatggtggattcttatatgtgacatctacctaccagtcactgcaagacctagtactcccaaccccaccttacttgtttgggattcttatccagaaatgggaaactccttgggctaaagtatttcctatccgtctgatgttgagacttggagctgaatatcgactttatccatgcccactattcagtgtcagatttcggaagccattgtttggagagacggggcataccatcatgaatcttcttgcagacttcagaaattaccagtataccttgccagtagttcaaggtttggtggttgatatggaagttcggaaaactagcatcaaaattcccagcaacagatacaatgagatgatgaaagccatgaacaagtccaatgagcatgtcctggcaggaggtgcctgcttcaatgaaaaggcagactctcatcttgtgtgtgtacagaatgatgatggaaactatcagacccaggctatcagtattcacaatcagcccagaaaagtgactggtgccagtttctttgtgttcagtggcgctctgaaatcctcttctggataccttgccaagtccagtattgtggaagatggtgttatggtccagattactgcagagaacatggattccttgaggcaggcactgcgagagatgaaggacttcaccatcagacggataggaaatactttagcccaaggagtttcccatttctggataagaatccccaacatgtaagct

SEQ ID NO: 110032 - DNA, 2399 bp, Homo sapiens
gtgggttgaccgtggcttgtgggttgaccgtggcttgtgggttgaccgtggctatccctcccttgcagcaagctcaggcctcaggagctctgagctctccacctcccactgtgatggtacctgtgggagttttaaagcaccctggagcagaagtggctcagcccagagagcagaggcgagtttggtttgctgatgggatcttgcccaatggagaagttgctgatgcagccaaattaacaatgaatggaacttcctctgcaggaaccctggctgtgtcacacgacccagtcaagccagtaactaccagtcctctaccagcagagacggatatttgtctattctctgggagtataactcaggttggaagtcctgttggaagtgcaatgaatcttattcctgaagatggccttcctcccattctcatctccactggtgtaaaaggagactatgctgtggaagagaaaccatcacagatttcagtaatgcagcagttggaggatggtggccctgacccacttgtatttgttttaaatgcaaatttgttgtcaatggttaaaattgtaaattatgtgaacaggaagtgctggtgtttcacaaccaagggaatgcatgcagtgggtcagtctgagatagtcattcttctacagtgtttaccggatgaaaagtgtttgccaaaggatatctttaatcactttgtgcagctttatcgggatgctctggcagggaatgtggtgagcaacttgggacattccttcttcagtcaaagtttccttggcagtaaagaacatggtggattcttatatgtgacatctacctaccagtcactgcaagacctagtactcccaaccccaccttacttgtttgggattcttatccagaaatgggaaactccttgggctaaagtatttcctatccgtctgatgttgagacttggagctgaatatcgactttatccatgcccactattcagtgtcagatttcggaagccattgtttggagagacggggcataccatcatgaatcttcttgcagacttcagaaattaccagtataccttgccagtagttcaaggtttggtggttgatatggaagttcggaaaactagcatcaaaattcccagcaacagatacaatgagatgatgaaagccatgaacaagtccaatgagcatgtcctggcaggaggtgcctgcttcaatgaaaaggcagactctcatcttgtgtgtgtacagaatgatgatggaaactatcagacccaggctatcagtattcacaatcagcccagaaaagtgactggtgccagtttctttgtgttcagtggcgctctgaaatcctcttctggataccttgccaagtccagtattgtggaagatggtgttatggtccagattactgcagagaacatggattccttgaggcaggcactgcgagagatgaaggacttcaccatcacctgtgggaaggcggacgcggaggaaccccaggagcacatccacatccagtgggtggatgatgacaagaacgttagcaagggtgtcgtaagtcctatagatgggaagtccatggagactataacaaatgtgaagatattccatggatcagaatataaagcaaatggaaaagtaatcagatggacagaggtgtttttcctagaaaacgatgaccagcacaattgcctcagtgatcctgcagatcacagtagattgactgagcatgttgccaaagctttttgccttgctctctgtcctcacctgaaacttctgaaggaagatggaatgaccaaactgggactacgtgtgacacttgactcagatcaggttggctatcaagcagggagcaatggccagccccttccctcgcagtacatgaatgatctggacagcgccttggtgccggtgatccatggaggggcctgccagcttagtgagggccccgttgtcatggaactcatcttttatattctggaaaacatcgtataaacagagaagacttcatttttttctgttcagacttgttgcaacagcagtcatacccaaatcatttgcactttaaaactggaagattaagcttttgttaacactattaatggggtggggaatagggtgggagtgggggtttgggagacgggtgggaaagggtggttggggggaccgatgttccataattctaagtcttctatgcattgtccaccaagaagatctgggcagcttctgttcctgcacaacagttatgctatccttgcagctaatccccttctgttactgtttagacaagaattccgctcctctctcaagatttacttatggtcatgtgctcagaaatgctcaaatgggtacaaccatcaccaagggtgggatgggagggcagaggggaaataaaatataaagcatcagttcttgcac

SEQ ID NO: 110033 - DNA, 2002 bp, Homo sapiens
ctctagaggatcttctaaacattcaaatatcactggtgtaaaaggagactatgctgtggaagagaaaccatcacagatttcagtaatgcagcagttggaggatggtggccctgacccacttgtatttgttttaaatgcaaatttgttgtcaatggttaaaattgtaaattatgtgaacaggaagtgctggtgtttcacaaccaagggaatgcatgcagtgggtcagtctgagatagtcattcttctacagtgtttaccggatgaaaagtgtttgccaaaggatatctttaatcactttgtgcagctttatcgggatgctctggcagggaatgtggtgagcaacttgggacattccttcttcagtcaaagtttccttggcagtaaagaacatggtggattcttatatgtgacatctacctaccagtcactgcaagacctagtactcccaaccccaccttacttgtttgggattcttatccagaaatgggaaactccttgggctaaagtatttcctatccgtctgatgttgagacttggagctgaatatcgactttatccatgcccactattcagtgtcagatttcggaagccattgtttggagagacggggcataccatcatgaatcttcttgcagacttcagaaattaccagtataccttgccagtagttcaaggtttggtggttgatatggaagttcggaaaactagcatcaaaattcccagcaacagatacaatgagatgatgaaagccatgaacaagtccaatgagcatgtcctggcaggaggtgcctgcttcaatgaaaaggcagactctcatcttgtgtgtgtacagaatgatgatggaaactatcagacccaggctatcagtattcacaatcagcccagaaaagtgactggtgccagtttctttgtgttcagtggcgctctgaaatcctcttctggataccttgccaagtccagtattgtggaagatggtgttatggtccagattactgcagagaacatggattccttgaggcaggcactgcgagagatgaaggacttcaccatcacctgtgggaaggcggacgcggaggaaccccaggagcacatccacatccagtgggtggatgatgacaagaacgttagcaagggtgtcgtaagtcctatagatgggaagtccatggagactataacaaatgtgaagatattccatggatcagaatataaagcaaatggaaaagtaatcagatggacagaggtgtttttcctagaaaacgatgaccagcacaattgcctcagtgatcctgcagatcacagtagattgactgagcatgttgccaaagctttttgccttgctctctgtcctcacctgaaacttctgaaggaagatggaatgaccaaactgggactacgtgtgacacttgactcagatcaggttggctatcaagcagggagcaatggccagccccttccctcgcagtacatgaatgatctggacagcgccttggtgccggtgatccatggaggggcctgccagcttagtgagggccccgttgtcatggaactcatcttttatattctggaaaacatcgtataaacagagaagacttcatttttttctgttcagacttgttgcaacagcagtcatacccaaatcatttgcactttaaaactggaagattaagcttttgttaacactattaatggggtggggaatagggtgggagtgggggtttgggagacgggtgggaaagggtggttggggggaccgatgttccataattctaagtcttctatgcattgtccaccaagaagatctgggcagcttctgttcctgcacaacagttatgctatccttgcagctaatccccttctgttactgtttagacaagaattccgctcctctctcaagatttacttatggtcatgtgctcagaaatgctcaaatgggtacaaccatcaccaagggtgggatgggagggcagaggggaaataaaatataaagcatcagttcttgcac

SEQ ID NO: 110034 - DNA, 494 bp, Homo sapiens
ttagggagctgtacattgtgtatttctcattttaattttcacaaccaaagattaaggtattatttctgatactccatacctttttacacacctctacccttccccagaaaactaagaccataacaggttaagtggcttacccagtgcctcatggttgtcaagtggtcaggaggagtaaacaacaggataagtgatcacccagaaaagaggataaatttgtattcactgccatatgtttagcctatggccaaaaaggacatctcctttcctgctcagcctccttgccctcagccctggagaggccttctctgttcagtaacctctcctccttttctctctgtggtataggttggctatcaagcagggagcaatggccagccccttccctcgcagtacatgaatgatctggacagcgccttggtgccggtgatccatggaggggcctgccagcttagtgagggccccgttgtcatggaactcatcttttatattct

SEQ ID NO: 110035 - DNA, 4873 bp, Homo sapiens
atgctgaagcggaggcggccgctgctcgaggatcaaacagagcatactgaatcagcaggactggctggtggtgcagcagacatcatgagtaagcaccgagaagtctgttccttatcacgtgtgtaaggggaaaaaggtttaaacaagtctcttaagtggtgtttcctcaccgatggagaattacttccaagcagaagcttacaacctggacaaggtgttagatgaatttgaacaaaacgaagatgaaacagtttcttctactttattggatacaaagtggaataagattctagatcccccttctcaccggctgtcatttaaccctactttggccagtgtgaatgaatctgcagtttctaatgagtcacaaccacaactgaaagtcttctccctggctcattcagctcccctgaccacagaggaagaggatcactgtgctaatggacaggactgtaatctaaatccagagattgccacaatgtggattgatgaaaatgctgttgcagaagaccagttaattaagagaaactatagttgggatgatcaatgcagtgctgttgaagtgggagagaagaaatgtggaaacctggcttgtctgccagatgagaagaatgttcttgttgtagccgtcatgcataactgtgataaaaggacattacaaaacgatttacaggattgtaataattataatagtcaatcccttatggatgcttttagctgttcactggataatgaaaacagacaaactgatcaatttagttttagtataaatgagtccactgaaaaagatatgaattcagagaaacaaatggatccattgaatagaccgaaaacagaggggagatctgttaaccatctgtgtcctacttcatctgatagtctagccagtgtctgttccccttcacaattaaaggatgacggaagtataggtagagacccctccatgtctgcgattacaagtttaacggttgattcagtaatctcatcccagggaacagatggatgtcctgctgttaaaaagcaagagaactatataccagatgaggacctcactggcaaaatcagctctcctaggacagatctagggagtccaaattccttttcccacatgagtgaggggattttgatgaaaaaagagccagcagaggagagcaccactgaagaatccctccggtctggtttacctttgcttctcaaaccagacatgcctaatgggtctggaaggaataatgactgtgaacggtgttcagattgccttgtgcctaatgaagttagggctgatgaaaatgaaggttatgaacatgaagaaactcttggcactacagaattccttaatatgacagagcatttctctgaatctcaggacatgactaattggaagttgactaaactaaatgagatgaatgatagccaagtaaacgaagaaaaggaaaagtttctacagattagtcagcctgaggacactaatggtgatagtggaggacagtgtgttggattggcagatgcaggtctagatttaaaaggaacttgcattagtgaaagtgaagaatgtgatttctccactgttatagacacaccagcagcaaattatctatctaatggttgtgattcctatggaatgcaagacccaggtgtttcttttgttccaaagactttaccctccaaagaagattcagtaacagaagaaaaagaaatagaggaaagcaagtcagaatgctactcaaatatttatgaacagagaggaaatgaggccacagaagggagtggactacttttaaacagcactggtgacctaatgaagaaaaattatttacataatttctgtagtcaagttccatcagtgcttgggcaatcttcccccaaggtagtagcaagcctgccatctatcagtgttccttttggtggtgcaagacccaagcaaccttctaatcttaaacttcaaattccaaagccattatcagaccatttacaaaatgactttcctgcaaacagtggaaataatactaaaaataaaaatgatattcttgggaaagcaaaattaggggaaaactcagcaaccaatgtatgcagtccatctttgggaaacatctctaatgtcgatacaaatggggaacatttagaaagttatgaggctgagatctccactagaccatgccttgcattagctccagatagcccagataatgatctcagagctggtcagtttggaatttctgccagaaagccattcaccactctgggtgaggtggctccagtatgggtaccggattctcaggctccaaattgcatgaaatgtgaagccaggtttacattcaccaaaaggaggcatcactgcagagcatgtgggaaggttttctgtgcttcctgctgtagcctgaaatgtaaactgttatacatggacagaaaggaagctagagtgtgtgtaatctgccattcagtgctaatgaatgctcaagcctgggagaacatgatgagtgcctcaagccagagccctaaccctaacaatcctgctgaatactgttctactatccctcccttgcagcaagctcaggcctcaggagctctgagctctccacctcccactgtgatggtacctgtgggagttttaaagcaccctggagcagaagtggctcagcccagagagcagaggcgagtttggtttgctgatgggatcttgcccaatggagaagttgctgatgcagccaaattaacaatgaatggaacttcctctgcaggaaccctggctgtgtcacacgacccagtcaagccagtaactaccagtcctctaccagcagagacggatatttgtctattctctgggagtataactcaggttggaagtcctgttggaagtgcaatgaatcttattcctgaagatggccttcctcccattctcatctccactggtgtaaaaggagactatgctgtggaagagaaaccatcacagatttcagtaatgcagcagttggaggatggtggccctgacccacttgtatttgttttaaatgcaaatttgttgtcaatggttaaaattgtaaattatgtgaacaggaagtgctggtgtttcacaaccaagggaatgcatgcagtgggtcagtctgagatagtcattcttctacagtgtttaccggatgaaaagtgtttgccaaaggatatctttaatcactttgtgcagctttatcgggatgctctggcagggaatgtggtgagcaacttgggacattccttcttcagtcaaagtttccttggcagtaaagaacatggtggattcttatatgtgacatctacctaccagtcactgcaagacctagtactcccaaccccaccttacttgtttgggattcttatccagaaatgggaaactccttgggctaaagtatttcctatccgtctgatgttgagacttggagctgaatatcgactttatccatgcccactattcagtgtcagatttcggaagccattgtttggagagacggggcataccatcatgaatcttcttgcagacttcagaaattaccagtataccttgccagtagttcaaggtttggtggttgatatggaagttcggaaaactagcatcaaaattcccagcaacagatacaatgagatgatgaaagccatgaacaagtccaatgagcatgtcctggcaggaggtgcctgcttcaatgaaaaggcagactctcatcttgtgtgtgtacagaatgatgatggaaactatcagacccaggctatcagtattcacaatcagcccagaaaagtgactggtgccagtttctttgtgttcagtggcgctctgaaatcctcttctggataccttgccaagtccagtattgtggaagatggtgttatggtccagattactgcagagaacatggattccttgaggcaggcactgcgagagatgaaggacttcaccatcacctgtgggaaggcggacgcggaggaaccccaggagcacatccacatccagtgggtggatgatgacaagaacgttagcaagggtgtcgtaagtcctatagatgggaagtccatggagactataacaaatgtgaagatattccatggatcagaatataaagcaaatggaaaagtaatcagatggacagaggtgtttttcctagaaaacgatgaccagcacaattgcctcagtgatcctgcagatcacagtagattgactgagcatgttgccaaagctttttgccttgctctctgtcctcacctgaaacttctgaaggaagatggaatgaccaaactgggactacgtgtgacacttgactcagatcaggttggctatcaagcagggagcaatggccagccccttccctcgcagtacatgaatgatctggacagcgccttggtgccggtgatccatggaggggcctgccagcttagtgagggccccgttgtcatggaactcatcttttatattctggaaaacatcgtataaacagagaagacttcatttttttctgttcagacttgttgcaacagcagtcatacccaaatcatttgcactttaaaactggaagattaagcttttgttaacactattaatggggtggggaatagggtgggagtgggggtttgggagacgggtgggaaagggtggttggggggaccgatgttccataattctaagtcttctatgcattgtccaccaagaagatctgggcagcttctgttcctgcacaacagttatgctatccttgcagctaatccccttctgttactgtttagacaagaattccgctcctctctcaagatttacttatggtcatgtgctcagaaatgctcaaatgggtacaaccatcaccaagggtgggatgggagggcagaggggaaataaaatataaagcatcagttcttgcac

SEQ ID NO: 110036 - DNA, 2625 bp, Homo sapiens
atgctgaagcggaggcggccgctgctcgaggatcaaacagagcatactgaatcagcaggactggctggtggtgcagcagacatcatgagtaagcaccgagaagtctgttccttatcacgtgtgtaaggggaaaaaggtttaaacaagtctcttaagtggtgtttcctcaccgatggagaattacttccaagcagaagcttacaacctggacaaggtgttagatgaatttgaacaaaacgaagatgaaacagtttcttctactttattggatacaaagtggaataagattctagatcccccttctcaccggctgtcatttaaccctactttggccagtgtgaatgaatctgcagtttctaatgagtcacaaccacaactgaaagtcttctccctggctcattcagctcccctgaccacagaggaagaggatcactgtgctaatggacaggactgtaatctaaatccagagattgccacaatgtggattgatgaaaatgctgttgcagaagaccagttaattaagagaaactatagttgggatgatcaatgcagtgctgttgaagtgggagagaagaaatgtggaaacctggcttgtctgccagatgagaagaatgttcttgttgtagccgtcatgcataactgtgataaaaggacattacaaaacgatttacaggattgtaataattataatagtcaatcccttatggatgcttttagctgttcactggataatgaaaacagacaaactgatcaatttagttttagtataaatgagtccactgaaaaagatatgaattcagagaaacaaatggatccattgaatagaccgaaaacagaggggagatctgttaaccatctgtgtcctacttcatctgatagtctagccagtgtctgttccccttcacaattaaaggatgacggaagtataggtagagacccctccatgtctgcgattacaagtttaacggttgattcagtaatctcatcccagggaacagatggatgtcctgctgttaaaaagcaagagaactatataccagatgaggacctcactggcaaaatcagctctcctaggacagatctagggagtccaaattccttttcccacatgagtgaggggattttgatgaaaaaagagccagcagaggagagcaccactgaagaatccctccggtctggtttacctttgcttctcaaaccagacatgcctaatgggtctggaaggaataatgactgtgaacggtgttcagattgccttgtgcctaatgaagttagggctgatgaaaatgaaggttatgaacatgaagaaactcttggcactacagaattccttaatatgacagagcatttctctgaatctcaggacatgactaattggaagttgactaaactaaatgagatgaatgatagccaagtaaacgaagaaaaggaaaagtttctacagattagtcagcctgaggacactaatggtgatagtggaggacagtgtgttggattggcagatgcaggtctagatttaaaaggaacttgcattagtgaaagtgaagaatgtgatttctccactgttatagacacaccagcagcaaattatctatctaatggttgtgattcctatggaatgcaagacccaggtgtttcttttgttccaaagactttaccctccaaagaagattcagtaacagaagaaaaagaaatagaggaaagcaagtcagaatgctactcaaatatttatgaacagagaggaaatgaggccacagaagggagtggactacttttaaacagcactggtgacctaatgaagaaaaattatttacataatttctgtagtcaagttccatcagtgcttgggcaatcttcccccaaggtagtagcaagcctgccatctatcagtgttccttttggtggtgcaagacccaagcaaccttctaatcttaaacttcaaattccaaagccattatcagaccatttacaaaatgactttcctgcaaacagtggaaataatactaaaaataaaaatgatattcttgggaaagcaaaattaggggaaaactcagcaaccaatgtatgcagtccatctttgggaaacatctctaatgtcgatacaaatggggaacatttagaaagttatgaggctgagatctccactagaccatgccttgcattagctccagatagcccagataatgatctcagagctggtcagtttggaatttctgccagaaagccattcaccactctgggtgaggtggctccagtatgggtaccggattctcaggctccaaattgcatgaaatgtgaagccaggtttacattcaccaaaaggaggcatcactgcagagcatgtgggaaggttttctgtgcttcctgctgtagcctgaaatgtaaactgttatacatggacagaaaggaagctagagtgtgtgtaatctgccattcagtgctaatgaatggtaagtattaaaacaggttgatttcatagttattgagacaaaacaagggaattacgatgagaagacttttttccccctgcctttctttacaagttgctcaccttctcaaatgtcataactttaactgaaaatatttagctaaatttccatgttttgaaagtatcttagcatttca

SEQ ID NO: 110037 - DNA, 4819 bp, Homo sapiens
atgctgaagcggaggcggccgctgctcgaggatcaaacagagcatactgaatcagcaggactggctggtggtgcagcagacatcatgagtaagcaccgagaagtctgttccttatcacgtgtgtaaggggaaaaaggtttaaacaagtctcttaagtggtgtttcctcaccgatggagaattacttccaagcagaagcttacaacctggacaaggtgttagatgaatttgaacaaaacgaagatgaaacagtttcttctactttattggatacaaagtggaataagattctagatcccccttctcaccggctgtcatttaaccctactttggccagtgtgaatgaatctgcagtttctaatgagtcacaaccacaactgaaagtcttctccctggctcattcagctcccctgaccacagaggaagaggatcactgtgctaatggacaggactgtaatctaaatccagagattgccacaatgtggattgatgaaaatgctgttgcagaagaccagttaattaagagaaactatagttgggatgatcaatgcagtgctgttgaagtgggagagaagaaatgtggaaacctggcttgtctgccagatgagaagaatgttcttgttgtagccgtcatgcataactgtgataaaaggacattacaaaacgatttacaggattgtaataattataatagtcaatcccttatggatgcttttagctgttcactggataatgaaaacagacaaactgatcaatttagttttagtataaatgagtccactgaaaaagatatgaattcagagaaacaaatggatccattgaatagaccgaaaacagaggggagatctgttaaccatctgtgtcctacttcatctgatagtctagccagtgtctgttccccttcacaattaaaggatgacggaagtataggtagagacccctccatgtctgcgattacaagtttaacggttgattcagtaatctcatcccagggaacagatggatgtcctgctgttaaaaagcaagagaactatataccagatgaggacctcactggcaaaatcagctctcctaggacagatctagggagtccaaattccttttcccacatgagtgaggggattttgatgaaaaaagagccagcagaggagagcaccactgaagaatccctccggtctggtttacctttgcttctcaaaccagacatgcctaatgggtctggaaggaataatgactgtgaacggtgttcagattgccttgtgcctaatgaagttagggctgatgaaaatgaaggttatgaacatgaagaaactcttggcactacagaattccttaatatgacagagcatttctctgaatctcaggacatgactaattggaagttgactaaactaaatgagatgaatgatagccaagtaaacgaagaaaaggaaaagtttctacagattagtcagcctgaggacactaatggtgatagtggaggacagtgtgttggattggcagatgcaggtctagatttcacaccagcagcaaattatctatctaatggttgtgattcctatggaatgcaagacccaggtgtttcttttgttccaaagactttaccctccaaagaagattcagtaacagaagaaaaagaaatagaggaaagcaagtcagaatgctactcaaatatttatgaacagagaggaaatgaggccacagaagggagtggactacttttaaacagcactggtgacctaatgaagaaaaattatttacataatttctgtagtcaagttccatcagtgcttgggcaatcttcccccaaggtagtagcaagcctgccatctatcagtgttccttttggtggtgcaagacccaagcaaccttctaatcttaaacttcaaattccaaagccattatcagaccatttacaaaatgactttcctgcaaacagtggaaataatactaaaaataaaaatgatattcttgggaaagcaaaattaggggaaaactcagcaaccaatgtatgcagtccatctttgggaaacatctctaatgtcgatacaaatggggaacatttagaaagttatgaggctgagatctccactagaccatgccttgcattagctccagatagcccagataatgatctcagagctggtcagtttggaatttctgccagaaagccattcaccactctgggtgaggtggctccagtatgggtaccggattctcaggctccaaattgcatgaaatgtgaagccaggtttacattcaccaaaaggaggcatcactgcagagcatgtgggaaggttttctgtgcttcctgctgtagcctgaaatgtaaactgttatacatggacagaaaggaagctagagtgtgtgtaatctgccattcagtgctaatgaatgctcaagcctgggagaacatgatgagtgcctcaagccagagccctaaccctaacaatcctgctgaatactgttctactatccctcccttgcagcaagctcaggcctcaggagctctgagctctccacctcccactgtgatggtacctgtgggagttttaaagcaccctggagcagaagtggctcagcccagagagcagaggcgagtttggtttgctgatgggatcttgcccaatggagaagttgctgatgcagccaaattaacaatgaatggaacttcctctgcaggaaccctggctgtgtcacacgacccagtcaagccagtaactaccagtcctctaccagcagagacggatatttgtctattctctgggagtataactcaggttggaagtcctgttggaagtgcaatgaatcttattcctgaagatggccttcctcccattctcatctccactggtgtaaaaggagactatgctgtggaagagaaaccatcacagatttcagtaatgcagcagttggaggatggtggccctgacccacttgtatttgttttaaatgcaaatttgttgtcaatggttaaaattgtaaattatgtgaacaggaagtgctggtgtttcacaaccaagggaatgcatgcagtgggtcagtctgagatagtcattcttctacagtgtttaccggatgaaaagtgtttgccaaaggatatctttaatcactttgtgcagctttatcgggatgctctggcagggaatgtggtgagcaacttgggacattccttcttcagtcaaagtttccttggcagtaaagaacatggtggattcttatatgtgacatctacctaccagtcactgcaagacctagtactcccaaccccaccttacttgtttgggattcttatccagaaatgggaaactccttgggctaaagtatttcctatccgtctgatgttgagacttggagctgaatatcgactttatccatgcccactattcagtgtcagatttcggaagccattgtttggagagacggggcataccatcatgaatcttcttgcagacttcagaaattaccagtataccttgccagtagttcaaggtttggtggttgatatggaagttcggaaaactagcatcaaaattcccagcaacagatacaatgagatgatgaaagccatgaacaagtccaatgagcatgtcctggcaggaggtgcctgcttcaatgaaaaggcagactctcatcttgtgtgtgtacagaatgatgatggaaactatcagacccaggctatcagtattcacaatcagcccagaaaagtgactggtgccagtttctttgtgttcagtggcgctctgaaatcctcttctggataccttgccaagtccagtattgtggaagatggtgttatggtccagattactgcagagaacatggattccttgaggcaggcactgcgagagatgaaggacttcaccatcacctgtgggaaggcggacgcggaggaaccccaggagcacatccacatccagtgggtggatgatgacaagaacgttagcaagggtgtcgtaagtcctatagatgggaagtccatggagactataacaaatgtgaagatattccatggatcagaatataaagcaaatggaaaagtaatcagatggacagaggtgtttttcctagaaaacgatgaccagcacaattgcctcagtgatcctgcagatcacagtagattgactgagcatgttgccaaagctttttgccttgctctctgtcctcacctgaaacttctgaaggaagatggaatgaccaaactgggactacgtgtgacacttgactcagatcaggttggctatcaagcagggagcaatggccagccccttccctcgcagtacatgaatgatctggacagcgccttggtgccggtgatccatggaggggcctgccagcttagtgagggccccgttgtcatggaactcatcttttatattctggaaaacatcgtataaacagagaagacttcatttttttctgttcagacttgttgcaacagcagtcatacccaaatcatttgcactttaaaactggaagattaagcttttgttaacactattaatggggtggggaatagggtgggagtgggggtttgggagacgggtgggaaagggtggttggggggaccgatgttccataattctaagtcttctatgcattgtccaccaagaagatctgggcagcttctgttcctgcacaacagttatgctatccttgcagctaatccccttctgttactgtttagacaagaattccgctcctctctcaagatttacttatggtcatgtgctcagaaatgctcaaatgggtacaaccatcaccaagggtgggatgggagggcagaggggaaataaaatataaagcatcagttcttgcac

SEQ ID NO: 110038 - DNA, 3628 bp, Homo sapiens
atgctgaagcggaggcggccgctgctcgaggatcaaacagagcatactgaatcagcaggactggctggtggtgcagcagacatcatgagtaagcaccgagaagtctgttccttatcacgtgtgtaaggggaaaaaggtttaaacaagtctcttaagtggtgtttcctcaccgatggagaattacttccaagcagaagcttacaacctggacaaggtgttagatgaatttgaacaaaacgaagatgaaacagtttcttctactttattggatacaaagtggaataagattctagatcccccttctcaccggctgtcatttaaccctactttggccagtgtgaatgaatctgcagtttctaatgagtcacaaccacaactgaaagtcttctccctggctcattcagctcccctgaccacagaggaagaggatcactgtgctaatggacaggactgtaatctaaatccagagattgccacaatgtggattgatgaaaatgctgttgcagaagaccagttaattaagagaaactatagttgggatgatcaatgcagtgctgttgaagtgggagagaagaaatgtggaaacctggcttgtctgccagatgagaagaatgttcttgttgtagccgtcatgcataactgtgataaaaggacattacaaaacgatttacaggattgtaataattataatagtcaatcccttatggatgcttttagctgttcactggataatgaaaacagacaaactgatcaatttagttttagtataaatgagtccactgaaaaagatatgaattcagagaaacaaatggatccattgaatagaccgaaaacagaggggagatctgttaaccatctgtgtcctacttcatctgatagtctagccagtgtctgttccccttcacaattaaaggatgacggaagtataggtagagacccctccatgtctgcgattacaagtttaacggttgattcagtaatctcatcccagggaacagatggatgtcctgctgttaaaaagcaagagaactatataccagatgaggacctcactggcaaaatcagctctcctaggacagatctagggagtccaaattccttttcccacatgagtgaggggattttgatgaaaaaagagccagcagaggagagcaccactgaagaatccctccggtctggtttacctttgcttctcaaaccagacatgcctaatgggtctggaaggaataatgactgtgaacggtgttcagattgccttgtgcctaatgaagttagggctgatgaaaatgaaggttatgaacatgaagaaactcttggcactacagaattccttaatatgacagagcatttctctgaatctcaggacatgactaattggaagttgactaaactaaatgagatgaatgatagccaagtaaacgaagaaaaggaaaagtttctacagattagtcagcctgaggacactaatggtgatagtggaggacagtgtgttggattggcagatgcaggtctagatttaaaaggaacttgcattagtgaaagtgaagaatgtgatttctccactgttatagacacaccagcagcaaattatctatctaatggttgtgattcctatggaatgcaagacccaggtgtttcttttgttccaaagactttaccctccaaagaagattcagtaacagaagaaaaagaaatagaggaaagcaagtcagaatgctactcaaatatttatgaacagagaggaaatgaggccacagaagggagtggactacttttaaacagcactggtgacctaatgaagaaaaattatttacataatttctgtagtcaagttccatcagtgcttgggcaatcttcccccaaggtagtagcaagcctgccatctatcagtgttccttttggtggtgcaagacccaagcaaccttctaatcttaaacttcaaattccaaagccattatcagaccatttacaaaatgactttcctgcaaacagtggaaataatactaaaaataaaaatgatattcttgggaaagcaaaattaggggaaaactcagcaaccaatgtatgcagtccatctttgggaaacatctctaatgtcgatacaaatggggaacatttagaaagttatgaggctgagatctccactagaccatgccttgcattagctccagatagcccagataatgatctcagagctggtcagtttggaatttctgccagaaagccattcaccactctgggtgaggtggctccagtatgggtaccggattctcaggctccaaattgcatgaaatgtgaagccaggtttacattcaccaaaaggaggcatcactgcagagcatgtgggaaggttttctgtgcttcctgctgtagcctgaaatgtaaactgttatacatggacagaaaggaagctagagtgtgtgtaatctgccattcagtgctaatgaatgctcaagcctgggagaacatgatgagtgcctcaagccagagccctaaccctaacaatcctgctgaatactgttctactatccctcccttgcagcaagctcaggcctcaggagctctgagctctccacctcccactgtgatggtacctgtgggagttttaaagcaccctggagcagaagtggctcagcccagagagcagaggcgagtttggtttgctgatgggatcttgcccaatggagaagttgctgatgcagccaaattaacaatgaatggaacttcctctgcaggaaccctggctgtgtcacacgacccagtcaagccagtaactaccagtcctctaccagcagagacggatatttgtctattctctgggagtataactcaggttggaagtcctgttggaagtgcaatgaatcttattcctgaagatggccttcctcccattctcatctccactggtgtaaaaggagactatgctgtggaagagaaaccatcacagatttcagtaatgcagcagttggaggatggtggccctgacccacttgtatttgttttaaatgcaaatttgttgtcaatggttaaaattgtaaattatgtgaacaggaagtgctggtgtttcacaaccaagggaatgcatgcagtgggtcagtctgagatagtcattcttctacagtgtttaccggatgaaaagtgtttgccaaaggatatctttaatcactttgtgcagctttatcgggatgctctggcagggaatgtggtgagcaacttgggacattccttcttcagtcaaagtttccttggcagtaaagaacatggtggattcttatatgtgacatctacctaccagtcactgcaagacctagtactcccaaccccaccttacttgtttgggattcttatccagaaatgggaaaggtggttggggggaccgatgttccataattctaagtcttctatgcattgtccaccaagaagatctgggcagcttctgttcctgcacaacagttatgctatccttgcagctaatccccttctgttactgtttagacaagaattccgctcctctctcaagatttacttatggtcatgtgctcagaaatgctcaaatgggtacaaccatcaccaagggtgggatgggagggcagaggggaaataaaatataaagcatcagttcttgcac

SEQ ID NO: 110039 - DNA, 3049 bp, Homo sapiens
atgctgaagcggaggcggccgctgctcgaggatcaaacagagcatactgaatcagcaggactggctggtggtgcagcagacatcatgagtaagcaccgagaagtctgttccttatcacgtgtgtaaggggaaaaaggtttaaacaagtctcttaagtggtgtttcctcaccgatggagaattacttccaagcagaagcttacaacctggacaaggtgttagatgaatttgaacaaaacgaagatgaaacagtttcttctactttattggatacaaagtggaataagattctagatcccccttctcaccggctgtcatttaaccctactttggccagtgtgaatgaatctgcagtttctaatgagtcacaaccacaactgaaagtcttctccctggctcattcagctcccctgaccacagaggaagaggatcactgtgctaatggacaggactgtaatctaaatccagagattgccacaatgtggattgatgaaaatgctgttgcagaagaccagttaattaagagaaactatagttgggatgatcaatgcagtgctgttgaagtgggagagaagaaatgtggaaacctggcttgtctgccagatgagaagaatgttcttgttgtagccgtcatgcataactgtgataaaaggacattacaaaacgatttacaggattgtaataattataatagtcaatcccttatggatgcttttagctgttcactggataatgaaaacagacaaactgatcaatttagttttagtataaatgagtccactgaaaaagatatgaattcagagaaacaaatggatccattgaatagaccgaaaacagaggggagatctgttaaccatctgtgtcctacttcatctgatagtctagccagtgtctgttccccttcacaattaaaggatgacggaagtataggtagagacccctccatgtctgcgattacaagtttaacggttgattcagtaatctcatcccagggaacagatggatgtcctgctgttaaaaagcaagagaactatataccagatgaggacctcactggcaaaatcagctctcctaggacagatctagggagtccaaattccttttcccacatgagtgaggggattttgatgaaaaaagagccagcagaggagagcaccactgaagaatccctccggtctggtttacctttgcttctcaaaccagacatgcctaatgggtctggaaggaataatgactgtgaacggtgttcagattgccttgtgcctaatgaagttagggctgatgaaaatgaaggttatgaacatgaagaaactcttggcactacagaattccttaatatgacagagcatttctctgaatctcaggacatgactaattggaagttgactaaactaaatgagatgaatgatagccaagtaaacgaagaaaaggaaaagtttctacagattagtcagcctgaggacactaatggtgatagtggaggacagtgtgttggattggcagatgcaggtctagatttaaaaggaacttgcattagtgaaagtgaagaatgtgatttctccactgttatagacacaccagcagcaaattatctatctaatggttgtgattcctatggaatgcaagacccaggtgtttcttttgttccaaagactttaccctccaaagaagattcagtaacagaagaaaaagaaatagaggaaagcaagtcagaatgctactcaaatatttatgaacagagaggaaatgaggccacagaagggagtggactacttttcttcccccaaggtagtagcaagcctgccatctatcagtgttccttttggtggtgcaagacccaagcaaccttctaatcttaaacttcaaattccaaagccattatcagaccatttacaaaatgactttcctgcaaacagtggaaataatactaaaaataaaaatgatattcttgggaaagcaaaattagtggcgctctgaaatcctcttctggataccttgccaagtccagtattgtggaagatggtgttatggtccagattactgcagagaacatggattccttgaggcaggcactgcgagagatgaaggacttcaccatcacctgtgggaaggcggacgcggaggaaccccaggagcacatccacatccagtgggtggatgatgacaagaacgttagcaagggtgtcgtaagtcctatagatgggaagtccatggagactataacaaatgtgaagatattccatggatcagaatataaagcaaatggaaaagtaatcagatggacagaggtgtttttcctagaaaacgatgaccagcacaattgcctcagtgatcctgcagatcacagtagattgactgagcatgttgccaaagctttttgccttgctctctgtcctcacctgaaacttctgaaggaagatggaatgaccaaactgggactacgtgtgacacttgactcagatcaggttggctatcaagcagggagcaatggccagccccttccctcgcagtacatgaatgatctggacagcgccttggtgccggtgatccatggaggggcctgccagcttagtgagggccccgttgtcatggaactcatcttttatattctggaaaacatcgtataaacagagaagacttcatttttttctgttcagacttgttgcaacagcagtcatacccaaatcatttgcactttaaaactggaagattaagcttttgttaacactattaatggggtggggaatagggtgggagtgggggtttgggagacgggtgggaaagggtggttggggggaccgatgttccataattctaagtcttctatgcattgtccaccaagaagatctgggcagcttctgttcctgcacaacagttatgctatccttgcagctaatccccttctgttactgtttagacaagaattccgctcctctctcaagatttacttatggtcatgtgctcagaaatgctcaaatgggtacaaccatcaccaagggtgggatgggagggcagaggggaaataaaatataaagcatcagttcttgcac

SEQ ID NO: 110040 - DNA, 2466 bp, Homo sapiens
tcttgggtacagaatggggcagtttcagtgtctgcggagcaccacatttgtgagagcaccaaacctttaccatacacaagagataaagaaaaaggcaagaagtttggttttagtctcttatggcgcagcttatctagaaaggagaagcccaaaacagaacacagcagtttctctgctcagttcccacctgaagaatggcccgtccgagatgaagatgacttggacaatatccctcgagatgttgaacatgagataatcaaacgaattaaccccattttgactgttgacaatttaatcaaacacactgtcctaatgcaaaaatacgaagaacagaaaaaatataatagccagggcacttccactgacatgctgacaatcgggcataagtatccttcaaaagagggggttaagaaaaggcagggtctgtctgcaaaacctcaagggcagggccattctcgaagggatagacacaaagccaggaatcagggaagtgagtttcagccaggaagcattagactggagaaacaccccaagctccctgctacacagcccatccccagaattaaaagcccaaatgaaatggtaggtcagaaaccacttggtgagattacaacagtgctaggttcccatttgatttacaaaaagcgaatcagtaatcctttccagggtttgtctcaccgaggaagcacaatatccaaagggcacaaaattcagaagacgagtgatctgaaacccagccagactggaccaaaggaaaagcctttccaaaagcctaggtccttggattcctcaagaatctttgatggtaaagccaaagagccatatgctgaacaacctaatgataaaatggaagcagaatccatttacataaatgaccctactgtcaaacccatcaatgatgacttcagaggtcacctcttcagtcaccctcaacagagcatgttgcaaaatgatggtaaatgctgtccctttatggaaagcatgttgagatatgaagtgtatggtggagaaaatgaggtaattcctgaagtcttgaggaaaagtcattcccactttgacaaattaggggagaccaaacagactccgcatagtctgccatcacgaggtgcctccttttcagaccgaacaccctctgcttgtagattagtggataacacaatacaccagtttcaaaatcttggccttttggattacccagttggcgtgaaccctttaagacaagctgcaagacaagacaaagactcagaagaattattgagaaaaggatttgtccaggatgcagagactacaagcctagaaaatgaacagctttctaacgatgaccaggccttgtatcagaatgaagtggaagatgatgatggtgcctgtagttcattatatctagaggaggatgacatttctgagaatgacgacttacgtcaaatgctgcctggccacagtcagtattccttcacaggtggaagccagggaaatcatttaggaaaacaaaaagtgattgagagatctctgaccgagtacaacagcacaatggagagggttgagtctcaggtgcttaaaagaaatgaatgctacaaacccactgggctgcatgctaccccaggtgaaagccaagaacctaacctctctgctgaaagttgtggcctaaattcaggggcccagtttggttttaactacgaagaagaacccagtgttgctaaatgtgtacaggcctcagcacctgctgatgaaagaatctttgattactatagcgcaagaaaagccagttttgaagctgaagtcatacaagacactattggtgacacaggaaagaagccagctagctggagtcagagtcctcagaatcaggaaatgagaaaacatttcccacaaaagttccaacttttcaacacttcacatatgccagtgttggctcaggatgtccaatatgaacacagtcacttggaagggacagaaaatcacagcatggcaggagatagtggaatagattctccacggacacagagtctgggatctaataattcagtcattttggatggactaaaaagaagacagaattttctgcaaaatgtcgaaggcacaaagagcagtcaaccactcacatctaattccttactaccgctaactccagtcataaacgtttaattttcttttggaaacctacttttttctttataaaaaggtagagcattattacagaatctttcaatcatgtaagaattgagtatataagaattgtctaaaggcaagcatatctatactattaaccacattacacattttgttctaattactggctttttttcctcttttggtgtcttaaggctttttgaagcttattttactgtgagtttattgggagtatatagattattttcgattaaaaagtggaattattggtccccttccaattgtaattatcttgaatttttatacattagtttctcaaatatatagaatgccaattta

SEQ ID NO: 110041 - DNA, 814 bp, Homo sapiens
ccagtgcaaatgaatccaataactcaatctcagttcgtacctttgggtgaagttctttgctgtgctatatctgatatgaatacagctcagattgtagtaacgcaggaatcacttttggagcgtttgatgaaacattacccaggcattgcaattccatcggaagatattctttataccactctgggaacgctgattaaagaaaggaagatttatcacactggagaaggatacttcatagttactcctcagacttacttcattacaaatacaaccacccaggaaaataagagaatgctgccatcagatgaaagtcgcctgatgccagcttccatgacatatctggacacagagtctgggatctaataattcagtcattttggatggactaaaaagaagacagaattttctgcaaaatgtcgaaggcacaaagagcagtcaaccactcacatctaattccttactaccgctaactccagtcataaacgtttaattttcttttggaaacctacttttttctttataaaaaggtagagcattattacagaatctttcaatcatgtaagaattgagtatataagaattgtctaaaggcaagcatatctatactattaaccacattacacattttgttctaattactggctttttttcctcttttggtgtcttaaggctttttgaagcttattttactgtgagtttattgggagtatatagattattttcgattaaaaagtggaattattggtccccttccaattgtaattatcttgaatttttatacattagtttctcaaatatatagaatgccaattta

SEQ ID NO: 110042 - DNA, 467 bp, Homo sapiens
gggattacaggcgtgagccaccgcgcgcggtctccatgcttctaaatactttgaaatgctggattaaatgcaaccctcgtccctaaaatgaataactagttcacaggaaagagcagtacccagagtctaaaatctaagagtgaacaaaaaagccagagcagtgagcagaactgcaccatgggtgcaaggctaggggtcttgactgaggaccttgagttttaatgaccacatcgacttgagacaaggcctggggtctaagccatgtaggagttggaattaagtcaccagcataaagtcaagctgcttaaaaaaggactgaggcagacctgggaaaacccaactgacagcacaagaactagcagagaagttggaatgtctcagcctgtttttgggttgggataacagtcttcccttgagactgtgtaaccacaggtctgccctcatgtggattcagggccagtttaata

SEQ ID NO: 110043 - DNA, 433 bp, Homo sapiens
gagggagagccagatcctgcaaacctcactgaggccttaggcttgatcctagaaggagtgggaataaatgaaggtaggtgttggtgatgactgctaatacaaaccctcactgctttctaatgatagaagcatcacattccagaacatgtaggagataaaggttttaaagaaaataaaaattacactaatgcccatcaccatttgttctttttttatttccagtatttaaaaatgtatacatttaaaatagctgagatgctgtatatatagctcttaatcttttacctcacttcttctatcatgagcatttttctgtaacacattttttgagacattttgatgactgtatattatcctactttgtgaatttttataatttatataatatccatttctaagatttttgttcttatggataaaattgttttactta

SEQ ID NO: 110044 - DNA, 595 bp, Homo sapiens
cccaagatggcgctgaacaaggctctcaggatgcctataagatgtgcaaggaatgaccatttcacaaaacaactcacgctttcctacctctggctgtaaaattgactttcctttctttccatcttaagagattctgcttcatttcaaaagcaagtaagataaggattagaaataccagccattgtcctgtcttgataaggacagactgaaggacacgttacgtgggttcccgttccttggctttaccacttagagccactgaccttggatcatggactcaaggccaatgactggcctcctgtggtccataaccaggtccctgttcaatatcaatgtcatcttttcagatattctgaaaagctgaattattttgttttccattttccttggtctatttgagaaatgatactgtatcagttttagatatttattttttaactatgacacagtccactcataggatgaaggatggcgtgccaaggctgtgcccaaaactgatcccacattcccatcacggatgtgattctaccccaggtctatgtcctgagaacttgtctcatcagagacatataaacaattcctagaacaaactttg

SEQ ID NO: 110045 - DNA, 213 bp, Homo sapiens
atagtacaggggagacagaaattggagataggagcctgtaaggaagagtcaccctgataagcatcttggtttacctgttgagaacggctatgccccaggggtaagagtaaaccagaaatagaccagtcttcatgaaaagtgaaacacagctgcagttagaacaaagtaatgtgccacttctgtacctgctcatcaggagacaaccggtcctct

SEQ ID NO: 110046 - DNA, 673 bp, Homo sapiens
actaggaacattcgtccggtgcgcgcagctagtcaggaggtgaacgtgggcataatctgttcacctcacgagatgctcggggtgcttgcactagatgcctgtggattgctcacacatgtaactcaaggcctggggttgacaaagagagacggattctgatacaataatcaaattgaatgagaatgattcatgtagaggtcaattaatatggtgtcgtagcgaacaaggatgtcaatgcggagtgctgttatcaaaaatattcaggggtgaatatttattatcaaaagttattaagttttttttatcccgatttaatgattttacttcttgaaatttatcctcaggctaaaataattcagttttaaaaaactgatttccataatgatgtctgtcagatttaggtataatatatcagcccctcaaataggaaagtgtgggatgggagttagaggccacatggccactactaaactataattataattaatatagtccttagaatacacttaccacagccagaaataatactttctataagtaaaactctaacaaatctaccactgttctagatggtatgtagcaaaaataagcaaaaacaaaacaggcaactttcaatagtgtaaacaacatgaaaaaatgctgattgtataaaatgttatgtctcttagtaact

SEQ ID NO: 110047 - DNA, 244 bp, Homo sapiens
aagcggtgttcagggagaggaggctgttatggctgtccaggcaagggatgggcagagcaggtaaatgtcagggtcaggggtgggagaggtgggagatgcacataggaggggtcggagaggtgtctttggcaggagctggccggggagtgattcctagtcaggggttttgggcatgtgtagaaggacagagtggtggcagcttctttattgtcatcttcttttttttgagatagagtcccactct

SEQ ID NO: 110048 - DNA, 531 bp, Homo sapiens
gaacctttcaaaacgatgcggggggtatacgtcgcctctaagctccttgaagatggaacttgacagtatcttgacagaaatcctcgagacgtcgcatagttcgtcctagagctactgcatcagttagtaatacgcccagagtgtgagaacagacagacgcaactggatgcatattcacgtagagggaacgagtgagtcttaagtatggttacgataatagctaatataagcactttatatggataatttcatttaatactgcagctcagtgagatggtagtggctattcccatttctgtgaatcggacaacattgcagtaattaaaaagaaggcagttctacagatattgacaattcagggaactcacttaccttggaatttcttgagcagtctgttaactgttgcattctttaatttttaattatattttaaaatcataaatgttatacacacatgttgtatataaaaattttgaaagaattctgaaataaagtaacagtatgctacatatatttctatagcttctttcc

SEQ ID NO: 110049 - DNA, 362 bp, Homo sapiens
tggttttcaaggtgtggtctgcagagaaccttataggaaatatctggtgtcaaaactatttttataataatgctaagatattatttacacttttcactgtcttgacatttgcaccgatagtataaaatcaatgtctgataaaactgctggctgcttagtacaaatcagctgcttagttgagaacaataaatggactcaagaaaataacgtggaagttgtacacatccttccatctacttacattccattggtaagaacttgtccaaatggtgaggctaagaccttgacatggaggaaggagtccatttaaaagggaaattcagggaatggtttctggggaaacactggcaatatctgccctg

SEQ ID NO: 110050 - DNA, 361 bp, Homo sapiens
ctagaatgtagtggttaagaagagtgtggcctggccgggtgtggtggctcatgcctctcacttttgagaggctgaggtggaggatcacttgagcctaggagttcgagaccagcctgggctacagggcgagaccccatctctatttaaaaaaaaaaagtggccttggatctagatagacatggattctagtcctgcttcatcacctgtgaacgagtgatgatgacaaatgagttaagttctgtaaactctcatttcctcattggtggaaatagaataataataaagctactactgtcttaatgagattgtaagaaaacaaagtgcttagcactgtatttgctaaaaggacttaataaacaca

SEQ ID NO: 110051 - DNA, 220 bp, Homo sapiens
tagggctacagggcgtgtctcctgttaacctgagtgttctttttttgatgaaagcaataagaggactgcggaagagctccctgtcaatgtaccgctctacaccagtgtattacgacagttcgtacacaacagtctgtagaggccacctgtctctccctgctgcgttaggaattcaggggagcaggtggtggcagtaagggattttgagggaacggaaatc

SEQ ID NO: 110052 - DNA, 128 bp, Homo sapiens
tttgctattgagttgtaggatatccttacacattctgctcatatagtttgaatattaaccaaaccatgagatagatggtgtgcaaatagtttctcccatttcatatgatgtctttttcattcttgatc

SEQ ID NO: 110053 - DNA, 191 bp, Homo sapiens
attctttgtgatgggtatacatttgttaaataataataaggttaggatgctgatgtatagtatatacacaagcacttactattctacacaatttatttatttatttattttaattgagatagggtctcatcctgttgtccaggctctggcgcagtggtgtgatcacagctcactgtagcctcgacctctca

SEQ ID NO: 110054 - DNA, 764 bp, Homo sapiens
gagtaagcactggatcgtaacacaggaagggtgagggaagtgtctgggagtgttttttgtttgtttggggctgggatttttagatccagaaggttttcaacatatttcttagtttagcagaacgaaacagaggaatggaagagattgaagatgtaaaagagtgaaggaataattgtctgaaagcttggcatgagatcaagaataaaagggcggagactcttcctgtgatggaaggccaggggccaagaacagacaagcaagtctacaaaggagctttagatagagggttccccaggattggctttgagattctcagtgtggggggatctggagtaatctgctgagattaagtgttggaggaataggaacaggttaggggagagttttataggaatttttagagacagccattatgagaaatgtgacagggagggaactaatgatggataaaaggattcttgagtaacattaagtgcccagtcaagattagacagcaggcatttgaagtggagccaactcaacttcctctggctgtgcttggtacagctaaatcaagaggcagcaagatgtttcatgtggaaaaataaatttttaacactctattattctttaacggagggcaggaattgaagcatccttatatgaagataattcaaagacatccaatagaggtggcataaataccaaaaatttgaaaagtatgttgttccgcagccttgtttttaggctcaaataaacaccccattaagtagaatgtatacccc

SEQ ID NO: 110055 - DNA, 1197 bp, Homo sapiens
cagaagcagcaggagtgagctgtgggcacagctgtggggcagccaggcgcgtcaggcctcacatgtctgggagatgtaggctgcctgggctggtggcccctgagccgcatggcctccctgggccccaggacaccggccccgagcaggtcacgaggacggagggccatgtgttgggtcagcaccatcagctcctgcccatgttaactcagccgacaccgcagcagcatggtgacaggtccccccagggtgtctgcctctacagaggaagggactgaagcacccagagagctggcagcttcatggcggctgaagagatgcattggcctgtccctatgaaggccattggtgcccagaacctgctaaccatgcctgggggcgtggccaaggctggctacctgcacaagaagggcggtacccagcttcagctgctgaaatggcccctgcgctttgtcatcatccacaaacgctgcgtctactacttcaagagtagcacctctgcctccccgcagggcgccttctccctgagtggctataaccgggtgatgcgggcggctgaggagaccacgtccaacaacgttttccccttcaagatcatccacatcagcaagaagcaccgcacgtggttcttctcggcctcctccgaggaggagcgcaagagctggatggccttgctgcgcagggagattggccacttccacgaaaagaaagacctgcccttggacaccagcgactccagctcggacacagacagcttctacggcgcagttgagcggcctgtggatatcagcctttccccgtaccccacggacaatgaagactatgagcacgacgatgaggatgactcctacctggagcctgactccccggagcccggaaggcttgaggatgccctgatgcacccaccggcttacccaccacccccagtgcccacgcccaggaagccagccttctctgacatgccccgggcccactcctttacctccaagggccccggtcccctactgccacccccgccccctaagcacggcctcccagatgttggcctggcggctgaggactccaagagggaaccactgtgcccgaggcgggctgagccttgccccagggtacctgctaccccccgaaggatgagcgatcccctctgagcaccatgcccaccgcacccggcctccggaaacccccttgcttccgggagag

SEQ ID NO: 110056 - DNA, 1090 bp, Homo sapiens
cagaagcagcaggagtgagctgtgggcacagctgtggggcagccaggcgcgtcaggcctcacatgtctgggagatgtaggctgcctgggctggtggcccctgagccgcatggcctccctgggccccaggacaccggccccgagcaggtcacgaggacggagggccatgtgttgggtcagcaccatcagcttcatggcggctgaagagatgcattggcctgtccctatgaaggccattggtgcccagaacctgctaaccatgcctgggggcgtggccaaggctggctacctgcacaagaagggcggtacccagcttcagctgctgaaatggcccctgcgctttgtcatcatccacaaacgctgcgtctactacttcaagagtagcacctctgcctccccgcagggcgccttctccctgagtggctataaccgggtgatgcgggcggctgaggagaccacgtccaacaacgttttccccttcaagatcatccacatcagcaagaagcaccgcacgtggttcttctcggcctcctccgaggaggagcgcaagagctggatggccttgctgcgcagggagattggccacttccacgaaaagaaagacctgcccttggacaccagcgactccagctcggacacagacagcttctacggcgcagttgagcggcctgtggatatcagcctttccccgtaccccacggacaatgaagactatgagcacgacgatgaggatgactcctacctggagcctgactccccggagcccggaaggcttgaggatgccctgatgcacccaccggcttacccaccacccccagtgcccacgcccaggaagccagccttctctgacatgccccgggcccactcctttacctccaagggccccggtcccctactgccacccccgccccctaagcacggcctcccagatgttggcctggcggctgaggactccaagagggaaccactgtgcccgaggcgggctgagccttgccccagggtacctgctaccccccgaaggatgagcgatcccctctgagcaccatgcccaccgcacccggcctccggaaacccccttgcttccgggagag

SEQ ID NO: 110057 - DNA, 1172 bp, Homo sapiens
cgaggcctccgggctgattaggactaatggcgctcaggggtgcagcctcagcctccacccgccacccgtacccgccctgcctcaggacttcgttcctgctgtacccctgctggctgcctgtccccacaggtggctccttcctccccaccggaggagctgctcccaggcgggaccctgggggtggaatctctgaaatgccttcccctcgggaccctcaccgcgactggacttcgctcagcttcagaccctgggctgcagctgcctaatgagcttcatggcggctgaagagatgcattggcctgtccctatgaaggccattggtgcccagaacctgctaaccatgcctgggggcgtggccaaggctggctacctgcacaagaagggcggtacccagcttcagctgctgaaatggcccctgcgctttgtcatcatccacaaacgctgcgtctactacttcaagagtagcacctctgcctccccgcagggcgccttctccctgagtggctataaccgggtgatgcgggcggctgaggagaccacgtccaacaacgttttccccttcaagatcatccacatcagcaagaagcaccgcacgtggttcttctcggcctcctccgaggaggagcgcaagagctggatggccttgctgcgcagggagattggccacttccacgaaaagaaagacctgcccttggacaccagcgactccagctcggacacagacagcttctacggcgcagttgagcggcctgtggatatcagcctttccccgtaccccacggacaatgaagactatgagcacgacgatgaggatgactcctacctggagcctgactccccggagcccggaaggcttgaggatgccctgatgcacccaccggcttacccaccacccccagtgcccacgcccaggaagccagccttctctgacatgccccgggcccactcctttacctccaagggccccggtcccctactgccacccccgccccctaagcacggcctcccagatgttggcctggcggctgaggactccaagagggaaccactgtgcccgaggcgggctgagccttgccccagggtacctgctaccccccgaaggatgagcgatcccctctgagcaccatgcccaccgcacccggcctccggaaacccccttgcttccgggagag

SEQ ID NO: 110058 - DNA, 1644 bp, Homo sapiens
tgtggttgggggtcctgcggctgggacccgcccctgacccctccctgcccagaggggctgtctttgggtgcagaaggagctggtggggtccagccgggtgacccaggccgaggccggcagaagacagcctgatgccttgaagacttcctcttgcacttttgttggagggtgctggtttgctaaaagcagagagtatttttctttttatttattttgtttttaattttttaattttagctccagctcagttgcccagactggagagcagtggccaatcatagcttactgcctcctggaactcctggctcaatcgatcctcctggataagcctcctccgggtactatagcttcatggcggctgaagagatgcattggcctgtccctatgaaggccattggtgcccagaacctgctaaccatgcctgggggcgtggccaaggctggctacctgcacaagaagggcggtacccagcttcagctgctgaaatggcccctgcgctttgtcatcatccacaaacgctgcgtctactacttcaagagtagcacctctgcctccccgcagggcgccttctccctgagtggctataaccgggtgatgcgggcggctgaggagaccacgtccaacaacgttttccccttcaagatcatccacatcagcaagaagcaccgcacgtggttcttctcggcctcctccgaggaggagcgcaaggtgactgggggtccgaggacgagtgcaaggtgactgggggtgtgggcctgcaggcaccaggctggacctgccttgggggctcgctggtcctggggcgctggcctctcagccccgggcaaagagaaggtgtggctgggacacaggcagctgggtgggtgctgccccagctccatccccatgcccagagcctggtgccagcgcccacacaaggaacatgctgtcctgggaggtgcccctgtgggctgaggggagccacacagccatgttgtatccagccgggtcgcctcctctgaccttgggagtcacagcagagcaggcagggcagtgaaggtggaggggtgcggtggggcccaccctggtggcaccgtgcccaccacagccccgctgacctgcagagctggatggccttgctgcgcagggagattggccacttccacgaaaagaaagacctgcccttggacaccagcgactccagctcggacacagacagcttctacggcgcagttgagcggcctgtggatatcagcctttccccgtaccccacggacaatgaagactatgagcacgacgatgaggatgactcctacctggagcctgactccccggagcccggaaggcttgaggatgccctgatgcacccaccggcttacccaccacccccagtgcccacgcccaggaagccagccttctctgacatgccccgggcccactcctttacctccaagggccccggtcccctactgccacccccgccccctaagcacggcctcccagatgttggcctggcggctgaggactccaagagggaaccactgtgcccgaggcgggctgagccttgccccagggtacctgctaccccccgaaggatgagcgatcccctctgagcaccatgcccaccgcacccggcctccggaaacccccttgcttccgggagag

SEQ ID NO: 110059 - DNA, 736 bp, Homo sapiens
cagaagcagcaggagtgagctgtgggcacagctgtggggcagccaggcgcgtcaggcctcacatgtctgggagatgtaggctgcctgggctggtggcccctgagccgcatggcctccctgggccccaggacaccggccccgagcaggtcacgaggacggagggccatgtgttgggtcagcaccatcagcttcatggcggctgaagagatgcattggcctgtccctatgaaggccattggtgcccagaacctgctaaccatgcctgggggcgtggccaaggctggctacctgcacaagaagggcggtacccagcttcagctgctgaaatggcccctgcgctttgtcatcatccacaaacgctgcgtctactacttcaagagtagcacctctgcctccccgcagggcgccttctccctgagtggctataaccgggtgatgcgggcggctgaggagaccacgtccaacaacgttttccccttcaagatcatccacatcagcaagaagcaccgcacgtggttcttctcggcctcctccgaggaggagcgcaagagctggatggccttgctgcgcagggagattggccacttccacgaaaagaaagacctgcccttggacaccagcgactccagctcggacacagacagcttctacggcgcagttgagcggcctgtggatatcagcctttccccgtaccccacggacaatgaaggtcttctatgcccgtcatccactgccc

SEQ ID NO: 110060 - DNA, 1226 bp, Homo sapiens
tgtggttgggggtcctgcggctgggacccgcccctgacccctccctgcccagaggggctgtctttgggtgcagaaggagctggtggggtccagccgggtgacccaggccgaggccggcagaagacagcctgatgccttgaagacttcctcttgcacttttgttggagggtgctggtttgctaaaagcagagagtatttttctttttatttattttgtttttaattttttaattttagctccagctcagttgcccagactggagagcagtggccaatcatagcttactgcctcctggaactcctggctcaatcgatcctcctggataagcctcctccgggtactatagcttcatggcggctgaagagatgcattggcctgtccctatgaaggccattggtgcccagaacctgctaaccatgcctgggggcgtggccaaggctggctacctgcacaagaagggcggtacccagcttcagctgctgaaatggcccctgcgctttgtcatcatccacaaacgctgcgtctactacttcaagagtagcacctctgcctccccgcagggcgccttctccctgagtggctataaccgggtgatgcgggcggctgaggagaccacgtccaacaacgttttccccttcaagatcatccacatcagcaagaagcaccgcacgtggttcttctcggcctcctccgaggaggagcgcaagggagattggccacttccacgaaaagaaagacctgcccttggacaccagcgactccagctcggacacagacagcttctacggcgcagttgagcggcctgtggatatcagcctttccccgtaccccacggacaatgaagactatgagcacgacgatgaggatgactcctacctggagcctgactccccggagcccggaaggcttgaggatgccctgatgcacccaccggcttacccaccacccccagtgcccacgcccaggaagccagccttctctgacatgccccgggcccactcctttacctccaagggccccggtcccctactgccacccccgccccctaagcacggcctcccagatgttggcctggcggctgaggactccaagagggaaccactgtgcccgaggcgggctgagccttgccccagggtacctgctaccccccgaaggatgagcgatcccctctgagcaccatgcccaccgcacccggcctccggaaacccccttgcttccgggagag

SEQ ID NO: 110061 - DNA, 702 bp, Homo sapiens
cagaagcagcaggagtgagctgtgggcacagctgtggggcagccaggcgcgtcaggcctcacatgtctgggagatgtaggctgcctgggctggtggcccctgagccgcatggcctccctgggccccaggacaccggccccgagcaggtcacgaggacggagggccatgtgttgggtcagcaccatcagctcctgcccatgttaactcagccgacaccgcagcagcatggtgacaggtccccccagggtgtctgcctctacagaggaagggactgaagcacccagagagctggcaggtgccgttttgcagaggccactttcccgagggagctggttgcaagggcccggcgggatgggacctgggcggggcctcagagccgaggctcccgcgccggccgtggatttccaaccaagctgtgtggactggcaggtgttgggggagtggagcgggaggcctcgtttgcatcgaaggcttcttgattccaggctgcaccaacagatgtgggcctcctgtcccaagcgcccaccaacctccttgcagcgtggggaaactgaggcccgcagggggctcacgtgcctcccgcgcacggtgacgcggcagggggcggggccgggaggggcgcgccgggatcctcacctgcccgcccagtcccccgccgagaggggaggagccggcggctgccaggccagggccggcgggcat

SEQ ID NO: 110062 - DNA, 1014 bp, Homo sapiens
gcgggcgggacggagctgcggcggcggcgggtcccgcgggcgggagcgcctggcggccgagtcaagccgccgcctcgacccagggcccgcgggccaggagagcgctcggcggcttcatggcggctgaagagatgcattggcctgtccctatgaaggccattggtgcccagaacctgctaaccatgcctgggggcgtggccaaggctggctacctgcacaagaagggcggtacccagcttcagctgctgaaatggcccctgcgctttgtcatcatccacaaacgctgcgtctactacttcaagagtagcacctctgcctccccgcagggcgccttctccctgagtggctataaccgggtgatgcgggcggctgaggagaccacgtccaacaacgttttccccttcaagatcatccacatcagcaagaagcaccgcacgtggttcttctcggcctcctccgaggaggagcgcaagagctggatggccttgctgcgcagggagattggccacttccacgaaaagaaagacctgcccttggacaccagcgactccagctcggacacagacagcttctacggcgcagttgagcggcctgtggatatcagcctttccccgtaccccacggacaatgaagactatgagcacgacgatgaggatgactcctacctggagcctgactccccggagcccggaaggcttgaggatgccctgatgcacccaccggcttacccaccacccccagtgcccacgcccaggaagccagccttctctgacatgccccgggcccactcctttacctccaagggccccggtcccctactgccacccccgccccctaagcacggcctcccagatgttggcctggcggctgaggactccaagagggaaccactgtgcccgaggcgggctgagccttgccccagggtacctgctaccccccgaaggatgagcgatcccctctgagcaccatgcccaccgcacccggcctccggaaacccccttgcttccgggagag

SEQ ID NO: 110063 - DNA, 620 bp, Homo sapiens
catgtgtgcatgtgtttgtcagtgtatccgtgtgtgcatctgtgtatctgtccatgtatccgcgtgtgcctgtgtgtacctttgtgtgagcatcaagggacctcccaggcctggtgctcaccgtccgccccaacgcaccctgcattgcagcgactccagctcggacacagacagcttctacggcgcagttgagcggcctgtggatatcagcctttccccgtaccccacggacaatgaagactatgagcacgacgatgaggatgactcctacctggagcctgactccccggagcccggaaggcttgaggatgccctgatgcacccaccggcttacccaccacccccagtgcccacgcccaggaagccagccttctctgacatgccccgggcccactcctttacctccaagggccccggtcccctactgccacccccgccccctaagcacggcctcccagatgttggcctggcggctgaggactccaagagggaaccactgtgcccgaggcgggctgagccttgccccagggtacctgctaccccccgaaggatgagcgatcccctctgagcaccatgcccaccgcacccggcctccggaaacccccttgcttccgggagag

SEQ ID NO: 110064 - DNA, 1249 bp, Homo sapiens
tgtggttgggggtcctgcggctgggacccgcccctgacccctccctgcccagaggggctgtctttgggtgcagaaggagctggtggggtccagccgggtgacccaggccgaggccggcagaagacagcctgatgccttgaagacttcctcttgcacttttgttggagggtgctggtttgctaaaagcagagagtatttttctttttatttattttgtttttaattttttaattttagctccagctcagttgcccagactggagagcagtggccaatcatagcttactgcctcctggaactcctggctcaatcgatcctcctggataagcctcctccgggtactatagcttcatggcggctgaagagatgcattggcctgtccctatgaaggccattggtgcccagaacctgctaaccatgcctgggggcgtggccaaggctggctacctgcacaagaagggcggtacccagcttcagctgctgaaatggcccctgcgctttgtcatcatccacaaacgctgcgtctactacttcaagagtagcacctctgcctccccgcagggcgccttctccctgagtggctataaccgggtgatgcgggcggctgaggagaccacgtccaacaacgttttccccttcaagatcatccacatcagcaagaagcaccgcacgtggttcttctcggcctcctccgaggaggagcgcaagagctggatggccttgctgcgcagggagattggccacttccacgaaaagaaagacctgcccttggacaccagcgactccagctcggacacagacagcttctacggcgcagttgagcggcctgtggatatcagcctttccccgtaccccacggacaatgaagactatgagcacgacgatgaggatgactcctacctggagcctgactccccggagcccggaaggcttgaggatgccctgatgcacccaccggcttacccaccacccccagtgcccacgcccaggaagccagccttctctgacatgccccgggcccactcctttacctccaagggccccggtcccctactgccacccccgccccctaagcacggcctcccagatgttggcctggcggctgaggactccaagagggaaccactgtgcccgaggcgggctgagccttgccccagggtacctgctaccccccgaaggatgagcgatcccctctgagcaccatgcccaccgcacccggcctccggaaacccccttgcttccgggagag

SEQ ID NO: 110065 - DNA, 1485 bp, Homo sapiens
cagaagcagcaggagtgagctgtgggcacagctgtggggcagccaggcgcgtcaggcctcacatgtctgggagatgtaggctgcctgggctggtggcccctgagccgcatggcctccctgggccccaggacaccggccccgagcaggtcacgaggacggagggccatgtgttgggtcagcaccatcagcttcatggcggctgaagagatgcattggcctgtccctatgaaggccattggtgcccagaacctgctaaccatgcctgggggcgtggccaaggctggctacctgcacaagaagggcggtacccagcttcagctgctgaaatggcccctgcgctttgtcatcatccacaaacgctgcgtctactacttcaagagtagcacctctgcctccccgcagggcgccttctccctgagtggctataaccgggtgatgcgggcggctgaggagaccacgtccaacaacgttttccccttcaagatcatccacatcagcaagaagcaccgcacgtggttcttctcggcctcctccgaggaggagcgcaaggtgactgggggtccgaggacgagtgcaaggtgactgggggtgtgggcctgcaggcaccaggctggacctgccttgggggctcgctggtcctggggcgctggcctctcagccccgggcaaagagaaggtgtggctgggacacaggcagctgggtgggtgctgccccagctccatccccatgcccagagcctggtgccagcgcccacacaaggaacatgctgtcctgggaggtgcccctgtgggctgaggggagccacacagccatgttgtatccagccgggtcgcctcctctgaccttgggagtcacagcagagcaggcagggcagtgaaggtggaggggtgcggtggggcccaccctggtggcaccgtgcccaccacagccccgctgacctgcagagctggatggccttgctgcgcagggagattggccacttccacgaaaagaaagacctgcccttggacaccagcgactccagctcggacacagacagcttctacggcgcagttgagcggcctgtggatatcagcctttccccgtaccccacggacaatgaagactatgagcacgacgatgaggatgactcctacctggagcctgactccccggagcccggaaggcttgaggatgccctgatgcacccaccggcttacccaccacccccagtgcccacgcccaggaagccagccttctctgacatgccccgggcccactcctttacctccaagggccccggtcccctactgccacccccgccccctaagcacggcctcccagatgttggcctggcggctgaggactccaagagggaaccactgtgcccgaggcgggctgagccttgccccagggtacctgctaccccccgaaggatgagcgatcccctctgagcaccatgcccaccgcacccggcctccggaaacccccttgcttccgggagag

SEQ ID NO: 110066 - DNA, 781 bp, Homo sapiens
cagaagcagcaggagtgagctgtgggcacagctgtggggcagccaggcgcgtcaggcctcacatgtctgggagatgtaggctgcctgggctggtggcccctgagccgcatggcctccctgggccccaggacaccggccccgagcaggtcacgaggacggagggccatgtgttgggtcagcaccatcagcttcatggcggctgaagagatgcattggcctgtccctatgaaggccattggtgcccagaacctgctaaccatgcctgggggcgtggccaaggctggctacctgcacaagaagggcggtacccagcttcagctgctgaaatggcccctgcgctttgtcatcatccacaaacgctgcgtctactacttcaagagtagcacctctgcctccccgcagggcgccttctccctgagtggctataaccgggtgatgcgggcggctgaggagaccacgtccaacaacgttttccccttcaagatcatccacatcagcaagaagcaccgcacgtggttcttctcggcctcctccgaggaggagcgcaagagctggatggccttgctgcgcagggagattggccacttccacgaaaagaaagacctgcccttggacaccagcgactccagctcggacacagacagcttctacggcgcagttgagcggcctgtggatatcagcctttccccgtaccccacggacaatgaagactatgagcacgacgatgaggatgactccagtaggggctgttgcctccaataaagcagcagtgagctttgca

SEQ ID NO: 110067 - DNA, 727 bp, Homo sapiens
tgggcgtgggcatgggggtggtgggtaagccggtgggtgcatcagggcatctcaagccttccgggctccggggagtcaggctccaggtaggagtcatcctcatcgtcgtgctcatagtcttcattgtgggtgcggtggggcccaccctggtggcaccgtgcccaccacagccccgctgacctgcagagctggatggccttgctgcgcagggagattggccacttccacgaaaagaaagacctgcccttggacaccagcgactccagctcggacacagacagcttctacggcgcagttgagcggcctgtggatatcagcctttccccgtaccccacggacaatgaagactatgagcacgacgatgaggatgactcctacctggagcctgactccccggagcccggaaggcttgaggatgccctgatgcacccaccggcttacccaccacccccagtgcccacgcccaggaagccagccttctctgacatgccccgggcccactcctttacctccaagggccccggtcccctactgccacccccgccccctaagcacggcctcccagatgttggcctggcggctgaggactccaagagggaaccactgtgcccgaggcgggctgagccttgccccagggtacctgctaccccccgaaggatgagcgatcccctctgagcaccatgcccaccgcacccggcctccggaaacccccttgcttccgggagag

SEQ ID NO: 110068 - DNA, 678 bp, Homo sapiens
gcaggggccagggacaacttggggagagggaaagaccccttcccgtttcccgtctgcaccttggagcccctgtccaacacacgcacccaacacacaccctgcacacacacaccccaggatgcaaatgataaccgccgcgccatcgcttgtgaagcttgacagaaaataatgagaaacactaaatcttttataaggtcaacacttgccttagccgagcagctgtcaaacaagaaaagaatttagcgccggagccacgaaacttccatcggctcattaaacccaacagggcccgggcctggcgtggcgaaggagacgcggggccttccgttttgtgtcagtaatttgcggtggaggaggcggaagaaacagccagcgccaaaggggcctgggggctggctggggaatcgttagcgcgccaggagcggcctcggctcctaattggaagcattgggcattatcaacggaggatttgcctcagttccctgacagctcgtgggcccaaaatgatcgcccacttgtcagtgtaaaagaccattaaaaacaaaccattttgatttaattggaggcggtgcaccgcggggccaggtgaggggctcgtcagcccggctcccccaagctgccacccccctctccctctgtgtgatggggctcggggggtggggtgggagagagtgtgtg

SEQ ID NO: 110069 - DNA, 390 bp, Homo sapiens
tgtctgcccattcactgaatgtcctgcacctttggtattttcccaaacaggagacagctaggctcagcaccatcctggtcctaagaaactgcctagaccttactttaaaaatacatgcttagggtggcctccaggcaaaagataaaaatttaaaaataaaaaatgaaataaaataaaaatacatgtttagatcctcttgcatttgccttaccatatgatgagaacctaatgcaaacaattattttggcaaacaagtatgttcaaaaaatgcatataaaattgtgagtagaataaagctatatatgtatgccatatcaaaaaccctggttgactcaacaaaactagcgcaatacctgaaatatttattgagaggaaaattgaaataaatta

SEQ ID NO: 110070 - DNA, 290 bp, Homo sapiens
aagattctgtttcaaatatagccacagaaataaagaagggacaacaatctgggacagtgtctcctcagaaacaatcggcctggaaggttatatttaaaaagaaagtttctcttttgaatattgccacaagaataatgggtggtgggaaatctggaacagtgtcttctcagaaacaaccagcctcaaaggctacaagtgacaagacagattctgctttgaatatagctacagaaataaaggatggactacagtgtgggacaggtaattttgcaaaacacatttaatgtcat

SEQ ID NO: 110071 - DNA, 519 bp, Homo sapiens
tgcatgatcacagtgaatcttatataaagtgaaaaataccactattactgaattataatatgctagaaaagctgttgatggtaatgtggtctatttttaatttacttcatttggaccatcaccatgaaaataaatctcaggatggtttgaacaaatgaataacccacttgcccagcctatcctccaagaaaatatattgtggcaaattccattcttcagcttttgctgaccctgttgtgttattctccccattccctccctcctgccagtcaaatatttgtgtacccgatgttacgtgccagactccgggaagaataccagcagtttaagacaaaagccccttccttcaggaaatgtgtgatccaattggcttgttataaaatgttgttttgtaatgttgaaatttctgagtgtaagccatccttactgttaatatgtgtttgaaaaccctaatgtgtgcaaacatttaaaaagatatgaataatcagcctgggcaacatggcaagactgtctgtacaa

SEQ ID NO: 110072 - DNA, 879 bp, Homo sapiens
attcctcttatttttcttttcttttccttctcttcctcctcctcccctcaagttttgaaaaaagtgatgacagacaatatattttttttcatttttcgagattgcaagctaattgaggaccaagtttgtgttttttattacttgtatttctggaaatttgcacaaaaagtacctggggcctgatcaagtttcttgattaatattcagaacacttgagttgacatttgggtactgctgctttgcaaatacaggctcaactccataatcatagggaaagaatttgatgcattttataaaatcgtcatgggttatcttactttttaaaacctctatatggtaaaggagcagggaaaatttgaatacatatttagaagtataaaaagctaacagcaaagctacaacttccattaggtggatggctcatttttaacaggatattcgtccttgggataggcctgagacctgaagctaatcttagtatgtctctctcctcctacgcagtgttttaattcagttccttctttttaacattttatttagaaaataaaattaaccattttaaagtgaacaatttggtgacatttaatgcattcacaatgttgtacaaccactatttctatctagttccaaaatatttctatcactccaaactaaaacctcttactcattaagcagtttcttcccattccctcctactcccagcccctggcaaccaccgatctgcattctgtttccatggatttctctattctggatatttcatataaatggagtcatacgatgcttcttttacttagcataatgtttttgaggttcatccttgccaacaccttgccgactgtactcatttcagagctatgactattcatttcaaataag

SEQ ID NO: 110073 - DNA, 778 bp, Homo sapiens
atcagtatttttcctgcctttcttacgtcatggagaagtgttggactccccttgctacctcccactgccatggaggaagcaaaggatgctggtgtagaatttgcagttcatgttttcagcttgtgctaatgaatggaggatctgagcatacatgctggacaggtacttcacattattctaggtagattacaaacatctgtgcttctcttggatgtaaactcatctcgagtctccttttcttgccttcttccttttctccctactatagctgacttctctttgcagagtcatacaaatgtaactgagttttggccctgttgagtcaaactctgttgagttttgctggttaccataaaaaaaaggcgggcaggttgggggagctttaagacactttggttagtccaagcctggctcattttcagatttagcgaattctttatcccagcaagctgtgaaaggcaatgtggggaagacattgtcagcctttctgggctcagtgggaaccttgtaagtgagcaagggcttgttctagaggagaactgaacttttctagcttcctgagatcaggcttgccataaacaggtgaccagaaaaatctgtttgcaaggagagagtggcacatggactagcgtttagcagtggaggttgctgaaatctgtgttagaaatcaaggtgctctgaagatctagtttctctttttcctttccctgctgccatagaagacaaagaatattcttgtctccttttaacatagtataagtgataataccattctatt

SEQ ID NO: 110074 - DNA, 199 bp, Homo sapiens
aatttggcatgagaactcagttcttcagattcttaatttactatgtccacacagtactaaagagagtgttatgcaaatactgaaacaatccatggaaagtcaggaaagattccatgactctagcctaggtcttaggatgcccattctgatctccactaccttaacttgggctttctctacgctaatcttatttatggac

SEQ ID NO: 110075 - DNA, 226 bp, Homo sapiens
caagcagctacccttactattacagagtcttcataacctaacttcaaattgttctataatattctatttaataaatggctcagagttaagtaaatgttttctttttggtgaaatgtagtgttttaataactgaaaaaaagatcaatttcttcaatttgtagtggataaataaatgaattattatctgccatctcctgggtactctgtgtaaaataaaataaaataa

SEQ ID NO: 110076 - DNA, 676 bp, Homo sapiens
aaggagggagggagggggcattcgtagcagggtctctggcaaagggggagccatgaaagcctgaagcgaggtgggttgtaagcagaggtaccttatctctcaggtttaagtcaaccccagcaatgaggagcatatctgctatgtcctgccaggcgtgctctgcagccaggtgaaggggcgtctgctgcctctaggggagaagccaagggaataggtaagtgtatatttcttctagtcttttctttaatgcagaatgttttcagtttgttggttttacatacatgagatcatcttatatgtacattttacatcttattttttttaccccaacatgacactttttgtgtactataaactctgataaacgccatttttgataactccatactagcctatttttgtctgtgccataatttacctaaccacttccctattattaaatatttaggccattttcaaattgaagactgataaataatactgcagtaaatatctctgtgcatgagcttttaatatgtttctcaaggctgagttcccagcagtgctcacacatatcatttaaaggtatatgacatattctgccaaattgctttcagctcccagtggctctgtgagccatgcccttgctggtactgagaattatatggttggtgggtagattgtggggacaggattt

SEQ ID NO: 110077 - DNA, 730 bp, Homo sapiens
aaggagggagggagggggcattcgtagcagggtctctggcaaagggggagccatgaaagcctgaagcgaggtgggttgtaagcagaggtaccttatctctcaggtttaagtcaaccccagcaatgaggagcatatctgctatgtcctgccaggcgtgctctgcagccaggtgaaggggcgtctgctgcctctaggggagaagccaagggaataggtaagtgaaaagcatgtaggggtggcccactaccctaagtcagcccccacaatgatcctagtatatttcttctagtcttttctttaatgcagaatgttttcagtttgttggttttacatacatgagatcatcttatatgtacattttacatcttattttttttaccccaacatgacactttttgtgtactataaactctgataaacgccatttttgataactccatactagcctatttttgtctgtgccataatttacctaaccacttccctattattaaatatttaggccattttcaaattgaagactgataaataatactgcagtaaatatctctgtgcatgagcttttaatatgtttctcaaggctgagttcccagcagtgctcacacatatcatttaaaggtatatgacatattctgccaaattgctttcagctcccagtggctctgtgagccatgcccttgctggtactgagaattatatggttggtgggtagattgtggggacaggattt

SEQ ID NO: 110078 - DNA, 134 bp, Homo sapiens
ctcagaagctgtttcagagctgcttcaggaaccaaggataagaggccaactacttcaacaaaagatattctttctgctctagtcacttaagaaatgatgaggcttacaagacctgtgttgagccaggaaccacc

SEQ ID NO: 110079 - DNA, 495 bp, Homo sapiens
ctttccccacgggagtaaagaggctgcaccagatggcattgcccctgcttccccaaggtccacaggctgtgccaggtgaacgtcctgcttgcctgtgggacctgggcaggcagcttcccggtcagtgcctgtacagagtgtgaaagggtcagaatccagtgcccaccctgccccagccccaacacactgtgaacagtttgcagagtctggccttgtggtcactgacttgggagtacgtttgacagcctccgtctgctgccttgggtccagggagcaaggcgagctctgggccttcaagcagctgcctgcacctgctttcttgggtattggggaccatgcgtctatgagccagaatacggctttaagtattttggggaattatgaaaacccttgaattgttgccaccctgggtggctgtaaaaccaagttctgcatcgttttcctcatctctaagatggagataatgttactttcttcaaagttgccttgagaaaa

SEQ ID NO: 110080 - DNA, 245 bp, Homo sapiens
cagatacttggcctcaggctctattgaattccaggtcaaggttttactgactccacacccccaccttgttcctccgggtagcaaagaagcacacagcctctggtttaccaacgggctttcctgggagattggaaatgccccaggtgggatccagatcgccagcgctcaccccacccccaatacgtgggccactgagtcaggccaggatgaggctcttgctccccgggcatgttctcctgccccag

SEQ ID NO: 110081 - DNA, 437 bp, Homo sapiens
caagggattggctgccttatacaaagaggaataattttgtattttacctcaaggtgcttatcaagaaagccaaaatcataaaaagacagacttgtggaattttggcggcttcctcttgaaactagaacaaaaactctgttctaggtacttgagtaggttgttctgaggggcatgtgggtatacatgtaagttcctggtgttcccatattagatattactgactctcagtccagttctgtttgcatcccattctgcggcatcccacagttatatggtgctgtgaattattgcactggggttgttagggtagagaaaactgaaacaatgagtcatccttgcctttcactttcctaaattgcccacaagctaatgtcccaaactcagtatttttcccttacagatcattctgagtattgctgctgtaacaattttcctaa

SEQ ID NO: 110082 - DNA, 471 bp, Homo sapiens
gccaagaaatgccaagagccaccagaagctcagaatgcctgcaggggcaatgtgtccctgccaacactttgagttcagtccagaaatactaatttcagacttccgaccctcaggatagtgagggaataaatttctgctgttttaaagctatccagtttcgcaattttttacagcagccacaggaaactactgtactatattcacacaaaaacctatatatgaatgtttatagaaagcttattcataattgccaaaaactgaaaccaaatgtccctcaataggggaagagataaacaaactatggtgtacctaccacaccatggagtactactcagcaacaaaaaggaacaaactattgacaactacatggatgaatcccaaatgcatgatgccaaatgaaataagccaaacttaaaaaactatacttgattccatttatatgacagtctggaaaatgtaatattataggga

SEQ ID NO: 110083 - DNA, 594 bp, Homo sapiens
tggggctcttgcatgggtcgggactctggttgattgcagcatcgtagagcctaactgctgggaggtggggcaaccccagcgagaaactcctaggaggaagcacctccctgtggtggttggggcaacttgtggagcagggtgcttgagaaaagagcacagggcttagaggaaggagtaaggctcctatctctgtctgctactcgctccccacctgcctgagatggtgtgcaggtcaccccctctttggacttggacttttcttcctgtgtaaaaaccaccaccaagaccgcttttcaagcacttactgccaggcactcactatcccaggtgatttacatatattaactcacttaaaacagtgcttgaaatggctacctcacagggtgattttgaagattatataacacagtgtgtgaaagtagaagtgttaaaaggaaaaataagggagccacagtgttaatgaagttattttccagtaaaaaaaatcatgtttaaactttgtatatgaatatatacatacgtatatatacactgaagtaaatagtactgaaaacagcaacaacagctttttaagcaacattccagcaggttcct

SEQ ID NO: 110084 - DNA, 364 bp, Homo sapiens
gagaaggaccaagataaatcatcatgtttaaataaggtttaacaacttcatagcatggggatgttctcataaaagtagactatgtttggctgggtgcggtggctcatgcctgtaatcccagcactttgggaggccgagatgggtggatcacgaggtcaagagatcaagaccatcctggccaacatgaggaaaccctgtctctactaaaagtacaaaaattagccgggtgtagtggcatgtgcctgtagtcccagctaccttggacgctgaggcaggagaatagcttgaacctgggaggcagaggttgcagtgagccgagattgcaccactgcactccagtctggcaatagagcgagaccccgtc

SEQ ID NO: 110085 - DNA, 795 bp, Homo sapiens
aaaacaaaaaaaaaccacaaacatctccccaggaaatagaactaatatgcaggtctttaaaagttcagtttatcaatgagaaaaagataaaccaactcacgagataaatgggcagagtacaggagcagtcacagaagaggagacacggctggccagtaagcacaaagagaaatgaaatggttttgattcccttacacatcttagcccccttcctctgtctacatggcccgtaaaagccacagaactgaacagttttccagttccctcagtgagcctgctttgtgcagtggtatgttactgtcagaagggatcctcttcgaagctgtggtatttgagaatgactgctcctcccaccgcttttctgagggtgttagcaggagtgcaacagagccttacttcaaggcccccagcgggctggctggaaccctgcttcagctcctccaagcacgtgcggccaagttctgggagccacgtcgatgtgggttgatgggtcccctgagacgccctctctgctcagaacacagccagtaagccatgggcagatcacaacaaacagcaccctgccttctgctccgcctccctccatctaccacactgccaagttcctaagaagcttaggggagaaggaactgctgtggtgcttagaatgcagtgtcttgcctgaaagtattttctcagtctttgagaaaacagtggaactgactcatctggtcagagctttacagaaatgtgattgcagatctcttgcaatttcattctgctttagtgtcagaattcatccgacaacgtgccaaa

SEQ ID NO: 110086 - DNA, 396 bp, Homo sapiens
gatcgcgccattgcactccagcctgggaaacaagagcgaaacattgtcacacaaaaaaaaaaaaagaaaaaagaaaaagaaaaaaggactcgggccaggcgcggtggctcacccttgtaatcccagcactttgggaggccaaggcgagtggatcacttgagctcaggagttcaagatcagcctgagccacagagggaaaccccatctctattaaaacaacaacaacaacaattgataagactcctgatataagttaataacatacacccagattattgataatctttcaaaagctctcacacccatttcattagctagtgatttatgcactctccctactatgtgcacagttttgcaacatgagcccagccaacatctatctaccttccaaacacc

SEQ ID NO: 110087 - DNA, 134 bp, Homo sapiens
agcgaaaagcatgtacttattaagggatgacaaggtgaagccaaggagaagacaagaaaggaggtaaggatgaagaggggtagttagggcaggaaatgcattatctcagaggatggctccacaagaaccctgag

SEQ ID NO: 110088 - DNA, 754 bp, Homo sapiens
tggccagtgcctggaggctggggcaggagaatcgtttgagcctgggaggcggaagttgcagtgagctgagatggtaccactgcactccagcctggaggatagattgagactctgtctcaaaaaaaataaaaagaaaaagaaaaccctcaccttctataatcaaataggtttttaagtgttttcctaagcttgatagcacttcagtctctcagaggaattctgcagtcctgcagttgtcttgggtcaaccagccaaaagttaactaatttgcataatggcagccccataaaatgcgcaaaattattatcttttatatgaatgcttattaatatatatatatatatatatctccttttacatctatctagaaaacgttttaagggaagaatcatatagcttcaaacatttttgttaattacaatatggaagaaaagagagttcaattccttaatctatcatgtgtgagttaggggactttaagcaagttattttcttaggaatcctgtttcctgacctatcaaatgaatgtaagaatagctacctcacataagtgtgaggacatagataatttctataaaatcatttagttagagtcttggcacatagtaggagccctgctctcagtacaagtttaaaatgtctgttgaatgctaaaagattactccattgagctttttcaaactttaaagtgagtatagtgtttcactgtaggattccaaaagctgtttgatgctatgatttctttctcaacatc

SEQ ID NO: 110089 - DNA, 393 bp, Homo sapiens
gtatttcagatttgcaagaagcaaaagctctggggattggttgcacagccatctgaatgcacttactactgaacagtactcttaacagtggttaaaaaggtaagtgtgatgttctgtgtattttaccataattaaaagaataaaaaagtaagttttggccaggcgaggtggctcacgcctgtaatcccagcactttgggaggccgaggcgggcggatcacctgaggtcatgagttcgagaccagcctggccaatatagcaagacccctgtctctaaacagatagatgatagatagacagacagaacagatagatagaagaaaagaaaagggtcacttggcactaggtcttcacaggtaaagattcagagtgtgataggaagcacaggctcagg

SEQ ID NO: 110090 - DNA, 854 bp, Homo sapiens
atcaccatatccctgagaggccagtttgacctttgcattcttacccaagccccaaatctagcatcagtgagtcaagagataaagagcttctagaatacaaagagcctgacattccttccaacacttagatcactcttttccccagcactccagtctccctccaaaggagtccctttccatgacttgcccttcccttctccagaaggggggccttggaaaaagaaaccatgcttgatataatgcagccattatagctccttggcccttctggccctctccccggggagactgatgcaagaggagaaaacgtggagactgccagttttctgcaaggaggaaaggggggaagtgagacacatgggagccatggaagaggctggaaaagagccacaagtacagaagtcataaagaccccatttctccttcaaccggctgaggaaagtccggcccagctccacctactcaatgatatcattgttttcaacaaaagccggtttcagaatccctagagaggtccccaatgaagcctcagctgctggaatgggcagaggtctcaccagttcctaagagaccaagtgcttagaattttagataaggaggagaaaacagagaaaaccaggggaggcacagattttgcttctgctgggcctgtcagcgttatggaaagagtacaggacactgcttttcacacaggttttattattgcatccccatgatgatcctgccaaggtggtgactaggaattattacctagtctaattagtccattgagtctaattacctatctaatgagaaacctaaagatccaaggaaagaggtggcttgtccaaggtcccaccacaagctaaggaaaa

SEQ ID NO: 110091 - DNA, 418 bp, Homo sapiens
gtgtatgaaatttgatgataactgactcagcactaacattctagtttagtttttttttttaaagagcgtgtctcattacagattattgtaaaataactataaaaacttgattttttacagtattgtcttttagaaactacttgaaaactaggtacaacatacatcatcagtaacagtacatttatataattgaggaatgcattttgagatgagaatatgtactgtgatgtgtaactatcaaatttgtgtttaatcacttgtttccatgggccaaatagctaaattttggctttactttgaatgattgtattttagaagttggtaatgcaactaaatttgaggaatttttttctgcattttagtaccattagattaaaagctgaaattggtgttttaaagtaagctccttttacctttg

SEQ ID NO: 110092 - DNA, 667 bp, Homo sapiens
aagcagcagacctggcacaagaaatgaagagagagctcagtgtattaaagatgaaaacaagaaaaccgaatatattgaaaggagcagagaggcaatgaaaacaagacaactgaaatgaggactttgccaaaagcttcaagaagtagccaacataactcaacatccaaaatgtctcctgccatttcccttaacactacagcctcagctggcacgtgattggaatctcaaggcatgacaagcaagagtccaacgcaaatgtcttgccgccacccagcaagtgttacagacatccagcctattctagctggaccctcactgctctctgccctgccacctcaactcagccattctgtattttcagatattatctgtgctgctctatttactgcaactaaattcaaaggaatgtgtttggctacaagtaacagaggataggtcaataaaaaggattttatttagtctacaagaaatctggacaaaggtggttccaggagtgggaggaggacaaaggcggagagcgatttggagcacagccagacagcagcgtttgccatgggatcatgcctattgatcttagttttccaacctccaacttggaaatagataaaccatctgtcttcccttcctggggagtagcaggttatgaataaattatgctgccagagcc

SEQ ID NO: 110093 - DNA, 759 bp, Homo sapiens
tgccaaaagcttcaagaagtagccaacataactcaacatccaaaatgtctcctgccatttcccttaacactacagcctcagctggcacgtgattggaatctcaaggcatgacaagcaagagtccaacgcaaatgtcttgccgccacccagcaagtgttacagacatccagcctattctagctggaccctcactgctctctgccctgccacctcaactcagccattctgtattttcagatattatctgtgctgctctatttactgcaactaaattcaaaggaatgtgtttggctacaagtaacagaggataggtcaataaaaaggattttatttagtctacaagaaatctggacaaaggtggttccagggtaagtttagcacttccatgacatcaaggcaccaggttgttatcttagccagtctctggccttcccctcatggccacaagatggctgccacagcttccagggttatcctcacctaacaacatccaaaggcagaaaggagggtcacagaagagtgttatctttgcatgcctccctcctgtgatcagagaagagaaatccttcccagaggcctactggcatagttctgttatactgccttcagttgcaaaggaagcttgtaacatgaatctctggcattttcattctttagagtgggaggaggacaaaggcggagagcgatttggagcacagccagacagcagcgtttgccatgggatcatgcctattgatcttagttttccaacctccaact

SEQ ID NO: 110094 - DNA, 447 bp, Homo sapiens
aacagacttgagcgagactggctcaatgacaagttactcagtctcttggggcccctgtttgatctgtaaaatggggatcatgatcagatcaatgtgaggattaagcgagggatgtaggaaaatgctaggtcagtgcattttcctggcgcgaagtaaatgttacttctctttaactgttgcctttcggtgtttgtggtatgtaattaccttttttgctactcaaaattcagatttagagtttgtagtactttaaaaatttttcccatttaaattttatgtcagaaattataatgggttctgcatgggatattttaagaaactcagcattgttatgaagcaaatgaattctgtgtccttgtgtctgtgctattggattgcacatttgacaccaacaaatatcagtgttctgtacaggcgatgtctttaaaagccatttttcatttgttc

SEQ ID NO: 110095 - DNA, 337 bp, Homo sapiens
taccacctgggcctgcagacacttgatcatctctgggcctgcctgcagagaaaaaaggacctcagttcctgtatctttagatacttttctaaatggcagtgggtataaataaccaaagaatttgaagtagacaagctttagtgaatactcttcagatatgatgtttatatttgtgtacatattctaactacctgttggattgtattattcttaagggtaggaaataattctctctctgtttctgtcacctctattggtatattatggatacaaacacttactagcaagtgctttctagtggtggggaaggcttatagttgttctaaaggcgtatagg

SEQ ID NO: 110096 - DNA, 454 bp, Homo sapiens
catctgtcaaagattggctcagccaggaagcacctctggcctcccaaactgcagtcacctcgctctgccctgaacttgctatctgtgtgggtgacttacagtagcagagccggcctcttgcagttctcacttctatttcctgtagtgacctctctcccacaggagatagcgggcccttgatggcagggaccccctaggtcccccagagctggaagctcagtgctcctgacatatactgcaagagattttcaccatcttctttaaacatgcgttttctttttgcctcaataaactgtgtgacctcggcaaagtcacttcaccagtctggacttcagattcttcatatttaaataaagagatcccagaatgaaataccatgccctgtagatgggctccttctgactggcatgcgtgctgctaccatcccctctcctgccagcggcagatatcacta

SEQ ID NO: 110097 - DNA, 280 bp, Homo sapiens
acaatgaagaacacagactttacaaaaatagttttaaaagactcattaaacaaccaccagaacaagcagcaataacaatccccagggagggggaaacattggctctccagctacaatattcaaaatatccaatttccaacaaaaacatctgaggcatgcaaataaagatcaaactatatcctggtcacaagagaaaaagaaattaacagaaattgtcccagaggaaggccagacactgaatttactagacaaagactttaaatcaactgccttaaatatg

SEQ ID NO: 110098 - DNA, 239 bp, Homo sapiens
tctctcacactggttccaatacttactgattcttcaggacctttggcaagtgtcacctctgtgaagtctttcctaatttctcaacaacccaatatactttctcttcccctttctctccccttcctcttttgcactgattttcagcttttgctttttgttttgttttttgcatacatgtttctgttataacaccacatatttgttcctgaaaaacctcatattctataaaaacatgcact

SEQ ID NO: 110099 - DNA, 791 bp, Homo sapiens
gggaggctgaggtgagaggatcacctgagcctggggaggtcgaggctgtactccagcctgggcgacacagtgagaccctgtctccaaaaaaacaatggtgaaatttatggtatgctaattgtatctcagttttttaaaaaaataaatgtaacaagaggcttaataattgatcttatatacaagtgaaataggcttaaatatggagatgagagccagaagaaaacttttaatcctgtaaaataggtcccagtttgttttttaaaaaataaaggacatttgtactttctggtgaggtagttcctagatttatggagagatcctcaaaaggatagttgatgaaaataattttgttatgagaccctttctggactttttctgatgagtcagaacttagcatttgttggggagaataaatgattaaatctgtctacatatcacattttatttaatcatgtctacccattgtagtattctccaattacaacaataaaaattttaatagcactttataattttcaaggtgcttttctgtgtgtataaataaagaggtatataaaaatatataggggtaggtatttattaataatgttaattgtatattggttgagaattagttaaataatggaggttttgttttttaccctggataaaacacttcaagctttgggtaagttttatatgtaagtgtaatggtttttgcaaccttagaatataaaaaaatacaaaaaattttgcaaatcagatttatttattgctgatatactgtttttcactgttacttgtgaagactg

SEQ ID NO: 110100 - DNA, 668 bp, Homo sapiens
tgtcaaagctagctctgaaagcataaccactagcaattacactcccagctagtactctgtagttagacacagattaacaattatgggtccatgaagtagccatatttgttttctttattgagataacatactttcttcttcaaaacaattgtatttcaattgtcatcctaaccacatgtcattatgagtctgtgtttactgagccatctcagccttaattccgtacctcctagtagtagcagatccctgctattactttccatgaatttattaacaattttgtgctcttactggcccactattttgttcaattgctgtatctcttttctattggttctcttttcctggacatgctctaaacctatgtcagttcttatcaaatagcctaaaagttgtgcaatacaaaatatattatttttataatagactgcagactctataagagaatggactaaacttgtttgtccaccattaaagtgccatcatctaatagacattgagtaattattttctaaagaatgaaatgaatgcatgaataaatgagaaacagatctgtgtttaattcatcaattatattatgtattttaaaattttatcatttagatttttcatattatattacaatttatacaaaatattatgaacatagtatttatattatatgatat

SEQ ID NO: 110101 - DNA, 525 bp, Homo sapiens
accatcacaaatgtaacttcatttcatcttagctctgaatgtgaaatccttttgagtgtccttgatattgctgaaggatttctaaatagtactactcaattcctaagcattcttttttttttttgaaattattttaaaccaagatgttctctaaaaggatttataacttaccattagaaatcctcttcattgctttttagccttttaggattttgtagggattactaagaggatttctttttatcactagggaaatatggctacagctactatatcttaaaaaaaataaatcttaggcatagcttgacagtgagaaatgcatttatattcccctccagaacagtttccttataacccaaagacactttttaaaagtattttaatttgacaaaaactataacaaaataaaacctagagcagttagatctacttttgtatatagtttactaatatagacattattgaactgaatatcaaaatatagtttagaactcacagtgcttaaaaagtcatgttttagcactc

SEQ ID NO: 110102 - DNA, 529 bp, Homo sapiens
tgagacagggtctcactctgtcacccaggctggagtacaatagcacgatcatggtcgctgcagcctcaacctcctaggctcaagagatactccttgtctcagcctccaaagtagctggtactacaggcatgcaccactacactgggctaatttttgtattttttgtagagatgggttttgccatgttgcccaggctgatctcgaactcctgggctcaagggatcccgcctcagcctcccaaaatgctgggatttcaggtatgaaccattgcacccagcccagactgttttggctgatcatttatgtccctagatactgtccactgtttcaccttccagtctgccttgcattaactttcaatgctctttccatcaaatcacactgggtcctatgtcaaaggctggcactgtttgtttcctcaaacctgaaagttgaaaggtcaagattcaacatcatgcaccaagagtttagtctgtggaggaggtctcaaaattgaggatggaataactaactccacaagatgggggca

SEQ ID NO: 110103 - DNA, 2609 bp, Homo sapiens
  misc_feature (1)..(1): n is a, c, g, or t
  misc_feature (29)..(29): n is a, c, g, or t
  misc_feature (1792)..(1792): n is a, c, g, or t
  misc_feature (1834)..(1835): n is a, c, g, or t
ntatgcatcttttgctttctagctcatanttctgagctgtaaatgtaaagtatttagatatatttatgtgagtggtgtttgaaagtctggaaaatgagaagtgtagcatggatgtgttatagcttctttcagtccacaacaggactgctttccaaattggctaatggctaatagaagggcagattttccatcaaaacaaaaagaattatttagggcaaaaagcaaatgacattttctgtgagtttgagtttttaactgaggtacttctcatgcaactagagtggttgggggtattgtcaagcacgagaatttttggtttttacaaaaggctaagtgaataggaagatgcctctggtgaagatgtgtgtcacatgcaggaccatgtgaaaagatcagagaggagatttattcagatgatgtttgaagagttttaggttaactgtgtacgaaagatttgaaacagccagaaagtatcaacatttgtggtatgcttcataaacagtagagtgagaattttttcttttgtctattatggaaagctgaataaaatattttctgaaggaaaaaataaaacactcagttgactttcaaaaatcttaacagtctagtgaccaggcacggtggctcatgcctgtaatcctagcagtctgggaggccgaggcagatggatcgggcagatcgcttgaactgggagttcgagaccagcctgggcaacgtggcgaaaccctgtctctgccaaaaatacacaaagtagctgagcatggtggtgcatgcctgtggtcctagcttctcgggaggctaaggcaggaggatcacttgagtctgggaggcagaggttgcagtgagccgagatcatgccactgcactccagcctgggtgacaaagtgagaccccatctcaaaaaaaaaaaaatcttaatagtctagatatagaaaaaaggtgaaaattatacatatataaaatgtttggggggggggttacgtgcattggaactttcacataagggggttagtgacaatcagatttatgtaagaatgatgaaatgtttgaaaaattctgtgatgacagataaacattataccataaatttgttgaaatcataacacagttctagcttttagtttatgttctgtggatttcttgtgtgtgtttacgggtgtttttatatatgtatgtatgtatgattgttcctccaaatcacccacctcattctggatatttactaatcagattaggtttagctctactagaaacttacccttagagtgaaaaactacttgatgccaatgatgatctgcgggataaaagcgaagcaatgagagactgcacaaaaggagaccgctccaaaaatattgcgcaatgatggagtcactgggaaaaaaaagactgtctactgcaggcagaaatgtacactcctaagctagaggctaattgtttgaataaatatagcatcttaaaatttcctttcataaataaaacatagtgatagaagaaagatgaagcccaggagtgctatgtgagcacttaatctgacacgaaggagaaaatcacagaaagaaagccttcttatagagaagtcacctcattctcccaagaagctaggaccacaggcatgtgccaccatgcccagctactttttgcatttttagtagagacagaattttgccgtgttgcccaggctggactcaaactcctgagctggagtgatctgcctgcctcagcctcccaaagcactaggattacaggcgtgttcttctggacactcatgccctctgtctgctctgtatgcctnttgggtgatttgctctacttgccagctttgctgtaaaaagannaaaaaaaaaaaaggggcagtaagtataactgcttatgcgagtgtgcattttggtggaggagttttataaatgatagacaaaattcccctttaggctctatttaatctttcagatagtaaatccagatttgcccccagatgtaagacgtcatgtgactagtagcttgtgactgtgtaagtcatcggtttcactttatgtatggataggattacacgcagaggtgaaaggtgaaacgctggttaagagtacaagtttcaagtttgctctgtgcttccatacaaatataatagaagcagcttctgtagaatttccttagcagtaaaccagacgtgttccaagagaataacagtaataaaaaaatttaggttaaaaatcttagagttaaggcttaaagtactgcctaaatgtcactaaggtacacttctgagctggcctgcagctaacttcagatctgacttttgcttgaattgcagtcatccgaatttcactaggaacataggcaaaagataacttttgcaaataaatttcatcatttcacctttatggcaaataatggatttctaatatgaaactttaataatattaacatatgggaattacattaacatgtgactagttacactatcattggaattttaaccaactgcttccaaatacagttagagaattttataattatttgatataatggggatagctgggactgaatgtcacttggacattcaaaagatcaatacttgaattaaagttaacacttatcttgggagtggaggt

SEQ ID NO: 110104 - DNA, 2702 bp, Homo sapiens
  misc_feature (1)..(1): n is a, c, g, or t
  misc_feature (29)..(29): n is a, c, g, or t
  misc_feature (1792)..(1792): n is a, c, g, or t
  misc_feature (1834)..(1835): n is a, c, g, or t
ntatgcatcttttgctttctagctcatanttctgagctgtaaatgtaaagtatttagatatatttatgtgagtggtgtttgaaagtctggaaaatgagaagtgtagcatggatgtgttatagcttctttcagtccacaacaggactgctttccaaattggctaatggctaatagaagggcagattttccatcaaaacaaaaagaattatttagggcaaaaagcaaatgacattttctgtgagtttgagtttttaactgaggtacttctcatgcaactagagtggttgggggtattgtcaagcacgagaatttttggtttttacaaaaggctaagtgaataggaagatgcctctggtgaagatgtgtgtcacatgcaggaccatgtgaaaagatcagagaggagatttattcagatgatgtttgaagagttttaggttaactgtgtacgaaagatttgaaacagccagaaagtatcaacatttgtggtatgcttcataaacagtagagtgagaattttttcttttgtctattatggaaagctgaataaaatattttctgaaggaaaaaataaaacactcagttgactttcaaaaatcttaacagtctagtgaccaggcacggtggctcatgcctgtaatcctagcagtctgggaggccgaggcagatggatcgggcagatcgcttgaactgggagttcgagaccagcctgggcaacgtggcgaaaccctgtctctgccaaaaatacacaaagtagctgagcatggtggtgcatgcctgtggtcctagcttctcgggaggctaaggcaggaggatcacttgagtctgggaggcagaggttgcagtgagccgagatcatgccactgcactccagcctgggtgacaaagtgagaccccatctcaaaaaaaaaaaaatcttaatagtctagatatagaaaaaaggtgaaaattatacatatataaaatgtttggggggggggttacgtgcattggaactttcacataagggggttagtgacaatcagatttatgtaagaatgatgaaatgtttgaaaaattctgtgatgacagataaacattataccataaatttgttgaaatcataacacagttctagcttttagtttatgttctgtggatttcttgtgtgtgtttacgggtgtttttatatatgtatgtatgtatgattgttcctccaaatcacccacctcattctggatatttactaatcagattaggtttagctctactagaaacttacccttagagtgaaaaactacttgatgccaatgatgatctgcgggataaaagcgaagcaatgagagactgcacaaaaggagaccgctccaaaaatattgcgcaatgatggagtcactgggaaaaaaaagactgtctactgcaggcagaaatgtacactcctaagctagaggctaattgtttgaataaatatagcatcttaaaatttcctttcataaataaaacatagtgatagaagaaagatgaagcccaggagtgctatgtgagcacttaatctgacacgaaggagaaaatcacagaaagaaagccttcttatagagaagtcacctcattctcccaagaagctaggaccacaggcatgtgccaccatgcccagctactttttgcatttttagtagagacagaattttgccgtgttgcccaggctggactcaaactcctgagctggagtgatctgcctgcctcagcctcccaaagcactaggattacaggcgtgttcttctggacactcatgccctctgtctgctctgtatgcctnttgggtgatttgctctacttgccagctttgctgtaaaaagannaaaaaaaaaaaaggggcagtaagtataactgcttatgcgagtgtgcattttggtggaggagttttataaatgatagacaaaattcccctttaggctctatttaatctttcagatagtaaatccagatttgcccccagatgtaagacgtcatgtgactagtagcttgtgactgtgtaagtcatcggtttcactttatgtatggataggattacacgcagaggtgaaaggtgaaacgctggttaagagtacaagtttcaagtttgctctgtgcttccatacaaatataatagaagcagcttctgtagaatttccttagcagtaaaccagacgtgttccaagagaataacagtaataaaaaaatttaggttaaaaatcttagagttaaggcttaaagtactgcctaaatgtcactaaggtacacttctgagctggcctgcagctaacttcagatctgacttttgcttgaattgcagtcatccgaatttcactaggaacataggcaaaagataacttttgcaaataaatttcatcatttcacctttatggcaaataatggatttctaatatgaaactttaataatattaacatatgggaattacattaacatgtgactagttacactatcattggaattttaaccaactgcttccaaatacagttagagaattttataattatttgatataatggggatagctgggactgaatgtcacttggacattcaaaagatcaatacttgaattaaagttaacacttatcttgggagtggaggtaaaaaataaataaaaagcttgtttcagtgctatgaaagatgcctgtaaatagcacagctgttttaggtttcttgttgtctgagaaagggttta

SEQ ID NO: 110105 - DNA, 405 bp, Homo sapiens
ttggtaattggcgtgggaaccaattcttttcaactagtatttacagtgaggcattgagacaagaactcttcctgccttgtcgttggtgctgtgtcttttcctagtattagtctcagcatataagagcaagtgtttgtaggtatcttctagttcactaccagtgggggtgacttgcccaaggttgtagagtgagttcatggcttaatgagggctatagcccagagatcctgatgccctgctttgtgttctttctagtgtaccacactgtctgtcttgtataggttaatacagcatgggcagaaggtatggtttccagaagccccctgttttatatgtatgtatatatgtatgtgggtatacatgtacacacatgatgtgtgtgtgtgtgtagtgcttaggacagtg

SEQ ID NO: 110106 - DNA, 799 bp, Homo sapiens
catcaagaccaaatgaattaattcatagaaagtacttaacactgtgcctagcacatagtgctgcatgagggttgttaaatgttattactttgattaaagtaaaccctgtttgctttcaaagtcagccactcattaggaaatgggagcttaggtatagattgagggttggtttgggtaatcaattgttagagctgtaactatttggaccataaagctttgtcttatttcatctctaacctggagacttacgaaggagccttctgaaatgattgacatgatctattctttcccatgctaaataatttcttctgtaatttgaaccttactttacctacattttttctgccttttacttttcttggcatattcttaaacagaagagagacaagacagtcaaaatgaataaaagaagtagtcataagaaaagaagggacctgttaagtaaggaaagcaaataagcttatgcatttttctctgataattgacttagaattatatctcataagttttcatatataatgttccattataattaatatctcaatagtctgcaattgcagtttttatttcctctttgaccctagagttacataaacttacttaagtacatttcatttctctttttctttccctccttccctccttccctcccttccttctttccttccctttcttaatttccaactaattggagattcttgtggtttctttatgattatctctaatttttttcatgtggttagatatggtctgaactatttcaacattttgaaattgttgagacttacattgctaccca

SEQ ID NO: 110107 - DNA, 339 bp, Homo sapiens
tgggcagcagtgctaacaagatgttccaggagtttttacagtgctcatatattttaatcctctcctggaagtctagcttaataaaatcatttgaaaataagcaaaaaccaatgcaaaaggatgccttcccaacccagatacttattctgggagaactgtgaaaaattggatgcaacataaatagtcaacaatagggtgtctccatatgatgggaaatcgagcagccattaaaaatggtatttgtgaataattttcatgacatggcagaaatgccattaagaagtatagcttcaggccgggcgtgtggctcatgcctgtaatcccagcactttgggaggc

SEQ ID NO: 110108 - DNA, 136 bp, Homo sapiens
gggcctaatgtccacctaaaacctggtgttcacctggggtctgatgttcagctgaagaccggatgtccacctggagccgaggaatccacccagggactggtgttgaactggggcctgatgaccacccggggacaag

SEQ ID NO: 110109 - DNA, 393 bp, Homo sapiens
gaggtcttctggaccacattttgaaaactcttaacagataactgacacatcgagttgttaacaaactggtaagttacatttctctaaatgtgtccttcatttccagaagttgttattggtttttatttatgctgtctatttcactgaagatttttccattcatatcctgtatgatttttttttaatttctttaagttggacttcacctttccctggtgcctccttgattagcttaataattgaccttctgagttctttttctggcaattcagagattttgtcttggtttggatccattgctggtgaactagtgttatctttggggggtgttaaagaactttattttgtcatattaccagaattaataaactagtaagttaacaaactcaaaat

SEQ ID NO: 110110 - DNA, 603 bp, Homo sapiens
gtagccttgtcctcaaatcaagtgggacttctggttctttctctgaccatctgcttgaccttcagtctggtgtctccaaggagtgtgtctctatggcagtttaaaaaattctgttacactgagaaagagacaaaatgtaaatcttaaaggaatcagtagatttttaaccccactgctggtgttgagaagacagtttgagtcttaatctctttccttaagtttcaaaacatgtaggatttatgttattgacatgtcaaactttttgtacttattcattagggaaggtttcaatacacacaaaaatagagtattataagatgcgctactatgtattcattatccagtttcaacagacgtcaccattttcccagtcttttgttatatagtatccccttcactttatgttcctgaaatattttaaggcaaagccttgacagcatattatttcacctataaatatttcagaagcatctctaacaaataagccccctcctttgttttacatagccatggtgccatatcacagctagcaagactattaggaattcttaatagcattaagaactgacgttcctcagttgtctcacaaatgcctttttacag

SEQ ID NO: 110111 - DNA, 263 bp, Homo sapiens
ggaggtagcactgaaccaagatccagcctggccaagagagtaagactccgtctcaaaaccaaaccaaaccaaaccaaaaaaagaagtgagttggcactttcaacattctgcctggaaatctccttaccaaacctataagatcattaggtatattttctgcactttgtattgtgacaggtgacagtgttaccaaactttttaccaggacataatagggtctgcctttcttctagttgctaacaatttcccccaagtccatcttg

SEQ ID NO: 110112 - DNA, 658 bp, Homo sapiens
ctgattgacattttctaaatagactaggtagtgtcaaggataaggaagctgcagtgtatcaaaagatgtgcccaatgttcccatgagcctgaaaatttatagatcagggagatgtcacctttagacaacttgtctaactgtcacattattaaaggaacttaattaactattaagcaatgttctcttctaattattgattcctgtgaccatcagataaataaaaattattaaatgaaatgctagcatctattgaaatattactattggccattaaaaacatgtattgccattcacatggaattatagaactctctagaaagcacatataggacaaggcaaactttactcttttggagtttaaaatttgtgttctgccatctcctattcattctatttatgatcattggtcataattttgttcataatcaaccaacatgcaaaagccctaatttcctgtacctctttcataacaaagaccttaacagagtcaattctccacacatgggctatgacctttactttgtattcaaaagggtgggattacaagcatgaaccaccggccccgcctaaaattctaaattaataatggtaatatgttggcacaaaagtttaaacccaaaccaagttaggaaaccttttttgccgggaagccctctga

SEQ ID NO: 110113 - DNA, 1919 bp, Homo sapiens
cagatatatctcatggcaaatttggtatcctgttacagccttggctcttaaacaactcaaaatattgggataggctgtcagtatgttaaggatagttgctcctgagtcaattcttcacttactccctctgttgttcttggctggatcctaacgctgatttccactctgctgtcacaaacatttttccccccgtaaaatgtcttaatgctgtcctaccattattttaccaactgtgaaagctggctttaatttttaggaggaaaagaaaagcctgcatgtgttctttattggtatcatttaaaatatacttttttttttttttttggtaaaggtaggcgtattttaagatattttcttaacttgagcagtagccaacaggaaggataccagtgtctctctctcttagcgacacactccttggtcttgcttaccaactggaggacactaggtagaataaccgagtatgacaattcttaattgtttacattttataacttcctgtccttcaaaagagtttgaaatgtcattttgggaaaagagagccagtcaagctagtaggctgattgtgaagaaaatctaataccttatctttatctcaaacctctgtacaactttattttcattgatgggatactttaacaaaaatgaaattttttttggtttttaaaatatgagtgattatgacctctttggggatcatgcttcaaaaagtcagaaacctagagacaaaactgtcattgatttttaagaagaaacacactaggtcaaaagaagatgtcctggaaatacgaagtactctttaaaaaccatgcatttggagaaagtaattgtttccttgaaaaacatgattaaaaactaaaactgggatgttcctgtgtgtacacagtgccaaatggttttccctttttatgttgtgttttagaaacagcacgaaagttttttccattttaaagtgagaaaacattatatttagacttccataattccaaaatcagaagctatttttaaaattagcattttcttgcatcaccaaatggtattcaattgtttgaagctcaaaatttttaccattccataaatgtttgtgaatttttagacagtgccaatttaaaagtagagatagccaatctgaatacggtgaaattatggggatctctggtgattgggatgaaaactctggccttaaaaggtccacttttagtatataattgcctaattagcaatcatttttattttttgctcactccctggtctgaatctatctgtctattcagatattttttggtaggtttggaaaatggagaagtgagcctaattggtgcctaattgtctggtgtatcattcactttattcagtttgttctatcaatatgatttacccctcaaggttaacctagcaggttgctcagttattatctctcaaggtcacagtactagaaatacttggcttgcatctttcagatgccattcatgttatcaagctcaaattatagttggtcacaggattctaaagtctttatttgacttctcctttttgaactggctcaaatggaaaagtgtagttgcttttaaatgttaaaaataagtttaaactttatatttcccattggtttcccctattttgtcctttctttgtgtgcttgaaatattttatttttcagtttgtcctcatagggaatcaagtattttagctaggtgatgtcttgcaagtacgttccactttgttacaatctactatctgtatatactatttgtatcttaattcttttatgagatgttctgtaacatttttctcactttgacaaatgtttttagactgtacagtcaagatctggcgcttgggggtaagtggaatgatttgctaatattgagaatctgttgtatcaaacataataaactttttttgagatgtgaaaaaaa

SEQ ID NO: 110114 - DNA, 265 bp, Homo sapiens
aaaaggctatcaaaacatatgaactacaaatacccaatttgatttatctttttgtatgtttgcagttattgtaagatgtcactgttatttgatcaggtatcttagcgaatgacaagcaaatgaatgtttgcagtgattttagtgaattacaagagcagaattaataattccagtattttcttaaaaagtggtcagagattatagttttatataatataatactaaattcctactcttccctatccagctgtgacaagacaaaagg

SEQ ID NO: 110115 - DNA, 286 bp, Homo sapiens
ctgccaagaaaaaactgcctaaattgaatttcttttgaggaaaaaaattaagtaaatcattattttttaaaataaatattgtaataatgttagctaatatttactatttttaaactcagtgttatttttactgttttttaataaattaacttggcaagctgtggtaaatattcctctttattatattggtttctttatttttagggagttctaatacatctgacattcataaagtatgagatacttaaaatcacttttcatatgataaatttgacttagtgtgctt

SEQ ID NO: 110116 - DNA, 345 bp, Homo sapiens
ttacttcaaacatgtttaattcagtgcaagttatttttatgttttgctcaattttattaacattcaaaaaataaatttccattgtcttttggcataaagagagagcttaaatattcagggttcagttacaagttggaactccctggagcagaactcttacagttatgtatactaaatagcagtctagatatcttgaaggcaatttacttaaaaattggtctaagacatagaaatatgagacaaaaggagaatatgtgcttaattcccttaagggagtttgggattgtctgaaaacacagtcctccattgctttctaagtgggaaacatttggggcagctcatatc

SEQ ID NO: 110117 - DNA, 445 bp, Homo sapiens
ggagacggaaagcagtgaacctctgtaaaagcttagagtctcctaagcaagggcagggcacacaccgggacagaacagcaaatcgatgactttagtcgctaaactaaagcttcattctccttaagaatgactctcctccatcgccacccctcaccccacttgaggacttatctggaatttcaaatgtttgttcctgcaaatgcatcttccatcctgggtgacaggaagtgtctggttccatgacgatgaagcagccacaaggcctctctgtgtcagtgctggagagagagagcttccttcctcctgtcctggacccctcctggagggacgctcccaaggctgagatgacacagtcatttcccgcatgctgtctagcactgacccacccatcgcccttgtcctggtgctggtctgcagcagcagtgagggggacccctttgtgtga

SEQ ID NO: 110118 - DNA, 327 bp, Homo sapiens
ttgtcaggatttttaaagtgtgacttccacccccagagagcaggaatgaatagacaggcaggaacgaatggatatggacagacataacaactgatttgttttgacaaatttgtggtttaataaaagcacatgtggccagacgcagtggctcatgcctgtaatcccagcactttgggaggccaaggcgagcagatcacttgagctcaggaattcgagaccagcctggccaacccggcaaaaccctgtctctactaaaaatacaaaaattagccattcatggtggtgcacacctgtaatcccagctactcgggaggctgacgtaggaga

SEQ ID NO: 110119 - DNA, 426 bp, Homo sapiens
attgggaataaaaacattaagatagaagcattcattatctggtggaaaacaggggaagtggagaaggggaagcacatatttcctgaaaccgacctatttgtcaggctcgatgaataatggcatcattgatactgatcaggactctcaaagccgctctcaaaactggggggtagcagggagagagacagagaaagataagtgcatggattgagaaagcaaagagaagcaagggctcttaagttttgtgtggtgtgtcaaaatgttaaattctcaatcatgtcttgctatttattaaaagctataggaagagcctccacgctcccactttctgatttagaaacacgtaattctctagtgggggtataatggcattgtagtgggttggtggagcagttgaagaatatggctcttaagtcagacttggtt

SEQ ID NO: 110120 - DNA, 436 bp, Homo sapiens
actgtttgtatgtataagaattacttaatatggagattaataccaagggccttaattatcttaaaatgataactgaaagaaccatgatttaaaaaaaatctttatgtgttgtaatttattaatgtaaataaatagattttacttattatgtctggtgtagagaacaattccgttgtgttggggactaagccctctttcagatctagcagtctttcatgccgtcatagtaatcaggactgctaaatttcatacgcccttgacagtcactgcagtcccatgttcttcatactgtccaatgtagtgtagaacatttggtaggctttcaatcatgagaattttagtatgcagaggcagattgtcaacctggggtttggacaaggtaccaaaagcagcacagagtctttcattattggtaaatatcaaggtcctatgatga

SEQ ID NO: 110121 - DNA, 411 bp, Homo sapiens
tctctgggaaaggagatgggagataggaatgagaaacgtctgtgtgctgtatgccctctttaatctttctaaatacctatcttatacatgtgtaagtattcagaaatcagtaaatatttaataatagaaaagtatgtatttctatgctgtatattacaaaaccaactctaatttatatgtaattcttggtatctgaaatttttatcaaacaatcagtggtgggttcaatgatacatatcagtattatcattttatggcttcatagaattaaaaaatatggatctttcataatttatgtaatcaacctcctctgatggatgtttagcttttttccaactttcagtgtaataataatatttcaaaggagcaaacttctaataaatgtctgcattgttctactacttcggtaaa

SEQ ID NO: 110122 - DNA, 520 bp, Homo sapiens
ggggctccacaaagattaaagacctaattatacaatccctaacactgtgcctcctaaagagtagaattcattgtgttaaatatattcattcatacttttattattttacacaattgtttagcagtggtcaaaaacttagccaacatttcttatggttttaattcagcttatccttttagaatttcaccagtttcagattattagaattaaagtttttgttcctttgcttggttatcatattcatatcagtttttgataccaattattccactggaaatacagagaagagtgctgtgatgctggaaaacaggcttatttccaggctatacttcactgtcagtgaccttgtattaatatttaatagcaagtgggtctgaatccagatattgctcaaggagatggatgtgacacctgggtcaggtcccaaatcattaactctgatatgtattggtagacttgcaatgatgactagatcttgtgtatgatggcttctgccctcctgggacaaccctcccaagaa

SEQ ID NO: 110123 - DNA, 335 bp, Homo sapiens
aaaattttcaggttgaattttttttctgattctttaatagcaattcaattaatccagataaacaggagcatctgtctcaccagtccatcctggccagattatccagtgccagtccatcatgtaggttccttctcttcttcctgttgccactgtctctgtctggtctaaactagttggggtcagagatttgaagcagaatgaaatgagagctatttaacaatctgctgtcaggtagccattgctgtcctgggaggagggacagcttatgctaccgctggagaatagcaggcaggtgcataatccactttgccaggcagtcacctgtcctgacctat

SEQ ID NO: 110124 - DNA, 321 bp, Homo sapiens
ttttaatattagcacctcttcaacctcttcttgactctaccaccaaaattatcttcctaatctctcttaccctgtaaatttctgtgtgtgtgtgagtgtgtgtgtgtgtgtgtgtgagagagagatagagacagggaaagagtggatttaccaaaaaataagataggaaggttgtcataacatcttcccttttatttctcaattctgaagtccccattttcatccctgggagagttgttctaggatagggtagctaaaggaacagagaaaatcagagtaatggaattagctaaaagggaaagtggcgacctgaagaccaaa

SEQ ID NO: 110125 - DNA, 358 bp, Homo sapiens
ctcagtagagttggcagatatacttgttgcaaaagactttgtagattttatttatgtaaacattctgtaccatcattattgacatttcttttctgagtctcactgaatttcagtaagtttaggagtggttgctgttgcattagggatggactagatgaatattgcataatactaatatgtttatgattgaagatgaactttaatagtccacaatgatttgctgagaaatgttgtgtctgagtcataatcttgagttttaattattgtaactacagctaggtggcaacatgttatactaggaaaaaaatctacacttctgatttcaggatctataagtttgccactgaataaaatgaaa

SEQ ID NO: 110126 - DNA, 280 bp, Homo sapiens
tgggctactaaggcgtgcttgagaacaacagaacacacagaatctcccaaagcagcctccttcctaaagcctccccagcagtcatcctcctgtgcccaggttacaaatgctatgcttggtgcagaagagagtcgacttcactgattaaaagcactaatgatactaagatttgtgtagagaaatgcaaatgtatagcagtccagattgacagttagtgagcttgggaacttccaaagtcagcccctcctcccctgtggtgtgagggtgtgtgggtttgggg

SEQ ID NO: 110127 - DNA, 324 bp, Homo sapiens
ggataacagcatcataaataacatgacctctctcaaactactgccttctcctactagttataataatagcaacagcttatatttgtatctatttttatagtctgtgagacgctttatcttttttcagcttatttgagctcagagcagccttgtaaaataggtacaagtattatacccattttgtaggtgaggaaactgaggttcacagaggttaaacaactgtggatcacacagcaactgactaggactgtttgggattctaaggtataatagtgccaatttgttgaaagggaatagcaacaaaaaaacttggactctaacccc

SEQ ID NO: 110128 - DNA, 177 bp, Homo sapiens
tcctttggttacctgtacccattgtcctcccgaaactgcacgtcccacatgctccaccactggacctcacgtccccctcccttccatatttagaaaaatatatacaagtggccattcgggtcagctcagattgtgcagtccacagcccatgggggaagaacacagagatacagatca

SEQ ID NO: 110129 - DNA, 365 bp, Homo sapiens
tcctcctgtgttctgtgtcctctccctcttctccctccaccggcaaccattagtttcttatactccagtgtttcattatgtaaacaagcaaaaatgaaatatattcttattttttatttttttcccctttcctactcaaaaggtagctttttgaatatacttttctatgtcgttttttcacttgttcttttttttgaaacctcttaaatgtaattaattgcatctgtgttccttgttactcatatatatttgttacttatgtgatttttgtcatataacatgcgtgtaggagtgtattaatgaatctgtcctctcccttagactataagcatcactctggagattttgttcttctctagtcgtga

SEQ ID NO: 110130 - DNA, 305 bp, Homo sapiens
gatttttaggagtgggtaaggaattaaaaacgggatgttactatctagaaactgtgactgtgggacaactaaccatgcctttgagcccatcgcctgttgctgttattctttgacagcagagagacttaccattttctatacatttgaaacatcttttctcacctttctttgtatctcccaacatttgacccaaccacttcaattcatttttgtctcttcatgtttaatacctcgcttctcatgaaactattattcttttagtcttgctggtacttagggtttacacttaagcttagtctaatgaa

SEQ ID NO: 110131 - DNA, 378 bp, Homo sapiens
agagagctggctctctctgtgcacatatagaggaaagtccatatgaggacaaagtggctgtctgcaagccaggaagagaggcttccctggaaactcaccctgttggaccttgatctggaacttttagcctccagaacagtgtccattgtataggccaacccgtctgttatggtttgtttgtttttgttttttttttttgagagacggagtctcactctgtcgcccaagctggaatgcagtggcacaatctcggctcactgcaatctccgctcactgcaatctccgcctcctggttctagcaattctcctgcctcagcctcccaagtagctgggactacaggtgcacaccgccacgcctggctaattttttgtatttta

SEQ ID NO: 110132 - DNA, 230 bp, Homo sapiens
cccaaagtgctgggattacaggcgtgagccactgtgcccggccgaggctagggtcagaggcctagagaatggggaatgctgttgggacagggttgaaatcacaggaagttgagctatctttttgccctaaataagttcatgggatcataagacctgttgagccacttcttggtatgggtttccattccaggtggtgctagccgttttatcagaatcagggtctgaaaagt

SEQ ID NO: 110133 - DNA, 1406 bp, Homo sapiens
agacatctacagcctgggggccacgctcatccacatgcagacgggcaccccaccctgggtgaagcgctaccctcgctcagcctatccctcctacctgtacataatccacaagcaagcacctccactggaagacattgcagatgactgcagtccagggatgagagagctgatagaagcttccctggagagaaaccccaatcaccgcccaagagccgcagacctactaaaacatgaggccctgaacccgcccagagaggatcagccacgctgtcagagtctggactctgccctcttggagcgcaagaggctgctgagtaggaaggagctggaacttcctgagaacattgctgattcttcgtgcacaggaagcaccgaggaatctgagatgctcaagaggcaacgctctctctacatcgacctcggcgctctggctggctacttcaatcttgttcggggaccaccaacgcttgaatatggctgaaggatgccatgtttgctctaaattaagacagcattgatctcctggaggctggttctgctgcctctacacaggggccctgtacagtgaatggtgccattttcgaaggagcagtgtgacctcctgtgacccatgaatgtgcctccaagcggccctgtgtgtttgacatgtgaagctatttgatatgcaccaggtctcaaggttctcatttctcaggtgacgtgattctaaggcaggaatttgagagttcacagaaggatcgtgtctgctgactgtttcattcactgtgcactttgctcaaaattttaaaaataccaatcacaaggataatagagtagcctaaaattactattcttggttcttatttaagtatggaatattcattttactcagaatagctgttttgtgtatattggtgtatattatataactctttgagcctttattggtaaattctggtatacattgaattcattataatttgggtgactagaacaacttgaagattgtagcaataagctggactagtgtcctaaaaatggctaactgatgaattagaagccatctgacagcaggccactagtgacagtttcttttgtgttcctatggaaacattttatactgtacatgctatgctgaagacattcaaaacgtgatgttttgaatgtggataaaactgtgtaaaccacataatttttgtacatcccaaaggatgagaatgtgacctttaagaaaaatgaaaacttttgtaaattattgatgattttgtaattcttatgactaaattttcttttaagcatttgtatattaaaatagcatactgtgtatgttttatatcaaatgccttcatgaatctttcatacatatatatatttgtaacattgtaaagtatgtgagtagtcttatgtaaagtatgtttttacattat

SEQ ID NO: 110134 - DNA, 426 bp, Homo sapiens
aggtgggattggagaggcagtaaaggtccctattggctgttgctgggcttgtagttgctctgggatgttctctgctgtccctgccccaggccttttctgcccacatatcatcactgccattgcccctctgaggtgccagctctttggagatcctagacttgaagcaggtcagaatctaaaagggctttggtcactaagaagccgtctggtcacttcttttacagaaaaccaagtctgtattttgaccaaagtctctcaggtggcaccaggggggatcacagtgcctgcattaggatttgtaggctttgtttccttgaggaaagaaacagttgaaactcagtaatttcagggaaaaaaagaaaaacaggaggccctttgaatgcggatttttagggggaacaggatttagggggaacagggaccgag

SEQ ID NO: 110135 - DNA, 2209 bp, Homo sapiens
aattctgcatttcagtgcactgcaggatggcgtcatctctgccctggctgtgcattattctgtggctagaaaatgccctagggaaactcgaagttgaaggcaacttctactcagaaaacgtcagtcggatcctggacaacttgcttgaaggctatgacaatcggctgcggccgggatttggaggtgctgtcactgaagtcaaaacagacatttatgtgaccagttttgggcccgtgtcagatgtggagatggagtatacgatggatgttttttttcgccagacctggactgatgagaggttgaagtttggggggccaactgagattctgagtctgaataatttgatggtcagtaaaatctggacgcctgacacctttttcagaaatggtaaaaagtccattgctcacaacatgacaactcctaataaactcttcagaataatgcagaatggaaccattttatacaccatgaggcttaccatcaatgctgactgtcccatgaggctggttaactttcctatggatgggcatgcttgtccactcaagtttgggagctatgcttatcccaaaagtgaaatcatatatacgtggaaaaaaggaccactttactcagtagaagtcccagaagaatcttcaagccttctccagtatgatctgattggacaaacagtatctagtgagacaattaaatctaacacaggtgaatacgttataatgacagtttacttccacttgcaaaggaagatgggctacttcatgatacagatatacactccttgcattatgacagtcattctttcccaggtgtctttctggattaataaggagtccgtcccagcaagaactgtttttgggatcaccactgttttaactatgaccactttgagcatcagtgcccggcactctttgccaaaagtgtcatatgccactgccatggattggttcatagctgtttgctttgcattcgtcttctctgctcttatcgagttcgcagctgtcaactactttaccaatcttcagacacagaaggcgaaaaggaaggcacagtttgcagccccacccacagtgacaatatcaaaagctactgaacctttggaagctgagattgttttgcatcctgactccaaatatcatctgaagaaaaggatcacttctctgtctttgccaatagtttcatcttccgaggccaataaagtgctcacgagagcgcccatcttacaatcaacacctgtcacacccccaccactctcgccagcctttggaggcaccagtaaaatagaccagtattctcgaattctcttcccagttgcatttgcaggattcaaccttgtgtactgggtagtttatctttccaaagatacaatggaagtgagtagcagtgttgaatagcttgcggccaggacaacctgaattctataagttcttgttttctgtttcctatgttttcttaaaaaatagcattgagacttgtgtagatgcttctcagaacatgaaatcaaattggaaatctgtaacgcagcttctgtaagcatgtgtgggcaaaaaagcaataatcctactcctcaaaatagaaagttgaagattgctgaaaaatatgacttttctgtatgttagagaaaaactttatgaggatgaaatgggttcaagatgaatttgtcaacttttgtcttccattgttcagtatttttaattgtcactgtaaataacatttaccacaaggcaaataaaataagaaatgctgacacttccaaaggttgccttaaaatatgtttattttggcttagttcccgagagggcaaaatataaatacagtctaaatatttatcagtaggttaataccagcatgttggaggcctttatgctagtaaaatgggctttcaggggcattgtaaagcctacattgagcttagccatttgtttttaacctcgctgtgctcttttacctcaataaaatgtggtgtttgtatacatataaattatacatagctcataaattatgtatgcatatgtacatagctgtagttggactaaaattcagtgtgttttatcctactaaattctccttttaaaataatacacttaccataattctatgaggttgtagaaaaaagtactcattataaggaagccttgtatattatgactatggttatctcttgtgttttccacatttccaattataacactaaataaaacaacaataaacatgg

SEQ ID NO: 110136 - DNA, 459 bp, Homo sapiens
ttccatataaaagtttattgagtatgtctataaaacctaaagcataattgtcttttgtggcaacatcattatcagtatattttattaaaacagtaaagaggtcatttggaaaggctgatgctctccaccttttacattgaggatggaccagtaggtgttctggggactctgttccaggtacagatggctgtagcattcataagagggtatttatagtaagtagcaatgaaaacttgaactcatcttttagaacaaagtgtatcatggtattcttttacggttctcaggtggcatttctctgcttaccatcaatgctgactgtcccatgaggctggttaactttcctatggatgggcatgcttgtccactcaagtttgggagctgtaagttacaacaggcttctgagagtcaaataatacatccaaaatatataattacttggttttagttgatactgga

SEQ ID NO: 110137 - DNA, 1755 bp, Homo sapiens
gcgacgcgcgatgcactctacactcgcataaatactgtcgcaagtagcacactctcacttaccctcagctcagactttgtcactggcctttggcatacataggctaattttatttattttttaaatccttaaatcatagctgattcaagcttatgagtgtgcaaagatgagaatgtaggctgggaatgtgtacagaagaatggcgtcaataaaccaggctgtaatttttttgtactaattgtccacatattccaaattggaattcacccctcctcccaatacacactattgcccaaacccattgccctacagactaatgcacaaccaggagtggctaggcctctgcaacctggctcgtctttccctaaggatacaatgcttaccgtagttctatgacatgaaacatgctttgtgttgtttgctgatgtattgagtaatagaatgtcagatggaagcaagtaaattattttacaatgtattttaagccttacttggaaaagtaacaccaacaaatactattaagaattcattgatgtttgaccttacatagaaagtaagtcgtcaataaatatttgtcaatggtgaaagagtgaataaataagcaattaagcaatatctattctttcatttgggcttaatatttgtcttttttccacagcatcctgactccaaatatcatctgaagaaaaggatcacttctctgtctttgccaatagtttcatcttccgaggccaataaagtgctcacgagagcgcccatcttacaatcaacacctgtcacacccccaccactctcgccagcctttggaggcaccagtaaaatagaccagtattctcgaattctcttcccagttgcatttgcaggattcaaccttgtgtactgggtagtttatctttccaaagatacaatggaagtgagtagcagtgttgaatagcttgcggccaggacaacctgaattctataagttcttgttttctgtttcctatgttttcttaaaaaatagcattgagacttgtgtagatgcttctcagaacatgaaatcaaattggaaatctgtaacgcagcttctgtaagcatgtgtgggcaaaaaagcaataatcctactcctcaaaatagaaagttgaagattgctgaaaaatatgacttttctgtatgttagagaaaaactttatgaggatgaaatgggttcaagatgaatttgtcaacttttgtcttccattgttcagtatttttaattgtcactgtaaataacatttaccacaaggcaaataaaataagaaatgctgacacttccaaaggttgccttaaaatatgtttattttggcttagttcccgagagggcaaaatataaatacagtctaaatatttatcagtaggttaataccagcatgttggaggcctttatgctagtaaaatgggctttcaggggcattgtaaagcctacattgagcttagccatttgtttttaacctcgctgtgctcttttacctcaataaaatgtggtgtttgtatacatataaattatacatagctcataaattatgtatgcatatgtacatagctgtagttggactaaaattcagtgtgttttatcctactaaattctccttttaaaataatacacttaccataattctatgaggttgtagaaaaaagtactcattataaggaagccttgtatattatgactatggttatctcttgtgttttccacatttccaattataacactaaataaaacaacaataaacatgg

SEQ ID NO: 110138 - DNA, 855 bp, Homo sapiens
aatgtcttaagaggtcttggctctggactaagtcacaaatgcatatatttaagttgcctcttggtctaaggatctaaagtttaacggaagcctatggagccctcaaggagtccttcctcaaaggtctagtctcaaatggggtccatgaccacggtgtgtgacagtaacctggtgtgagtctggagaaagagtccaggtaaacatttggcaaagtggtccctccgctatggacattcaggatttggcatttcagatagtagtgaaatggataactcgatggcttcctataattcccagatgccaggttttgtgctaaatcagactctccacattctgaatccttacagtgatcacatgaggaaagtccttttcttattttcatttttatgagaaaaccaaggttcagagaggttaagtaatttggccaaggtcacctggcttacatgtgtttaaaaacatgaatatgtatcatgtgaattatttatatggctaactcatttgcaaaagctattaggtataattaaacaacagggacagtgggttgacgaggataaaaatgtcttggcagccggacgcggtggctcacacctgtaatcccaacactttgggaggctgaggcaggaggatccctgaggccaggagttcatgaccagcctgggcaacatagtgagactgtgtctctacaaaaaaagcaataaattagcccggtgtggtggcacacacatgtagtcccagctactcgggaggctgaggtgggaggatctcttgagcccaggaggtccaggctgcagtgagctgtgatgacaccactgcactccagtctgggcgacagagcgagatcctgtctcagaaaaa

SEQ ID NO: 110139 - DNA, 653 bp, Homo sapiens
gtaaataactgaactaacaaatgagtgaacaaaagaacaaatgaataaaaaacctcagatctagcccctaacaagaataccttaaaaaaaagttttagtgtctcaattgtctgtatagacaatgatttcacaagttcacgtgaaatacactaccaatatcaacaatcatgttaaatcaaatgaaatctatatcctctgggaatgcttgtggtatggcttagggacaagctttacttatgaacaatgatactgagacttcacaatagtcagctgtgcagatgtcagactttgcatttcacacatgcttttaacctagagctcaaataggcagttttaagccctggacctcaagtcaatgtggttcatgttttgtcacttcaagatctacaattgaacttcattacgatagtcttagatggtttttcataaattttgagtcatgaaaaactgacaacatatgagtctccaagtaccttttaatatatgcaatattttacctacttaatgaatacatgtgtttatttgataactaaaaagtttataaagtctagaaataaagaaaagtccatgtcctttttcttttttgttttcttttaaatgaaaactcatgagaaataagagggcagaatgcattaaattatttcttctgtaac

SEQ ID NO: 110140 - DNA, 294 bp, Homo sapiens
gggattacaggcatgggccactgcgcccagcctgtgctgtttttttgtttgttttttaagaaatgggtcttaactgtgttgaccatgttgatcttgaactcctggcctcaagcagtccacctgccttggcgtcccaaactgctaggattacaggcatgagccaccatgcctggccaaagcatcctgtgctatttgcactaagtatgaaagtgctgttctgggaattatagcggcctggaccagttatgcaaggaagacagggaagcaccttctctccattaacctagatttgtg

SEQ ID NO: 110141 - DNA, 268 bp, Homo sapiens
cacaggagagcccggggtcctgcggtggggacctcgccaccaggcagtgagttggggaggtgtgtggccccattcgctgacacctgctccgtgatggccatcccttcttgtcagttcccagcccccacccccacctatgggccacaccccaggggcaccacaaacctagtgccttcacgaggccacagcaacccggggctgtgccctgcctccaccacatccctgatggcgccctgacctgtgctggcacacttcttacatctccccc

SEQ ID NO: 110142 - DNA, 347 bp, Homo sapiens
ctattgcaaattttttgaagaatagtatttatttaagtgcctattgttaaccactttcattttagtttttataaaaatgggctagacacaatggctcgtgcctggaatcccagcatggtgggaggatggcttgaggccaagagtttgagaccagcctgagcagcatagcaacaccctgtctctacagaaataaaaaaaaaaatagccagatgtggtggcacatgcctgtagtcctatttgggaggctgaggcagatggattgcctgaacttcagaattcaaggcagtagtgagctatgttcacaccactgtacttactccagcctgagtgacagggccagaccctgt

SEQ ID NO: 110143 - DNA, 321 bp, Homo sapiens
atagcttcggaaattaccatttcattgctgtcttatctactagaattcaataaactctggaaggcagtaaagctttgtcttataccccaatgtacacccattactgaaaatagtgagtggcacacgggtcttcaataaatatttgttgactgcatggctgaagagagtctcaatgttcaatcaagcgtccagggcatgaaaacaaaacagttgctccaactcatctatactttgcaatagcaacctctcctcccgtcccccacaaataaccagctacctcccacaaaaattccaccccaaacctctttagaatatactatt

SEQ ID NO: 110144 - DNA, 1168 bp, Homo sapiens
  misc_feature (1044)..(1044): n is a, c, g, or t
  misc_feature (1159)..(1159): n is a, c, g, or t
cactggtgtatataaaaacagtttaacaaggatgtacaaatgtttttaaattaacataaaaaagaaggccacagagtggctctacccagcactttgggaggccagggcgggcggatcacttgaggccagaagttcgagaccagtctggccaacatggtgaaaccccatctttactaaaaatatgaaaattagccaggcatggtggtgtgttcctgtagtcccagctactcgggaggctgagcaggagaatcgctggaacctggcaggcagaacttgcagtgagctgagatcgtgccactgcactccagcctaggcgacagagtgagactccgtctcaaacaacaacaacaacaaaagctcctcgatggaaccatttgatagtgacaaggattgaagtaagtatctgaagaggctacttagaaactcagaattggttacaggaagtgactgcccactttccatgtgttcttcagatgctctggttattctaacagcctagttaaccacccagactttggttctcattgcctttatccatttgtttggtgtatatactaatgttcaacgatgcacacataatgcatgtgatgttttttggataccgtcttatcacttgtagaattgccatgataggcattttttggagctactttaagtacttgctggcctagtaattatgcaagtaagtaattaagtgtttattcatatgtgaaagcccaatgtaagcattatttatgtctttcagtgaagtgtggtgtgcctttcatttttctgagtggtctttattttatggaatattaaatggatctttgaataaactcaagagggtagattataaaaggaagaactgttaaattagtcaaaaacaactttataacacaattagctgcataagccagtgcgtgcgtaagcaggtagtataaatgcttaggttgagatactaaaattattattagagaaaattacggaagtactatgctcccactatgttttgtacttggttaatttttctcctctgaacttctggcaggtttactggggaantttccattaggaatattctggtccttaagtttcattttgaatgtataatataatcatgcagattacgaacccacaatctaaaatcaaggcattcttttttaaagtttcagatgangctgggtgt

SEQ ID NO: 110145 - DNA, 438 bp, Homo sapiens
ggtcagggagggcttcctggatgaggctggatgatgatttgagctggtcttatggggcagccaaggtgaggctgctggagaaggagcctcatgcatcctgggtgtagaagtggtaggaactggggtttagaaagccccacagatggcctttgtggtccctcttggagcaccatctcccattatcaaaagccctcagaagtcctgcggctaacatttgacaccagatttcccaagtgtgtttgaccactcatagctgatgaacatggaggtcttgaatgggtttccacatggcttctgtctctctgactaatgcttcagctcatctgggctaccacctcacttctgtaaaacagggattggcaactttaaaagttcagcctcttgggagcaccaaaaaattatttgaagttcacctcttatctttttccaggcattgct

SEQ ID NO: 110146 - DNA, 296 bp, Homo sapiens
caaaggagagatgaaagtgtcaattccaatccaataagcatatttttatattcactataagtgcattggaaactgtgttgtgttcttctgttaaaaagtttaacttaattgttatcatcatagtgtccagtagaataatggcaaatgcattatgagatgccctttaagttcctggagaatgatgtggctatgaagtttaagctctctaggtcctttctcagaaccagatatgataaaacaacagatctacagttttttttctccagatggtacttaaagacctgttagaaaaagct

SEQ ID NO: 110147 - DNA, 1295 bp, Homo sapiens
  misc_feature (1196)..(1196): n is a, c, g, or t
  misc_feature (1206)..(1206): n is a, c, g, or t
  misc_feature (1223)..(1223): n is a, c, g, or t
  misc_feature (1295)..(1295): n is a, c, g, or t
ggaggtttccagaagcgctgccgccaccgcatcgcgcagctctttgccgtcggagcgcttgtttgctgcctcgtactcctccatttatccgccatgataagtgccagccgagctgcagcagcccgtctcgtgggcgccgcagcctcccggggcctacggccgcccgccaccaggatagctggaatggccttagtcatgaggcttttagacttgtttcaaggcgggattatgcatcagaagcaatcaagggagcagttgttggtattgatttgggtactaccaactcctgcgtggcagttatggaaggtaaacaagcaaaggtgctggagaatgccgaaggtgccagaaccaccccttcagttgtggcctttacagcagatggtgagcgacttgttggaatgccggccaagcgacaggctgtcaccaacccaaacaatacattttatgctaccaagcgtctcattggccggcgatatgatgatcctgaagtacagaaagacattaaaaatgttccctttaaaattgtccgtgcctccaatggtgatgcctgggttgaggctcatgggaaattgtattctccgagtcagattggagcatttgtgttgatgaagatgaaagagactgcagaaaattacttggggcacacagcaaaaaatgctgtgatcacagtcccagcttatttcaatgactcgcagagacaggccactaaagatgctggccagatatctggactgaatgtgcttcgggtgattaatgagcccacagctgctgctcttgcctatggtctagacaaatcagaagacaaagtcattgctgtatatgatttaggtggtggaacttttgatatttctatcctggaaattcagaaaggagtatttgaggtgaaatccacaaatggggataccttcttaggtggggaagactttgaccaggccttgctacggcacattgtgaaggagttcaagagagagacaggggttgatttgactaaagacaacatggcacttcagagggtacgggaagctgctgaaaaggctaaatgtgaactctcctcatctgtgcagactgacatcaatttgccctatcttacaatggattcttctggacccaagcatttgaatatgaagttgacccgtgctcaatttgaagggattgtcactgatctaattcagaaggactatcgctccatgccaaanagctatgcangatgcagaagtcagcangagtgacataggagaagtgattcttgtgcgtggcatgactaggatgcccaagctcagcagactgtacagatn

SEQ ID NO: 110148 - DNA, 1295 bp, Homo sapiens
  misc_feature (1196)..(1196): n is a, c, g, or t
  misc_feature (1206)..(1206): n is a, c, g, or t
  misc_feature (1223)..(1223): n is a, c, g, or t
  misc_feature (1295)..(1295): n is a, c, g, or t
ccgcgcgccctttagggtttgaattctccagtataggtcaggcgggaaggaaggtaacgggccttccatagttagcgctgccgggtcaagattttgcccaaggttttgcctccggcttgggccctgctgagtcacacccctcgcgatctagagtgtcatttcaaaattaccaggatagctggaatggccttagtcatgaggcttttagacttgtttcaaggcgggattatgcatcagaagcaatcaagggagcagttgttggtattgatttgggtactaccaactcctgcgtggcagttatggaaggtaaacaagcaaaggtgctggagaatgccgaaggtgccagaaccaccccttcagttgtggcctttacagcagatggtgagcgacttgttggaatgccggccaagcgacaggctgtcaccaacccaaacaatacattttatgctaccaagcgtctcattggccggcgatatgatgatcctgaagtacagaaagacattaaaaatgttccctttaaaattgtccgtgcctccaatggtgatgcctgggttgaggctcatgggaaattgtattctccgagtcagattggagcatttgtgttgatgaagatgaaagagactgcagaaaattacttggggcacacagcaaaaaatgctgtgatcacagtcccagcttatttcaatgactcgcagagacaggccactaaagatgctggccagatatctggactgaatgtgcttcgggtgattaatgagcccacagctgctgctcttgcctatggtctagacaaatcagaagacaaagtcattgctgtatatgatttaggtggtggaacttttgatatttctatcctggaaattcagaaaggagtatttgaggtgaaatccacaaatggggataccttcttaggtggggaagactttgaccaggccttgctacggcacattgtgaaggagttcaagagagagacaggggttgatttgactaaagacaacatggcacttcagagggtacgggaagctgctgaaaaggctaaatgtgaactctcctcatctgtgcagactgacatcaatttgccctatcttacaatggattcttctggacccaagcatttgaatatgaagttgacccgtgctcaatttgaagggattgtcactgatctaattcagaaggactatcgctccatgccaaanagctatgcangatgcagaagtcagcangagtgacataggagaagtgattcttgtgcgtggcatgactaggatgcccaagctcagcagactgtacagatn

SEQ ID NO: 110149 - DNA, 1241 bp, Homo sapiens
  misc_feature (1142)..(1142): n is a, c, g, or t
  misc_feature (1152)..(1152): n is a, c, g, or t
  misc_feature (1169)..(1169): n is a, c, g, or t
  misc_feature (1241)..(1241): n is a, c, g, or t
ggaggtttccagaagcgctgccgccaccgcatcgcgcagctctttgccgtcggagcgcttgtttgctgcctcgtactcctccatttatccgccatgataagtgccagccgagctgcagcagcccgtctcgtgggcgccgcagcctcccggggcctacggccgcccgccaccaggatagctggaatggccttagtcatgaggcttttagacttgtttcaaggcgggattatgcatcagaagcaatcaagggagcagttgttggtattgatttgggtactaccaactcctgcgtggcagttatggaaggtaaacaagcaaaggtgctggagaatgccgaaggtgccagaaccaccccttcagttgtggcctttacagcagatggtgagcgacttgttggaatgccggccaagcgacaggctgtcaccaacccaaacaatacattttatgctaccaagcgtctcattggccggcgatatgatgatcctgaagtacagaaagacattaaaaatgttccctttaaaattgtccgtgcctccaatggtgatgcctgggttgaggctcatgggaaattgtattctccgagtcagattggagcatttgtgttgatgaagatgaaagagactgcagaaaattacttggggcacacagcaaaaaatgctgtgatcacagtcccagcttatttcaatgactcgcagagacaggccactaaagatgctggccagatatctggactgaatgtgcttcgggtgattaatgagcccacagctgctgctcttgcctatggtctagacaaatcagaagacaaagtcattgctgtatatgatttaggtggtggaacttttgatatttctatcctggaaattcagaaaggagtatttgaggtgaaatccacaaatggggataccttcttaggtggggaagactttgaccaggccttgctacggcacattgtgaaggagttcaagagagagacaggggttgatttgactaaagacaacatggcacttcagagggtacgggaagctgctgatcttacaatggattcttctggacccaagcatttgaatatgaagttgacccgtgctcaatttgaagggattgtcactgatctaattcagaaggactatcgctccatgccaaanagctatgcangatgcagaagtcagcangagtgacataggagaagtgattcttgtgcgtggcatgactaggatgcccaagctcagcagactgtacagatn

SEQ ID NO: 110150 - DNA, 1434 bp, Homo sapiens
ggaggtttccagaagcgctgccgccaccgcatcgcgcagctctttgccgtcggagcgcttgtttgctgcctcgtactcctccatttatccgccatgataagtgccagccgagctgcagcagcccgtctcgtgggcgccgcagcctcccggggcctacggccgcccgccaccaggatagctggaatggccttagtcatgaggcttttagacttgtttcaaggcgggattatgcatcagaagcaatcaagggagcagttgttggtattgatttgggtactaccaactcctgcgtggcagttatggaaggtaaacaagcaaaggtgctggagaatgccgaaggtgccagaaccaccccttcagttgtggcctttacagcagatggtgagcgacttgttggaatgccggccaagcgacaggctgtcaccaacccaaacaatacattttatgctaccaagcgtctcattggccggcgatatgatgatcctgaagtacagaaagacattaaaaatgttccctttaaaattgtccgtgcctccaatggtgatgcctgggttgaggctcatgggaaattgtattctccgagtcagattggagcatttgtgttgatgaagatgaaagagactgcagaaaattacttggggcacacagcaaaaaatgctgtgatcacagtcccagcttatttcaatgactcgcagagacaggccactaaagatgctggccagatatctggactgaatgtgcttcgggtgattaatgagcccacagctgctgctcttgcctatggtctagacaaatcagaagacaaagtcattgctgtatatgatttaggtggtggaacttttgatatttctatcctggaaattcagaaaggagtatttgaggtgaaatccacaaatggggataccttcttaggtggggaagactttgaccaggccttgctacggcacattgtgaaggagttcaagagagaggtgagttaccaatgtggttaatatgtagacgttgggatattgagaaattctttgttcagattgctctttgctttgtttacgagttcagttcaacccccttattctagacacagatactcttttcagaatattttttttccctacacattaagggtaataaaaagtaattcatgcttatatataaaggtatgactccattttgtgttgttccaccttattactgcagtttatttatcacctcactaatgctggtgtttggtgttcaatgtcttcactttatagacaggggttgatttgactaaagacaacatggcacttcagagggtacgggaagctgctgaaaaggctaaatgtgaactctcctcatctgtgcaggtgagacacggaaaattcgagcagtcttgatggatattttcagccggagcttatttaaaataaatagtattttctaattgaaaaaaag

SEQ ID NO: 110151 - DNA, 978 bp, Homo sapiens
  misc_feature (879)..(879): n is a, c, g, or t
  misc_feature (889)..(889): n is a, c, g, or t
  misc_feature (906)..(906): n is a, c, g, or t
  misc_feature (978)..(978): n is a, c, g, or t
ggccgaaggtgccacaactgaaggggtggttctggcccttcagttgtggcctttacagcagatggtgagcgacttgttggaatgccggccaagcgacaggctgtcaccaacccaaacaatacattttatgctaccaagcgtctcattggccggcgatatgatgatcctgaagtacagaaagacattaaaaatgttccctttaaaattgtccgtgcctccaatggtgatgcctgggttgaggctcatgggaaattgtattctccgagtcagattggagcatttgtgttgatgaagatgaaagagactgcagaaaattacttggggcacacagcaaaaaatgctgtgatcacagtcccagcttatttcaatgactcgcagagacaggccactaaagatgctggccagatatctggactgaatgtgcttcgggtgattaatgagcccacagctgctgctcttgcctatggtctagacaaatcagaagacaaagtcattgctgtatatgatttaggtggtggaacttttgatatttctatcctggaaattcagaaaggagtatttgaggtgaaatccacaaatggggataccttcttaggtggggaagactttgaccaggccttgctacggcacattgtgaaggagttcaagagagagacaggggttgatttgactaaagacaacatggcacttcagagggtacgggaagctgctgaaaaggctaaatgtgaactctcctcatctgtgcagactgacatcaatttgccctatcttacaatggattcttctggacccaagcatttgaatatgaagttgacccgtgctcaatttgaagggattgtcactgatctaattcagaaggactatcgctccatgccaaanagctatgcangatgcagaagtcagcangagtgacataggagaagtgattcttgtgcgtggcatgactaggatgcccaagctcagcagactgtacagatn

SEQ ID NO: 110152 - DNA, 1380 bp, Homo sapiens
ccgcgcgccctttagggtttgaattctccagtataggtcaggcgggaaggaaggtaacgggccttccatagttagcgctgccgggtcaagattttgcccaaggttttgcctccggcttgggccctgctgagtcacacccctcgcgatctagagtgtcatttcaaaattaccaggatagctggaatggccttagtcatgaggcttttagacttgtttcaaggcgggattatgcatcagaagcaatcaagggagcagttgttggtattgatttgggtactaccaactcctgcgtggcagttatggaaggtaaacaagcaaaggtgctggagaatgccgaaggtgccagaaccaccccttcagttgtggcctttacagcagatggtgagcgacttgttggaatgccggccaagcgacaggctgtcaccaacccaaacaatacattttatgctaccaagcgtctcattggccggcgatatgatgatcctgaagtacagaaagacattaaaaatgttccctttaaaattgtccgtgcctccaatggtgatgcctgggttgaggctcatgggaaattgtattctccgagtcagattggagcatttgtgttgatgaagatgaaagagactgcagaaaattacttggggcacacagccactaaagatgctggccagatatctggactgaatgtgcttcgggtgattaatgagcccacagctgctgctcttgcctatggtctagacaaatcagaagacaaagtcattgctgtatatgatttaggtggtggaacttttgatatttctatcctggaaattcagaaaggagtatttgaggtgaaatccacaaatggggataccttcttaggtggggaagactttgaccaggccttgctacggcacattgtgaaggagttcaagagagaggtgagttaccaatgtggttaatatgtagacgttgggatattgagaaattctttgttcagattgctctttgctttgtttacgagttcagttcaacccccttattctagacacagatactcttttcagaatattttttttccctacacattaagggtaataaaaagtaattcatgcttatatataaaggtatgactccattttgtgttgttccaccttattactgcagtttatttatcacctcactaatgctggtgtttggtgttcaatgtcttcactttatagacaggggttgatttgactaaagacaacatggcacttcagagggtacgggaagctgctgaaaaggctaaatgtgaactctcctcatctgtgcaggtgagacacggaaaattcgagcagtcttgatggatattttcagccggagcttatttaaaataaatagtattttctaattgaaaaaaag

SEQ ID NO: 110153 - DNA, 454 bp, Homo sapiens
ggaggtttccagaagcgctgccgccaccgcatcgcgcagctctttgccgtcggagcgcttgtttgctgcctcgtactcctccatttatccgccatgataagtgccagccgagctgcagcagcccgtctcgtgggcgccgcagcctcccggggcctacggccgcccgccaccaggatagctggaatggccttagtcatgaggcttttagacttgtttcaaggcgggattatgcatcagaagcaatcaagggagcagttgttggtattgatttgggtactaccaactcctgcgtggcagttatggaaggtaaacaagcaaaggtgctggagaatgccgaaggtgccagaaccaccccttcagttgtggcctttacagcagatggtgagcgacttgttggaatgccggccaatgagacgcttggtagcataaaatgtattgtttgggttggtgacag

SEQ ID NO: 110154 - DNA, 323 bp, Homo sapiens
atttgtgttgatgaagatgaaagagactgcaggtgagtgggtttagttcacatctgggaaagttctaagaacaatgattcctgtgagatcactagctccctgtgctccagctcctgtagatgaatctgtggtcccttttgtatagaaaaactaggaatggcaaaactgtgttatacttcatgctttccctgcagattgaattaatcttcaaatctcactaatggtggctggcttgtttctttttttccagtagggggtaatgttctatattgaaagccacaagactacacattaagcttttgtccctgttaggtataaattag

SEQ ID NO: 110155 - DNA, 345 bp, Homo sapiens
ctggattccagctgattaaggcacttattatttggagaaaataattagagagtatatgtgatttttttatttaaaaaaagaacagggactatgctaatttattgctaaagagcatttgtccttctcactttaaaatatctgcagccagttaattattagtaaagagtcgtttccctctactttgtggatggtctggtagcccgcctatgctgtagagaagatgggtctccattgctccttctgtgggaagaataacttctagcaaggaccaaggctcaagatgcatccctcattgagcagaagcttagagtccatggcatttcctgtgaatcactgttaaaaccc

SEQ ID NO: 110156 - DNA, 413 bp, Homo sapiens
aaaattacctattttcagagagggcaaaagaaattgcacttaatgtagcaaggccataatttacccagtcacagtacaaactttccttaagtattggttttagtttcctttgatacatatggtttcaggccgggcatggttgctcacacctgtaatcccagcactttgggaggccaaggcgggaggatcgcttgaggtcaggagttcgagaccagactgaccaacatggtgaaaccctgtctgtactaaaaatacaaaaaaattagctgggtgtgatggcacatgcctgtagtcacaactacttgggaggctgaggcagaagaattgcttgaacccgggaggcggaggttgcagtgagctgagatcgtgccacggcactccagcctgggtgagagagagagactccatctcaa

SEQ ID NO: 110157 - DNA, 248 bp, Homo sapiens
tcccagcccaaggaataggactcagcctgcttctgtgccacctggggctgcttgaactttgcgacttgtggcttgggaggagggaggtggccgtgacctttgggggtttttgttctgcctggctgtagccaccagcagagggggtggggcacaggccagaaaaaccccttttgtggggttgtgaggagtgacaattggctgcttctcctccccttccaggctcagagcagggctggggggcagttgtg

SEQ ID NO: 110158 - DNA, 969 bp, Homo sapiens
aagcaacccagacttcataccagctcccaacaccatgacctgctgccagaccagcttctgtggatatcccagctgctccaccagtgggacatgcggctccagctgctgccagccaagctgctgtgagaccagctgctgccagccaagctgctgccagaccagcttctgcggatttcctagcttctcaactagtgggacctgcagctccagttgctgccagccaagctgctgtgagaccagctgctgccagccaagctgctgccagaccagctcctgcggaactggctgtggcattggtggtggcattggctatggccaggagggcagcagtggagctgtgagcacccgtatcaggtggtgccgcccagactgccgtgtggagggtacctgcctgcccccctgctgtgtggtgagctgcacacccccaacctgctgccagctgcaccacgccgaggcctcctgctgccgcccatcctactgtggacagtcctgctgccgcccagtctgctgctgctactcctgtgagcccacctgctaaaagccagtttgctgattttcaacttgaaatttccactttcagttccattcatgaacgaattatttcttcaagcacttatggacaacgaacaaattcttcaacctttctttgtctttcttatgggggttaccaaatattttggcctcagaattatctgattcctttcaattccagaaagaccttactcttctctctgaggacgccaaaatacaaatttgacccaagaaatgaaaaagccgatttaccttgaaactgagcctttgcaagcattgaagcccacgctctgagtctcagcgccgacgagaccatggaagagccatctgtccttctcaggacactcacttcctgtatcccaccgtcctgcaaattgcaccccctatgaaagaggaataatataccaaggtctaataaattttaactattggtgcaac

SEQ ID NO: 110159 - DNA, 423 bp, Homo sapiens
ttcttctttcaagtcaacttttcccaattatattattcttgtcaaaaatacgttcaatagttgaggaatttggagattacctttcctacctgcattgatttgcaaactttgtgatgatttctgccttggaaaggtgttatttataggctcacttataaaaagacaattagaagtgtgaaaaataagtgagaaactttgactaccagacttctatcttaacgatgctatatgtcctttcaaaaatccacaaagcaaacccatgagaggatgaggctgcagtgtttcctttactgattagttgaggggttatagacttctctccatcacaataaatgtgcacagatgataacacacatactgatattagaaggaaaaatgagagatgagtcaaatttaaaaaaatatataaaaaataattgggac

SEQ ID NO: 110160 - DNA, 370 bp, Homo sapiens
aatcacagtagggcaaatttcgaaaagactcacccctacaacatctaggcaggtctgaggcatcatgcagatccttttagatccttagggatttcgtgatttattccttgggctctgcttgaggtttcttcaggctgctcacgtctgacctctcttaggaacatgggactatcccatggatcccacagataaggcaggcaagagaccactgccgacgcacctccaccaaggtgtccttctaagtcgagccacagggacttgtggctagggaacggaggcatttattgggatgttaaccacagctcacagctcaggccccgtgccctaagactagcgcatgcgcattcgcgatggaggcgcccacgctagg

SEQ ID NO: 110161 - DNA, 182 bp, Homo sapiens
tggacagatgcattattacagaaatctgaacatttctgaaatcattgctctagctatattgaattatttgtagtttcctgatatacttgactattgtattcaactcttccactttcctgtactactgtatactctctcctcaaaccactaatactctcagccaatgcttgcttattacttca

SEQ ID NO: 110162 - DNA, 381 bp, Homo sapiens
tgagttttatacagtggtgcagctggagtcctgaagcccatgcatcataccatcagagcaaatgattgataaaaacaacaacaaaaaaattaaagactgatacttccttgcaccatctaaaatgaacaaaatcccacactgaggaaagtattatcccaagatactttccatcaaaacagactgcttaagtaactgtggattttatttcacactccagagttcatgtccacacctattatgtcttacgttctgactaaactgcatttgacacagatgcaaataattttatgaaagtatgacttcttgtagcataacttccttccaagacagttaatattcaagcaatacaaaaggccaagtctttcttcttcacttaagatc

SEQ ID NO: 110163 - DNA, 253 bp, Homo sapiens
aaaaaaattaagcctttaaatcaagctataaaacatgataccattgtggcatcatgaattagagagattaacttttttaaagatcaataataatcctttgtgattttattccagtgcatttaaaaatctataaaatgataatttatattgatagctttcttctttttgtgaatatatccttatcagattattatgcttttgatagactacttaattctatttcttaacatttaattgtatctataatcatagg

SEQ ID NO: 110164 - DNA, 351 bp, Homo sapiens
gtgatttgcaactgacttcttcctcccacaaactaatatttttaaatggtttgcacttttttctgtccccaaagggatttgttaagtgtgattttcagcaggacatgtactttttttatttgttagccataatggaaatgcatagataaactgaatctgtgttaacataataagacaatcaaattttttgtttagttgtggggaagggacgggatagaggaagtagaaaaagctccctcaaacataagctgaatatttatgtggtttttgtttttatttaaaccaacctctttagaaaattactttcttaataagacattatacaatgaatttttccagtcattttgaggg

SEQ ID NO: 110165 - DNA, 323 bp, Homo sapiens
agagaccgtgtggttcataatcctaaagtatttattttctgaccctttatgaaaaagtttgctgaccttttgaagtagatggaaaatgtgacctaaggttttaatacaaattttaaaataaatttatataccacatcatacccattaagatagctgtaatcaaaaagacagataataacaagtgttggtaatgctgtgaaaaaattggaaccttctgtatactgctggtgggaatataaaatggtgcagccactttgaaatcagcctggcagtttctcagatgagcagacacagatttactggaagagcaagccattctactc

SEQ ID NO: 110166 - DNA, 479 bp, Homo sapiens
gcctgcaatgatacaggagaattggtgaactccccaaaggaaaagaaaggaaggaggggatgaaaccagctaactcatcccccaggccatgtaggaaggagccaggaagctctttttctatcatgtcatgctgtcgcatatcaaatattgttatgaatttctgtactatggagaaaataaagtgcagtggttaacagcagggactctggcatgtcagtgtctgggttgaaatcccaactttgcaacttactcgctgtgcgactcagcttcctcctgtgtgaaacggggagaccattggaccttccacaatgtgtgtcacaggaccccagtgtgggctaaagttaatacatgtaaaacactcggaggaacactgcaaggaagaagttctgttctaggtgcttcacatatattaacccttagtccacacaaagtcctactattattactatactgcagaaagcccagaagtagcctggact

SEQ ID NO: 110167 - DNA, 313 bp, Homo sapiens
gtctgaatcttgatttacccattcatttcctgagaaatagttcctcaatgttgtagaacattcttgtttgccaataactggcaatagagtccatacacacatatgctgcttattagggtgaactgatggtgagataacctggagaacagccccttataaccatctggaacatgtctccacagctgcaaagcccattgaaattttatttagctttaaaaagacatgctgtaaagaatctgaccatataaaaaagatgaattatgaagtgactatttcagttttgtttaaaagaataaacttcactttatcaaat

SEQ ID NO: 110168 - DNA, 225 bp, Homo sapiens
ttttaatgaagaggcaagacattgtctccaaatgtgcagtctctgaaaatgatcatcttctctttcttgagaggaagagaaatcttgagtagtattaactcaagttttatcccaagccactttaacacagcaagcagtcattgagatctaataagcatcaagttgatttgcttccaaatcaacatacttctggagctaaaaataatggggacaaaaagttattgt

SEQ ID NO: 110169 - DNA, 157 bp, Homo sapiens
  misc_feature (15)..(15): n is a, c, g, or t
  misc_feature (69)..(69): n is a, c, g, or t
  misc_feature (85)..(85): n is a, c, g, or t
  misc_feature (105)..(105): n is a, c, g, or t
aaaagacctaggtanaaggctagctatactatgttcataaactaaaaaatgttgttaagatgtcaattntctcaaaactgatacntaaattaaacttactcccanaaggattctagcgtttgtcgtaagaatttttaaataaaacgaacaaaaagaa

SEQ ID NO: 110170 - DNA, 319 bp, Homo sapiens
tcccaatcagcctttgtgtcatccagacaaattgtactctgagtccatgctttgaagaaatctagtaacacagagagttgtctgtgggaggtctgttccttgttgtttccaaataattattaagcagacatatggtgaattgaatttataccaacatttctgagcctattcaattttttaagtgtactaaaggaaggataacatcaacttgtaagtatttttaaaacttttccatattaggttttaattatcttaattttcatcatatgtattaagacttgggttaaaaaaaaaaaaagaaaaaaagatggatttttgc

SEQ ID NO: 110171 - DNA, 272 bp, Homo sapiens
ctgagatctgctaggccaactgaaaggtagatttggtccaaaactatgcacacttattaccaagtcccattagactccactctgactaaagaagtagattgaccttcagatccctctgagattactgtgtgagctcagaagatgatacaataatacccccaaatcaaggtattttgtttcccttggcacacatttacccggataaatggttgaaagtgcctttggagaaagctaggaggaagatttacaaaatataccggggtaataaacag

SEQ ID NO: 110172 - DNA, 729 bp, Homo sapiens
ctactctcctccacatagttcacaacacagatgaagggtgtactccttctctcctcctccaaatatggtctagttcttttctggagcatttctgtcccctatatctgaaatgaacgtaattggaaagattggaggagttaccgacccagcctgggaattacatttataaatgaaatgccagtcttcccagttgattctggaacatttttcctgtgtgtcaagaggaagcagtggggagatgttgctatgagaatccactgatgtctgatgttggttcttctgacatagcagggctgtgctatcccatttccttttctttgctgtaagaattcaccctgaagctgtgtgctcatttgcgacgcttttcccaaagaggggtagaacagcctgccgagtcagagctaccaaagtaccaaatgctggcttcactgcttactagttggtgaccttgggcaattcacttgatatctctgtgctcatctgtaaaacatgggtaataatatttaacctcatagaattgtggagatgattaaataagataatcaaagcatttagaactgtggcatttgggcaatagtaagtactatatgagtgttagctatagctcttgttcttaagtctaggctatataaatttattttttttatatggaacacttcgcgaatttgtgtattacccttgtgcgggggccatgctaatctctgcgtcattccaattttagtatatgtg

SEQ ID NO: 110173 - DNA, 315 bp, Homo sapiens
ccaaactgctgggattacaggcatgagccaccgtgcctggcctcatagaggagtttttaatacaacaggacaatgaaccatagtaaaatactatatgatggaaggttcttaggccttgtagaatttagccctggcttggaaaggattactgactgtggtatggaatggagttccattttttcatggctttcaggagggctgttttttattttcttttataggctggtaagtaggtgggaaagctgatgttcatgtctagtcatggtggcactctgcaagacactgtggaggttgggatgaatgagatatatggtt

SEQ ID NO: 110174 - DNA, 789 bp, Homo sapiens
gagatgggtctccctctgtcacccaggctggagagtgcagtgatcttggctcactgaaacctccacttcccgggttcaggtgattcttctgcctcagcctcctgagtagctgggattacaggtgcatgccaccacacctggctaagttttctatttttagtagagatggggttttactctgttggccaggctggtctcgaactcctgacctcaggtgacctgcccacctcgccctcccaaaatgctgggattacaggcatgagccaccacgcctggctgcaaagaccttttaatacacagttttaaagtctgttcaactgaatatagactacagacaaatatattttctcataactttagtgtatcacaacccagatttttaaaatatttttattacgtgatagtgataactagcaattatttgtcattgctgtttcttaattaaaaataattgcaatgttaagtaaaacttttttcaagtttttttcttctataactattactaggctttcattcagtagctttcacctgtaatgagttttactaagtatgtgaaagtaattttgataggagactacccagatcaaaacgatttcagctatagcccactagtataattcctggagctattatccatctttagaaaatttgagaattagccagagactttctaggaaataacgattagcctgaaacgttataggaaaactgtgtgtaattatctcattcaccttcagttaccataaaggagaagggaaaataaagttgagttgaaataagaaaaaattc

SEQ ID NO: 110175 - DNA, 139 bp, Homo sapiens
caccatagcactagaagtcctagccagagcaagtagtaaaggaaaagaaataaaaagcatcccaattggaaagaaaaacaataaaattatctctgtttacagatgacatgatcttagatgtaagaaaccctaaaaatgg

SEQ ID NO: 110176 - DNA, 333 bp, Homo sapiens
gtaacaggaagggtcccctggcctcttcagttgtgggtgggagacaggcctttctgtgcataggcagggttgagggcaaggagggtcccatgggctgtgcttggtaaggcgctggcagcatgccccagctgagtgagagtgtggggcatctctctccccagccctgcctgaaatagctggaaaaggggagtaccaacccagggatggattcctgatgcctcccagcttctgcagatgggggtatctggggccctcctgcgaagtcaggagatgtctgagcgctggcagcgggattcctaggaggggctcagcggggagctcctggtcctggct

SEQ ID NO: 110177 - DNA, 445 bp, Homo sapiens
gcagagtaattctttaaactgaaattttgatagtgcaagtttatgatttttaaaaagtcatcaaataaattagcttttgagactatagggtgaaaatatctgaaatgtataaaaattgcttggttttgtatagtaccttattatatatgattttctggttattttttaaataaaagatgtactggccgggcacagtggctcacgcctgtaatcccagaactttgggaggtcgaggcgggtggatcacaaggtcaagagatcgaggccatcctggccaacatggtgaaaccccgtctctactaaaaatacatggtggcgcacacctgtagtcccagctacatgggaggctgaggcaggagaatcgcttgaacccaggaggtgaaggttgcagtgagccgagatcatgccactgcactccagcctggcaacagagtgagactgtctc

SEQ ID NO: 110178 - DNA, 414 bp, Homo sapiens
gcttttcagggcttctcttctcgaaacctaaatgaagtgtgaatacaaattacagcagctagcagcctgcagtgggactgaaagtccttggtgaatctccatcaagctgggctgtttaatagaaccagtttagtgtcccattttacttgaaacattagattttgagcacctgcttggtacaagccattttgctaggccatgtggaatggatgatgagcacacacagaccagctaaccctagtggatgttaaaatctcttaggaaatagaagtcaaagaagtacaaagccatctgtgttgtaagaaatgtgaacacagaacctgcctccgagagtaagagggaacttctggattgatcagagaaggttccatggagagcatgacatttgaactagagccaaaagtgtgggtgggt

SEQ ID NO: 110179 - DNA, 612 bp, Homo sapiens
ctggaatgggaggctttcattagtgtggcttcatcccaactcctgcttgtaggtgctgtctgggtgtatctgtgtgattacagtattgtggtgatatgaattattgtagtgtatatataaaaatgagcagagactttttttttcttaagaaatgaagcataagaaatgtctgatggagaaaaaaagattatttttgaagtactgatagagaaaatagtgttggaaaccagatggcaattttttttttataattgcaaaatgttgaaatttgggaggaaaacagttttgttttgtttttgcattacactattaattgtgagctcttataatgaagatcaaagtacatctaagcttttcactagtgagcatatttattttcatgccttccgtacttaaaatttatttattattttattcatttaacaagtataaatggagtacatcattctaggccctggagataaatggcgtttgatcaagactaatctatcagatgggaataagtgttgtgcagaaagttcaaagagggtggtatgttcgagggtgacctggggtacattagaatagatgaccagggaaagttctgcttttagaaaggaatctgtcagttta

SEQ ID NO: 110180 - DNA, 702 bp, Homo sapiens
tcagcttcattcatgattcagagatagaggggtgggggcttaggtggatatcattccatccacacctattagacagcccagaggagggaaggaatgtgcctgtctgctgtgtagcagagtgtgttgtgcacagtggagctggggctagctttgggagaagtgtcccaagcagcaggaatgtgaacaggtgaggcttccagcccacaggagcctgcagagagtgtgcgagactgaattggaaggatgcccacagtgtggttttctgtgcctctgttgccttctcaagtctcctgagtgacattctgggcttagggcttggagccatgtgggtcatctatccaggagagaggtcacggttgagagctggaaaggtagcttcccaaagtcatcaaggatgcaggcttctgtattgctgtttcaccatcctgagttttggctttcaccctcctggatacttcatggtctctagtgagtgctgaaactatggaccctggacccactctgaagggagcagaaggagctggtctgcccccctttaacaagtcttctcatcagtctcattcagcatttctgattccatcccaaccaccacatgggagacacatggccacacctagctgcaagagaagccaggaaatatagcttatctgttacacatattgtccaggtttttgtccctgaggaagaaggggaggatggatt

SEQ ID NO: 110181 - DNA, 137 bp, Homo sapiens
aaaggcaaataatggtaaataaaataattcctgaggctatagaaattggggtaaatggcaagcagcattctatttccatctctccagataagggtccttaggagctgctattttagaccagggtgccaaacattcaa

SEQ ID NO: 110182 - DNA, 367 bp, Homo sapiens
taaataacctcaggactagtgtatgaaatgggctgggctaatactgactgctggactcttaagtcatcatcttgcttactgtcatagtttactggtgcctaccaggaaggtccttcttccccacctctgatcaccgtgtttctctttcaaatgtcttttgcagtggttgtctgacaactcaatggttggtgtaacacaggatttggcatcttccttaaagttatctgattgtgtttatttcacccttgggacataatgtgcaagaccctaggatgctggaaacatggctctatccaagccccgaaggcctgagaaccagggaaacggatggtgtaactgtcagtctaaggccaaaggcctgagaagc

SEQ ID NO: 110183 - DNA, 282 bp, Homo sapiens
taggcaatagagcaaggctgtgtctcaaaaaaagaaaaagaatgcggtagagacaaacgcagtggctcatgcctgtaatccccattactcaggaagctaaggcaggaggattgcttgaggccaggaataagtatgtatttttatacacatcaaagctatacatctacacacaagtattttaaaatatatgcaaaatataatatatttgtttctctgagtaagaaagatatctaaaccagtaatagttgatacctctaatgagtagaaaagtcaacttgggca

SEQ ID NO: 110184 - DNA, 326 bp, Homo sapiens
gtgtaattagacagtctcaaagcataagcaatttcaatgtgacgtgtgtattttaggggagagggacaggagaaggacttttggtggaatttattactacttcaaaaaagtaaacttggcaaatccatcccttcttggcattaaacagatattgtcttcatagtggtaaatggtctccatgactcagcctccagttgcaaggcagatgagaggtctctaaacctgtcagagagcccacagggttacttaagtcaactccctgccccagtcagctatctatctactccccacaataaatggctggtcagttccactttaaatatctc

SEQ ID NO: 110185 - DNA, 853 bp, Homo sapiens
gtagagctagaatttgtggcccattctgtccagctctaaagtttgcatctgtttttaacttttttcttaattaaaaagagataaatatgcacatagagaaaaacctactttttatttcaccatccagaggcaaacactactaatattctggcacattttcttcctgcctttcttggatattttttaaaattttatatttgagagataacagactttaaaggaaatgtgaaactcttccctcaccattcggtgaatggaatgatataaggaggtaagtggaattactctagtaggtaaataaataataaatgaataaataaataagagccttgatctcctgggatcaagcaattctcccacttcagcctcccatgtagctgggactacaggcacatgccaccacacccatataattattattattattttttgtatacacagggtcccactgagttgcccaaggctagtctcaaacttgtgcactcaagggatcctcctgcctcagcctcccaaagagctgggattacaagcataatccactgtacccagcctgtaatccactgtatttctttttttcagcatcctaaataatactgtagtggatatctttttgcagtaacttattaaatctatagaactttgcacatattaataattaatgagacattaattgctatgaaagtctcatgcaattaaagatgacaaaacacagaaagatatttagtgttacagttccaatagttaatcttgtgtgtttgagatgactgtgttaagggggtcataactgcaaaatgtcttcaatatgttgtaactgatatctcaattgctactgataagaacttatttctaaaac

SEQ ID NO: 110186 - DNA, 412 bp, Homo sapiens
tcctgacctcgtgatccgcccgcctcggcctcccaaagtactgggattacaggcgtgagccaccgcgcccggccgcctgtccctgctttctcacaacctcaccccaagctgagctgctctgttctgtgtagccagaggctgagtcctcagacctgacacccaacagcttgtgggccacatctcttccttccaatcgcgatgccttgtcttgtgtcctggccctcgctgtgtacaggctccctctggcttttggcatatagtccaagactcctgcccccaccacccccaggctgatcttcctgagtccaggtttggcgaaggtacagccctgctaagaagcctttgatgggctcttttgcataatgccccaactctcaggcagacatttccaccctttcccattcacacccca

SEQ ID NO: 110187 - DNA, 394 bp, Homo sapiens
tagctgagccctgacccacaaaatcttgagaaggaattaaattgctattgttcccagccagaaaagcaaggtagcttaaggtagtttgttccacagcagtaggtaactagaacagtcatgtccaaggatttgttcctgcactttccccttcgccacgtatggcagaaattctcaggaattctcatgagccagtgtcatgctagtgcttgttgcatctgctcctctccagccgccccagcccactgatccaagcactctgtgaaatgacttttgtgtgtcgacttcttcccacgaggaagacgtttctttcattgccatgtgctggaccccagtgcagagcccggggcattgtcagtgcttagtgtttgttgaatgagccaatggaactggtcac

SEQ ID NO: 110188 - DNA, 351 bp, Homo sapiens
attcagcttcatcactgcatcacacaccgggtagacgtgcattcaacactgggtagacgtgcattcagcttcatcactgcatcacacaccgggtagacgtgcattcaacactgggtagacgtgcattcagcttcatcactgcgtcacacaccgggcagacgtgcattcaacactgggtagacgtgcattcagcttcatcactgcatcacacaccgggcagacgtgcattcaacactgggtagacgggcattcagcttcatcactgcgtcacacaccgggcagacgtgcattcaacactgggtagacgtgcattcagcttcatcactgcgtcacacaccgggcagacgtgca

SEQ ID NO: 110189 - DNA, 398 bp, Homo sapiens
cttctaaccctacctattttctcctctttttgacaatgctttaaaagaaccactgctacatttgaaataagacacaaacctttacaaaaaaaacttttaaaagccttatcgattcttattttgaatgaggaaagaggaaaatagttcacacagtcacaactagtttcttcatactcccatacaaaaaaaaaaaacaaaaaaaaaccaaaagcaactaacaaaagaattaacacagtgtcaggacaaactgtaagatttggtagggcaaaccaagtagtatttgaagagccgtaaatagcagaaacgtctactacacgtatcagataatcaaaaaatcacatatggctttacgatgcattttaaaaagttttctgttcataagagtgtcaccatttaaa

SEQ ID NO: 110190 - DNA, 437 bp, Homo sapiens
cctctgagttgattaaggccatatcaccagaatagtgcttccagaccagagcattcaggttcatttaatttctctttgtaaacaaagcaaccaattttcagttctattgcaaatatctaactgtcctctttttcacagaggagagacaagtattaactgctcttcaaaagaaagttactctgatttacagagattgtaaacctctggcccccacaaacaaacaaacaaacaaacagaaagaaaacacagagcaacaagtctcttaaggacgtaagacacctaggagatagtgttcccactaaacaatgttgggactgggccctgtggctcatgcctgtaatctcagcactttggagggtgaggcaactggatcacttgagcccaggagttagcgaccgattgggcaacatagcaaaaccccgtctctacaaaaagtt

SEQ ID NO: 110191 - DNA, 497 bp, Homo sapiens
gtaggagggcaaaaaccaagagaaggcagtcaccgaggatgaaaggggagacaagtccaagataaggaatgttcaacaatgccacctgctgtgggactgtcaaggtaatggaaggactgtaaagtatccattaggttgagccctatgacgtagaaatcagagacctcagtgagaacggtgtcagaacaggtgacaagggttcgaaggatgggtggaaggtgaggaaacaaagataaaaagtatagagagcttaactatttggctgtgaagagagggagctggaatagctatacctggtggggcaggaggatgagaggtgggtggagagtttgttttgaaagtagattagagtatgtttaaatactggtggcaaaaagaggggttggtagacagtggataaagacacagaagggaatgagatcattaaggagccagcccttgaaaagggaggaggttggggtctagagaacaggtggtgagagacacattgacctagg

SEQ ID NO: 110192 - DNA, 718 bp, Homo sapiens
tgactgtggtcccagccccttgggaggctgaagttggaggattgcttgagcacagcaggtggaggctgcagtgagccgtaaccgcacatctgcactccagcctgggtgaccaagcaaaaccctgtctcaaaaaaaaaaaaaaaagaaaaagaagaagaaagaagatcagtaagcacaattgatggaaatgaattaagtgtttcccttaaaagattgtcagactagattaaaaagctgaatttaaatgtatgctgtatatcagagacatataaaatataagaacagaaatgctgaaaataaaaaaataaaaaagaagttaaaacatctaccaaaacacagaacaaagaaaactggttaaccacttccagttagaacacagaaatatgacactttgcataacaaggagaaaaggttagataagcaatgaaatcatactttttgttgggtggttggttggttagttgggtggttgtatacaagaaagctgagaactcaaagaacgtaaatgaactaaactccagagaaagagaagcccttgctaagagagaaaacactccaagcccttttcatccctgggtcacagtggaaagaagagtaaactgcatgctgaaagcagggcaagagaaaccaaaataatcttttagcaacctttcattggctgaagatatttgacttaattaattaaaacctgaggctctccagacctgttctgccaatt

SEQ ID NO: 110193 - DNA, 782 bp, Homo sapiens
gaaatttcaattactcaaatcagaaaattattaagttcacctttagcaatatataatatagatctttttccccactctgtttttcgaagagctgtactaccattttgtttcatcaagttctgcctccagtgatacttgacccccatttaaaacattcgagtttatttaacagcttattgagcccttggacatatcatagaaactactttgtttatccatctgtttcattgatcagagagaacagggtcagttttttctgccatcagaaaaatcttttattagttgttggttctgtgacccttctttctggacagcgtgggttctctcttgccaaaaacatatagccactattgggttttcctgtcactacacggggtactttttacccagtggacctctattatccttcagtcttgaagatccctagtcattctccttctctccccttccatctaacattaattgagcaccaactatgtgccagaccctgcgctaggtgcttggagtacagtagaaattaaactcttttctgtgtttaccaatctatgtgcctttcatctcagttttctacagaagttagtcgaagatatcagagttgatacccagaacttattaaatattttttcccttagccaggcattgtggtgtgcgcctgtagtcccaactacctgggaggctgaggtgggagggtcagctgagcccaggaggttgaggcagcagtgagccataattgtgccactgcactccagcctgggtgacgagcaaggccctgtctttaaaaa

SEQ ID NO: 110194 - DNA, 483 bp, Homo sapiens
cagctagtgtagacttaaatcctgtgccctctactcaactaaagccctgccccacctaatgtatattagataaggggtgggggatggtggtggtagtaatcaggactctgaccaatattctatgccaaaggatgctaaagatacaaagttttcagttctcagtagatttccatgaaaagtccttggccaccctggaagaggcatactgcctgtcctacctccacctccaacatgaatttgacttggagtatttatgttctaaaggactgaagaacctccactcctatcctgtcccaattcaggattgtctctttcttccttccaggtcacttgcaacagtactggtccagatgaaataaaactgtcaagggaatcctggagctattttgtcaaaaggcagccattggcagcaaacctcttgttggcattactcagtgcccctttgggaacaatcccagtgattaccctagccataacccagcc

SEQ ID NO: 110195 - DNA, 849 bp, Homo sapiens
caggctttaactctcccctctctcccctctcccctcctcaagggaaatttaaattaagtgggaaattactttttgtatagatgttcttttgtcttaaattcatgctcatgtgactttccacttgccatttagagtaacagttattcaaagagcattacctaaattccattcattaagaaaaaaacttatgcccctgctctgctccttcacccctcatcattatttttaaagctctctaaatgcctgtcttgcttaaagaatcataagactatggaagtggaatgcacttggcatgttgttcactattccatgaatttgtagactaaatatgttatttctgtggctcatccagaagatgttgtcatcctttaaaattgcaattagcattattgtaaaattcgttgatggaaaaagatctattaaggttacgtgtattttggatttaatgttgctttacctaaggatgttagggttcaccaaatcctgctttgcttgggatatgcaggcaggaaaattgagaagaaatctttttttttcccattaataaatgaaagaacttcaatgtgaagaatttaaaaaagtcccaagcacagatggttcacctgggtaatttgcaaggaaactggatgagcataatgtaggtggggaagacttagggaaattattcggatagttcagttcctttccttttatctgtctgagccagttagggggaaaaaaaaaaatgaggtttttggatgtcagaattacctgctggaatttttcatgcacttttcagaataaaaaacgtcaaaagagagaagttaaattttccagtatgttttaagaaaataaacaaaatgagacatg

SEQ ID NO: 110196 - DNA, 429 bp, Homo sapiens
tgaaaatccatagaactatacaacaaaagaataagttttactgttacataaaatttttgaaagtagctttagcacaacattttctagaagtcatctgaagtcacctctgtcgtgcataatccctctcagccctaaggtctgaggtcctactctactggaagcacctagaaggagagctctgctgttgtctctatcacagtctgttacaaaaagataattacttgttgactgcatgcatagtttaatctggaccataaggcatcacatttttataactcacattcccaataatttggcagtattaaatctcactaattgcacattatctgtatggacagatctaaataggaaaagcaaatagatggtttcagcaattatcctaggtaattaaacttaagcatacattgatccaaacatgtgttagcatct

SEQ ID NO: 110197 - DNA, 2117 bp, Homo sapiens
gttcctttaaagatcagtagtatttatactctgaaaagagtaccaagcttagttcagttatttattcatccattttttttctattgtttctcctctggggggaaatggtgttttgtttttgtttgagttttgtgttttagttttttggttttggttttgttttgtttttttgtcattcagattcactaaatttggggatggttttattaaagtatattaacttctttttaaccaaagctttctgaatatgaccagcctcaggtgctagcgcattaaagagcaactaaacctaattccagtgtcgatttgtgaaataataaaagctaattgaatttctctaagggtgagagagaacataatgatgaacttaaaaagaaattccttttcccagaagggattctgcatgtacctacaaacaatcatgctctaaccacagtaatagtcatgccatggtgacattgcttttacggtaaaccaagataggtaatatgatgcttcttcccaggtgtttctgaaagaaaagcagcggtggagcttaagagccaagtccactgattgacataataggatggaattgtagacagagacatgctccatgaaacaaggaaacaactgactactatttggatctaagttgggatctgatgttaaacaataaattcagtttaaaaaaaatatggagctcagaaaaggatgtgaaaaactttgcattttcctttcttcattattacaaaaacacctatgtgatgacataaaatacttgggtgatatcagaacaattatccttaatagtttttataattaaagtttcctaaacttcagtctccaatagtcttttaaggattggaaccacatcactgtcagccccgctgctacaatgcctttgtacaatttttttacataaggcaaataaggcttttgtacaaagcctgaataccttctgttccaatggtgtccaaatggttattatattgtgaaaaacctggccttggtcacaatgcaaacaaaagtacagatgaaagtgctttttggacagtttgcaaattgtgttaaagctacggattttttttaaagtgttcagcatcttaacgtgtattaaagctatggatttttttttaaagtcttcagcatcctaattcaccctttctaacttaagaaaaacatgacttaagacactgcttctaagtttggttgttctttatagtgtggatacccagttatctgtgagcgtatgggggtgggctgagggtcaggtgaggaaggagtgtgtgtgtgtgtgtgtgtgtgtgtgtgtgatttgcatgtgtatgatgtgtgtgcgtcggaccgcttctaggctactaagtgtcaatggaaaagaaaatgtattcaaaatacttaaatcaaaactagaagatggggaaaaaaagatttattctatacaaagccttgtctggaccactttagagagacttctatttttttaacccttctataaatatttgatggcacttgaaatattcctgcaataaaatgtgatttgtgtaaagaaaaaaagattttgtaatgtgaaacaaagaaagaaagtaatgtaattttctaaaaaaaaaaatacaaacaaacaaactttgtattattttcttgatggaatttgtctatctgtctttggaaaactttttatttcattgaatgtgccatagtagaaatgtgtgtttttagttttagactaaggaatagctagttgttgtgttccgacattccaaaatgcaaaacaacctagtagtatctttcatgaaaaggtttaagtagtatgtaagcttctctcattgttgcttttttgcacatgttcttcattcctctctagtgcaatatgtacatagagcacttgcgggtgtaccttgatccctcagggaaaaatacatatttgtacagttttttggggtttttttgttttttggttttttttgttttgccttttgtttttggctaaggaatgtcgatcgaatcacttgttattgttgaggggcagccagataataatcctaaagccactgtttccaacattgattgtttaaatcatatgtccttccaatgctattattttaagataataataaaaagttattttctgacaaaaa

SEQ ID NO: 110198 - DNA, 1979 bp, Homo sapiens
gttcctttaaagatcagtagtatttatactctgaaaagagtaccaagcttagttcagttatttattcatccattttttttctattgtttctcctctggggggaaatggtgttttgtttttgtttgagttttgtgttttagttttttggttttggttttgttttgtttttttgtcattcagattcactaaatttggggatggttttattaaagtatattaacttctttttaaccaaagctttctgaatatgaccagcctcaggtgctagcgcattaaagagcaactaaacctaattccagtgtcgatttgtgaaataataaaagctaattgaatttctctaagggtgagagagaacataatgatgaacttaaaaagaaattccttttcccagaagggattctgcatgtacctacaaacaatcatgctctaaccacagtaatagtcatgccatggtgacattgcttttacggtaaaccaagataggtaatatgatgcttcttcccaggtgtttctgaaagaaaagcagcggtggagcttaagagccaagtccactgattgacataataggatggaattgtagacagagacatgctccatgaaacaaggaaacaactgactactatttggatctaagttgggatctgatgttaaacaataaattcagtttaaaaaaaatatggagctcagaaaaggatgtgaaaaactttgcattttcctttcttcattattacaaaaacacctatgtgatgacataaaatacttgggtgatatcagaacaattatccttaatagtttttataattaaagtttcctaaacttcagtctccaatagtcttttaaggattggaaccacatcactgtcagccccgctgctacaatgcctttgtacaatttttttacataaggcaaataaggcttttgtacaaagcctgaataccttctgttccaatggtgtccaaatggttattatattgtgaaaaacctggccttggtcacaatgcaaacaaaagtacagatgaaagtgctttttggacagtttgcaaattgtgttaaagctacggattttttttaaagtgttcagcatcttaacgtgtattaaagctatggatttttttttaaagtcttcagcatcctaattcaccctttctaacttaagaaaaacatgacttaagacactgcttctaagtttggttgttctttatagtgtggatacccagttatctgtgagcgtatgggggtgggctgagggtcaggtgaggaaggagtgtgtgtgtgtgtgtgtgtgtgtgtgtgtgatttgcatgtgtatgatgtgtgtgcgtcggaccgcttctaggctactaagtgtcaatggaaaagaaaatgtattcaaaatacttaaatcaaaactagaagatggggaaaaaaagatttattctatacaaagccttgtctggaccactttagagagacttctatttttttaacccttctataaatatttgatggcacttgaaatattcctgcaataaaatgtgatttgtgtaaagaaaaaaagattttgtaatgtgaaacaaagaaagaaagtaatgtaattttctaaaaaaaaaaatacaaacaaacaaactttgtattattttcttgatggaatttgtctatctgtctttggaaaactttttatttcattgaatgtgccatagtagaaatgtgtgtttttagttttagactaaggaatagctagttgttgtgttccgacattccaaaatgcaaaacaacctagtagtatctttcatgaaaaggtttaagtagtatgtaagcttctctcattgttgcttttttgcacatgttcttcattcctctctagtgcaatatgtacatagagcacttgcgggtgtaccttgatccctcagggaaaaatacatatttgtacagtttttaagggcttccagtaatactagtatgattgtgtatggtatattttagtttgttaactacgtaca

SEQ ID NO: 110199 - DNA, 1603 bp, Homo sapiens
tttgtgaatgtttatgttcttggtataatctaggaaccctatgagtttatctcagagtgaactaattctagatttgttgtcaatagatgctataattcaagaatgttgctctccatatttgaaaaacgatggataggagggtgagggaagcatacaatgttgaaccagtttctcttatttaaatattaaatactttaagcctttaaagtgaagttgatgctagctgcaaacatttactcttgtatttatcttcactaggaaactgtggactgtaatttattttattaaatatttagaagattatttggcttgtgtgttcaggtgagaaatactgagttgtttttgtttaatttcatggtttttttttttaatgatccctagtgggggaaggggaaaggaatagtctgataaacagatgtgcatattttaaaaacaagtgaccttttgggaatgtaggcatttagacgatgattttagtcgcactaggggtgggattcaaactactggtcaaagaccatttggtacagaaaagggaacatctccgatgggtgttaaggtaggagtttccatgcagccctttatgtctgagaaatagtctcctctgccattggggtccctgcggaatcttctacaggaattgcagctcttcacgtcatgctaggttaccagcatgggcttcccagagcacttcactctgtttctaactccactgacttttctgacttgtttcttgagggacttggaaaaggggaaggtattattcacacagatgtgtgtatgaagcctaaataacatccaactttttttccaaaaacatagtaagagtttaaccataaatggaaaagaaaatgtattcaaaatacttaaatcaaaactagaagatggggaaaaaaagatttattctatacaaagccttgtctggaccactttagagagacttctatttttttaacccttctataaatatttgatggcacttgaaatattcctgcaataaaatgtgatttgtgtaaagaaaaaaagattttgtaatgtgaaacaaagaaagaaagtaatgtaattttctaaaaaaaaaaatacaaacaaacaaactttgtattattttcttgatggaatttgtctatctgtctttggaaaactttttatttcattgaatgtgccatagtagaaatgtgtgtttttagttttagactaaggaatagctagttgttgtgttccgacattccaaaatgcaaaacaacctagtagtatctttcatgaaaaggtttaagtagtatgtaagcttctctcattgttgcttttttgcacatgttcttcattcctctctagtgcaatatgtacatagagcacttgcgggtgtaccttgatccctcagggaaaaatacatatttgtacagttttttggggtttttttgttttttggttttttttgttttgccttttgtttttggctaaggaatgtcgatcgaatcacttgttattgttgaggggcagccagataataatcctaaagccactgtttccaacattgattgtttaaatcatatgtccttccaatgctattattttaagataataataaaaagttattttctgacaaaaa

SEQ ID NO: 110200 - DNA, 880 bp, Homo sapiens
cggtgtcttctgggtctctatcctgctttggtaggcttaaaaagtgtgtgtgtgtgtgatttgcatgtgtatgatgtgtgtgcgtcggaccgcttctaggctactaagtgtcaatggaaaagaaaatgtattcaaaatacttaaatcaaaactagaagatggggaaaaaaagatttattctatacaaagccttgtctggaccactttagagagacttctatttttttaacccttctataaatatttgatggcacttgaaatattcctgcaataaaatgtgatttgtgtaaagaaaaaaagattttgtaatgtgaaacaaagaaagaaagtaatgtaattttctaaaaaaaaaaatacaaacaaacaaactttgtattattttcttgatggaatttgtctatctgtctttggaaaactttttatttcattgaatgtgccatagtagaaatgtgtgtttttagttttagactaaggaatagctagttgttgtgttccgacattccaaaatgcaaaacaacctagtagtatctttcatgaaaaggtttaagtagtatgtaagcttctctcattgttgcttttttgcacatgttcttcattcctctctagtgcaatatgtacatagagcacttgcgggtgtaccttgatccctcagggaaaaatacatatttgtacagttttttggggtttttttgttttttggttttttttgttttgccttttgtttttggctaaggaatgtcgatcgaatcacttgttattgttgaggggcagccagataataatcctaaagccactgtttccaacattgattgtttaaatcatatgtccttccaatgctattattttaagataataataaaaagttattttctgacaaaaa

SEQ ID NO: 110201 - DNA, 393 bp, Homo sapiens
ctgcttagaagaaggtatgagctccccgtctctagaaatatttgagcagaagacagaaaccaactgccagggaacctgcagagtcctatttggggacccggtcagagtagtctggatgtccaagataatctcagaaggcactcagaaaacccaccagctccagggttctatagagcagcagttcccacgcctggttcatcctcagaacctcctgttttaaaaatacaggctatccccaaaagctgctgcttcagtacaggcagggcctgtgttccagggttcactgcgtcctccaaagaagattatgttgaagtcctaacccccggtacctcagaatgtgactttatttggaaataggatctttatggaggtaatcaagttaacatgaggtca

SEQ ID NO: 110202 - DNA, 240 bp, Homo sapiens
tcagagacttgctataggtcacacagcagggagagcagagctgggatctgactgagttctactcccagccctgtgttctttcgagagcttccaccactgctggacattgctgccccttccagcaaagggcagttgccagcacccgctccaagcaggggcacctacagatgccagtaccagtggggatcgcttggctggccgtcccaagcacggccactctgctgctcctgaatgagcaca

SEQ ID NO: 110203 - DNA, 180 bp, Homo sapiens
ggaagggttggagattcagtgtcacaataaatgcctggtcctacccagaagttgaccctgaaaatgttgagtatggaccctgaattgtcttagcaaagctgtgatgaaatgacaagcttagcttcaggactaagtggacttgttagaaaccagtttcctctatgaatggacttgatggaa

SEQ ID NO: 110204 - DNA, 633 bp, Homo sapiens
tgtaatcccagctactcgggaggctgaagcaggagaatcacttagaacctgggaggcagaagttgtagtgagccgagatggtgccattgcactccagcctgggtgacagagtgagactccgtctcaaaaaaaataaataaaaaaataaaaagtcagcaaagggaagtttcagggtttcaggattcattcatccattctaaaaaattttgagtgcatactatgtgtcaaattattgtctaggtgatggctatagcatgccgaggtagtaagtgctaagaagaaaataaagcagagtaaggaactgatagtgactggtgcaggaaaggggtgccagtttaaatagcatggtcagatggaaaagcctgtgataaggtaaaattgagcagagacctaaatgagagagagtgaaccatgcgaataattaagtgaataatgttttaattatagggaacaatatgtgtgtgtctatatatatatatacacacaaaggtactgaggcagcagtatacttggcatgtttgaggaataacaaggacactagtttggaacagtgtgtgggagggaaaaaatgatagaagatgacatcatagggagtaatggtgtggagccatggtaagatgttaagattttact

SEQ ID NO: 110205 - DNA, 739 bp, Homo sapiens
atttaaggtagttttcgttctgtggggtgggggagggaaggaggatagagttggagaggaatatacaggctggtttctggggtattggtaatattctatttcttgccttgatactactgttcattttaattttgttcattaaacaatacacattgttttacatgctttttatatgtgtgctatatttcatgaaaaataatttcaacctctctgacttctccccacttctccactctccctccttcttaccaaacaaattattccttattttaaaaccgcttcccacttttacctctgatctctttcttctggagtgtaatcctctgggtcgtgcaagagttttatgttcctttattaacaaacctgttaatctatcaccaatctcaggtcatccctttttctttgtcattgtcacttttgctcttctttctccattcttttccttaagcagacttttaaatttgcccttagaaagtaaataagaaagcgggtttcccttgctgttatctttattttattcttttagtttttcttttatgagtttactaggaaattattttaggtgtctccgtttcacttagccactgagtaagcagaaagtttaagtgaacttaatgaaatggggggaggccagggtgggaggatcacataaggccaagagtttgagacctgcctgggtaacataccaagaccctgtctgtacaaacaattttaaaaagtaactgggtatggtggtgtg

SEQ ID NO: 110206 - DNA, 148 bp, Homo sapiens
tccgagacccacacccttcagcaccatctgggcttttcgtgtcattaccgaaaatcttaggccatattttctttaaaaaaaatcctccaagactgctggggagcggtttccaatgaacactggcaacaaaggtgacctaagaggttaa

SEQ ID NO: 110207 - DNA, 503 bp, Homo sapiens
  misc_feature (503)..(503): n is a, c, g, or t
gccagttttttcatatctttttcattctcaatgtgttttaaagacgatcaatcatgattccacaattgcacatgtaagttgccttattttctcgagagagagttggattgtactcagagatttataatcatttaagatttctctttattttcatttttttcctttcatcctggagaaattttttctgctttagtcaacaccatagcctggcatctaacacactacccgattattgactgcttaagttttcgatcttttttccttcctgtttccttttttttttttgtgtggagaacgaggagtttctcgcctcttttgtcgcccgaggctgtggaagtgtgcgagttagccacgaactcctcagaggcttccacgtggcaaacctctccaaacctttcccgagggttttccagagggtgagatctatctttgtggcgcctcgaagcttaacttccaagagagggcttggaggccaaggggagaattaggcctgtgaaccccgn

SEQ ID NO: 110208 - DNA, 237 bp, Homo sapiens
ggaatattgttttcatgcctgttaacaaaacacccattctgctgccatagatagagattgctctgatgaatgtggcaaagtaaattgaacaccttcagaaaataatttgccttgctagatcccataaagaacgtttgtaattcatgaaaggaggtcaaaatatcaacattaacagaagcttggaagtctattccaactcttgaggggtttaagacttcaatggagaaagtaactgca

SEQ ID NO: 110209 - DNA, 370 bp, Homo sapiens
tgctctcctttccagggctttaagcccagcacatgatgttgtgcgtttcttgttccaccaactggctgctgtggaatgactacgaaacatcttggatgacagtttaatcctcgtggggtaccaggtggcatctgggcacaggtcaaactttccgagagcctttttaacctctttcactgcagccaggaatggctggatctctgctgctgcctatagggattacagttgtcccatccatacactggtctgtgttggcttttgtcacctgggcatgtgcggccaccatcttgactgctcagctagttctgtacctgggttctagaatgatgtcataatgatgccattatgacagatcagcccaaggctgcac

SEQ ID NO: 110210 - DNA, 295 bp, Homo sapiens
aaaaaatggaaaagtgaaaagaatgatcgtctaaaaataagcacgaggaagtctagaacacggtgcttaccagtcaagtttggagtcaggcagctggggtttgcatctctgctccacttctgattggctgtgcaacttaggaaagtggcttcagtccagggtctccattcctcctctgtacagtggggataattgtaggatctgcttcaggatgttgttctgaggattcacggagacaacatatgcaaagccctacagttgtgcctggcatatagtgagcaaacagtgcctatta

SEQ ID NO: 110211 - DNA, 415 bp, Homo sapiens
ccttactaacataggtgttagcccatggaagaattctcaattaatttcaaaggactaaactcatacaaagtactttctctgaccacagtggaatgaagctagaaatcaaatgtggaagaaaaactggaaaatttgcaaatatgtggaaagtaaaccacacactcttaaaccagcaagtcaaagaagaaaccactagggaaatataagatatttttagaccaatgaaaacataccaaaactgatgggatgtagtaaaggcagtactcagaggaaaatttatagctgtaaatgcctaaagatctcaaatcaacaacctagctttacaccttaaggaattagaaaaagaagagcaaacaaaacctaaacccagcagaaggatagaaacaataaagattagataacagataaatgatgt

SEQ ID NO: 110212 - DNA, 1307 bp, Homo sapiens
cagcgggagacggccacgagattcccccatctctttgaatataattttagattgagattcagattaaatccgaggggaaaacactttatgaggctgaaagctgtgtcgttgccagagacagggttatgagctatcaaatgcaattacattaagacagattatactgggcaaattgagccatttagaaggtgagaatcaaagaaacggctctgatcctcttttcccccttctctctccctctccctctctctctaaattgcagttcgtagttccttccaattcggaggcacaaaagtaggtgagactgcttttgtatctgcgaagtgcttcactcctgaatgtaattctagctgagtgcaatctaggttaagagccggacaagcgggtaattagagcccgctagctgcccgaggaccggccgccccgccaaagcgcgccccgagtcggcgcccttctcccggccgagcctagctgcggctggacacggagcgcccgagatgatggtgctggacaaggaggacggcgtgccgatgctctccgtccagcccaaagggaagcagaagggctgtgcgggctgtaaccgcaagatcaaggaccgctatctgctgaaggcattggacaagtactggcacgaagactgcctcaagtgtgcctgctgtgactgccgcctgggcgaggtgggctccaccctctacaccaaggccaacctcatcctgtgccgacgcgactacctgaggctctttggcaccacagggaactgtgctgcttgcagcaagctgatcccagccttcgagatggtgatgcgggcccgggacaacgtgtatcacctcgactgcttcgcctgccagctctgcaaccagagattttgtgtgggagacaaattcttcctgaagaacaacatgatcttgtgtcagatggactatgaggaagggcagctcaatggcacctttgaatcccaagttcagtaacgcccggcgcctggcctccaggcccgtctgtccatctgcccgcctgcccacctgcctggccggccagccagccactctaccagtgcaggctggccagccgctctcctgccacattagaacttctccgtcctcgatgggagggatggcccttcctcctccaccaccgcccgtctgtgtgtgacccctcctggggccaggccgggcctgtacagtctgtcttctgtatataaatgggaacatttattttatgagaaatgtaatgcgattttattactggcgtggattaaacttatgaatgtttccgggaggttactctgcgttgttcacatgactgacaca

SEQ ID NO: 110213 - DNA, 824 bp, Homo sapiens
gggcccatcctgcgttgctgtctgtctgtccgtctgcaggcgtgccgatgctctccgtccagcccaaagggaagcagaagggctgtgcgggctgtaaccgcaagatcaaggaccgctatctgctgaaggcattggacaagtactggcacgaagactgcctcaagtgtgcctgctgtgactgccgcctgggcgaggtgggctccaccctctacaccaaggccaacctcatcctgtgccgacgcgactacctgaggctctttggcaccacagggaactgtgctgcttgcagcaagctgatcccagccttcgagatggtgatgcgggcccgggacaacgtgtatcacctcgactgcttcgcctgccagctctgcaaccagagattttgtgtgggagacaaattcttcctgaagaacaacatgatcttgtgtcagatggactatgaggaagggcagctcaatggcacctttgaatcccaagttcagtaacgcccggcgcctggcctccaggcccgtctgtccatctgcccgcctgcccacctgcctggccggccagccagccactctaccagtgcaggctggccagccgctctcctgccacattagaacttctccgtcctcgatgggagggatggcccttcctcctccaccaccgcccgtctgtgtgtgacccctcctggggccaggccgggcctgtacagtctgtcttctgtatataaatgggaacatttattttatgagaaatgtaatgcgattttattactggcgtggattaaacttatgaatgtttccgggaggttactctgcgttgttcacatgactgacaca

SEQ ID NO: 110214 - DNA, 872 bp, Homo sapiens
gggcccatcctgcgttgctgtctgtctgtccgtctgcaggcgtgccgatgctctccgtccagcccaaagggaagcagaagggctgtgcgggctgtaaccgcaagatcaaggaccgctatctgctgaaggcattggacaagtactggcacgaagactgcctcaagtgtgcctgctgtgactgccgcctgggcgaggtgggctccaccctctacaccaaggccaacctcatcctgtgccgacgcgactacctgaggctctttggcaccacagggaactgtgctgcttgcagcaagctgatcccagccttcgagatggtgatgcgggcccgggacaacgtgtatcacctcgactgcttcgcctgccagctctgcaaccagagattttgtgtgggagacaaattcttcctgaagaacaacatgatcttgtgtcagatggactatgaggaagggcagctcaatggcacctttgaatcccaagttcagtaacgcccggcgcctggcctccaggcccgtctgtccatctgcccgcctgcccacctgcctggccggccagccagccactctaccagtgcaggctggccagccgctctcctgccacattagaacttctccgtcctcgatgggagggatggcccttcctcctccaccaccgcccgtctgtgtgtgacccctcctggggccaggccgggcctgtacagtctgtcttctgtatataaatgggaacatttattttatgagaaatgtaatgcgattttattactggcgtggattaaacttatgaatgtaaaaaaacccatatagatgacaccccatttaccattttaaccatttgaaagttcattggcattcacagtgtcgtgctcagagtccctg

SEQ ID NO: 110215 - DNA, 338 bp, Homo sapiens
tttgggctaaagccgttgggtttgggacaagagaaggggagagctggtacctcttcccttttttgcccaggaaagttgtttctccatcatttcatggctcaaagtcattaaatctgagtaattcttacaaaccagatccaggaagaatctaggagtgggctctctgtagattagaatgcttcaggctgcaggtaacagaagacttgactggaaatgccttcaacagagaagggatgtatcattttctagaaggagaaattctgcagctgggacggttccagggttggtttctttggaaactcagaacttcatcgaggctctggattcatttcttcttt

SEQ ID NO: 110216 - DNA, 306 bp, Homo sapiens
taggttacgtggcaaaggggcgaagggggaattaaggttgcagatagagtttaagttgccagtcaattgaccttgagatggggagaggatcctgaattttctgggtgggttcagtgcaatcagcgttctcataagtggaagagggaggcaggagaaagaatgtcagggggacgccatatgagaaggactcgactggccactgctggcttcaacaatgggagggggccaggagccaaagagtggtgacacctggaaaaggcaaggaaacagcttttcccccagactctccagaaaggaatgtagccc

SEQ ID NO: 110217 - DNA, 319 bp, Homo sapiens
gactctgagtgatccccctagcgcatcagggtggttcaaaaacatggataatattcttggagtaattagtggctaggtagttaaactcatttaggttaatctcagaaaaaaacaattataaaaaagtaaaactctggaagctagaatttaaaaaaaaaattagttttattactttagaattaatttgcattattttcttagattaatttaggtttttcttttggggtaaataggatcatgtgcatctgcaatgacatcatgagcaaattttgcttctcggaaatgctagattttcttttttctgacggagtttcgctct

SEQ ID NO: 110218 - DNA, 387 bp, Homo sapiens
gggttgtttgaagctgatacatttgtggtagtttgttacacagcagtagacagctaaattaacttctctatgaatctgtcaaaaaattaacgttgaaaaagttaaattcgctggccaggtgtggtggctcatgcctgtaatctcagcactttgggaggctgagacgggcagatcacgaggtcaggagttcaaaaccagcctggccaacatagtgaaaccccatctctactaaaaatacaaaaatgagccaggtgtggtggcacatgcctgtataatcccagctgctcaggaggctaaggtgggagaatcacttgaaccgagacgcagaggttgcagtgagctgagaccacgccaccgcactgcagtctgagtgacagagtgagactc

SEQ ID NO: 110219 - DNA, 185 bp, Homo sapiens
ctacattttacactgtgccatttctgtatttgtcctttttagcctacttctatcacagtctctctttgctaaaatacattagttgccatggaaacgatgtcatagtgtgtaaaaccatttactgtccttggaaaggcattcatgataaaattgaacagtagcacgttccacaaagagaagcaaca

SEQ ID NO: 110220 - DNA, 488 bp, Homo sapiens
ccaagttagggcacctgaagggcaggggatagaggtaggtgggctttggatcataatctcgacagacacagtcctgagcaccataatcccaaatgttgaaatcccaaaagatcaaagtccctaaggtcttggctggtccagaggtagtgagttatcttgattgttcagttacagatcaaactccatgttctactctttacccccttcttacttctacacttgactagtcaaggagaaaaatccttactgtctaaaatcccaaaaatcacaatctcaaaagattaaaatcctgaatgttgaaatcctaatgttgaattcatgttatgaattctagggaagggattagtgcattttccgctgtatgcaggatagtgcatcatattagttataccatgtaactaatatgatgcaaccattaccttgttattgtctttatttgaattaagtatggtttaaggagatgtgaatgggtgctaagttgacaagga

SEQ ID NO: 110221 - DNA, 584 bp, Homo sapiens
gttttgaagtcatgagcaaaagttgcaaagtaatttgtctagggatacataggaaaattagtctctttatcattatactttgtgtcgagatttaatactgaaataactatggaaagtgaagtagaagaggctcttttttcttaatgtgaaaaccttgtgaaaactatataagagaaggctagtttttgagtccaaagctagaatttgaatgttaaaaggtgcacagcctggtagctggtgagtagggcacattttatgtactggaacatagtgaataaaaccagtattcctaccaggtgagaaatccctaaattgtgtcttacacacctgctgaaagagaaggaaagcctatgggagcaggacatcgaggccatcctgattagaggaccaggactggtaaagaggatctcttactaatgaattagaaaagcagcagcagagaggaaatcatgaagaaaaagtgtaataggactagagatgttagtagacaaggaacagaaagggcatcaaaatgatcctcagtattttcatgttgagacacattcattcccctccctacctgactccgcatttcccacttttct

SEQ ID NO: 110222 - DNA, 448 bp, Homo sapiens
tgtagagacggggtttcaccatgttgcccaagctggtctcaaactcctggactcaagcaatcctcctgcctgggcctcccaaagtgatgggatttacaggcgtgagccactgtgcctgacctgaaatgccaacgtcttcatgcctaatgatgtgtgcaccatttgattccctcatcagccatcctaataccttcttctgaccacttaaactgttataaatgccctgtccttgagaaggcagcagagggagaggagcaggaacaagggggcctggtggcagaaggaggtgctggccagaacaggggggcagagaagtgtgggctctgaaagcccatcccagaccccagaatggaataagctgaatgcacatggcccctgctgacctgaacggacggttctgcagcctgagagaggagctgggtctgaagggagtgtggcggctggcggc

SEQ ID NO: 110223 - DNA, 959 bp, Homo sapiens
ctgtgtgcatcttaaaccggcagtctctgaactgggcaacatacatcctttacccttaaccttgagaggaacataaaggctttcccgggggggttatatagttaaggatagtttaagagtattaattctcaggttgtcaacttgcatgtattcattcctaagattgatcttcctcagagtgtactgaactagacatctttttgctttcctctttagcagttgtccctctctcactgacaaatatggggataccttatctgacctaaatcttgatagtggtgtttagaaagtaaatgactgtgatgaatgagtagttaactctttggcaaaattggtgagttacagttgctttagaaaataattgcagaaggaccaaattgacttatcagttgatcattaaaaataatttttgaagcatacccatgtgtgatttttggtatataacttatgagttcacacaaatgattattgctataaccagaaatcgttacacttgcaaatgtttggaatggaagaataaaacatataaaaatagaattaacctgaattctgtttctttctagcaataagtaatatttatttttgggtatatggcctaatgagggagggggcagaaggtcctgtccattttttttatgacatgcatttccaataaaagctttttatattttataggccaggcacagtggctcatgcctgtgatcccagcactttgggaggctgagatgggccaatcacctaaggtcaggagttaaagaccagcctggacaacatggcaaaactccatctctactaaaatacaaaaattatccagacatggtggctcactcctgtagtcccagccacctggggaggctcaggcacgagaattgcttgaactcaggaggcagaggccacagtgaactgagattgcaccactgcactccggcctgggtgacagaccaagactccgtctcaaa

SEQ ID NO: 110224 - DNA, 224 bp, Homo sapiens
aagctacaggcatttcaagtgatttaaacaactctcttttatctaattgcacctgtgtatgcaaggcagtgttgtttaacataacggtagaggagtaactgggaattattgatagctgttcaggctctttcagaggaaggcagagctgagcacttctccaacctgcagccttatctctgtgaagcagcagccgtgagaacatagctcactccatctgtgttata

SEQ ID NO: 110225 - DNA, 260 bp, Homo sapiens
caccatctccatcattacttgcagcgagcatctactaagcttactctatgttaagtactcagcattctctactaaatgctttacacgatcatattcagtctttgcaacaaccatactaacattatccccattttaaagatgagggaactgaggctcacagatgaagtaagtatttaagccaagaatcagggtcatgtattaatagttccaaagcctatgcatgtttttttccattctaccatgccattttcaagcttctt

SEQ ID NO: 110226 - DNA, 287 bp, Homo sapiens
tcagtgttgagtctgagtctttattagggtcatagcttgtatgtgcatttctgtttcttggaccctggctgtaaaaaatgggtcattgaaggtaatgagagtgtttctctggtctctgccctgtgtgtgctgctgacgaggcagctgggccacatttgctatgcccagatcctctgtgacctaacagcaatgttaggaactattcccgaaagtgataaacacaatttcagtttattagtgctcctctcattaacccattgtttttttctttctttctttctttcttt

SEQ ID NO: 110227 - DNA, 1050 bp, Homo sapiens
gagacaggagaataatgtggctgtgattatgaggctttctgcaacataataaaccaaaacagtaatgcagaaatgatttgaaaacaaatccctgggtttaaacctacgcaccagaagaaagaagagggtctggtgatctgaaaacaaaaatacccagcatagaaatatagaccacagacatatcccctaaagcaaagaactcaagaggacatttgcttggtggttacagctttggagccaaacggcctggatgtagatcctggggtcatcatttgctatctgtgcaacttgggaaaattgcttcacttctacaggccccaattttcccatcataacctgcctcataaagttgaaatgagggatgaaagagttaccatttgttaaaatctgagaacagtgctcagcaggtgtcactcaaatagtgggagcatgtacagatgctccttgacttacgatggggttatgcaccaatagacccattgtgagttgaaaatatggtaagtcaaaatgcacttaataacacctaatgtaccacctaatgtatcacagcttaacctagtctaccttaaacctggctcagaacacttacatttagcttgcagttaaacaaagttatctaacacaaagcctattttataataaagtgttgaatatctcatgtaattttaaaaatactgagctgaaggtgaaaaattgaatgattatatggtacttaaagtatgtgtatcacaaaagtgatgcatgttcagtagaaatgaatgtgtaaagtcatagaaatcataaagtcgaaaaattatgcatcaaaccatcatacatatgggactgtctgtaatgtatcatccaaagcagaacacttttaatagaaaaagggggtgctaaaagcattaaagtttatatgatattttgaaatgtttatttattgatcacaaaaggtctatgtataaactaatattagcttattcaaaaaatattttcaaaaggaaaactttttaaatataatatatattcataaccattaaaacaaaatattttatttattgaatattatga

SEQ ID NO: 110228 - DNA, 401 bp, Homo sapiens
tggggtagatgattattttatgtagttaggttttatttgcctctatattagaaagaaatataacctgcacttcgaagtcctggattcaaggaaatggttgcttagaatgaagctaaacctgaaaagggacacgttttatgaaagttttcgttgacgtggcaaaaacccatgctggtggcaggctggtaggaggtactgcaggctgtcattgggagtctcagaaccacggcaggcttggtgctgttattggtgcctttggctgctgctgaaacggagacagagggaggtgactagtccaaggcctctctactgctgctggcagagctgagatccagtgcaggatggtctgagtccccggtcctaaccaccgaaccacctggtgctctttgcaagggtcacac

SEQ ID NO: 110229 - DNA, 755 bp, Homo sapiens
ggttttctatgagtgaaactaagtggaggaaaagcacagatacacaaactgtcccattatgcagtgttatgggccttttcactctgcagtgttgaaactgccttggcctcactttgaaaaataggactatggtacccatggttgtgtcctggcctggggttcctcccatggcaggagccctgctccaagttaccctcctagccgctgcatgtgcggtgaaggggcttcccacagtgggtatgtggaagtctgatggaagtctgatgtgctcataaggagatctgatatgttcacgtgacaaggaacagctgtgttgaaaaatctgcagaacactttggtgccactcaagttatttatttctgggaataattcacaaggcactttaggcaatgccagttgggtggttggaatgcatttgagtattttaatcttttatgtttgattctatgaatgacttatcagaaatacatgtagtcattccttggtatctgtgggggattggttccagggcacactgaggatactaaaatccaaggaagctcatgtcccttgtataacatgaaatataaactatgcacgttctcccatatactttaaatcatctctagattacttgtaatacctaatacaaggtaaatgctatgcagatagttggttatacttcattggttgtggcagcagtccccaattcctttggcaccagggaccagttcgtggaagacaattttccatgggacggagggatcaggggagga

SEQ ID NO: 110230 - DNA, 391 bp, Homo sapiens
tggattgtatatttgcaggcaagtgtaaaaggacactctactttctattattccaaaaagctgagcatttatagactttttgaaaatatgttacatactttctgaaaggaattattcaaatgtcagtttaagcctataaagcaatacaactagatggcatttattattattccacttcacttcctttctcctttaggagcaagggatcgctttacatcaggttccaagctcagaaacatttggctacagtcctttctaatctttgagtcagaaattacaaagaacaaaacaaaagatgattctctcccatctctttcatgtattccaaattctcactgaaatccaggaaagagttattacagtgttttggttggatattcagttttaaaaa

SEQ ID NO: 110231 - DNA, 482 bp, Homo sapiens
tgagatgaagtcttgctctgtcatccaggctggagtacagtggcactatctcagctcactgcgacctatgcctcctgggttcaagagattcttctgcctcagcctcccgagtagctgggattacgggtgcccgccaccatgcccagctaatttttctatttttagtagagatggggtttcaccatattggccaggctagtcttgaacttctgaccgcaagtgatccacccatctcagcctcccaaagtgctgagattacaggcgtgagattactgcgcctggcctaaaacaagacaatattgttctgatcaatcaattgcctaacttctgattaaagaaaaaaatcagggtgattctcagtcctcagctacttttcagtctaaagaaaaagatctatattttatgcttaagaaaatcaagctgggctgggtgcggaatctactgagtattatattccaacaaatatttaccgaacacttact

SEQ ID NO: 110232 - DNA, 392 bp, Homo sapiens
catgaccccagctctcacgtgtccccggccctcacacacccccagctctcacacatccccggccctcacatgcccccagttctcacacgtccccagctctcacatatccccggccctcacgcatccctgactctcactcccacccagccacacccttcagagcatcaggcgtgccaacacagcagcacgccaagccatcagcctggcatgacccacagggcccgttcagactctcgtagctctgcatgccctggtgtgtgtgtgtgtgtgtgcgcgcgcgtgcactcacttcaggcaaggccattttatcacacgtgtagattcgtgtaactgccaccaccaccaaagcactaactgttcccctcatcacaggctgcctccagctgcccccc

SEQ ID NO: 110233 - DNA, 476 bp, Homo sapiens
gcacagggagtgatgaagtgggcctccctcaggaaggactgaaagctctgttccccagtcctctcgaccccaactttctggctccctgcatgacaggctccagcttggggaggtggacccgggccaccccgcctactgcaacttgctgggccaactgggcacagcccagggcgcaggtggccggggaaacaccctctggggctgggcccatccccagggtgagatagctcccccagtgccacccaggtaaccggacaaagatgtccaaaccactacgagggcctggggtggagcatctaagtatgaggctgtgtccttttatgacggccggggactttgcaatcctccacaccctcctgtattcacagtagcccagagtcagtcccattccaccccaccgccctccttctaggcaacccgtggagtaggaaacaggattgggaggtggaatctgttccttaaaagcttagatcccc

SEQ ID NO: 110234 - DNA, 824 bp, Homo sapiens
ggccaggaagctctagaggcgtttttttggccaagggagctgaggaactgcgtgtggagtcagcccagtctggatgcacaggaggatgctggcggcacagtgagtgaggcctggtgccagagctgtgcggaccccttgttggccatggagcagcaggcccagaggccctctccccagccctgcttgcctgcctcggagaggacagaggcctaggcccacgggggagggtgttggcagacagatgccctccaggccctggggcctccttaacggccccttaacgacacgcgtgccaagggtggaggatgccagccaaggggcgctacttcctcaacgagggcgaggagggccctgaccaagatgcgctctacgagaagtaccagctcaccagccagcatgggccgctgctgctcacgctcctgctggtggccgccactgcctgcgtggccctcatcatcattgccttcagccagggggacccctccagacaccaggccattctgggcatggcgttcctggtgctggcggtgtttgcggccctctctgtgctgatgtacgtcgagtgtctcctgcggcgctggctcagggccttggcgctgctcacctgggcctgcttggtggcgctgggctatgtgctggtgttcgacgcatggacaaaggcggcctgtgcgtgggagcaggtgcccttcttcctgttcattgtcttcgtggtgtacacactactgcccttcagcatgcggggcgctgtcgccgttggggccgtctccactgcctcccacctcctggtgctcggttctttgatgggaggcttcacgacacccagt

SEQ ID NO: 110235 - DNA, 966 bp, Homo sapiens
agtcagttgataaacactgttgcctgaacacccgctgtgtgcagagacctagcagataccctggttggggcagtgctaaggattctgccttctgggagctcatttcctgagcagaattccctcttggtacctggcctggcacctggtgcacagaaggcatgagtgcacatctgctgaagagctgaggaactgcgtgtggagtcagcccagtctggatgcacaggaggatgctggcggcacagtgagtgaggcctggtgccagagctgtgcggaccccttgttggccatggagcagcaggcccagaggccctctccccagccctgcttgcctgcctcggagaggacagaggcctaggcccacgggggagggtgttggcagacagatgccctccaggccctggggcctccttaacggccccttaacgacacgcgtgccaagggtggaggatgccagccaaggggcgctacttcctcaacgagggcgaggagggccctgaccaagatgcgctctacgagaagtaccagctcaccagccagcatgggccgctgctgctcacgctcctgctggtggccgccactgcctgcgtggccctcatcatcattgccttcagccagggggacccctccagacaccaggccattctgggcatggcgttcctggtgctggcggtgtttgcggccctctctgtgctgatgtacgtcgagtgtctcctgcggcgctggctcagggccttggcgctgctcacctgggcctgcttggtggcgctgggctatgtgctggtgttcgacgcatggacaaaggcggcctgtgcgtgggagcaggtgcccttcttcctgttcattgtcttcgtggtgtacacactactgcccttcagcatgcggggcgctgtcgccgttggggccgtctccactgcctcccacctcctggtgctcggttctttgatgggaggcttcacgacacccagt

SEQ ID NO: 110236 - DNA, 313 bp, Homo sapiens
atctccactctcttctgcacggaggggtcctttgaaatctagtctcccactgaaactcactgctccactgcactatctatgaagagtctaaaaggccattctgaggcagccaagaactggaggtcctgagcaggtgattcagcaatgccagcaggcaatttgagctctgaggttctttttggtctcacttgctctgtctcagcaggtgagaaaggatcagcgctgcccagccttccccaggctgttttttttttttttcgtctgacacagagtttcacttttgttgcccaggctggagtgcaatggcgtgatc

SEQ ID NO: 110237 - DNA, 370 bp, Homo sapiens
gtaatcaataaattagagggaagcaccatgcacagggcaacaaataacatgttttaaaaacctttttggataagaccataagatagaataatcttgtccatgtagtcttcgactgtacttcgtggtgatgctcaaaccttttgcacttggaagcatcccaactgccatgactcctatgaaatcagctctttatacccattctagctgaatttattattgacattaataaatgaaaataacaaaacctgtggaggtcatatataattttcacatttttttgaaataggaaacattagtgtgtattcttgagcaaaaaagagaagatatacaagtggagaagcaaagggactaatggaaaggctgttacagt

SEQ ID NO: 110238 - DNA, 517 bp, Homo sapiens
atagccacttagatacaatcttacaaatgcccgtcccagcacattaaaatactacatgcaggagagaaaaaaatgacaatatttcactctggtgattctctaactctatgtagacagaggcaagtgtttacccaattctctgcctcagcaatagctctgacatgtgtttatctccttcatggatactcatccactgtccagcaaggccaccatcatccctgtctactgggatcagtataggatcttcacagctgcacttccctgaatctgtcttgcattctccatatccttcccagcagtcccatgtctctataaatgcaaatctcactctctcactcccccggtacaaattctttattgggttctatttgtgcaatcaataaattatgaggtcttgatgaggaatgaaggcacaacaggtcttctgatccttggcatgagaactcttcagtcctatctgttttctcatcctcctctcttccctccactttccccctctatagcattcgcccgtaaa

SEQ ID NO: 110239 - DNA, 791 bp, Homo sapiens
  misc_feature (103)..(104): n is a, c, g, or t
  misc_feature (134)..(134): n is a, c, g, or t
tccaaagcaagggacatgcctgcattccctgcttcaagcctcccagagctcctcactgcctggagaatcgtatccaaactcattatcacagcagccaaggccnnccaccagctggccctcacccacatgggagnccacatacctgcaccaaaatcaaatcctgtgatcaaatcaaagacgtgtacctgccacgtctttccccactatcagtgcctttcccacccttatcaaaagtccaactcaaatgtctgatctttcatgatgccctcctctcacacccaccttacagccccacagctctctacatgtctattagggaacttctcggtttctacctggaataagggccacgcgtctgctgagctttcttctcaattaacttctgctgacagaagaagagtttctatattaaagcacttcttttccttggatattatcattaattgttaatgatacaaagtgctttttaatccattcgtatgtccactatcaacaatactgctaatgtactactaacattagttatctaagtaaattgattttttttcttcctctttcaccatgcagcctaaagctcttaaacttctgggaatggaagtaagtagaacttgttttcaacagttttataatatcctggtcaaatatacatagcccttttaagttctgtatttgcgaatatacgatactactcaccaaaatttacctagatgtcttagtcaaattatataaaaggaccatatatacattttctttaatggggataaaagctgcacaatccatttctagaacta

SEQ ID NO: 110240 - DNA, 367 bp, Homo sapiens
ctcctccctcatgggttgtatttccctaccttcccatacacttctctccctaaggtcttatctaaccatcattctcttcaagttgccatttccattccctacttcccagctatgcacctttctgttccatttggttgacttttatttttttcttctttccagcacatggctttcagttttcctgcctctgctggagttgtcagggttggagccaggagggctttactttttccttttcttctaccaggttagcccggttggtttatgacatctcctcattttcaactctcctcatctcttttcatgtggctttgttggggttggatggctgaggttggctggactgatggttacaaaagaatatgtg

SEQ ID NO: 110241 - DNA, 773 bp, Homo sapiens
gagtctctctggagttatttgctgccgctacctagtctgaaggtgtgagcagctgggcttagtttggcagatgtggaaagctggtaagcactttcatttcatagtgctgttagaaaggaggggaagagaataggaagaagagtccttttctcttaatttggagtcttcaattgaaatctgcctttacaaatcatataaagcttgatgccaattctactaaaataaaactctacacttgtatatgtatttaaaaaacaccacgcctggcacagcctacacactttaaatttacccatttagagtgtacagctgagtggtttttagtaaattgaaaaaattgaacaattatcacaatcttaattttagaactttaaaaatacccctgaaaagaaaaatttcttgtaattctgttcatatattttagtggtatgaatccttttataaatcttgtgacattttcagggtgaacctagcactgtgagttatgaaggcatataagacacagttcttgacttcaagtagctgatagactaatagggaagaaaaggaaacataaatgtctttacaacaagacagttgattaaagtttcacaccagtgatataagctatatatcacaggtttgctgaggaattgaagaatcatctgtgtttggaatgatgacaacaggcctcatggaagtagggagatggaattttctagccagaaaaaatgtggaattatattattctttgtataggcacttttcagtctataataaacattttctttttg

SEQ ID NO: 110242 - DNA, 388 bp, Homo sapiens
gtaaggataatggctgagtgtcattgcttgagctcttaaccagggctcttcaagccgcttgaagctgatttctgattcctccaaagccttgaaaattcccaagtcagggtctcagagattcaaatcccaaataaatcttttgtgtttcacctgcatctgatagtcagttggtatgccttcacatgactacattgactgttgaaataatagaacactctcacaccaattgataattagctgctccccttaacccctgagccctccattattacctggggctgccttgtcccattcctcagaactctctagaccacccccatggtcatgcaacaaaaggtataccaaggaatctctaagactccaagtctacagtaggcatctgttgtga

SEQ ID NO: 110243 - DNA, 307 bp, Homo sapiens
ttttcatttgcttagatttccatgtctttaattcagtttcaaattcccgtcccagctgtgtaaaactccttgttaggtattttaacaattttaccttcttaaagacacctttaagaaccttctagcctgctccattctgagttggttattctgaaactgaatacacagctgtcatcctgtgatctttcaccattgttcagaagattccctttgcctcaatcttgtgtcttcttgttttagtggagaacttcccccaatagttttctgataaaaaggctcactggtaagtctttggacaccagtgtat

SEQ ID NO: 110244 - DNA, 442 bp, Homo sapiens
aactaaacactggcaagatctggagtaacttaactattacaatacaaacaatgacagactgtgaaactccctgagggcagagaccctgtctaattcatctctgtatccaacaattagcatcctgtagttaaatgttgaagagaggtaagctaacatccaaaatttaaatgtgagctattgaaaaattcaacttaacaatctgaaagttatctttttatgactgacattattttttaaatgttaaacaataatgtccaatgcaagtatacaagcgacattaccatggaatgtttgtcaacaactgtggctgtcaaaatcagtataacctagtcttaagagtataaggtagggtgagaggatagaaacagtggcagggaagggtagtaagggaagacctgagactggtgcagagacctgaagaagtgagggatatatactgcct

SEQ ID NO: 110245 - DNA, 266 bp, Homo sapiens
attgttttttctgctttcagtttcactgatttccgctgttatcattttccttctgttaggaaacacaaaaccataatgagataccactatatgcctattcaaacagctaaagctttaaaaatactgacaatgtcaagtgctgacaaagactgtgaagcaatagaaactcatatattgctgatgggcatgcaaaatggtatagccactctggaaaacagtgtggaagttctttatacagtaaagcaaacactcaccagacgacccag

SEQ ID NO: 110246 - DNA, 387 bp, Homo sapiens
tcgaagttatgactaattgttttttaatgaaaaaaacaaggtttgcttaatgtttgatgagtcacgcaagtgagcatctctgtatcaggactctcccactttcaaagacttggcctgtccatctacctgtggctgaggggagaggccaggtgagaccctctctcctgagggcccaccatgtgctatacaaatcccctagcagagcagtagggtcaacagggtggtctctgcgctcaagaagcccacgatggacaggaaaggaagatgtgcacaggctctctcttgacactaggcagggcagggcaccctgtaacaggcacaggccaggggctctggggccaacagaccatgccaacaacaaatgttgagccgggtcttggcctcccc

SEQ ID NO: 110247 - DNA, 322 bp, Homo sapiens
tgccaaaaatgagggatcagctatataagacagtgctattattcttggatttcaggtgaatcaggactgaactactgttacctgctgactgactcatttcaacctgtttaagctccatcaaagtccccatcagaaagttcacttattttcccagccttgccaactggtttaagaaaaatgtaatagcaaataaggaagagaatgactcagaaatctaaaaaaaaaattttccttcaaggaaattaaaataatatttagggaaacaaattatataaatgaataattattttaagtgaggaataagacattctacagagaagag

SEQ ID NO: 110248 - DNA, 131 bp, Homo sapiens
tttgactaacttaacttgcttaaaatatttagggcatgttcatctttcaagatttttattttcctgtctcaacagatcttaaaacttagtgttaaaccagactgttttttaaaaagtctggcttattgagg

SEQ ID NO: 110249 - DNA, 155 bp, Homo sapiens
ggcctctctgtcagcctggcactggctttacagtctcccagtggtgtgattaatgtctgggcttaggaggaaatttcctctgcaggtttgagtttatgcaggtgaagggaaggtacagctgatctaaagcatctgtaggcctcctggggttctgg

SEQ ID NO: 110250 - DNA, 276 bp, Homo sapiens
tacagaaggagcaagtggccatgggttgagctgcattcattaagtgcctgctgttatgtgtcaacatcaagagtcctaggactccggctaaccaggctgttgaggaaaaatgcagtttccctaaattcattatctgtcagcccctcttggttgtaatccccttttacttgaacccgttgctgagaagctctctgcgtgttggcagtcctactccggacttgtgaagctgagtgagtgacggtgactgaggcctcacagggcccttgggtgtttatt

SEQ ID NO: 110251 - DNA, 277 bp, Homo sapiens
ccagaatgtcataaaggccaattggtgaagccgaatgtcaccctcccaaacaaggcctcaatctctggctggaggtgttggctctgcacagtggacgtaacccttagacccctaaggatttctgtgctgcctctgcccaagcaccttgtgccataatgacctgcctgggctggcttggggccacttgccttttaaaaatatatttttaaaagttgaagctgcgcagtgtcccacccctgtaatcccagcactgtgggaggccgaggcaggtggatca

SEQ ID NO: 110252 - DNA, 1205 bp, Homo sapiens
ttctccccgcccaggttctcttacttccctctttctaccattgtgtttgtggtagagcatgctggtttgttctttctttgccagctttcccctttcctcttgtctgtctgctttcattttcttgccacttttgcattgcccagccttggctccagtggaatttggttttgatcatcattgccagcccagtgcaagcacttgttttgttgtgttgctttgaacagttggattcatcagatcaaatgaaataatttacataaaatgtcacagagaactaaaaatgtctatactatttatatagtgacatgtataaagggaacttgtctaggtttggaaagctttttcaaacccagtaatttgctatgtaaagtgatagcttaatatctgaagtattgctattctttcttacataaaaaatagcatgacacgttatcatcaaaagtatagtttatactgtatactgtttttaaaaagcatcaaaaattttatcctcctttcatagatttttaagaaaaaaaatgatcacatgtgcattgtcagacaacacattggaaagatttactcgtttattctctcattctgtaatttttattgagtgacttctctgtgagggccgcattacagatgcagtgactgaaaatacacgtaaggatttttatgcagatgaagcctgcaatctaacagtcgtctggcaccaagtgtgttgtctttttgctgaatttgaacatcccatagtttttggcaaaggatgaaattgtattataatacctataatacactgacgtgatgattttagtgtcagaacccaaaccccctttactcaggaacctgatcatgcaaataaatcatgtgtttgtttggttctggaacctggaagagttgcattatcttctctttaaactcttcagctgttcctcctgtagcctgagactcagagggagctcctagcatccaaacttgaacgaaatgtgccatgtaaactcagagtgccaggatgacccacgggggtgcgcactcagcttgtacagactcttacacacatagagatgaggtagctgttttctgaacaagtgaggttgaaattgaatgttggatacattttacgaaagttaatctatttttgaacattgaaaataatcatagtatgtaattcagaggtccccttgtgagcagattttagcaacatgatatgctgtgtggagata

SEQ ID NO: 110253 - DNA, 402 bp, Homo sapiens
aaggggatttacaatatgttcatgtaaggctctgggcagaatttaaagtcactctatcagctcagccaaatgagaagatcctctttctgacaaatcccaacagaagacatgtcagtgagctaaaagtatcttggtatcttcttccatctgggctgctatcacaaaatatcataggctgggtagcttatgaacagtagaaatgtatttctcacagttctggggccaggaaggccaagatcaaggtactggcagtacctggtgagaggtcattcatagatggctgtcttccagctgtatcctcacatgacagaggagataaggagtctttctcaggcctcattcataatggcactcatcccattcatgagagctctaccctccaacctaagtgcctccaaaaag

SEQ ID NO: 110254 - DNA, 1179 bp, Homo sapiens
cttgtcttcaaggagtagaaaaaataggcatggaagccaggtgtggtgactcacacctgtaatcccaccactttgggaggctcaggtgttccactcccctcggcctcccaaagtgctgggattacaggcgtgagccaccgcgcctggcctatatcccactatttctttagttagtaccttttcttttttagatcttggtttcccaaggtccttgtagtttctttcttcctccttcaaaatattttgatataattggttttagcatttttagtcttttgcatttacacttgccttatttctgaactactattctgaaggtcaagctggtaccaaaccagagcacctctggagataagaattcacttagctgaattgcttatctgtgtgaaataataaacaaattatttcagcctaatttattgttcagttttgattaaaaacaaagaagtttagactaatggttaagatagactatagaaccagactgtctagattcagatattctctgctactcagcgagtgttcttggacaaattacctgattactgtgtgtctgtttttataactataaattggggataattatagttcctgtctcatagggtgattatgaggattaaataagttaatatgcatgcactgcttaaaattgtgtctagcatataacaagtagtaggtaaatacttgctgcaggtggcgatgacagcagcagcagtaatagtagtagtagtaatctggtttgctgatgataaaagccagaaagaacagaaaatttggagaactcagaatagcatgataataattgctattgacaaagtagggtaaaagaaaatagatatgaaatataaactatcagatttgccagtgttaaaatttggagcagtatcttttattccactttcaagttcctggattagtcgaatcaagaggaaatatattcttacagaattagtatgaaaatttttactatttataactacttgtatgaaacctaatacagaaataaattatgtcaaacacaatcctactttcaaatttttaagtcctttcaactgacacattttaaaaaggaaaatactacaaattttccactttataaatgtgtgccgttttgatcacttgaaaatgtatgaaagattgcatttggaggaaaaaaggttgtgctaataaaaaatgtct

SEQ ID NO: 110255 - DNA, 245 bp, Homo sapiens
tggggctgtttgtgtttgggactgcctggccctaaataagggatcagtggaccaacggtggggagtggggttttgaaccttgtcgctaacgcagccgcctgggcacccaaaagttcagataagtaagtctctacctcctgcacacacagcccacctaggtggacatttggttgagtggagaattgaaccactacctcccgggttctggcttctagcttctagcctacaccttgtcccccagccca

SEQ ID NO: 110256 - DNA, 739 bp, Homo sapiens
tgtttggagtacttctatacccagtccataaaagtgtgacaactcctgaactcagttaatcaggtttcaaagtgatttttcctgtggttgagacaatatagggagggaattaggatttggggatttacagtcagactgcctgggctcaaatcctagctctgtgacaacttactgattataaccttagtgtagttaatgaactagacccagttccctcagctatataatgaggactaagtcaacctctgcatataaaaacatgacacagggctgggacataactctcaaagggatactgctgaataggtacaatgctatgcaatgaattgtgaccccccaaattcatgtgtcgaagccctaacccccaatatgatggtatatgaagatgaaacctttgggaggtcattatgtttagatgagatcataaaggtggggtctcataatagttttagtgcccttaagagacaccagagaacttgcttctctctctctctccctggccaatgcaagcacacagcaagaaggaggccatcagcaaactgggaagaggaccctcaccaggaaccacatctgccagcaccttgatcttgaacttctcagcctccagaacggtgagaaataaatgtctgtcgtttaagacacccagtacatggtactttgttatagcagtctaagctaactaagatgtacaattttgttattagcattcttcgtggggcctgagagtcttatgagaaat

SEQ ID NO: 110257 - DNA, 761 bp, Homo sapiens
tgtttggagtacttctatacccagtccataaaagtgtgacaactcctgaactcagttaatcaggtttcaaagtgatttttcctgtggttgagacaatatagggagggaattaggatttggggatttacagtcagactgcctgggctcaaatcctagctctgtgacaacttactgattataaccttagtgtagttaatgaactagacccagttccctcagctatataatgaggactaagtcaacctctgcatataaaaacatgacacagggctgggacataactctcaaagggatactgctgaataggtacaatgctatgcaatgaattgtgaccccccaaattcatgtgtcgaagccctaacccccaatatgatggtatatgaagatgaaacctttgggaggtcattatgtttagatgagatcataaaggtggggtctcataatagttttagtgcccttaagagacaccagagaacttgcttctctctctctctccctggccaatgcaagcacacagcaagaaggaggccatcagcaaactgggaagaggaccctcaccaggaaccacatctgccagcaccttgatcttgaacttctcagcctccagaacggtaaatcagacaccgcctattcaccagctcatctataaaaccccctgcatttcaccgcagaactggaacctattttaccaggacccctctctgcagcagagagctcttctctttctttcgcctattaaacttccactcttaacctcatta

SEQ ID NO: 110258 - DNA, 376 bp, Homo sapiens
cagctgtgccaatagaaaagggctacctggggaccaggcatgtccaccctggaggtttcatcttccctttttttgttaccatgtgtacagtaatagataaatgggcaacatggcacagctcaggcagagaaccagccagcataatagaagattagggtgggggctaccagaaattcgtgccctatgcaaatggcacacctgatataaccagttttttgcaccctaggtaaatcagacaccgcctattcaccagctcatctataaaaccccctgcatttcaccgcagaactggaacctattttaccaggacccctctctgcagcagagagctcttctctttctttcgcctattaaacttccactcttaacctcatta

SEQ ID NO: 110259 - DNA, 707 bp, Homo sapiens
tgtttggagtacttctatacccagtccataaaagtgtgacaactcctgaactcagttaatcaggtttcaaagtgatttttcctgtggttgagacaatatagggagggaattaggatttggggatttacagtcagactgcctgggctcaaatcctagctctgtgacaacttactgattataaccttagtgtagttaatgaactagacccagttccctcagctatataatgaggactaagtcaacctctgcatataaaaacatgacacagggctgggacataactctcaaagggatactgctgaataggtacaatgctatgcaatgaattgtgaccccccaaattcatgtgtcgaagccctaacccccaatatgatggtatatgaagatgaaacttttagtgcccttaagagacaccagagaacttgcttctctctctctctccctggccaatgcaagcacacagcaagaaggaggccatcagcaaactgggaagaggaccctcaccaggaaccacatctgccagcaccttgatcttgaacttctcagcctccagaacggtaaatcagacaccgcctattcaccagctcatctataaaaccccctgcatttcaccgcagaactggaacctattttaccaggacccctctctgcagcagagagctcttctctttctttcgcctattaaacttccactcttaacctcatta

SEQ ID NO: 110260 - DNA, 2143 bp, Homo sapiens
tgtttggagtacttctatacccagtccataaaagtgtgacaactcctgaactcagttaatcaggtttcaaagtgatttttcctgtggttgagacaatatagggagggaattaggatttggggatttacagtcagactgcctgggctcaaatcctagctctgtgacaacttactgattataaccttagtgtagttaatgaactagacccagttccctcagctatataatgaggactaagtcaacctctgcatataaaaacatgacacagggctgggacataactctcaaagggatactgctgaataggtacaatgctatgcaatgaattgtgaccccccaaattcatgtgtcgaagccctaacccccaatatgatggtatatgaagatgaaacctttgggaggtcattatgtttagatgagatcataaaggtggggtctcataatagttttagtgcccttaagagacaccagagaacttgcttctctctctctctccctggccaatgcaagcacacagcaagaaggaggccatcagcaaactgggaagaggaccctcaccaggaaccacatctgccagcaccttgatcttgaacttctcagcctccagaacgatcacaatggaagcagaaatcaccttgctcattgttgacaatagctttgccatgtgcaagtctgcctttgctggggacaatgccctcaagtcatgttcctctccattgtcaggcacccctggcaccagggcatgatggtgggcaggggctaggactcctatgtgggcgatgaggcccagagcaagcagcatcctgatcctgaagcaccccatggagcaggcctcatcaccaactgggaccacatggggaagatctagcaccataccttccgcaatgggctgcacgtggcccctaaggagcaactggtgctgctgaccgaggcccccgagccccaaggccaacagagagaagatgattcagatcatgtttggggccttcaacaccccagtcaagtacagggccattcaggtcaccctgtccctgcatgcctctgtcagtgccattggcaccatgggggactcaggcgatggggtcacccacacttgcccatctccaaggatacagccaccctctcccagtcatcctgtgtttggccctggctggccgggacctggccgactacgtggtgaagatcctcgaggggcccgctacagcttcatcaccacagtgaagtgggggattgtgcgtgacatccaggaaaagctatgctgtgttgccttggacttgcagcaggagatggccactgccgtgtcctcttccttcctggagaagagctacaagctctcccacagcctggtggtcaccatcagcaatgagtggttctggtgtccagaggcgctgtcccagccctccttcctgggcatggaatcttgctgcatccaggagaccatcttgacctccatcatgaagtgtgatgtggatatctgcaaggacctgtacaccaatgtggtgctgtctggcagcattgccatgcacccaagtatcacacacaggatgtagaaggagatcactgccccagcacccaggaccatgaagatcaagatcatggctgtctctgagcacaagtattccatgtggatcagcagctccatcctggcctcactgtccaccttccagccaatgtggatcagcaagcgggagtgccaccagtcaggcccctccactgttcaccgcaaatgcttctaaatggactgtgatgagatacgtagcctgtgctgcctgagtcaattcagaagtacaaatttgtccctggaaaatgtatacatctcatgctagccttaggaaactggaataagcctttgaaaagaaatttgtcaggctgggtgcagtggctcatgcctgtaatcccagcacttttggaggcccaggcgggcggatcacctgaggtcgggagtttgagaccagcctgaccaacatggagaaaccccgtctctactaaaaatacaaaattagccgagcatagtggcacatgcctgtaatcccagctactcgggaggctgaggcaggagaatcgcttaaacctgggaggcagaggtgagctgagatcgcgtcattgcactccagcctgggcaacaagagtgaaactccgtctc

SEQ ID NO: 110261 - DNA, 237 bp, Homo sapiens
gtcagagaagagagaatcttagttgaacatcagaggcattcaatagagaacacagatgggtcattctaatgagtagagataaacaagcctctagtaaatggaggacctgctgaggctcacggactatcagcggcgcctgtactggtgccaccttcgtctgagcagcgaccctatgctgagcgagttcaagagcctggacatcatctagaagaaattggcccacgagggcccacggcc

SEQ ID NO: 110262 - DNA, 735 bp, Homo sapiens
tgcggtagctcacgcctgtaatctcagcactttgggaggctgaggcgggtggatcacgaggtcgggagattgagaccatcctggctaacatggtaaaaccctgtctctactaaaaatattttaaaaattagccaggtgtggcggcgggcgcctctagtcccagctactcgggaggcttaggattacaaacatgaggcaccacacttggccaggacatcatcaaacctattaagaaaattaaatgaaaagctacagactggaataacatatttgcaaatcacatattcaacaaatggcatgtacacaaaacatacaaaaaatcctcaagactcaacactaagaaactaacagcccaattaaaagtagacaaaggtctttgaacagacctttcatcaaagaggacacagagaaatcaaataagcacttgaaaaaatactcaccttatgactattagggaaatacaagctaaaaccatgatgagatacacctactagaatggatataatgaaaaaagaccaagtgctgacaaggatgcagagaaactagaagcattatgcattgctgctgagaatgcaaaatggtacaaccagtctggaatttgtctggcaatttctttctcagtctgtcacccaggctggagtgcagtggtgcgatcatagctcactgcagcctcaacctcctgggcttaagcaatcctcccacctcagcctcctgagtagctaggactacaggcat

SEQ ID NO: 110263 - DNA, 2209 bp, Homo sapiens
aggagctgcaaagtgactgctaatggaggaacgatctgctggctgggggaaatgtggcctgagactagagatgcagagcaggcatctctagaaggagagatgatgccaatagaagccccaggagggaactggccagtgaatacaattttataaagattctcagtactttttctgaaaaaattcctaaaattttcaagggcgcgtctagccctctgcctctttagaggtgagctcagtgctacttctgggttcttaaggcaaatgccctacaaacaccaaagtcttgtattttccactctcagccggcactggctaagtgggattttttttttcccttccctaagtgaaagggacttgttttcaggagaagtgtcctttaaacatccagctaaaactggaagtaattttttgcatgaatggctttttacagctaggtctacagcagaacaaaacttgtattaaactaagtgctactttacatatcttatttcaagggaaatgaaggatttattgtcgtgtaaatgatatacactgatttgtttcctactggacattacatgtccctttatctctaggctgatgttgtgcagcaaactttcaatatctggaaaatcagctggtacctacttcagtgcattattaggatattacgttccctgagaggaattttgccaatgaagtttaggtactgttgtaactgatttccatcccccctccctaagcttctgtactaagtatatgtaaagctattatatcttgtctgatcccatgtgttcatgtgtgtttcccaatgtttgcataaatatattggcaatctgaagggttagctggcttatggcaactgctgaacaatggtatgtttggcatgtgggacacctgatacctgggcacacctgttctgaggccaagctaattttacagattttggaaaagaaaaaacagcagcaacaacaacagtgtggcttgaattaaggaaagtttaacaatgaatacagtattgccaagtcatcatttatgggtggagacgttgaccacagcagttgaggtgctttcaactggatcttatgccctttattttaatcccaattgatagttcctcatttgtattttatgacttagaaatactcctacgtgatgctcgtttgtttttctcccaggcttctggaaagtgctgatcatgattgcttcctatcatttggatcccaaagttgataacttaacataagtgactgaggttttagtagaactgggttttactaatcgtatctcctccttgaggtgctgttcccttcattcctttcctttatgacaggtgaatgcattggctatgctgattttatttgcatcctggcgagtcttggagaatcaatctcgttaaaatgatgactgcatttgcctttggagaagaggtttattgtctaagtaaaactcttatgtgaaggtgtcatttatgtaaaaaaaaaaaaaattctaacttgataagatggccacaggttagaggggtgtgttctcagttgatattaagggatatgttgaaaaggcaagtgcccaccctctattcttcatctcacccttcctttctccccaacctcaaaagaaaacaaaaaattatttttttaaattgtattagtaatttatgtttaatacaaaaggatgatttaatggtatcaccaaaggttgtttctcccattgtgcatgtccttcagtctcggccccatacccatcaccccattcttcaccctcatgcttccatcccaaggcaaacatgtgtcttcatcggaatctatgggtgttgaagttaaatgtgggggcagagatttaacaccatgacactaatacaaatcaaccattcttcactttcaaatggttaatcactacaggaaggcgaactcttttcttggtttttgtttaaaaacattttatacatatatatgtatatatgtgtgtgtatgtatggacataggtatgtatatgcacatgtacatgtatatatgtatatatccatcttcaatataaatatatcataagtgagagttgtaaatactccttggtcatatgtctgtctttctcatagtatcatatcttcaatgttatgttaacaactccatttattgattgatgaaatcgtgtgtagacctgtatcctcctgacatagtttatgtagggtctcttctcaaataaagtataaaacaacaaaaaccttgtttta

SEQ ID NO: 110264 - DNA, 523 bp, Homo sapiens
tgagacagagttttgctcttgttgcccaggctggagtgcaatggtgcaatctcggctcacggcaacctccgcctctcatgttcaagctattatcctgactcagctgggattacaggcacccaccaccacacctggctgattttggtatttttagtagagacggggtttctccatgtcggccaggctggtctcgaactcctgacctcaggtgatccacccgccttgggctcccaaagtgctgggattacagccctgagccaccatggctgacaataataaaaaattttaaagcaaaactaaagatttataaattgtaaaatgcggttgtaacaagtatttactgtaccagtaaatatgaaaaatattaatgtcctcacacacggaggtggcttgtgagtggtgtgagcatttcatggtcagagtttggcagttgggcgagagacaggatggattttaactcgaacatcgcagacacaaaactgaaaaccctgatgcggtgcctgcaccgttgcctcctttcctg

SEQ ID NO: 110265 - DNA, 709 bp, Homo sapiens
gccctacggttgggagtcagagaagagccggtgttccagggacaatgcagcagaggctgagcccaggcctgctgtcctgagaggtggctggatcactgacactttggcagtggtgctggggtttatgtcatgacctgcagctgagcctacttccaatgaccgtgagatctgaaagactgttttgagggcgtagcctctgccatgattgtggggaatgctgtcctgtttcctcccttggccctgctcagcccagcgagaggctgaggcacacgtggctccccgggtgcccacaggcagcgtggctcaccagccgggcccttttccactgagccagaaccccccaaagccttcaatgcaggcaccacggtgagcccacgagaaaccctgacctcaggtgatccacccgccttgggctcccaaagtgctgggattacagccctgagccaccatggctgacaataataaaaaattttaaagcaaaactaaagatttataaattgtaaaatgcggttgtaacaagtatttactgtaccagtaaatatgaaaaatattaatgtcctcacacacggaggtggcttgtgagtggtgtgagcatttcatggtcagagtttggcagttgggcgagagacaggatggattttaactcgaacatcgcagacacaaaactgaaaaccctgatgcggtgcctgcaccgttgcctcctttcctg

SEQ ID NO: 110266 - DNA, 3191 bp, Homo sapiens
gccctacggttgggagtcagagaagagccggtgttccagggacaatgcagcagaggctgagcccaggcctgctgtcctgagaggtggctggatcactgacactttggcagtggtgctggggtttatgtcatgacctgcagctgagcctacttccaatgaccgtgagatctgaaagactgttttgagggcgtagcctctgccatgattgtggggaatgctgtcctgtttcctcccttggccctgctcagcccagcgagaggctgaggcacacgtggctccccgggtgcccacaggcagcgtggctcaccagccgggcccttttccactgagccagaaccccccaaagccttcaatgcaggcaccacggtgagcccacgagaaaccctgcttgccacctcccacacccccacccccaagttcaaaggaaatggtccctgaaccaagggctgagatcagctgtgggtccagctgtcctggggagctgtactggagcccaccacggtgggactgttggtccggcggtgacccccacctccatgtctgtggccgcagctggacaggccactccctgggccacagagatgttttacctctcgcagccctcgggcacacattgagcagatgtgtgtgtgtgtgcgtgtgtgggtgggtgcgcatttgtgtgtgcctgtgtgtgtgcgcatgtggtgtgggtgcacgtgtgtgcacgtgtgtgggtaaacattgtgtgtgcgcatacgtgtgtgggtaaacatttgtatgtgcacgcgtgtgtgggtaaacgtgtgtgcgcacgtatgtatgtgtgtacatttgtatgtgtgtacatttgtatgcatgtgtgcctgtgtgtgtgtgcctgtgtgtgtgggtgcacatttgtgtgtgtgtgtgtgcctgtgtgtgtgtgtgcacgtatgtatgtgtgcacacttgtatgcatgtgtgcctgtgtgtgtgggtgcacatttgtgtgtgtgtgcctgtgtgtgtgggtgcacatttgtgtgtgtgggtgcacatttgtgtgtgtgtgcgcctgtgtgggtgcacatttgtgtgtgtgtgtgcctgtgtgtgtgcctgtgtgtgtgggtgcctgtgtgtgtggggcacatttgtgtgtgtgtgtgcctgtgtgtgggtgcacatttgtgtgtgtgcctctgtgtgtgtgcctgtgtgtgggggtgcacatttgtgtgtgcgcctgtgtgtgggggtgcacatttgtgtgtgcgcctgtgtgtgtgggtgcacatttgtgtgtgtgtgcgcctgtgtgtgtgggtgcctgtgtgtgtgtggggcacatttgtgtgtgtgtgtgtgcctgtgtgtgggtgcacatttgtgtgtgtgcctgtgtgtgtgtgcctgtgtgtgggggtgcacatttgtgtgtgtgtgtgcctgtgtgtgggggtgcacatttgtgtgtgtgtgtgcctgtgtgtgtgggtgcacatttgtgtgtgtgtgtgcctgtgtgtgtgggtgcacatttgtgtgtgtgtgcctgtgtgtgtgggtgcacatttgtgtgtgtgtgtgcctgtgtgtgtgggtgcacatttgtgtgtgtgcctgtgtgtgggtgcacatttgtgtgtgtgtgcctgtgtgtgtgtgcctgtgtgtgtgggtgcacatttgtgtgtgtgtgtgcctgtgtgtgtgggtgcacatttgtgtgtgtgtgtgtgcctgtgtgtgtgttgcaggccctggatgccagacactgaataaacgcaggaagacgtctgtcttcattctcctcgtgggtcgctggtccagaaacaccttgatggaaagtgctctgcaggaacggtgcctctgcctgtggcggggaccctggtgagcggatgggccagccccacgtgtcttccggccactcagcatgcagtgtttccaggggcactaagagaccaaaatcgagatatgattagctgtaggatgtcatctaatcacagatcatcccgaggctaatttatctcccccatgaccataacacatcaaaaagttgactttttgcagctcggctgtgcctcatcttcccacgaagccccgacaggcacatccagtgaggaaccacagtgggagtcctgtggcagggtcaccccacttccgatgccctccagctgcatcttggcacgaaaaaggctgcccagttctcatgccctttcaagtcccgggctggggggtagcagtggaggctggggttaaccgccgtccgtctcaaaggcctcattgtggagctgcaaacacgaacgtccttgaaatgtgaggggacagtgctctggggcaggggctgctcactggttcatggccagaggtgagcgggctctgggtctgggtctgtgaggtgctgtggacgtcgggggtgctcctggggcagggacacagccacggccctcacaccagtggagccgtcttccttcccgaggcagaggcttggccttctcacaccttgggacccttctctcccctgtgctcatgctggaagcacagcgtgagggggcaaaggtcatgggaggcaaaaggctgggctgaggccgaggctctgtggctgtggccggataccaggtcctgtggtggtgtgggcagggcgcgctctctcctctgagcagcctggggctgcgtgtgtgaacagaaacaggcctgccgatttgaagatggtttgaccaagtctcccaaagctgaagagaggtccctgcccatgtcccccgggtggcaatccacagacgcacctgtgtccatcagacggtatcgttgatagggagtctgaagccacccagacgtggtctgttcacgccgtggacaccacggtctgaggcagacggttacagccaccggcataggcgaatctcagccagagagagtgaactgggacaccattcacgtgatgggccagatgggctggcagcggctcgctggagccgtccgggtgggaacgctgtgtctgttggtctggtgctgcttatgtggctggttcaggtctgtcatccgtcaacctgcatatttatcactggtgcattttcatgtatgttgtacctcaattaaaacattttagggccgggcgcggtggctcacgcctgtaatcccagcactgtgggaggcggaggcgggaggatcatgaggtcaggagatcgagaccgtcctggccgacatggtgaaaccccatctctact

SEQ ID NO: 110267 - DNA, 413 bp, Homo sapiens
tcctttaaagaacctagcatatcattaatgtgaaaatctgataaagatatagatacaaaaaagaaaactataattaattttatttataacaatagatgaaaaatttcaattaagatactaggccagggtttggcatagtggctcatgcctgtaatcctagcactttgggagtctgaggcaggtggattgcttgagccaagtaggttgataccagcctgggcaacatggtgaaaccccatctctaccaaaaatgcaagaatcagctgggcgtggtggcgcacgcctgtagtcccagctacttgggagactgaagtgggaggatggcttgagcctgggaggcagagattgcagtgagccatgaccgcaccactgcactccagcctgagcaacagagccagaccctgtctcaaaaa

SEQ ID NO: 110268 - DNA, 432 bp, Homo sapiens
gttcccagcctagactgaaggaatctgtttaattcacagcagtttttgaaattgtttatggtgatagtggaattctggatcttgggagctggtagtcatgtgaaagagaagtaaggactcatgccccatgccccaggagcctccctgtgcaggctgtgtggcgtccaggggtctcatgccactgcagccctccaggtctgtgctggccctccttgttcttcatcctccttcatctctctcttaatttgaagcttctacttccctggttaagctcactttctttaaatcatggtagcaaagcacatggttcaaattcatttccctgctagactaccgctgttattcagggttgggatgactacaggctttattcatgtcatttcactcatgttctttaacccttttagaggtgtacaatgttaatatttttaa

SEQ ID NO: 110269 - DNA, 362 bp, Homo sapiens
atttaaaagctgtgtaggaggaaagagagaatttgacacttcaccctgcctggctgtcaccactcctcttcccctgccttctgctggggctcagacagcttcaggcctcgagcctgagaaagtgcctgcccagaattgggcccaggggttgaatggtggaatctacattgcgaggggacctgcagaatcatcctgtccactgcccatctcgagcgccaccatgcctcagccatctcagacatgggatggggctggagtcgcttcgttcagcaagtatttgtgaggcatgtagccaggcactgagggcagacagcagtgaatgaccagacagacctctgcccttcaggagcttttagtttatt

SEQ ID NO: 110270 - DNA, 373 bp, Homo sapiens
tactactactaaattcgcggccgcgtcgacttttttttttttgtagagacagagtttcaccatgttgcccaggctggtctcaaactcctgagctcaaaccatcacccacctcggcttcccaaagtgctgggattacaggcgtgagccaccacatctgaccgcgggagtccttttacccaaagccacccaacagacccacgcagagacttttaaccagcaatcgtctcagttccctctgaggctgccggctctccctgtgacagcagcccatcttagcccttcctgtgtatctctgctgcctaaaggatgagagtttcctaaagtgtagaactgtgaggggtggagggacattcctctcatgctggcctgaatc

SEQ ID NO: 110271 - DNA, 152 bp, Homo sapiens
cacaggtgccccctggtggctgctttggggagaacggactatgggggccagaggaggagccaggaggggactgagctggtcctagtggaaggaaagtaggcagatttgagatggacattttttttttttttttttttttttgagacagggcc

SEQ ID NO: 110272 - DNA, 482 bp, Homo sapiens
tcttacttacccctgttaaacagggggcaatcactttcaaataccacacattcctgaaggaatcaccctgctctacccctgctcagcatcattgatggaagtgactgctcactgttgaacctgcttcttctcttgattcctcgcagaggcagctgctggctacagacttactaaattgcaagtcgcctcagttggcagaactgccccttctcgacgatttataaactctgtccatcgagagcacactccagagacagggctctggacgggacagaagcaggaatcttggccaaggatacaaagcttccagaactaccaaaggcattgtccgccaataaaataccactctgaatggactcattcatgtcccattaacaaaagtgttgctaataataggtgccaccttacttatgctacaagggcactgtaagaattaatgaaataatgaggtctctggagcacttgcccagagagggcggcca

SEQ ID NO: 110273 - DNA, 955 bp, Homo sapiens
  misc_feature (1)..(3): n is a, c, g, or t
nnngacagggatagcggcagagccggtagcggacggtccttgcattggcctccggcaggcgccccccgggggcgggaagctgcctcacagcatggaaccacaggttactctaaatgtgacttttaaaaatgaaattcaaagctttctggtttctgatccagaaaatacaacttgggctgatatcgaagctatggtgagtgttactttattttgtttctccttggtttaagcatggttattttttccaaaggtagctatttttagcagtgttgtttcatagctgtgaagtctgtcatagttaccatttctgggccttttggaaaattgcttttgatagggtttcagtattcatatatgagatgtgccccagtaaagggaaccaacacataaatttccttttgaacattttagaaagggaaggtaaaattgtttttagtgagataggatttagaaaacctattaattttagaaccagtatgaggagtgaattggtgtgggctccacccaaccagatcccaaggaaatgttctcttgtgtgaggatatgacttgtgttttgcacaaggatataacttgtgttttgcaagagcctatcaattgtttttattgctaggtcagaggttgagtatctcagagttgagcaggaaaaactttcatacctgcttagacagcagttcacctgttccgtttttttgctaaggcttttcctcctcttggtttgccctttgtactcttctgtttttgttcagtttgcagtggtgaatgttttacttcctgtgttgactgtgtttctctctgaaaccctttggtaaaaatctacgtttacctggttatatctgatgataactaaaaagggaaagaaatggtagatcttaaaagatgatctgaggtagttgtctgccttccagcaaatacctgttcatactgtcctatcagtgacagtgagacccgtctca

SEQ ID NO: 110274 - DNA, 607 bp, Homo sapiens
tctagaggatcccagtcactttctacacatttaaaagggaaaagtaaatttaacagttgccttttttcttaatgtcagggcagatcttattttacagtacagtgggggaaatagaaacatgtgaaaggcaaaaggcaggctcctaaattaatgtcagtgaagttcagggtgggcaaatgagtgtgtgtgaggtataggaaatgctgatgacttctttaatgcttgaagtccgttcacaggtatctagccctagaatgcctagaacaggaagaggcagctggtgttctgcaaaacttggacaggggcaaagttgctgaaaaagttttggtttaacccgaagataagtggaaaagagcttgtccatgaacccaggttctcactctgtttacagaagtgtgttgagtacagttggtgaaggaagaggtaacaaaaaatgctaaatattttatccatgaaaatgacttccagaaaaggaagaatatgaaccccagaccgaaggggaaaagatagttaatagtattatctaacctggttggtatttgtaatgaatggtgattttaattagtcattagccatgacgatatttctcccgggtcagctcggttcg

SEQ ID NO: 110275 - DNA, 4794 bp, Homo sapiens
ttccagttgcggcttattacgtcacagtaattgctgtaccaaggtcagaatcgccacctgaggcctgaatatcagcgtaagatagtgtccaaagcagtcttaagaagaggtcccattaccccactctttccgccctaatggaggtctccagtttaggtaaataaaaggattgttgggaggtggagggaaagaactactatttccaacatgcattgcggaacgaaaggccttggccacactgttccttggaaactgtagtcttatggagaggaacatccaataccaaagcgggcacaattctcacggaaatccagtggatagattggagacctccgcgggcttatacatgtcaacagtaatggattggagtgttgttatgttctcctatcttgagagcagagactaggccaaaaaaagatacctacaactcctaggaagactacgattcccatccagccccacgagtctcgggcaagtagtcctctaagcctcacagcatggaaccacaggttactctaaatgtgacttttaaaaatgaaattcaaagctttctggtttctgatccagaaaatacaacttgggctgatatcgaagctatggtaaaagtttcatttgatctgaatactattcaaataaaatacctggatgaggaaaatgaagaggtatccatcaacagtcaaggagaatatgaagaagcgcttaagatggcagttaaacagggaaaccaactgcagatgcaagtccacgaagggcaccatgtcgttgatgaagccccacccccagttgtaggagcaaaacgactagctgccagggcagggaagaagccacttgcacattactcttcactggtgagagtcttgggatcagacatgaagaccccagaggatcctgcagtgcagtcgtttccacttgttccatgtgacacagaccagcctcaagacaagcccccagactggttcacaagctacctggagacgttcagagaacaagtggttaacgaaacggttgagaagcttgaacagaaattacatgaaaagcttgtcctccagaacccatccttgggttcttgtccctcagaagtctcaatgcctacttcagaagaaacattgtttttgccagaaaaccagttcagctggcatattgcttgcaacaactgccaaagaaggattgttggtgtccgctaccagtgtagcctatgcccatcctacaatatctgtgaagattgtgaagcagggccatatggccatgacactaaccacgtcctgctgaagttgcggagacctgttgtgggctcctctgaaccgttctgtcactcaaagtactctactcctcgtcttcctgctgctctggaacaagtcaggctccagaaacaggttgataagaactttcttaaagcagaaaagcaaaggttgcgagctgagaagaaacaacgtaaagcagaggtcaaggaacttaaaaagcagcttaaactccataggaaaattcacctgtggaattcaatccatggactccagagccccaagtctcctttaggccgacctgagagcttgctccagtctaataccctgatgctccctttgcagccctgtacctccgttatgccaatgctcagtgcagcatttgtggatgagaatttgcctgatgggactcaccttcagccaggaaccaagtttatcaaacactggaggatgaaaaatacaggaaatgtaaagtggagtgcagacacaaagctcaagttcatgtggggaaacctgactttggcttccacagaaaagaaggatgttttggttccctgcctcaaggccggccatgtgggagttgtatctgtggagttcattgccccagccttggagggaacgtatacttcccattggcgtctttctcacaaaggccagcaatttgggcctcgggtctggtgcagtatcatagtagatcctttcccctccgaagagagccctgataacattgaaaagggcatgatcagctcaagcaaaactgatgatctcacctgccagcaagaggaaacttttcttctggctaaagaagaaagacagcttggtgaagtgactgagcagacagaagggacagcagcctgcatcccacagaaggcaaaaaatgttgccagtgagagggagctctacatcccatctgtggatcttctgactgcccaggacctgctgtcctttgagctgttggatataaacattgttcaagagttggagagagtgccccacaacacccctgtggatgtgactccctgcatgtctcctctgccacatgacagtcctttaatagagaagccaggcttggggcagatagaggaagagaatgaaggggcaggatttaaagcacttcctgattctatggtgtcagtaaagaggaaggctgagaacattgcttctgtggaggaagcagaagaagacctgagtgggacccagtttgtgtgtgagacagtaatccgatcccttaccttggatgctgccccagaccacaaccctccttgcagacagaagtccttgcagatgacatttgccttgcctgaaggaccacttggaaatgagaaggaggagattatccatatcgctgaggaagaagctgtcatggaggaggaggaggatgaggaggatgaggaggaggaggatgagctcaaagatgaagttcaaagtcagtcctctgcttcctcagaggattacatcatcatcctgcctgagtgctttgataccagccgccccctgggggattctatgtacagctctgcgctctcacagccaggcctggagcgaggtgctgaaggcaagcctggggttgaggctgggcaggaaccagctgaggctggggaaagactccctggaggggagaaccagccacaggagcacagcataagtgacatcctcacgacctcacagactctggaaacagtgcccctaatcccagaggtagtggagcttccaccgtcactgcccaggagctctccttgtgtacatcatcatggttccccaggagtggatttaccagttaccataccagaagtttcttcagtccctgatcagatcagaggagagcccagaggctcatcaggacttgtaaacagcagacagaagagctatgaccactcaaggcaccatcatgggagcagcattgctggaggactggtgaagggggctttgtctgttgctgcctctgcatacaaggccctgtttgctgggccaccagtcactgcacagccaataatttctgaagatcagacagcagccctgatggcccatctctttgaaatgggattctgtgacaggcagctgaacctacggctgctgaagaaacacaattacaatatcctgcaggttgtgacagaacttcttcagttaaacaacaacgactggtacagccaacgctattgaggagtgaccttgtattaaataactgcctgctgctcagagatgatctttattctgtcattggggtatgggatagaagcccttgcttatttttaatctgatgaatctgtatagagcccatcgttgagttaccaagacaatacctgctacagtattttggggagcaaactaaagaccagaacttaaattttcactttagacattggatgaatagtatgaagacagtttttcagttgatttggataaaactattttagtgcattgacaagtgtaacttcaacttcatatagaaccatttttctttctgcttttattgaaactgagtatttttctttggctaatgtggattttttatggggatatctgttaattttcaggttttgaaagacattaacctcggaagttgtttttaagaattattctcataattcttattctcataatttctgtaatccacctcaagcttcatagttatttggcattgaaataacacccagagcatgatagaaatgttgttactcttcctctctcaaggagaaagtaattttcctgcaatacttaataattggcaccgttgctttctaaagactccatggtgcattcaagagtatccaacttcaagggaatctccgcatttcaatgaaaggaggaagagtgtgctgataaacctaccagcacctattgagcaatgtctattatagtaattttgcatacatttttatttaagggaaaaaatataggtattgtgaaatattttgctaatcttatagaaaaggaaaaaatcccgttatttaaagggaaaagtaaatttaacagttgccttttttcttaatgtcagggcagatcttattttacagtacagtgggggaaatagaaacatgtgaaaggcaaaaggcaggctcctaaattaatgtcagtgaagttcagggtgggcaaatgagtgtgtgtgaggtataggaaatgctgatgacttctttaatgcttgaagtccgttcacaggtatctagccctagaatgcctagaacaggaagaggcagctggtgttctgcaaaacttggacaggggcaaagttgctgaaaaagttttggtttaacccgaagataagtggaaaagagcttgtccatgaacccaggttctcactctgtttacagaagtgtgttgagtacagttggtgaaggaagaggtaacaaaaaatgctaaatattttatccatgaaaatgacttccagaaaaggaagaatatgaaccccagaccgaaggggaaaagatagttaatagtattatctaacctggttggtatttgtaatgaatggtgattttaattagtcattagccataatgatgtttatttacagtataactcctgaatgctacttaaataaaccaggattcaaactgca

SEQ ID NO: 110276 - DNA, 4779 bp, Homo sapiens
ttccagttgcggcttattacgtcacagtaattgctgtaccaaggtcagaatcgccacctgaggcctgaatatcagcgtaagatagtgtccaaagcagtcttaagaagaggtcccattaccccactctttccgccctaatggaggtctccagtttaggtaaataaaaggattgttgggaggtggagggaaagaactactatttccaacatgcattgcggaacgaaaggccttggccacactgttccttggaaactgtagtcttatggagaggaacatccaataccaaagcgggcacaattctcacggaaatccagtggatagattggagacctccgcgggcttatacatgtcaacagtaatggattggagtgttgttatgttctcctatcttgagagcagagactaggccaaaaaaagatacctacaactcctaggaagactacgattcccatccagccccacgagtctcgggcaagtagtcctctaagcctcacagcatggaaccacaggttactctaaatgtgacttttaaaaatgaaattcaaagctttctggtttctgatccagaaaatacaacttgggctgatatcgaagctatggtaaaagtttcatttgatctgaatactattcaaataaaatacctggatgaggaaaatgaagaggtaaaatatattatggcacttaatatgatggcagttaaacagggaaaccaactgcagatgcaagtccacgaagggcaccatgtcgttgatgaagccccacccccagttgtaggagcaaaacgactagctgccagggcagggaagaagccacttgcacattactcttcactggtgagagtcttgggatcagacatgaagaccccagaggatcctgcagtgcagtcgtttccacttgttccatgtgacacagaccagcctcaagacaagcccccagactggttcacaagctacctggagacgttcagagaacaagtggttaacgaaacggttgagaagcttgaacagaaattacatgaaaagcttgtcctccagaacccatccttgggttcttgtccctcagaagtctcaatgcctacttcagaagaaacattgtttttgccagaaaaccagttcagctggcatattgcttgcaacaactgccaaagaaggattgttggtgtccgctaccagtgtagcctatgcccatcctacaatatctgtgaagattgtgaagcagggccatatggccatgacactaaccacgtcctgctgaagttgcggagacctgttgtgggctcctctgaaccgttctgtcactcaaagtactctactcctcgtcttcctgctgctctggaacaagtcaggctccagaaacaggttgataagaactttcttaaagcagaaaagcaaaggttgcgagctgagaagaaacaacgtaaagcagaggtcaaggaacttaaaaagcagcttaaactccataggaaaattcacctgtggaattcaatccatggactccagagccccaagtctcctttaggccgacctgagagcttgctccagtctaataccctgatgctccctttgcagccctgtacctccgttatgccaatgctcagtgcagcatttgtggatgagaatttgcctgatgggactcaccttcagccaggaaccaagtttatcaaacactggaggatgaaaaatacaggaaatgtaaagtggagtgcagacacaaagctcaagttcatgtggggaaacctgactttggcttccacagaaaagaaggatgttttggttccctgcctcaaggccggccatgtgggagttgtatctgtggagttcattgccccagccttggagggaacgtatacttcccattggcgtctttctcacaaaggccagcaatttgggcctcgggtctggtgcagtatcatagtagatcctttcccctccgaagagagccctgataacattgaaaagggcatgatcagctcaagcaaaactgatgatctcacctgccagcaagaggaaacttttcttctggctaaagaagaaagacagcttggtgaagtgactgagcagacagaagggacagcagcctgcatcccacagaaggcaaaaaatgttgccagtgagagggagctctacatcccatctgtggatcttctgactgcccaggacctgctgtcctttgagctgttggatataaacattgttcaagagttggagagagtgccccacaacacccctgtggatgtgactccctgcatgtctcctctgccacatgacagtcctttaatagagaagccaggcttggggcagatagaggaagagaatgaaggggcaggatttaaagcacttcctgattctatggtgtcagtaaagaggaaggctgagaacattgcttctgtggaggaagcagaagaagacctgagtgggacccagtttgtgtgtgagacagtaatccgatcccttaccttggatgctgccccagaccacaaccctccttgcagacagaagtccttgcagatgacatttgccttgcctgaaggaccacttggaaatgagaaggaggagattatccatatcgctgaggaagaagctgtcatggaggaggaggaggatgaggaggatgaggaggaggaggatgagctcaaagatgaagttcaaagtcagtcctctgcttcctcagaggattacatcatcatcctgcctgagtgctttgataccagccgccccctgggggattctatgtacagctctgcgctctcacagccaggcctggagcgaggtgctgaaggcaagcctggggttgaggctgggcaggaaccagctgaggctggggaaagactccctggaggggagaaccagccacaggagcacagcataagtgacatcctcacgacctcacagactctggaaacagtgcccctaatcccagaggtagtggagcttccaccgtcactgcccaggagctctccttgtgtacatcatcatggttccccaggagtggatttaccagttaccataccagaagtttcttcagtccctgatcagatcagaggagagcccagaggctcatcaggacttgtaaacagcagacagaagagctatgaccactcaaggcaccatcatgggagcagcattgctggaggactggtgaagggggctttgtctgttgctgcctctgcatacaaggccctgtttgctgggccaccagtcactgcacagccaataatttctgaagatcagacagcagccctgatggcccatctctttgaaatgggattctgtgacaggcagctgaacctacggctgctgaagaaacacaattacaatatcctgcaggttgtgacagaacttcttcagttaaacaacaacgactggtacagccaacgctattgaggagtgaccttgtattaaataactgcctgctgctcagagatgatctttattctgtcattggggtatgggatagaagcccttgcttatttttaatctgatgaatctgtatagagcccatcgttgagttaccaagacaatacctgctacagtattttggggagcaaactaaagaccagaacttaaattttcactttagacattggatgaatagtatgaagacagtttttcagttgatttggataaaactattttagtgcattgacaagtgtaacttcaacttcatatagaaccatttttctttctgcttttattgaaactgagtatttttctttggctaatgtggattttttatggggatatctgttaattttcaggttttgaaagacattaacctcggaagttgtttttaagaattattctcataattcttattctcataatttctgtaatccacctcaagcttcatagttatttggcattgaaataacacccagagcatgatagaaatgttgttactcttcctctctcaaggagaaagtaattttcctgcaatacttaataattggcaccgttgctttctaaagactccatggtgcattcaagagtatccaacttcaagggaatctccgcatttcaatgaaaggaggaagagtgtgctgataaacctaccagcacctattgagcaatgtctattatagtaattttgcatacatttttatttaagggaaaaaatataggtattgtgaaatattttgctaatcttatagaaaaggaaaaaatcccgttatttaaagggaaaagtaaatttaacagttgccttttttcttaatgtcagggcagatcttattttacagtacagtgggggaaatagaaacatgtgaaaggcaaaaggcaggctcctaaattaatgtcagtgaagttcagggtgggcaaatgagtgtgtgtgaggtataggaaatgctgatgacttctttaatgcttgaagtccgttcacaggtatctagccctagaatgcctagaacaggaagaggcagctggtgttctgcaaaacttggacaggggcaaagttgctgaaaaagttttggtttaacccgaagataagtggaaaagagcttgtccatgaacccaggttctcactctgtttacagaagtgtgttgagtacagttggtgaaggaagaggtaacaaaaaatgctaaatattttatccatgaaaatgacttccagaaaaggaagaatatgaaccccagaccgaaggggaaaagatagttaatagtattatctaacctggttggtatttgtaatgaatggtgattttaattagtcattagccataatgatgtttatttacagtataactcctgaatgctacttaaataaaccaggattcaaactgca

SEQ ID NO: 110277 - DNA, 5022 bp, Homo sapiens
ttccagttgcggcttattacgtcacagtaattgctgtaccaaggtcagaatcgccacctgaggcctgaatatcagcgtaagatagtgtccaaagcagtcttaagaagaggtcccattaccccactctttccgccctaatggaggtctccagtttaggtaaataaaaggattgttgggaggtggagggaaagaactactatttccaacatgcattgcggaacgaaaggccttggccacactgttccttggaaactgtagtcttatggagaggaacatccaataccaaagcgggcacaattctcacggaaatccagtggatagattggagacctccgcgggcttatacatgtcaacagtaatggattggagtgttgttatgttctcctatcttgagagcagagactaggccaaaaaaagatacctacaactcctaggaagactacgattcccatccagccccacgagtctcgggcaagtagtcctctaagcctcacagcatggaaccacaggttactctaaatgtgacttttaaaaatgaaattcaaagctttctggtttctgatccagaaaatacaacttgggctgatatcgaagctatggtaaaagtttcatttgatctgaatactattcaaataaaatacctggatgaggaaaatgaagaggtatccatcaacagtcaaggagaatatgaagaagcgcttaagatggcagttaaacagggaaaccaactgcagatgcaagtccacgaagggcaccatgtcgttgatgaagccccacccccagttgtaggagcaaaacgactagctgccagggcagggaagaagccacttgcacattactcttcactggtgagagtcttgggatcagacatgaagaccccagaggatcctgcagtgcagtcgtttccacttgttccatgtgacacagaccagcctcaagacaagcccccagactggttcacaagctacctggagacgttcagagaacaagtggttaacgaaacggttgagaagcttgaacagaaattacatgaaaagcttgtcctccagaacccatccttgggttcttgtccctcagaagtctcaatgcctacttcagaagaaacattgtttttgccagaaaaccagttcagctggcatattgcttgcaacaactgccaaagaaggattgttggtgtccgctaccagtgtagcctatgcccatcctacaatatctgtgaagattgtgaagcagggccatatggccatgacactaaccacgtcctgctgaagttgcggagacctgttgtgggctcctctgaaccgttctgtcactcaaagtactctactcctcgtcttcctgctgctctggaacaagtcaggctccagaaacaggttgataagaactttcttaaagcagaaaagcaaaggttgcgagctgagaagaaacaacgtaaagcagaggtcaaggaacttaaaaagcagcttaaactccataggaaaattcacctgtggaattcaatccatggactccagagccccaagtctcctttaggccgacctgagagcttgctccagtctaataccctgatgctccctttgcagccctgtacctccgttatgccaatgctcagtgcagcatttgtggatgagaatttgcctgatgggactcaccttcagccaggaaccaagtttatcaaacactggaggatgaaaaatacaggaaatgtaaagtggagtgcagacacaaagctcaagttcatgtggggaaacctgactttggcttccacagaaaagaaggatgttttggttccctgcctcaaggccggccatgtgggagttgtatctgtggagttcattgccccagccttggagggaacgtatacttcccattggcgtctttctcacaaaggccagcaatttgggcctcgggtctggtgcagtatcatagtagatcctttcccctccgaagagagccctgataacattgaaaagggcatgatcagctcaagcaaaactgatgatctcacctgccagcaagaggaaacttttcttctggctaaagaagaaagacagcttggtgaagtgactgagcagacagaagggacagcagcctgcatcccacagaaggcaaaaaatgttgccagtgagagggagctctacatcccatctgtggatcttctgactgcccaggacctgctgtcctttgagctgttggatataaacattgttcaagagttggagagagtgccccacaacacccctgtggatgtgactccctgcatgtctcctctgccacatgacagtcctttaatagagaagccaggcttggggcagatagaggaagagaatgaaggggcaggatttaaagcacttcctgattctatggtgtcagtaaagaggaaggctgagaacattgcttctgtggaggaagcagaagaagacctgagtgggacccagtttgtgtgtgagacagtaatccgatcccttaccttggatgctgccccagaccacaaccctccttgcagacagaagtccttgcagatgacatttgccttgcctgaaggaccacttggaaatgagaaggaggagattatccatatcgctgaggaagaagctgtcatggaggaggaggaggatgaggaggatgaggaggaggaggatgagctcaaagatgaagttcaaagtcagtcctctgcttcctcagaggattacatcatcatcctgcctgagtgctttgataccagccgccccctgggggattctatgtacagctctgcgctctcacagccaggcctggagcgaggtgctgaaggcaagcctggggttgaggctgggcaggaaccagctgaggctggggaaagactccctggaggggagaaccagccacaggagcacagcataagtgacatcctcacgacctcacagactctggaaacagtgcccctaatcccagaggtagtggagcttccaccgtcactgcccaggagctctccttgtgtacatcatcatggttccccaggagtggatttaccagttaccataccagaagtttcttcagtccctgatcagatcagaggagagcccagaggctcatcaggacttgtaaacagcagacagaagagctatgaccactcaaggcaccatcatgggagcagcattgctggaggactggtgaagggggctttgtctgttgctgcctctgcatacaaggccctgtttgctgggccaccagtcactgcacagccaataatttctgaagatcagacagcagccctgatggcccatctctttgaaatgggattctgtgacaggcagctgaacctacggctgctgaagaaacacaattacaatatcctgcaggttgtgacagaacttcttcagttaaacaacaacgactggtacagccaacgctattgaggagtgaccttgtattaaataactgcctgctgctcagagatgatctttattctgtcattggggtatgggatagaagcccttgcttatttttaatctgatgaatctgtatagagcccatcgttgagttaccaagacaatacctgctacagtattttggggagcaaactaaagaccagaacttaaattttcactttagacattggatgaatagtatgaagacagtttttcagttgatttggataaaactattttagtgcattgacaagtgtaacttcaacttcatatagaaccatttttctttctgcttttattgaaactgagtatttttctttggctaatgtggattttttatggggatatctgttaattttcaggttttgaaagacattaacctcggaagttgtttttaagaattattctcataattcttattctcataatttctgtaatccacctcaagcttcatagttatttggcattgaaataacacccagagcatgatagaaatgttgttactcttcctctctcaaggagaaagtaattttcctgcaatacttaataattggcaccgttgctttctaaagactccatggtgcattcaagagtatccaacttcaagggaatctccgcatttcaatgaaaggaggaagagtgtgctgataaacctaccagcacctattgagcaatgtctattatagtaattttgcatacatttttatttaagggaaaaaatataggtattgtgaaatattttgctaatcttatagaaaaggaaaaaatcccgttatttaaagggaaaagtaaatttaacagttgccttttttcttaatgtcagggcagatcttattttacagtacagtgggggaaatagaaacatgtgaaaggcaaaaggcaggctcctaaattaatgtcagtgaagttcagggtgggcaaatgagtgtgtgtgaggtataggaaatgctgatgacttctttaatgcttgaagtccgttcacaggtatctagccctagaatgcctagaacaggaagaggcagctggtgttctgcaaaacttggacaggggcaaagttgctgaaaaagttttggtttaacccgaagataagtggaaaagagcttgtccatgaacccaggttctcactctgtttacagaagtgtgttgagtacagttggtgaaggaagaggtaacaaaaaatgctaaatattttatccatgaaaatgacttccagaaaaggaagaatatgaaccccagaccgaaggggaaaagatagttaatagtattatctaacctggttggtatttgtaatgaatggtgattttaattagtcattagccataatgatgtttatttacagtataactcctgaatgctacttaaataaaccaggattcaaactgcaagccagccaggccgttcattatttaaaacgttttaatcggggcttccgggtagaaggtggagcggcagggtgtaattgggttgatgggtgggacctgtcttgaccatcggagttttataatcgagggccaggagggcccgggttgctctcctggttatgtatgtacttgtacataaccacctaaagaatggtgaaataaatgttcttggaaattcctaaaaaaaaaaa

SEQ ID NO: 110278 - DNA, 4423 bp, Homo sapiens
cttggcttgtaaaggcctctggtggagacagtaatcaaagctcaggttgccaggtctgtttcattaaagggattttgttgaggctgaaaaaaaaatcgacgtggaggaaaagctaacttgtgccaagcaaagcctcacagcatggaaccacaggttactctaaatgtgacttttaaaaatgaaattcaaagctttctggtttctgatccagaaaatacaacttgggctgatatcgaagctatggtaaaagtttcatttgatctgaatactattcaaataaaatacctggatgaggaaaatgaagaggtaaaatatattatggcacttaatatgatggcagttaaacagggaaaccaactgcagatgcaagtccacgaagggcaccatgtcgttgatgaagccccacccccagttgtaggagcaaaacgactagctgccagggcagggaagaagccacttgcacattactcttcactggtgagagtcttgggatcagacatgaagaccccagaggatcctgcagtgcagtcgtttccacttgttccatgtgacacagaccagcctcaagacaagcccccagactggttcacaagctacctggagacgttcagagaacaagtggttaacgaaacggttgagaagcttgaacagaaattacatgaaaagcttgtcctccagaacccatccttgggttcttgtccctcagaagtctcaatgcctacttcagaagaaacattgtttttgccagaaaaccagttcagctggcatattgcttgcaacaactgccaaagaaggattgttggtgtccgctaccagtgtagcctatgcccatcctacaatatctgtgaagattgtgaagcagggccatatggccatgacactaaccacgtcctgctgaagttgcggagacctgttgtgggctcctctgaaccgttctgtcactcaaagtactctactcctcgtcttcctgctgctctggaacaagtcaggctccagaaacaggttgataagaactttcttaaagcagaaaagcaaaggttgcgagctgagaagaaacaacgtaaagcagaggtcaaggaacttaaaaagcagcttaaactccataggaaaattcacctgtggaattcaatccatggactccagagccccaagtctcctttaggccgacctgagagcttgctccagtctaataccctgatgctccctttgcagccctgtacctccgttatgccaatgctcagtgcagcatttgtggatgagaatttgcctgatgggactcaccttcagccaggaaccaagtttatcaaacactggaggatgaaaaatacaggaaatgtaaagtggagtgcagacacaaagctcaagttcatgtggggaaacctgactttggcttccacagaaaagaaggatgttttggttccctgcctcaaggccggccatgtgggagttgtatctgtggagttcattgccccagccttggagggaacgtatacttcccattggcgtctttctcacaaaggccagcaatttgggcctcgggtctggtgcagtatcatagtagatcctttcccctccgaagagagccctgataacattgaaaagggcatgatcagctcaagcaaaactgatgatctcacctgccagcaagaggaaacttttcttctggctaaagaagaaagacagcttggtgaagtgactgagcagacagaagggacagcagcctgcatcccacagaaggcaaaaaatgttgccagtgagagggagctctacatcccatctgtggatcttctgactgcccaggacctgctgtcctttgagctgttggatataaacattgttcaagagttggagagagtgccccacaacacccctgtggatgtgactccctgcatgtctcctctgccacatgacagtcctttaatagagaagccaggcttggggcagatagaggaagagaatgaaggggcaggatttaaagcacttcctgattctatggtgtcagtaaagaggaaggctgagaacattgcttctgtggaggaagcagaagaagacctgagtgggacccagtttgtgtgtgagacagtaatccgatcccttaccttggatgctgccccagaccacaaccctccttgcagacagaagtccttgcagatgacatttgccttgcctgaaggaccacttggaaatgagaaggaggagattatccatatcgctgaggaagaagctgtcatggaggaggaggaggatgaggaggatgaggaggaggaggatgagctcaaagatgaagttcaaagtcagtcctctgcttcctcagaggattacatcatcatcctgcctgagtgctttgataccagccgccccctgggggattctatgtacagctctgcgctctcacagccaggcctggagcgaggtgctgaaggcaagcctggggttgaggctgggcaggaaccagctgaggctggggaaagactccctggaggggagaaccagccacaggagcacagcataagtgacatcctcacgacctcacagactctggaaacagtgcccctaatcccagaggtagtggagcttccaccgtcactgcccaggagctctccttgtgtacatcatcatggttccccaggagtggatttaccagttaccataccagaagtttcttcagtccctgatcagatcagaggagagcccagaggctcatcaggacttgtaaacagcagacagaagagctatgaccactcaaggcaccatcatgggagcagcattgctggaggactggtgaagggggctttgtctgttgctgcctctgcatacaaggccctgtttgctgggccaccagtcactgcacagccaataatttctgaagatcagacagcagccctgatggcccatctctttgaaatgggattctgtgacaggcagctgaacctacggctgctgaagaaacacaattacaatatcctgcaggttgtgacagaacttcttcagttaaacaacaacgactggtacagccaacgctattgaggagtgaccttgtattaaataactgcctgctgctcagagatgatctttattctgtcattggggtatgggatagaagcccttgcttatttttaatctgatgaatctgtatagagcccatcgttgagttaccaagacaatacctgctacagtattttggggagcaaactaaagaccagaacttaaattttcactttagacattggatgaatagtatgaagacagtttttcagttgatttggataaaactattttagtgcattgacaagtgtaacttcaacttcatatagaaccatttttctttctgcttttattgaaactgagtatttttctttggctaatgtggattttttatggggatatctgttaattttcaggttttgaaagacattaacctcggaagttgtttttaagaattattctcataattcttattctcataatttctgtaatccacctcaagcttcatagttatttggcattgaaataacacccagagcatgatagaaatgttgttactcttcctctctcaaggagaaagtaattttcctgcaatacttaataattggcaccgttgctttctaaagactccatggtgcattcaagagtatccaacttcaagggaatctccgcatttcaatgaaaggaggaagagtgtgctgataaacctaccagcacctattgagcaatgtctattatagtaattttgcatacatttttatttaagggaaaaaatataggtattgtgaaatattttgctaatcttatagaaaaggaaaaaatcccgttatttaaagggaaaagtaaatttaacagttgccttttttcttaatgtcagggcagatcttattttacagtacagtgggggaaatagaaacatgtgaaaggcaaaaggcaggctcctaaattaatgtcagtgaagttcagggtgggcaaatgagtgtgtgtgaggtataggaaatgctgatgacttctttaatgcttgaagtccgttcacaggtatctagccctagaatgcctagaacaggaagaggcagctggtgttctgcaaaacttggacaggggcaaagttgctgaaaaagttttggtttaacccgaagataagtggaaaagagcttgtccatgaacccaggttctcactctgtttacagaagtgtgttgagtacagttggtgaaggaagaggtaacaaaaaatgctaaatattttatccatgaaaatgacttccagaaaaggaagaatatgaaccccagaccgaaggggaaaagatagttaatagtattatctaacctggttggtatttgtaatgaatggtgattttaattagtcattagccataatgatgtttatttacagtataactcctgaatgctacttaaataaaccaggattcaaactgca

SEQ ID NO: 110279 - DNA, 4578 bp, Homo sapiens
ttccagttgcggcttattacgtcacagtaattgctgtaccaaggtcagaatcgccacctgaggcctgaatatcagcgtaagatagtgtccaaagcagtcttaagaagaggtcccattaccccactctttccgccctaatggaggtctccagtttaggtaaataaaaggattgttgggaggtggagggaaagaactactatttccaacatgcattgcggaacgaaaggccttggccacactgttccttggaaactgtagtcttatggagaggaacatccaataccaaagcgggcacaattctcacggaaatccagtggatagattggagacctccgcgggcttatacatgtcaacagtaatggattggagtgttgttatgttctcctatcttgagagcagagactaggccaaaaaaagatacctacaactcctaggaagactacgattcccatccagccccacgagtctcgggcaagtagtcctctaagatggcagttaaacagggaaaccaactgcagatgcaagtccacgaagggcaccatgtcgttgatgaagccccacccccagttgtaggagcaaaacgactagctgccagggcagggaagaagccacttgcacattactcttcactggtgagagtcttgggatcagacatgaagaccccagaggatcctgcagtgcagtcgtttccacttgttccatgtgacacagaccagcctcaagacaagcccccagactggttcacaagctacctggagacgttcagagaacaagtggttaacgaaacggttgagaagcttgaacagaaattacatgaaaagcttgtcctccagaacccatccttgggttcttgtccctcagaagtctcaatgcctacttcagaagaaacattgtttttgccagaaaaccagttcagctggcatattgcttgcaacaactgccaaagaaggattgttggtgtccgctaccagtgtagcctatgcccatcctacaatatctgtgaagattgtgaagcagggccatatggccatgacactaaccacgtcctgctgaagttgcggagacctgttgtgggctcctctgaaccgttctgtcactcaaagtactctactcctcgtcttcctgctgctctggaacaagtcaggctccagaaacaggttgataagaactttcttaaagcagaaaagcaaaggttgcgagctgagaagaaacaacgtaaagcagaggtcaaggaacttaaaaagcagcttaaactccataggaaaattcacctgtggaattcaatccatggactccagagccccaagtctcctttaggccgacctgagagcttgctccagtctaataccctgatgctccctttgcagccctgtacctccgttatgccaatgctcagtgcagcatttgtggatgagaatttgcctgatgggactcaccttcagccaggaaccaagtttatcaaacactggaggatgaaaaatacaggaaatgtaaagtggagtgcagacacaaagctcaagttcatgtggggaaacctgactttggcttccacagaaaagaaggatgttttggttccctgcctcaaggccggccatgtgggagttgtatctgtggagttcattgccccagccttggagggaacgtatacttcccattggcgtctttctcacaaaggccagcaatttgggcctcgggtctggtgcagtatcatagtagatcctttcccctccgaagagagccctgataacattgaaaagggcatgatcagctcaagcaaaactgatgatctcacctgccagcaagaggaaacttttcttctggctaaagaagaaagacagcttggtgaagtgactgagcagacagaagggacagcagcctgcatcccacagaaggcaaaaaatgttgccagtgagagggagctctacatcccatctgtggatcttctgactgcccaggacctgctgtcctttgagctgttggatataaacattgttcaagagttggagagagtgccccacaacacccctgtggatgtgactccctgcatgtctcctctgccacatgacagtcctttaatagagaagccaggcttggggcagatagaggaagagaatgaaggggcaggatttaaagcacttcctgattctatggtgtcagtaaagaggaaggctgagaacattgcttctgtggaggaagcagaagaagacctgagtgggacccagtttgtgtgtgagacagtaatccgatcccttaccttggatgctgccccagaccacaaccctccttgcagacagaagtccttgcagatgacatttgccttgcctgaaggaccacttggaaatgagaaggaggagattatccatatcgctgaggaagaagctgtcatggaggaggaggaggatgaggaggatgaggaggaggaggatgagctcaaagatgaagttcaaagtcagtcctctgcttcctcagaggattacatcatcatcctgcctgagtgctttgataccagccgccccctgggggattctatgtacagctctgcgctctcacagccaggcctggagcgaggtgctgaaggcaagcctggggttgaggctgggcaggaaccagctgaggctggggaaagactccctggaggggagaaccagccacaggagcacagcataagtgacatcctcacgacctcacagactctggaaacagtgcccctaatcccagaggtagtggagcttccaccgtcactgcccaggagctctccttgtgtacatcatcatggttccccaggagtggatttaccagttaccataccagaagtttcttcagtccctgatcagatcagaggagagcccagaggctcatcaggacttgtaaacagcagacagaagagctatgaccactcaaggcaccatcatgggagcagcattgctggaggactggtgaagggggctttgtctgttgctgcctctgcatacaaggccctgtttgctgggccaccagtcactgcacagccaataatttctgaagatcagacagcagccctgatggcccatctctttgaaatgggattctgtgacaggcagctgaacctacggctgctgaagaaacacaattacaatatcctgcaggttgtgacagaacttcttcagttaaacaacaacgactggtacagccaacgctattgaggagtgaccttgtattaaataactgcctgctgctcagagatgatctttattctgtcattggggtatgggatagaagcccttgcttatttttaatctgatgaatctgtatagagcccatcgttgagttaccaagacaatacctgctacagtattttggggagcaaactaaagaccagaacttaaattttcactttagacattggatgaatagtatgaagacagtttttcagttgatttggataaaactattttagtgcattgacaagtgtaacttcaacttcatatagaaccatttttctttctgcttttattgaaactgagtatttttctttggctaatgtggattttttatggggatatctgttaattttcaggttttgaaagacattaacctcggaagttgtttttaagaattattctcataattcttattctcataatttctgtaatccacctcaagcttcatagttatttggcattgaaataacacccagagcatgatagaaatgttgttactcttcctctctcaaggagaaagtaattttcctgcaatacttaataattggcaccgttgctttctaaagactccatggtgcattcaagagtatccaacttcaagggaatctccgcatttcaatgaaaggaggaagagtgtgctgataaacctaccagcacctattgagcaatgtctattatagtaattttgcatacatttttatttaagggaaaaaatataggtattgtgaaatattttgctaatcttatagaaaaggaaaaaatcccgttatttaaagggaaaagtaaatttaacagttgccttttttcttaatgtcagggcagatcttattttacagtacagtgggggaaatagaaacatgtgaaaggcaaaaggcaggctcctaaattaatgtcagtgaagttcagggtgggcaaatgagtgtgtgtgaggtataggaaatgctgatgacttctttaatgcttgaagtccgttcacaggtatctagccctagaatgcctagaacaggaagaggcagctggtgttctgcaaaacttggacaggggcaaagttgctgaaaaagttttggtttaacccgaagataagtggaaaagagcttgtccatgaacccaggttctcactctgtttacagaagtgtgttgagtacagttggtgaaggaagaggtaacaaaaaatgctaaatattttatccatgaaaatgacttccagaaaaggaagaatatgaaccccagaccgaaggggaaaagatagttaatagtattatctaacctggttggtatttgtaatgaatggtgattttaattagtcattagccataatgatgtttatttacagtataactcctgaatgctacttaaataaaccaggattcaaactgca

SEQ ID NO: 110280 - DNA, 4388 bp, Homo sapiens
  misc_feature (1)..(3): n is a, c, g, or t
nnngacagggatagcggcagagccggtagcggacggtccttgcattggcctccggcaggcgccccccgggggcgggaagctgcctcacagcatggaaccacaggttactctaaatgtgacttttaaaaatgaaattcaaagctttctggtttctgatccagaaaatacaacttgggctgatatcgaagctatggtaaaagtttcatttgatctgaatactattcaaataaaatacctggatgaggaaaatgaagaggtatccatcaacagtcaaggagaatatgaagaagcgcttaagatggcagttaaacagggaaaccaactgcagatgcaagtccacgaagggcaccatgtcgttgatgaagccccacccccagttgtaggagcaaaacgactagctgccagggcagggaagaagccacttgcacattactcttcactggtgagagtcttgggatcagacatgaagaccccagaggatcctgcagtgcagtcgtttccacttgttccatgtgacacagaccagcctcaagacaagcccccagactggttcacaagctacctggagacgttcagagaacaagtggttaacgaaacggttgagaagcttgaacagaaattacatgaaaagcttgtcctccagaacccatccttgggttcttgtccctcagaagtctcaatgcctacttcagaagaaacattgtttttgccagaaaaccagttcagctggcatattgcttgcaacaactgccaaagaaggattgttggtgtccgctaccagtgtagcctatgcccatcctacaatatctgtgaagattgtgaagcagggccatatggccatgacactaaccacgtcctgctgaagttgcggagacctgttgtgggctcctctgaaccgttctgtcactcaaagtactctactcctcgtcttcctgctgctctggaacaagtcaggctccagaaacaggttgataagaactttcttaaagcagaaaagcaaaggttgcgagctgagaagaaacaacgtaaagcagaggtcaaggaacttaaaaagcagcttaaactccataggaaaattcacctgtggaattcaatccatggactccagagccccaagtctcctttaggccgacctgagagcttgctccagtctaataccctgatgctccctttgcagccctgtacctccgttatgccaatgctcagtgcagcatttgtggatgagaatttgcctgatgggactcaccttcagccaggaaccaagtttatcaaacactggaggatgaaaaatacaggaaatgtaaagtggagtgcagacacaaagctcaagttcatgtggggaaacctgactttggcttccacagaaaagaaggatgttttggttccctgcctcaaggccggccatgtgggagttgtatctgtggagttcattgccccagccttggagggaacgtatacttcccattggcgtctttctcacaaaggccagcaatttgggcctcgggtctggtgcagtatcatagtagatcctttcccctccgaagagagccctgataacattgaaaagggcatgatcagctcaagcaaaactgatgatctcacctgccagcaagaggaaacttttcttctggctaaagaagaaagacagcttggtgaagtgactgagcagacagaagggacagcagcctgcatcccacagaaggcaaaaaatgttgccagtgagagggagctctacatcccatctgtggatcttctgactgcccaggacctgctgtcctttgagctgttggatataaacattgttcaagagttggagagagtgccccacaacacccctgtggatgtgactccctgcatgtctcctctgccacatgacagtcctttaatagagaagccaggcttggggcagatagaggaagagaatgaaggggcaggatttaaagcacttcctgattctatggtgtcagtaaagaggaaggctgagaacattgcttctgtggaggaagcagaagaagacctgagtgggacccagtttgtgtgtgagacagtaatccgatcccttaccttggatgctgccccagaccacaaccctccttgcagacagaagtccttgcagatgacatttgccttgcctgaaggaccacttggaaatgagaaggaggagattatccatatcgctgaggaagaagctgtcatggaggaggaggaggatgaggaggatgaggaggaggaggatgagctcaaagatgaagttcaaagtcagtcctctgcttcctcagaggattacatcatcatcctgcctgagtgctttgataccagccgccccctgggggattctatgtacagctctgcgctctcacagccaggcctggagcgaggtgctgaaggcaagcctggggttgaggctgggcaggaaccagctgaggctggggaaagactccctggaggggagaaccagccacaggagcacagcataagtgacatcctcacgacctcacagactctggaaacagtgcccctaatcccagaggtagtggagcttccaccgtcactgcccaggagctctccttgtgtacatcatcatggttccccaggagtggatttaccagttaccataccagaagtttcttcagtccctgatcagatcagaggagagcccagaggctcatcaggacttgtaaacagcagacagaagagctatgaccactcaaggcaccatcatgggagcagcattgctggaggactggtgaagggggctttgtctgttgctgcctctgcatacaaggccctgtttgctgggccaccagtcactgcacagccaataatttctgaagatcagacagcagccctgatggcccatctctttgaaatgggattctgtgacaggcagctgaacctacggctgctgaagaaacacaattacaatatcctgcaggttgtgacagaacttcttcagttaaacaacaacgactggtacagccaacgctattgaggagtgaccttgtattaaataactgcctgctgctcagagatgatctttattctgtcattggggtatgggatagaagcccttgcttatttttaatctgatgaatctgtatagagcccatcgttgagttaccaagacaatacctgctacagtattttggggagcaaactaaagaccagaacttaaattttcactttagacattggatgaatagtatgaagacagtttttcagttgatttggataaaactattttagtgcattgacaagtgtaacttcaacttcatatagaaccatttttctttctgcttttattgaaactgagtatttttctttggctaatgtggattttttatggggatatctgttaattttcaggttttgaaagacattaacctcggaagttgtttttaagaattattctcataattcttattctcataatttctgtaatccacctcaagcttcatagttatttggcattgaaataacacccagagcatgatagaaatgttgttactcttcctctctcaaggagaaagtaattttcctgcaatacttaataattggcaccgttgctttctaaagactccatggtgcattcaagagtatccaacttcaagggaatctccgcatttcaatgaaaggaggaagagtgtgctgataaacctaccagcacctattgagcaatgtctattatagtaattttgcatacatttttatttaagggaaaaaatataggtattgtgaaatattttgctaatcttatagaaaaggaaaaaatcccgttatttaaagggaaaagtaaatttaacagttgccttttttcttaatgtcagggcagatcttattttacagtacagtgggggaaatagaaacatgtgaaaggcaaaaggcaggctcctaaattaatgtcagtgaagttcagggtgggcaaatgagtgtgtgtgaggtataggaaatgctgatgacttctttaatgcttgaagtccgttcacaggtatctagccctagaatgcctagaacaggaagaggcagctggtgttctgcaaaacttggacaggggcaaagttgctgaaaaagttttggtttaacccgaagataagtggaaaagagcttgtccatgaacccaggttctcactctgtttacagaagtgtgttgagtacagttggtgaaggaagaggtaacaaaaaatgctaaatattttatccatgaaaatgacttccagaaaaggaagaatatgaaccccagaccgaaggggaaaagatagttaatagtattatctaacctggttggtatttgtaatgaatggtgattttaattagtcattagccataatgatgtttatttacagtataactcctgaatgctacttaaataaaccaggattcaaactgca

SEQ ID NO: 110281 - DNA, 2833 bp, Homo sapiens
  misc_feature (32)..(32): n is a, c, g, or t
ctccgaggatttcgcgttatccgtacaagcanaactgatgatctcacctgccagcaagaggaaacttttcttctggctaaagaagaaagacagcttggtgaagtgactgagcagacagaagggacagcagcctgcatcccacagaaggcaaaaaatgttgccagtgagagggagctctacatcccatctgtggatcttctgactgcccaggacctgctgtcctttgagctgttggatataaacattgttcaagagttggagagagtgccccacaacacccctgtggatgtgactccctgcatgtctcctctgccacatgacagtcctttaatagagaagccaggcttggggcagatagaggaagagaatgaaggggcaggatttaaagcacttcctgattctatggtgtcagtaaagaggaaggctgagaacattgcttctgtggaggaagcagaagaagacctgagtgggacccagtttgtgtgtgagacagtaatccgatcccttaccttggatgctgccccagaccacaaccctccttgcagacagaagtccttgcagatgacatttgccttgcctgaaggaccacttggaaatgagaaggaggagattatccatatcgctgaggaagaagctgtcatggaggaggaggaggatgaggaggatgaggaggaggaggatgagctcaaagatgaagttcaaagtcagtcctctgcttcctcagaggattacatcatcatcctgcctgagtgctttgataccagccgccccctgggggattctatgtacagctctgcgctctcacagccaggcctggagcgaggtgctgaaggcaagcctggggttgaggctgggcaggaaccagctgaggctggggaaagactccctggaggggagaaccagccacaggagcacagcataagtgacatcctcacgacctcacagactctggaaacagtgcccctaatcccagaggtagtggagcttccaccgtcactgcccaggagctctccttgtgtacatcatcatggttccccaggagtggatttaccagttaccataccagaagtttcttcagtccctgatcagatcagaggagagcccagaggctcatcaggacttgtaaacagcagacagaagagctatgaccactcaaggcaccatcatgggagcagcattgctggaggactggtgaagggggctttgtctgttgctgcctctgcatacaaggccctgtttgctgggccaccagtcactgcacagccaataatttctgaagatcagacagcagccctgatggcccatctctttgaaatgggattctgtgacaggcagctgaacctacggctgctgaagaaacacaattacaatatcctgcaggttgtgacagaacttcttcagttaaacaacaacgactggtacagccaacgctattgaggagtgaccttgtattaaataactgcctgctgctcagagatgatctttattctgtcattggggtatgggatagaagcccttgcttatttttaatctgatgaatctgtatagagcccatcgttgagttaccaagacaatacctgctacagtattttggggagcaaactaaagaccagaacttaaattttcactttagacattggatgaatagtatgaagacagtttttcagttgatttggataaaactattttagtgcattgacaagtgtaacttcaacttcatatagaaccatttttctttctgcttttattgaaactgagtatttttctttggctaatgtggattttttatggggatatctgttaattttcaggttttgaaagacattaacctcggaagttgtttttaagaattattctcataattcttattctcataatttctgtaatccacctcaagcttcatagttatttggcattgaaataacacccagagcatgatagaaatgttgttactcttcctctctcaaggagaaagtaattttcctgcaatacttaataattggcaccgttgctttctaaagactccatggtgcattcaagagtatccaacttcaagggaatctccgcatttcaatgaaaggaggaagagtgtgctgataaacctaccagcacctattgagcaatgtctattatagtaattttgcatacatttttatttaagggaaaaaatataggtattgtgaaatattttgctaatcttatagaaaaggaaaaaatcccgttatttaaagggaaaagtaaatttaacagttgccttttttcttaatgtcagggcagatcttattttacagtacagtgggggaaatagaaacatgtgaaaggcaaaaggcaggctcctaaattaatgtcagtgaagttcagggtgggcaaatgagtgtgtgtgaggtataggaaatgctgatgacttctttaatgcttgaagtccgttcacaggtatctagccctagaatgcctagaacaggaagaggcagctggtgttctgcaaaacttggacaggggcaaagttgctgaaaaagttttggtttaacccgaagataagtggaaaagagcttgtccatgaacccaggttctcactctgtttacagaagtgtgttgagtacagttggtgaaggaagaggtaacaaaaaatgctaaatattttatccatgaaaatgacttccagaaaaggaagaatatgaaccccagaccgaaggggaaaagatagttaatagtattatctaacctggttggtatttgtaatgaatggtgattttaattagtcattagccataatgatgtttatttacagtataactcctgaatgctacttaaataaaccaggattcaaactgca

SEQ ID NO: 110282 - DNA, 4968 bp, Homo sapiens
ttccagttgcggcttattacgtcacagtaattgctgtaccaaggtcagaatcgccacctgaggcctgaatatcagcgtaagatagtgtccaaagcagtcttaagaagaggtcccattaccccactctttccgccctaatggaggtctccagtttaggtaaataaaaggattgttgggaggtggagggaaagaactactatttccaacatgcattgcggaacgaaaggccttggccacactgttccttggaaactgtagtcttatggagaggaacatccaataccaaagcgggcacaattctcacggaaatccagtggatagattggagacctccgcgggcttatacatgtcaacagtaatggattggagtgttgttatgttctcctatcttgagagcagagactaggccaaaaaaagatacctacaactcctaggaagactacgattcccatccagccccacgagtctcgggcaagtagtcctctaagcctcacagcatggaaccacaggttactctaaatgtgacttttaaaaatgaaattcaaagctttctggtttctgatccagaaaatacaacttgggctgatatcgaagctatggtaaaagtttcatttgatctgaatactattcaaataaaatacctggatgaggaaaatgaagaggtatccatcaacagtcaaggagaatatgaagaagcgcttaagatggcagttaaacagggaaaccaactgcagatgcaagtccacgaagggcaccatgtcgttgatgaagccccacccccagttgtaggagcaaaacgactagctgccagggcagggaagaagccacttgcacattactcttcactggtgagagtcttgggatcagacatgaagaccccagaggatcctgcagtgcagtcgtttccacttgttccatgtgacacagaccagcctcaagacaagcccccagactggttcacaagctacctggagacgttcagagaacaagtggttaacgaaacggttgagaagcttgaacagaaattacatgaaaagcttgtcctccagaacccatccttgggttcttgtccctcagaagtctcaatgcctacttcagaagaaacattgtttttgccagaaaaccagttcagctggcatattgcttgcaacaactgccaaagaaggattgttggtgtccgctaccagtgtagcctatgcccatcctacaatatctgtgaagattgtgaagcagggccatatggccatgacactaaccacgtcctgctgaagttgcggagacctgttgtgggctcctctgaaccgttctgtcactcaaagtactctactcctcgtcttcctgctgctctggaacaagtcaggctccagaaacaggttgataagaactttcttaaagcagaaaagcaaaggttgcgagctgagaagaaacaacgtaaagcagaggtcaaggaacttaaaaagcagcttaaactccataggaaaattcacctgtggaattcaatccatggactccagagccccaagtctcctttaggccgacctgagagcttgctccagtctaataccctgatgctccctttgcagccctgtacctccgttatgccaatgctcagtgcagcatttgtggatgagaatttgcctgatgggactcaccttcagccaggaaccaagtttatcaaacactggaggatgaaaaatacaggaaatgtaaagtggagtgcagacacaaagctcaagttcatgtggggaaacctgactttggcttccacagaaaagaaggatgttttggttccctgcctcaaggccggccatgtgggagttgtatctgtggagttcattgccccagccttggagggaacgtatacttcccattggcgtctttctcacaaaggccagcaatttgggcctcgggtctggtgcagtatcatagtagatcctttcccctccgaagagagccctgataacattgaaaagggcatgatcagctcaagcaaaactgatgatctcacctgccagcaagaggaaacttttcttctggctaaagaagaaagacagcttggtgaagtgactgagcagacagaagggacagcagcctgcatcccacagaaggcaaaaaatgttgccagtgagagggagctctacatcccatctgtggatcttctgactgcccaggacctgctgtcctttgagctgttggatataaacattgttcaagagttggagagagtgccccacaacacccctgtggatgtgactccctgcatgtctcctctgccacatgacagtcctttaatagagaagccaggcttggggcagatagaggaagagaatgaaggggcaggatttaaagcacttcctgattctatggtgtcagtaaagaggaaggctgagaacattgcttctgtggaggaagcagaagaagacctgagtgggacccagtttgtgtgtgagacagtaatccgatcccttaccttggatgctgccccagaccacaaccctccttgcagacagaagtccttgcagatgacatttgccttgcctgaaggaccacttggaaatgagaaggaggagattatccatatcgctgaggaagaagctgtcatggaggaggaggaggatgaggaggatgaggaggaggaggatgagctcaaagatgaagttcaaagtcagtcctctgcttcctcagaggattacatcatcatcctgcctgagtgctttgataccagccgccccctgggggattctatgtacagctctgcgctctcacagccaggcctggagcgaggtgctgaaggcaagcctggggttgaggctgggcaggaaccagctgaggctggggaaagactccctggaggggagaaccagccacaggagcacagcataagtgacatcctcacgacctcacagactctggaaacagtgcccctaatcccagaggtagtggagcttccaccgtcactgcccaggagctctccttgtgtacatcatcatggttccccaggagtggatttaccagttaccataccagaagtttcttcagtccctgatcagatcagaggagagcccagaggctcatcaggacttgtaaacagcagacagaagagctatgaccactcaaggcaccatcatgggagcagcattgctggaggactggtgaagggggctttgtctgttgctgcctctgcatacaaggccctgtttgctgggccaccagtcactgcacagccaataatttctgaagatcagacagcagccctgatggcccatctctttgaaatgggattctgtgacaggcagctgaacctacggctgctgaagaaacacaattacaatatcctgcaggttgtgacagaacttcttcagttaaacaacaacgactggtacagccaacgctattgaggagtgaccttgtattaaataactgcctgctgctcagagatgatctttattctgtcattggggtatgggatagaagcccttgcttatttttaatctgatgaatctgtatagagcccatcgttgagttaccaagacaatacctgctacagtattttggggagcaaactaaagaccagaacttaaattttcactttagacattggatgaatagtatgaagacagtttttcagttgatttggatttctttctgcttttattgaaactgagtatttttctttggctaatgtggattttttatggggatatctgttaattttcaggttttgaaagacattaacctcggaagttgtttttaagaattattctcataattcttattctcataatttctgtaatccacctcaagcttcatagttatttggcattgaaataacacccagagcatgatagaaatgttgttactcttcctctctcaaggagaaagtaattttcctgcaatacttaataattggcaccgttgctttctaaagactccatggtgcattcaagagtatccaacttcaagggaatctccgcatttcaatgaaaggaggaagagtgtgctgataaacctaccagcacctattgagcaatgtctattatagtaattttgcatacatttttatttaagggaaaaaatataggtattgtgaaatattttgctaatcttatagaaaaggaaaaaatcccgttatttaaagggaaaagtaaatttaacagttgccttttttcttaatgtcagggcagatcttattttacagtacagtgggggaaatagaaacatgtgaaaggcaaaaggcaggctcctaaattaatgtcagtgaagttcagggtgggcaaatgagtgtgtgtgaggtataggaaatgctgatgacttctttaatgcttgaagtccgttcacaggtatctagccctagaatgcctagaacaggaagaggcagctggtgttctgcaaaacttggacaggggcaaagttgctgaaaaagttttggtttaacccgaagataagtggaaaagagcttgtccatgaacccaggttctcactctgtttacagaagtgtgttgagtacagttggtgaaggaagaggtaacaaaaaatgctaaatattttatccatgaaaatgacttccagaaaaggaagaatatgaaccccagaccgaaggggaaaagatagttaatagtattatctaacctggttggtatttgtaatgaatggtgattttaattagtcattagccataatgatgtttatttacagtataactcctgaatgctacttaaataaaccaggattcaaactgcaagccagccaggccgttcattatttaaaacgttttaatcggggcttccgggtagaaggtggagcggcagggtgtaattgggttgatgggtgggacctgtcttgaccatcggagttttataatcgagggccaggagggcccgggttgctctcctggttatgtatgtacttgtacataaccacctaaagaatggtgaaataaatgttcttggaaattcctaaaaaaaaaaa

SEQ ID NO: 110283 - DNA, 867 bp, Homo sapiens
tctagaggatcccagtcactttctacacatttaaaagggaaaagtaaatttaacagttgccttttttcttaatgtcagggcagatcttattttacagtacagtgggggaaatagaaacatgtgaaaggcaaaaggcaggctcctaaattaatgtcagtgaagttcagggtgggcaaatgagtgtgtgtgaggtataggaaatgctgatgacttctttaatgcttgaagtccgttcacaggtatctagccctagaatgcctagaacaggaagaggcagctggtgttctgcaaaacttggacaggggcaaagttgctgaaaaagttttggtttaacccgaagataagtggaaaagagcttgtccatgaacccaggttctcactctgtttacagaagtgtgttgagtacagttggtgaaggaagaggtaacaaaaaatgctaaatattttatccatgaaaatgacttccagaaaaggaagaatatgaaccccagaccgaaggggaaaagatagttaatagtattatctaacctggttggtatttgtaatgaatggtgattttaattagtcattagccataatgatgtttatttacagtataactcctgaatgctacttaaataaaccaggattcaaactgcaagccagccaggccgttcattatttaaaacgttttaatcggggcttccgggtagaaggtggagcggcagggtgtaattgggttgatgggtgggacctgtcttgaccatcggagttttataatcgagggccaggagggcccgggttgctctcctggttatgtatgtacttgtacataaccacctaaagaatggtgaaataaatgttcttggaaattcctaaaaaaaaaaa

SEQ ID NO: 110284 - DNA, 3205 bp, Homo sapiens
ttccagttgcggcttattacgtcacagtaattgctgtaccaaggtcagaatcgccacctgaggcctgaatatcagcgtaagatagtgtccaaagcagtcttaagaagaggtcccattaccccactctttccgccctaatggaggtctccagtttaggtaaataaaaggattgttgggaggtggagggaaagaactactatttccaacatgcattgcggaacgaaaggccttggccacactgttccttggaaactgtagtcttatggagaggaacatccaataccaaagcgggcacaattctcacggaaatccagtggatagattggagacctccgcgggcttatacatgtcaacagtaatggattggagtgttgttatgttctcctatcttgagagcagagactaggccaaaaaaagatacctacaactcctaggaagactacgattcccatccagccccacgagtctcgggcaagtagtcctctaagcctcacagcatggaaccacaggttactctaaatgtgacttttaaaaatgaaattcaaagctttctggtttctgatccagaaaatacaacttgggctgatatcgaagctatggtaaaagtttcatttgatctgaatactattcaaataaaatacctggatgaggaaaatgaagaggtatccatcaacagtcaaggagaatatgaagaagcgcttaagatggcagttaaacagggaaaccaactgcagatgcaagtccacgaagggcaccatgtcgttgatgaagccccacccccagttgtaggagcaaaacgactagctgccagggcagggaagaagccacttgcacattactcttcactggtgagagtcttgggatcagacatgaagaccccagaggatcctgcagtgcagtcgtttccacttgttccatgtgacacagaccagcctcaagacaagcccccagactggttcacaagctacctggagacgttcagagaacaagtggttaacgaaacggttgagaagcttgaacagaaattacatgaaaagcttgtcctccagaacccatccttgggttcttgtccctcagaagtctcaatgcctacttcagaagaaacattgtttttgccagaaaaccagttcagctggcatattgcttgcaacaactgccaaagaaggattgttggtgtccgctaccagtgtagcctatgcccatcctacaatatctgtgaagattgtgaagcagggccatatggccatgacactaaccacgtcctgctgaagttgcggagacctgttgtgggctcctctgaaccgttctgtcactcaaagtactctactcctcgtcttcctgctgctctggaacaagtcaggctccagaaacaggttgataagaactttcttaaagcagaaaagcaaaggttgcgagctgagaagaaacaacgtaaagcagaggtcaaggaacttaaaaagcagcttaaactccataggaaaattcacctgtggaattcaatccatggactccagagccccaagtctcctttaggccgacctgagagcttgctccagtctaataccctgatgctccctttgcagccctgtacctccgttatgccaatgctcagtgcagcatttgtggatgagaatttgcctgatgggactcaccttcagccaggaaccaagtttatcaaacactggaggatgaaaaatacaggaaatgtaaagtggagtgcagacacaaagctcaagttcatgtggggaaacctgactttggcttccacagaaaagaaggatgttttggttccctgcctcaaggccggccatgtgggagttgtatctgtggagttcattgccccagccttggagggaacgtatacttcccattggcgtctttctcacaaaggccagcaatttgggcctcgggtctggtgcagtatcatagtagatcctttcccctccgaagagagccctgataacattgaaaagggcatgatcagctcaagcaaaactgatgatctcacctgccagcaagaggaaacttttcttctggctaaagaagaaagacagcttggtgaagtgactgagcagacagaagggacagcagcctgcatcccacagaaggcaaaaaatgttgccagtgagagggagctctacatcccatctgtggatcttctgactgcccaggacctgctgtcctttgagctgttggatataaacattgttcaagagttggagagagtgccccacaacacccctgtggatgtgactccctgcatgtctcctctgccacatgacagtcctttaatagagaagccaggcttggggcagatagaggaagagaatgaaggggcaggatttaaagcacttcctgattctatggtgtcagtaaagaggaaggctgagaacattgcttctgtggaggaagcagaagaagacctgagtgggacccagtttgtgtgtgagacagtaatccgatcccttaccttggatgctgccccagaccacaaccctccttgcagacagaagtccttgcagatgacatttgccttgcctgaaggaccacttggaaatgagaaggaggagattatccatatcgctgaggaagaagctgtcatggaggaggaggaggatgaggaggatgaggaggaggaggatgagctcaaagatgaagttcaaagtcagtcctctgcttcctcagaggattacatcatcatcctgcctgagtgctttgataccagccgccccctgggggattctatgtacagctctgcgctctcacagccaggcctggagcgaggtgctgaaggcaagcctggggttgaggctgggcaggaaccagctgaggctggggaaagactccctggaggggagaaccagccacaggagcacagcataagtgacatcctcacgacctcacagactctggaaacagtgcccctaatcccagaggtagtggagcttccaccgtcactgcccaggtaccactcacagccccttcagctggggtgttcttcagaggtgaaataaagagaggaatcgacctgatctcaaaacctgttttttcctcagtatggaaagagactattttccatagcaaagtctgaatttagatgaataaaagttgtatttcccagtatttgtggattctggatttaaagaaatatttgttttagttggccttaaattatctgagtatagtctgtctgcttatattttga

SEQ ID NO: 110285 - DNA, 2392 bp, Homo sapiens
ttccagttgcggcttattacgtcacagtaattgctgtaccaaggtcagaatcgccacctgaggcctgaatatcagcgtaagatagtgtccaaagcagtcttaagaagaggtcccattaccccactctttccgccctaatggaggtctccagtttaggtaaataaaaggattgttgggaggtggagggaaagaactactatttccaacatgcattgcggaacgaaaggccttggccacactgttccttggaaactgtagtcttatggagaggaacatccaataccaaagcgggcacaattctcacggaaatccagtggatagattggagacctccgcgggcttatacatgtcaacagtaatggattggagtgttgttatgttctcctatcttgagagcagagactaggccaaaaaaagatacctacaactcctaggaagactacgattcccatccagccccacgagtctcgggcaagtagtcctctaagcctcacagcatggaaccacaggttactctaaatgtgacttttaaaaatgaaattcaaagctttctggtttctgatccagaaaatacaacttgggctgatatcgaagctatggtaaaagtttcatttgatctgaatactattcaaataaaatacctggatgaggaaaatgaagaggtatccatcaacagtcaaggagaatatgaagaagcgcttaagatggcagttaaacagggaaaccaactgcagatgcaagtccacgaagggcaccatgtcgttgatgaagccccacccccagttgtaggagcaaaacgactagctgccagggcagggaagaagccacttgcacattactcttcactggtgagagtcttgggatcagacatgaagaccccagaggatcctgcagtgcagtcgtttccacttgttccatgtgacacagaccagcctcaagacaagcccccagactggttcacaagctacctggagacgttcagagaacaagtggttaacgaaacggttgagaagcttgaacagaaattacatgaaaagcttgtcctccagaacccatccttgggttcttgtccctcagaagtctcaatgcctacttcagaagaaacattgtttttgccagaaaaccagttcagctggcatattgcttgcaacaactgccaaagaaggattgttggtgtccgctaccagtgtagcctatgcccatcctacaatatctgtgaagattgtgaagcagggccatatggccatgacactaaccacgtcctgctgaagttgcggagacctgttgtgggctcctctgaaccgttctgtcactcaaagtactctactcctcgtcttcctgctgctctggaacaagtcaggctccagaaacaggttgataagaactttcttaaagcagaaaagcaaaggttgcgagctgagaagaaacaacgtaaagcagaggtcaaggaacttaaaaagcagcttaaactccataggaaaattcacctgtggaattcaatccatggactccagagccccaagtctcctttaggccgacctgagagcttgctccagtctaataccctgatgctccctttgcagccctgtacctccgttatgccaatgctcagtgcagcatttgtggatgagaatttgcctgatgggactcaccttcagccaggaaccaagtttatcaaacactggaggatgaaaaatacaggaaatgtaaagtggagtgcagacacaaagctcaagttcatgtggggaaacctgactttggcttccacagaaaagaaggatgttttggttccctgcctcaaggccggccatgtgggagttgtatctgtggagttcattgccccagccttggagggaacgtatacttcccattggcgtctttctcacaaaggccagcaatttgggcctcgggtctggtgcagtatcatagtagatcctttcccctccgaagagagccctgataacattgaaaagggcatgatcagctcaagcaaaactgatgatctcacctgccagcaagaggaaacttttcttctggctaaagaagaaagacagcttggtgaagtgactgagcagacagaagggacagcagcctgcatcccacagaaggcaaaaaatgttgccagtgagagggagctctacatcccatctgtggatcttctgactgcccaggacctgctgtcctttgagctgttggatataaacattgttcaagagttggagagagtgccccacaacacccctgtgggtaagaatgtcactcatttcatcttgttcgtcttactaataggcacaaaagtaccacagcctagacactggtagtgttttattctgaggaaatggcaaggatttctcccacagtaggatagtaaagcagcaatcatggatccgtt

SEQ ID NO: 110286 - DNA, 179 bp, Homo sapiens
gggatcttatttctccagtgatatgggctttaataattcaaaatagtgtttagcttatttgtgtggtggtttaaatatatttgataactgaatattctaagaagacttgcagcatctgagatggagttgagaaatggagaagcaacactgaagaatatctcagagataactttcactta

SEQ ID NO: 110287 - DNA, 211 bp, Homo sapiens
agcccagaggctcatcaggacttgtaaacagcagacagaagagctatgaccactcaaggtaacaaccttgtgcagtctcttttttcagaagcaggtggatattcttgtattccttctgcttaaaagagcctctcacagtatgtacccatcttcagagagcagagaaggggagcctttgttccgtcttattcttgtttcttctaaaggcttt

SEQ ID NO: 110288 - DNA, 336 bp, Homo sapiens
cctatgcccatcctacaatatctgtgaagattgtgaagcagggccatatggccatgacactaaccacgtcctgctgaagttgcggagacctgttgtgggctcctctgaaccgttctgtcactcaaagtactctactcctcgtcttcctgctgctctggaacaagtcaggtaaaaccctctacatggagatgcttattctctgattgacttcttggttctggtgacagggtatgaatcacaaaactacagatagtctccttagttctgctcattttcaattgatgtgcaataatgaagacagttatccaaagttagtgaaatagaaataatagctat

SEQ ID NO: 110289 - DNA, 753 bp, Homo sapiens
cagtgccttctgaaacttctaacaaattgtcacctcctctaacacataccatattgctattattcaaggaaagactgatatcaagagaaaaatccaagttaaatgtgcaaagcctccatcaaatttgaagtcattctcaacttttatggaccagtgaaaagcaacaaaacatgttctcccttaatctttgctcattactaaacaagacacctcaggtcaattttacagcagagagtcagggtgccatggaacacagtgtgggtggatggcctctgagcaatctgctttggtagctgggtctttgtaaatggcctaaaattatgacacttcctcagtgtttgttgctgcccacacgtgcaccatgaatcaaggaacaatcacttcacatgccagagtgctggcaatgaatattaatcacaaagaaatggaacaaacagtgacggtactcaattttccgaataccattctacaaactgaagccatcctagaaattctggagagaaaacaccatggtaaccctttttcttatgttaactgacaatattcaagttattgaaagaatatataaatgcaaaaaatgagatatctattgccctaaagatttcatttgatttggcttttaaaatgagatctttaaagcattttctctttatctcagaataaaggccagttttgttcagtaacagttctaaattgaacatcctgccatccatcaatggtgtgtactacagctgcctatgctttttcctccag

SEQ ID NO: 110290 - DNA, 331 bp, Homo sapiens
gaggccaaggtgggcagattgcttgagcccaggagctccagaccagactgggccacatagcaaaacccctctcgacaaaaaaatacaaaattaaccgggcatcatggtacatgcctttagtcccagctatggggagactgagagatgggaggatcatttagcctcagaggtggaggctgtggtaagccaatcatgccactgcactccaacctgggcaacagagtgacaccctgtctggaaaaaaaaaaagaaacaaagttgcagatgccacatttggagacaataacaaccagtctaggacagagagtttaagtaaagaaactttagatta

SEQ ID NO: 110291 - DNA, 296 bp, Homo sapiens
tgggagtatatgctgggtaggtgaagaggagaaagggcatttcagtcagaaagaatgcttagtagctggaagtggttataaattaggttctgcaggatggaggtaaaagggaggctgagtctaaagggtcttctatgctatgcacagggctttgacctatatttcatggatgattgaaaaccaccaaagagtttgaaacgtaagatatgtgataagagtctgttttggaaacatttgcacagtgtcagtaaacgaaagaggctgaaaggcagtggtcaagaaagcaaaagcccaga

SEQ ID NO: 110292 - DNA, 721 bp, Homo sapiens
tccagcctgggcgacagggcgagactccatctcaaaaaaaaaaaaaaaaaaaaaaagatagaaattgggtggggaattacagaaggctgtgaacactgcatcttagatgtgggattgttcttcactgtagtgagagctaagaaaagaggcagcacttggcacccttaatcacccaaattaagcaattattctgatcccccattcgaaatgaattggtatcatgagaacaaagaggcaacatgcaattgccaaatatttggcctatattttattgtttcctttctttctccagtactggcagcagcccatgatgctaagaaatatcccgtttggttatgaagttaatgtggagattaaaagtcattccctgttctacccacaccctttttcttgtgtatagcatgtgactgagctgattggaaggcatatagcccagtggccaagcacttgggcctcagtgtgatggctgacacatgtttctgactctgtccatttctattttgttgtggacaagccttggctttctcagctgtcaaatgggggtgacaacagctctacatatagtcctgtagcaattaaatgaaagcatttagggccaggcatggtggcttatggcggtaatcccagcacttagggaggccaaggcaggacaaagtgggctcttgtctttgagccctagagtttgagaccagcctgggcaacatagtgaggccctgtctct

SEQ ID NO: 110293 - DNA, 372 bp, Homo sapiens
cagcggtcgcggactccaggagctccagacctggggtcgtggtgagattcgttgattgactgcgcgatggtggctgagttgcaaccaaatgggtttcatcaccttaaatggttttgaaccaatgaagctatattcccttaaagagacggacagcccatcgtgtgaactatagagtttgtgaacaaatttatattgggttcatagtggcatcatgcacacagactcctgcgagttcccctaagttcttagaggactgctttaccttttgatctgagagttgcaaagttccgtaaagaatggccctgtggataagcgctaagtcaagagacagcgattggacagaatttgtgaaggaattcgccgccagatcac

SEQ ID NO: 110294 - DNA, 264 bp, Homo sapiens
gcagcacgcaagggtgagccctgccccagatgtctcaccccacccttcgtgaagaacttgtaactagccttgcctatgcccatcactcatcacttttctggccagtctctaccttccagaaaaggaaaaatcagaaatctgcaggctttctcagcccctttgtggtgcagacagcatagttttttgttttttgtctttttttgagacgaggtctcactctgtcacccaggcaagtatcttggcttactgcaacctctacctccc

SEQ ID NO: 110295 - DNA, 467 bp, Homo sapiens
tcttgactgtcacagggtaaatctgtagtataaacctatgaaaagctgtcagaaaaaaaattagcatcatcaaagagactgtgataaagcccaggctttctaatactgtgagtctcaaatgtagctcataggaatagggaaaataaatgcacctttctagatgtcccgaagcttatccctttcacctagtgggagaaagacctaagaagaagaattatattggtgtagcaataaggacttcaagacaaagagtctaccatctcaccagcgctcttcagtgggtccatttaatataaatacatttggggtgggtgaaataaaactatgaatattcatagaatcctcttcttctgcccacatccccatccctattgtgtctcccactccagggggaagaagccttggtgttatgaatcaaagtgagagctgtggaagtcagagataccacatttccttgggaggcagaa

SEQ ID NO: 110296 - DNA, 728 bp, Homo sapiens
gagctttacatatatagtctgtatattatttgactatatgtatgtatgtgttagacatatatttatatggcaaatattttttacagtttatttttttaactttgtagtgtcatgtctcatggggatgttgacagtttgcaggtagtcaactttatcaatttttccctttttatgtctttttgaactataagaaactctttcgtataccagtgtcattgatataggttgattcacacatttaagccctttaaaaaatctatctgcaatttattgttaatgttgtgagatgtagatgaatctttttgtccctcccatcatctcaatcctccacacagggggtggacagttgttccagccccgtctgtagtctagtgggcgttttctcttaatttgaatgcttttatcacgtacaaatgtttttgagatgtttttttgaatttacatgttatattctatcaatttattattgtatttctttggaaataagtgattgacttatagctttataatcctcttgctatcagatagagcaaattctcttatttcttttcacaattttttggctattcttgaatattcattcttccaaatgaatttagaatcgcctcttgattctgaatgttgcatttggatttttatctgaattgcatgcaactaatagattcatgtggggaaagttatcataaaatactgattatccatctgggaacattcactccatttattca

SEQ ID NO: 110297 - DNA, 383 bp, Homo sapiens
gacctcactctcctttctcccaccagatcctgaactcctgctctcccttggctcaacctcatcacagccagaaaggatgagagctctttaatgaagtgcatacatgtcagtttcccaggacacaaaccaaagtaaagaagaatggagcatgctcctataaaggaaaataaaaggagatccataaagcaaatccaactcatggacacttactaaacatgcactgtgttcatgtaatggctccaagaatcttagtggacatggacggaagtacacacctggagtggacctacagaagctcagagtcaaatggcagaaagatgatatgggcattgaatacattaaatgaaaataaaagtaataaatcacaagagaagagagtaact

SEQ ID NO: 110298 - DNA, 645 bp, Homo sapiens
acttttgaatttcaatgaaactcctggttcaattagatccctcttcccatccttcttacccctccccagcccattctcctttccccttgctgcttctgcctctgtattcctctctctcctcctccctcctatgccttatatcctcttggcacttttacactgagacatctacaagtggatctgctgtcttcagcagtggtcattgttgtgaaactgaaggatagcaatgaatatttcatatatagcacttaaacctcttcatctagattatgcattttgcttcattgtacccatccataggcacttaataagtgcttatcgattgtctagtgagattgtattataactgattttgagacttttcataccctctgcagttactagtactatatttctttgattctaagatgtacatttttttcaaattttaactttttaaaatctaaaatcaccttgtgatcaagctgtattgtgatttaattgacagtttttttttcaatctttctttcttggtcatgcgtctcacaatcagtggtatcttagattgatgaaatgcagcagtgaaaatatatacctaagtttgtgacttgtataatatgttaaaggccatatatttggaacttcataaagtcttcttttttcctt

SEQ ID NO: 110299 - DNA, 1081 bp, Homo sapiens
agctgaaactgagtaattaaacggtcccctgaagccaagtattccctggttagtcgccaccccaccactccttcctgtctctagtgtcacacttgggctgttgattttcttactcttctcttgctttaatccttccccccggctctctggctcctgtggatatctgtgcttgtttcctggtccaggatggtgatctgactttcaaaccagcttctcaaaaggggtgacataaaatcagttttgatgtttttcctcctgaaaaatcagatgaatattttagtcactgttactcatgcacattgtgttcttatgtttacagaagtgcttaagtgaatggaagcactagacatttggatttccttcctaacgtaatttttaatgattaccccttttatacagtaatttgtggtctttagaaagcagttaaactaattgaccatctaatagttgtactatacatatgtctaaaataatagtcatggtaagtttggcatcatatcttccccaaaaaatgtttattaaaattagattattccagtttaatgctattttgtgaactgtataccctctgaaagcgcttatttttacatgctacacaacagttccaattttaaggagtgtctcctaaaattgggatgaaaatctactgtagtctgttttaaagtatgctatactatgttcattggttacttaactggatattaatataaaggttattacaagaaaaatgatgaagagcaaaaggagaagaaaatatttgcaagtgaatccacaattcttgcagaactatttgagttgatactaaagattttatgttcactcctttaccttagaactgtcaagcttgggaatgaggaaagtgccttggctgtgcttgaaacctgaattttagtgcttcccttattacattcattgttttcaatgattgatttataaaattaagacatactggtagtacaagttgaaagttggtttgaatacattttaattaaatgataatatgttaatatgcttttgttcattgctttctcactgaggtaaaacagcattaaaaagttgtccagaatttaaactgactcta

SEQ ID NO: 110300 - DNA, 445 bp, Homo sapiens
atggggctgcaggggatacctggacattagtggttgcatatatggagatgaggcaacctcacctcaaagtcatgattctcagaccaggtgccagagcagagacagggaagagtgtatgcctgaacacaaccttcttcaagactctgagcagcactgtctcactctcaggcagtgatttgtgtctctgtgcacctcaaaaactttctgcaatctaagtttgtttcttcagccccctggatggcagacaggtttatgggtgtgtggctggagcagatatccttgaagaggagaggaggggagagctgtagctcttagagaggggaggggtggggaaagggtgattccagcaaaacatccacttcccattctcctgcctcactgccttctattaaggcagagtctggaaacagtcctggtaccaaagagatgcacctggctgtagaaa

SEQ ID NO: 110301 - DNA, 688 bp, Homo sapiens
tgccaggaggccttcatccttccagatgggcaccatttgttgggtctttttccgtggtatgaagaaaatgaagcaatgattagaaattggtccctcggccgggcacaatggctcatgcctgtaatcccatcactttggcaggccgaggcgggtggatcacctgaggtcaggagtttgagaccagcctgaccaatgtggtgaaaccccatctctactaaaaatacaaaaattagctgggtgtgatggtgcacacctgtaatccagctactcgggaggctgagacaggagaattgcttgaacctgggaggcagaggttgcagtgagccaagatcaccccactgcattccaggttgggcaacagagcaagactctgtctcaaaaaaaaaagaagaaagaaagaaattgatccctcataataggctgtatagcagattctactgcaaaggctatggttgcacaacagacttctttgaatttgcttgctaaacttttactggataatactgggattacaggtgtgagccactgtgcccagcctctcctgtttaactgtattcattctaatgtttacttacttctttaatttgtaaaattgggtcacttagagttttttagcctatcttgccatttagccactgttactgataatttggatggaaaagaaaaataaattatatcacctctcatc

SEQ ID NO: 110302 - DNA, 727 bp, Homo sapiens
  misc_feature (628)..(628): n is a, c, g, or t
gtgtcatttcttaaccatctatgattacactgaaatatgaacaggtggcttgaacgttatttaggaagtgtgatgagtccgtaaggtctgtcatgtgggcatctcgattcacatcctggagctgtggcctgtgcctcagacacagttgcctgaatgagccatgatctgctcattagcacaccctccacagccattgggtcaatagcacttactttgttcagtttctactctctgcttattaaggatatgtaattttgatttgtgaggttgtgcccatgagtcctttctccattccagttgctgtcagcttaacctggggctcttggcacctctgtgttggacttttgcatcgctctccctgtggattctctcccagctctcccttcctccatatgctttgcagggtgatctttctgaaatgcagatctgattgggatactttgtcgcttaaaacctttgaaagccagcccctgctcccttgccttcaagccacctctgtgtccttagaagagtgtagcaatgaggatgaccagaggtcgctctcgttgccattttggttttggcaggttttgtctgactcctttactgcaacctgttttatcagcaaggtctttatgacctgtatttngtgctaatctcctatctcatcctgtgacttagaatgccttaacttgctgggttgcagcccagtaggtttcagcctcattttttacccagttcctattta

SEQ ID NO: 110303 - DNA, 779 bp, Homo sapiens
gttggtttgtcatcttcataccaaaatctactttatttgcacatcagtcataaaggtgttttacccatttggcttatttgtgtgtttaaaattaaaactcaagccattttccctctccagaaaatgtgacttgtgtagtatgacatcttactggagttgggggaaggcttggtgggcacctgaataaacatcgatctggggaagatgcacctggagggctgcctggacaagtccctgacgctactagattgcctactttcaaaggactaggaaacattttttcagctttaaaagatttaaaagccggtgatatttcagaatagtgctgaaagagccctgctgttgaatgaacattgggagcaccgcatgtgggttgtggcaaaccctttatcccatgaggccctctcttctccatgcctctaagttctacagaccatcagtgccgcccctgaaatgtcctgtcttaaatagaatgccttgaaccatacctctgcatcaaaaatgtggagccgggggagctccaaggactggggattctctgtgccttcaaaatgacaagttagaagtactaaggtaaaagcagaaaagcatctgtgagggactaacttcaggtggtgcctctgacaacacagagcagtcaagttactactgtgcatttaacagggcacaccttttagctctgaaagaaccttaactttttcagtgcttctttaccagcactgtcaccactggtctttacagcgttcttaggaaagcgccgcaaagggatcctctgttca

SEQ ID NO: 110304 - DNA, 259 bp, Homo sapiens
ctgcttgatactggagaggtgagtttctggtcactttcccaggtgtgagtgaggtgagaattctttcagtttatctagctgggggaatgtagtgagcatagctaaagtcacagggcaccacctctccagaagtacaggccatggtgcagagataacgctgtgcatatcagcatccatgccactcacggtcaaatagcagttttctgcaaaacttagtgagggctggtgtttggaagtggagttgagtaattgcagtacc

SEQ ID NO: 110305 - DNA, 787 bp, Homo sapiens
cacagtttcattctttttgaatgaagcagtgtcggtcgggtttatcgcttctcgatctttgaaaagctttatttgggttctgagaaaccactcttcctagttcttgtcttggttcatggtttcacctttcccagatcctttgctggtatctgttcctcactaccataactaaatacagtcatgcatcgatggtgataccttctgagaaataccttgttagccaatttcagcattttgcaaatatcttctagtgtacttacacaaacgtagatgtatgggctactatacacctaggctacaattgtatagtagactgtacacctaagctatagtaggctatacatctaggtttgtgtaagtacactaaatggtgtttgcataatgatgaaaatgcatttgttgcttctaggctaccaacctgcatagcatgttactgtactgaatactgtaggcaattgtaacacaatgctaagtatttgtgtatgtaaacatagaaaaggtaatgtcttgtgcttgaatgttgtgacaactacaacgttgttagacaataggaatttttcagctctgctaccagatcaccattgtatatgtgattcattgttgatgatccaggactgtattggtattgctgggttagtccataaacctcttcactctgatgtctttaatatcacctataatgatgattcacaaatgttaatctctggctaagacctctcccaagaaaacagattttaagaaaaaacacctgcacttataagttaataaacatctcaaaccaaatata

SEQ ID NO: 110306 - DNA, 419 bp, Homo sapiens
ttggatcagggatgattaaaactgaaagagggaaaccagctagtaggctataatgatcactgcagcagttcaggttgggattactaaggcaatggcagtgggaatggagaggagagaattaattcaagaaatgagaaatggaatggaggcaagtatacagagggagtgcacattttaagtcagatagactaaagttcacaccccacttcttagctatagaacaggtcattcaaccctctctgagacttgaggttaaaatctcatctttaaaatggaaatgataatacctaccttgcggagttgtgataattatacaatatctataaagtgcacattagggccccacgcagagtagctagactgttcaactatagctatgaagatgataacaatgatagcatgacgtctggtttggataa

SEQ ID NO: 110307 - DNA, 731 bp, Homo sapiens
ttggaactgtccgctgctctctggtctctggatatgaggcaggagggcttggggacaactgtggggacatggcccagatgatctgatcctggcagtagtgactgttggggaccagccattacagcagcagatcatcagactccaccaagagcttgggagacagaagtctctgtgggctgatgttcatggaaaactccggagtcatatagatgctttgagggagcagaacatggagctccgagaaaagctgagagctctgcagctgcagcggtggaaagccaggaagaaatctgcagcgtccccacacgcggggcaagaatcgcacactctggcattggaacctgcttttggaaaaatttcacctctgtcagctgatgaagagacaatacccaaatacgctggccacaagaatcagagtgccactctcctgggacaaagatcgtcatctaacaattcagctcctccaaagccaatgagtttaaagatagaaagaattagctcgtggaaaacaccaccacaggaaaatagagataaaaatctttccaggagacgtcaagacagaagagcaacacctactggaaggccaactccctgtgcagagagacgggggggtgtctgaagatggaaaggtggcctcggacacctgtgtcactctacactggccccttggaaaattcagattcagataaagttccacttaggtctaataaaagtactcaatttgttattca

SEQ ID NO: 110308 - DNA, 1183 bp, Homo sapiens
ttggaactgtccgctgctctctggtctctggatatgaggcaggagggcttggggacaactgtggggacatggcccagatgatctgatcctggcagtagtgactgttggggaccaggatgctggcaggtcaactcgaggccaggaccccaaagagggcacccacccagaggacccgtgcccaggagctggggctgtcatggagaagacagctgtggcagccgaggttctcacggaggactgcaacactggggagatgccaccattacagcagcagatcatcagactccaccaagagcttgggagacagaagtctctgtgggctgatgttcatggaaaactccggagtcatatagatgctttgagggagcagaacatggagctccgagaaaagctgagagctctgcagctgcagcggtggaaagccaggaagaaatctgcagcgtccccacacgcggggcaagaatcgcacactctggcattggaacctgcttttggaaaaatttcacctctgtcagctgatgaagagacaatacccaaatacgctggccacaagaatcagagtgccactctcctgggacaaagatcgtcatctaacaattcagctcctccaaagccaatgagtttaaagatagaaagaattagctcgtggaaaacaccaccacaggaaaatagagataaaaatctttccaggagacgtcaagacagaagagcaacacctactggaaggccaactccctgtgcagagagacgggggggtgtctgaagatggaaaggtggcctcggacacctgtgtcactctacactggccccttggaaaattcagattcagataaagttccacttaggtctaataaaagtactcaatttgttattcaaaatagacctagtaatttattaaactaattatgtttctatagataaaaacttgaagttcttcagacatgtctctaatgctataaaagcaaacaacttggattgggttttataaatcagttgctttcctgagctctgtagttggtatatttctgcagagtctttaaaaaaattaacccaccttgtagtatggagtgtcgggctgttgggtgagccctggggtcttgctggaaatcgaggatggctgaagatggctttgtgctcccagcctttgggctcaaggcattgcccgctccagggaccttgtgac

SEQ ID NO: 110309 - DNA, 1039 bp, Homo sapiens
ttggaactgtccgctgctctctggtctctggatatgaggcaggagggcttggggacaactgtggggacatggcccagatgatctgatcctggcagtagtgactgttggggaccagccattacagcagcagatcatcagactccaccaagagcttgggagacagaagtctctgtgggctgatgttcatggaaaactccggagtcatatagatgctttgagggagcagaacatggagctccgagaaaagctgagagctctgcagctgcagcggtggaaagccaggaagaaatctgcagcgtccccacacgcggggcaagaatcgcacactctggcattggaacctgcttttggaaaaatttcacctctgtcagctgatgaagagacaatacccaaatacgctggccacaagaatcagagtgccactctcctgggacaaagatcgtcatctaacaattcagctcctccaaagccaatgagtttaaagatagaaagaattagctcgtggaaaacaccaccacaggaaaatagagataaaaatctttccaggagacgtcaagacagaagagcaacacctactggaaggccaactccctgtgcagagagacgggggggtgtctgaagatggaaaggtggcctcggacacctgtgtcactctacactggccccttggaaaattcagattcagataaagttccacttaggtctaataaaagtactcaatttgttattcaaaatagacctagtaatttattaaactaattatgtttctatagataaaaacttgaagttcttcagacatgtctctaatgctataaaagcaaacaacttggattgggttttataaatcagttgctttcctgagctctgtagttggtatatttctgcagagtctttaaaaaaattaacccaccttgtagtatggagtgtcgggctgttgggtgagccctggggtcttgctggaaatcgaggatggctgaagatggctttgtgctcccagcctttgggctcaaggcattgcccgctccagggaccttgtgac

SEQ ID NO: 110310 - DNA, 238 bp, Homo sapiens
gagacagaagtctctgtgggctgatgttcatggaaaactccggagtcatatagatgctttgagggagcagaacatggagctccgagaaaagctgagagctctgcagctgcagcggtggaaagccaggaagaaatctgcagcgtccccacacgcggggcaagaatcgcacactctggtaccaaaagcgcatttatgtttttgtaccgtttgcgttatgtaaaaatagcgtccccataaa

SEQ ID NO: 110311 - DNA, 875 bp, Homo sapiens
ttggaactgtccgctgctctctggtctctggatatgaggcaggagggcttggggacaactgtggggacatggcccagatgatctgatcctggcagtagtgactgttggggaccaggatgctggcaggtcaactcgaggccaggaccccaaagagggcacccacccagaggacccgtgcccaggagctggggctgtcatggagaagacagctgtggcagccgaggttctcacggaggactgcaacactggggagatgccaccattacagcagcagatcatcagactccaccaagagcttgggagacagaagtctctgtgggctgatgttcatggaaaactccggagtcatatagatgctttgagggagcagaacatggagctccgagaaaagctgagagctctgcagctgcagcggtggaaagccaggaagaaatctgcagcgtccccacacgcggggcaagaatcgcacactctggcattggaacctgcttttggaaaaatttcacctctgtcagctgatgaagagacaatacccaaatacgctggccacaagaatcagagtgccactctcctgggacaaagatcgtcatctaacaattcagctcctccaaagccaatgagtttaaagatagaaagaattagctcgtggaaaacaccaccacaggaaaatagagataaaaatctttccaggagacgtcaagacagaagagcaacacctactggaaggccaactccctgtgcagagagacgggggggtgtctgaagatggaaaggtggcctcggacacctgtgtcactctacactggccccttggaaaattcagattcagataaagttccacttaggtctaataaaagtactcaatttgttattca

SEQ ID NO: 110312 - DNA, 1434 bp, Homo sapiens
ttggaactgtccgctgctctctggtctctggatatgaggcaggagggcttggggacaactgtggggacatggcccagatgatctgatcctggcagtagtgactgttggggaccaggatgctggcaggtcaactcgaggccaggaccccaaagagggcacccacccagaggacccgtgcccaggagctggggctgtcatggagaagacagctgtggcagccgaggttctcacggaggactgcaacactggggagatgccaccattacagcagcagatcatcagactccaccaagagcttgggagacagaagtctctgtgggctgatgttcatggaaaactccggagtcatatagatgctttgagggagcagaacatggagctccgagaaaagctgagagctctgcagctgcagcggtggaaagccaggaagaaatctgcagcgtccccacacgcggggcaagaatcgcacactctggcattggaacctgcttttggaaaaatttcacctctgtcagctgatgaagagacaatacccaaatacgctggccacaagaatcagagtgccactctcctgggacaaagatcgtcatctaacaattcagctcctccaaagctcctctttagaacattctcccagccagtgtgtctcttcctgtcccagctttgtgtcaccctcatactcaggaagcaaatctcgtgagtccacagccagcaactgatactgggttgatgtggatggagaaggcgcccccaactcctgaagatgatttatcccctcgcattctttcccaaagcaactgctgagcagataacactttattccctgaaggaagatcagaaatctactccaagcatttgtcacaaccaatgagtttaaagatagaaagaattagctcgtggaaaacaccaccacaggaaaatagagataaaaatctttccaggagacgtcaagacagaagagcaacacctactggaaggccaactccctgtgcagagagacgggggggtgtctgaagatggaaaggtggcctcggacacctgtgtcactctacactggccccttggaaaattcagattcagataaagttccacttaggtctaataaaagtactcaatttgttattcaaaatagacctagtaatttattaaactaattatgtttctatagataaaaacttgaagttcttcagacatgtctctaatgctataaaagcaaacaacttggattgggttttataaatcagttgctttcctgagctctgtagttggtatatttctgcagagtctttaaaaaaattaacccaccttgtagtatggagtgtcgggctgttgggtgagccctggggtcttgctggaaatcgaggatggctgaagatggctttgtgctcccagcctttgggctcaaggcattgcccgctccagggaccttgtgac

SEQ ID NO: 110313 - DNA, 665 bp, Homo sapiens
gaaaaaatatttgcatatcaccacatatctgacaaaggacttttatctagaaaaataaagaactcaaaactcaacaacaaaatatccaaataaccccctggtcaaacgggcaaatgacagcaagagtaagtggatatacggatggcaaataagcacatacaataatgttcaacatcattagccattacagcattacaaattagtaccacaatgagatattactatacacctatcacgacagctaaaataaaaaatagtgacaatgcaaaattgtggagaacctggatcactcatagattagtcgtgggatgtataatggtacagtcactatggaaaacaaattgatcgttctctaaacaaacaaacaaacaaagttaaacatacaactaccacaaaagccagtaattgcactgttgggcatttatcccagggaaatgacaagttatattcacacaaaaacctgcacatgttatagcacctttatttgtaataaccccaaactagaaacaacctagacgtctgtccttcaagagggaatgcttaaacgaactatggtacaaccataccatgaaatactaattagcaatgaaaagaaacaagctattaaaaacctgtaagaataggccgggcgcggtgactcacgcctgtaattcagcactttggga

SEQ ID NO: 110314 - DNA, 420 bp, Homo sapiens
cattcatttaagaaatatagattgagaatctatatttgtgcaaggtagtgtactaggtactgaggctatatctgtaaacagaaattcttacttttttgatgtttagattctgagtaaattatatgttagaaaacaattaatgagatggggaaaaatacagagcaagataagatcaggagtggtaggttgcaattttaactggaatagtgagaatactcattgaaaagttgagatttaagcaaagacatgaaggatatgaggatgtaaactgtatagatgtctgaggaagagcctctaggccaagggaacagtcaatgcaatggctctaaggtgtgagcatgcctgatgtgttgaagaacagtaaggaggtcagtgtggatgtatcagagtgattgagtagaacagtaggagatgaggtca

SEQ ID NO: 110315 - DNA, 232 bp, Homo sapiens
acagcaatggaagccacaaggcaagcaaaacgcacatattcaaagggcagtaaaatagcatctacatggaattacccaccttcaaaagtcatgggcgaggctgggcgcggtggctcatgcctgtaatcccagcactttgggaggccgaggcgggcggatcacctgaggtcgggagttcgagatcagcctgaccaacatggtgaaaccctgtctctactaaaaatacaaaatt

SEQ ID NO: 110316 - DNA, 489 bp, Homo sapiens
tatgctcagtatctttatctttctggaatttagacctataatattctaacattcttggaatgtgagccatctaccactggtttctcttctagtagtagttttaatttataataaatttttgagggatatgatccaaagaaacttacaggcattatccatcttaattgtcccaagtgtgtgtgtttaacagcttgttgagatataattggcaaactgcacactgcccatatttagaagatacaatttgataagttttcatctattttgacacctgtgaaaccatcgctgcagtcaagctgacagaccttctcccccagtggtgccccagcaccccttagcagtgcctcccttcaccttttctctttctgctgttaatcagcagttgatctggctggtttcctgttggctgcaaagcagcttcagatgaaggttgctttctgtggtgtgggctgccgtgggtcccctctcagactcagcctcttagtatgg

SEQ ID NO: 110317 - DNA, 491 bp, Homo sapiens
aaatactagtgggttttaaaaatacatagtctttttgttctgttttgttttggggaaaaaatggtaagctccttagtttatatgtttaactgggattcttcttccaattttcatttggctttttgcattttgatcatttctgttacacactggcatagtaaaaagccagccagctaatctgttcattgcattttgtggtagcaaggctctgaatattggatatgaacgtttgacggactgaaattaggctttgcattatctgtaattttaagtattcttcctttttataaaaccacatatttctatcccctcaatgtaaacattttgattagatgtgaaagttacatttatttaacacaaactgggtatttaaaagcatttaggtgtgtttgaattcagagaggatttgtgcaaattacaaatttcatatgtttacaaggaaatgctcacctgctaagtacaatgtaaatattccaaacatccggcgaaag

SEQ ID NO: 110318 - DNA, 337 bp, Homo sapiens
ggagacgtcgcctcagggagttgtttcctggtggatttagagccaagcaggcacctagttcctgtgaagtccatactgtgattaagaggtggtctgtacccatcccatgtggggtgtaagggtcagtggtacaagtcaaattggttatatcctagctgtcccacagggaggtggtcacccagaatgcagtcgtgtaagaaatatatgtgagttgaccacatggaggaaatgggaggaggtggagaactagaaactgttaagtttgaataaagtttttttccgttatgagaaagttaaatccataaagaaaatgcatgctaaggtaacatataactat

SEQ ID NO: 110319 - DNA, 419 bp, Homo sapiens
tccacatcagagacttcattttgttgataaaccctatgaatgtaaggaatgtgggaaggcgttcagagtgcgccaacagcttacttttcatcacagaattcatactggtgaaaaaccgtatgaatgtaaggaatgtgggatggccttcagacagactgcacaccttactcgacatcagagacttcattctggtgaaaaactctatgaatgtaaggaatgtggggaagctttcatatgtggtgcagatcttagagtacatcagaaaatgcatattggtgagaagccctatgaatgtaaagaatgtgggaaggcttttagggtacgaggacaacttactctgcatcagaggattcatactggtgagaaaccctatgtgtgtaaagagtgtggaaaagcctttagacagtacgcacacctga

SEQ ID NO: 110320 - DNA, 321 bp, Homo sapiens
gctgagcaggcacatcagccggagcctttgttctctcttaatagccatgactgatttctgctaactttagctgcctcagctgcctctgtgtcaattagagctgcaccttttccatagctcactgggtagcacgttgagcaaccatctcttggggtagggcccttctgcaattggctcttagcctttttatgttgattttaccaatttcactgtaagagtgaccttttcctgactggatctcagctatgttataaccatgtgtgttacggccagccagcttacttctgatgggatgacctggttaactgctctgtgccagcc

SEQ ID NO: 110321 - DNA, 720 bp, Homo sapiens
cagcatgattatttttccatggcttctaatttatgtgcttgtcttggagccacgaactttctaatggtctgttaattagtctacttgttgttgacctttatggtgaaagttgtcaaaacaaaatgagtaacagtgtagcactttagaatagctctttactctgttaattctttctataagttcttttaaatttacagtttcatctcaatagtttacaatgcattataattggaaaagtctgattagtattgaattcagttgctgagtggaggggaccacactcttgtcttctactcttaagtgcttagtaattaggagttggaaggaaaacagtatatgaccctgttgttaaattagtaaacttttaattctagggtaaggttagctgctcatcattatctctgtttgctttactttacataaaggtaccataattcgaatcctctaaaatccattaaatgcaatttatccattaaatgtaatccattaaatgcaatttatctattgaatcttcatgcaagtttgaaacttaagtgttttaacattctcctgtcaagatgaagaaaatattttgacaattttctgtccaaatgttttacagtttatgtggtaagaattctcccctcccccaactaaggattttccttcttttaccactagtgtattatcatttaggggtggaatctggcaaacgagtctggaataaaggttgcttttaaa

SEQ ID NO: 110322 - DNA, 162 bp, Homo sapiens
ccccatgttgtttcctctgcctagaacactcttaaccacccttcatctgcctacatctacccaactctctggtttagattaaatgtcacttcctccagaaggctttctttgactccctaacttgggaaggcactcctactacatgttcccatagcacccaat

SEQ ID NO: 110323 - DNA, 274 bp, Homo sapiens
ctctggtaacacagtggcttaatcatataactttatagcaagtcttgattttaagtaggctgagtcctccaactttgttcttttttattactttcactattctagttcctttgcattttcatataaattttacaatcaactttccaatttctataaaaattgttgggattttgattggagttacatttaatatgtatatcaatttagaaagaactgataacttcaacattattgaattatctaatccatgaacatgggctatctcatcctttag

SEQ ID NO: 110324 - DNA, 439 bp, Homo sapiens
aattaaaattaataaaatgtgtcccaccggctagcttcatgactgtgtttcagatgactgtgcactttctagaaaacattttgcctttttgttcaaacagtatcctcaaagatgacttcctactatctgcatcagccttgtttatttccagctgtcacatgctccctccaagaacaaagcttggccacccctgagaatgttacaaagaatgagccaaggctccaaaggagagggctctaagagagacactctggaatgttcagagctgtggcaactatcttgttgcatgtgtgtgtagttttcccaggaaactgcttggaggataactactgccatttggatgcactccttggctacgtgggttttaattaggtgtgcggctttagggtgacacccatactaatgcctgtaggacttatgtagttaagtgttttctttc

SEQ ID NO: 110325 - DNA, 211 bp, Homo sapiens
ggaggaggatcacttaaggccaggagttcaagaccagcctgggcaacacagtgatgtcctgtctctacaaaagaatgaaaaattagcctaatgtggtggcatgcacctatagttctactgtagtctcagctacttgggaggctgaagtgggaaggatcacctgagtcctggagttggatgctgtagtgagctatgattgtgccactgcact

SEQ ID NO: 110326 - DNA, 489 bp, Homo sapiens
ttctatgttcggcacgagcacagggtttcagcatgttggccagactggtcttgaactcctgacccatctagagtaagttaggtgctctttccatgtggtctaggatctcgtacttactcaacacaccgaattgtaaatgcttgtttatgtgtatcagcactgcttaccacctccacctaaggggagggcagggaatgtctcgttttcctcttttaattcctgaggcttagcacaaggcctgttatatgggaagtgtttattaaaatttggagtgaataaaatggatagtaaaggtgctgttttgttggttagcagtggtaggatctaataacgtacccaatacactttgtactaaattttcaatattcgttgcagagtttttaagtttttcttattaaatttatagtatttgtctaacaggtatcaaaaaccactttgaaggccaggcatggtggctgacgcctgtaatcccagcactttgggaggccg

SEQ ID NO: 110327 - DNA, 456 bp, Homo sapiens
atcatattgagacttacattttcatagataaaaataaagaaactactgttaaagaataaaaacaaaacagaaatacagcatagtatacctgcatgtcaaggacccaaacaagattcaaacatacaatttgtgtaagcaaatttccaaataggcacacacacaagaataaacttatcagaatgaataggcaaaaaagagaagaagagcagaaatgccttatcttgaaaataattcacccaaatacattgatacaatgtctgagatttcttaaagtagtccaggggaagtgagtagtagagaaagagagaaaaatgagattggccatgagttaataattgactaacctgggtgatgtacacatatggttcattatactcttctctctacttttgtgtatattggaaaatatctataaaaatatttttaaaatactaaataaatataatgtctaaagag

SEQ ID NO: 110328 - DNA, 401 bp, Homo sapiens
aaccatgttcacatacagcttgcggggttgtgactctgctggctgcactgaacttggctgtcttagcttctccattgccagcagggccactgggaatcttctcagacttactttacccgtttttaatcctcccataatcctctcagcaccactgtctgcaccactgtgggcactcgttttgaagcattcttttccaaatacagtcttgcccatcggtttatatagtgcatttagtgcctgttctgtaccagacgctatgctagatactgaggttaaagatatgagccccttgttcccaaggagcccacggtcctcttttttcctcagaaataaggtcacttagggcaggaatcaattctaccaatttatatcacctcgtgccgaatcctgcagcccggggg

SEQ ID NO: 110329 - DNA, 258 bp, Homo sapiens
atgtggttcaggtttgttttttgttttattttgtttttgagacagggtctcactctgttgcccaggctggagtgcagaggcgtggcgcgatctcagcttactgtagcctttacctccagggctcatgcaattctcccagttctgcctcacaagtatctggaactacaggtacatgccaccatgctgggctgatttttctgtatttgtagagaagagatttcaccacgttgccagggctagtctcaaactcctgagctc

SEQ ID NO: 110330 - DNA, 338 bp, Homo sapiens
aagcacccagaaaaatattaaatcagaatagtaatcaatgatatctttgttttgctcttgactttaatgagcatgtgccagtatttcccactaagcatgatcctggctttggggtagtgaatagatagacagacaaacagatatcttaagaaattactcatctgggccagatgcagtggctcacgcctgtaatctcagcactttgggaggccaaggcaggcagatcactgaaggccagtagtttgagaccagcctggcgaacatggagaaaccccatctctactaaaaatacaaaaattagccaggtgtggtggtgggtgcctgtaatcccagctatt

SEQ ID NO: 110331 - DNA, 343 bp, Homo sapiens
gtatctatcaccagatgctcttgtatctagtacctgcttggcatacagtagatagaaagctttgctgagtgaatagctctgcctttcgtcttttttgatatgtgtacatcttttaaaaaataatgaatagactttgttttagagctgttttgatttacagcaaaactaagcagaaagaaaatatccccttccacaaacatcctggactgtacagcctcccctaccatcaacatcctgcattactgtggaatatttgtcacacctgataaaccaacatagattcatggttacaaaaatgaaccaatatggataaaacatatacattatcagccaaagtccggag

SEQ ID NO: 110332 - DNA, 320 bp, Homo sapiens
ttgatattctccagttgcatcagaagtcttgctgctcttccagcacaccaagattgatgctgcctcagggcctttgcaccagctccttcttctgcctggacactctcgccctggttctgcgcatggctcctttctcctttttgtttggattgctgctcaaattgtgcctccacatggaggctttctaagtgatccagacctacaggctcaggcacactctatcccctcactctgttttcttcttcataatatttacaaccatctgaaatatgtaatgtttacatagccgtttgcttaatacctgtaagattccaccaact

SEQ ID NO: 110333 - DNA, 689 bp, Homo sapiens
cgcggtggctcacgcctgtaatcccagcactttgggaggttgaggcgggtggatcataaggtcaggagttcaagaccagcctggccaagatggtgaaaccctgtctctactaaaagtacaaaaattacagtgtgcctgtaatcccagctacttgggaggctgaggcaggagaatcacttgaacctagtggggcggaggttgcagtgagccgagatcatgccactgcactccagcctgggcgacagagcaagactccgtctcaaaaaaaaaaataaaactgttttaactttaagatgttttatgtaatctccatttttcatgaccattatgaaaatatttatagaatgtatgaaaaacattttaaaaataaagtatgtcactacacaattaaaatttaaattgaagaaaacagaagaaaaaacatctacaggaaacacataaaacaataataataaaatgataatagtagcttcatttatttaaacaatcattttaaatataaattaactaaactacttaataagaagaaatgtaatcccaatattttgggaggccaaggtgggctgaacacttgatcctaggattacaagaccagcctaggcaacataacaaaaccctgtctctacaaaaaatacaaaaaatctagctgggtgtgatggcacttacttgtagtagagatacttgagagg

SEQ ID NO: 110334 - DNA, 169 bp, Homo sapiens
atcattgcataatgatgaagaggtcaatccaccaagaagacagcaatcctaggtatatgtgcatcaaacagagctgtaaatgtgaaggaaaaaaactgatgaaactaaaaggagaaataggtaaatacacaattatagttggtgattttaacatctctccttcaacaat

SEQ ID NO: 110335 - DNA, 366 bp, Homo sapiens
tattgctctatgcattcgcaaacatatacccatttcctatacaaagaaaatatgaacatctcccatgtgcaggaatatgtagttttattaagctttgctctgttgagctttacagatactgtgcttttttaaaaattgaagctttgttggcaactctgcattaaacaagtctattgacaccatttttccagcagcacgtgctcacctaatgtctctgcgtcacattttggtaattcttacaatacttcaagctttttctttattatatctgttatgttgatctgtaattggtgatctttgatgttactattgtaattgttttgggccacaagccatgcccatataagatgggaaacttaatagata

SEQ ID NO: 110336 - DNA, 480 bp, Homo sapiens
agtaccaaaactggaatgatgcagagaagattagcatggttcctgtgtaaggatgacattcaaagtcgtgaaatagtccatatgttagaaaataagaacaaagtacaatgaataaagaatcccattcacaataggaataaaagtataaaacaaaggcataaactcaacaaaaaggaaggaaggaatgaagggagagaagaagagaggaagggagggaaggcataaacaaaggtataaactcaacaaaaaggaaaggaggagaggagagcagggaaggagggagaaaggaaatagcaaacttcaggggaagagcccaaataaaaggaagagaggacatggagaactggagagacagccaggacctggatggaaagagttggcaaagatgtcagtattcttcggggaggtgcagggagagctccccactgtctataccacaggcacccagggaggacccaggagagctgccatccccaaacc

SEQ ID NO: 110337 - DNA, 199 bp, Homo sapiens
actcggtaccccctgggcaacacagtgatgccttgtctcaaaaacaaaaaaattaaaaaaaaaccaacaaaacagctggactacgttaggcaacacggtgaaactccgtctgcacaagaagtgcaagaattggccaggcatggtggtgcatgcctgtagttccagctatttgggaggctgaggcagaaggatcatttga

SEQ ID NO: 110338 - DNA, 211 bp, Homo sapiens
cgctcccccttccccctccgcgggggcgcctcccccggcccccgtggctgcttctcatcgaccccaaaacatgcttgagtcatacaagcttgataatattaaatatttagcagggtctatatttacgtgcctaacagtagctctgggattttatcacctgtggatctaataaagtgtctatttaaagagggggggaaaaggatttaccatt

SEQ ID NO: 110339 - DNA, 351 bp, Homo sapiens
attttccgtcagttctttgtcatagtaaatgcttctcaaggtaataaggcaatatcagcttattgtcatttttctctttcactctgtgtatatgtgtgtgtgcgtgcacgcgtgtgcacacacaatgttgccattcagtttagccaacaggtcattaaattcaagctgtacatcaaacagtgcatataatgtggtatgctgccaggctaactattcaatccaatgcataaaggaattgactactgttttctctgctgcagcccagatactgcatccttaaggccaatgtgcaagcagaaaatgagtgattgactggccgatctcattgagaggtttttggtttatttaagg

SEQ ID NO: 110340 - DNA, 441 bp, Homo sapiens
ttcttatacatcattaccccatcatccagcttcaaaatattggtgttttgtacttcccttttccctttactttcctaccatatcccttcccatcccagcctaaccatatccagtcacaaagttctaggcatagtccctaataatgtcgtgtccctgtatctcaagatacgtccctgtatttttttaatcttctggcttatatgttaatttttataatgggccttaaccctaccctctgctctattcaagatcaaagcatatctcagtggtcagttgaaggcaaattcctggcttccttctttgccaaaaattaccctacctcaaactctctaagattaattgctctcaaaagcctctgttgtgaaaaatctactgagaattcctggtggaccctcaatcctctcttggcagtcccaagctctagtgtcttcaagggcaaca

SEQ ID NO: 110341 - DNA, 585 bp, Homo sapiens
ctggagtctgtgctgaagttcattttcagaaagaatgcctggaaaataaattttttttttcccccctgagatggagtgtcgctctgttgcccaggctggagtgccgtggcgcaatcttggctcactgcaacctctgcctcccgggttcaagtgattcttctgcctcagccccctgagtagctgggactataggcgcatgccaccacgcacagctaattttgttgtgtttttcgtagagacgggggttcaccatgttggctaggatggtctccatctcttgaccttgtgatccgctcgcctcagcctcgcaaagtgctgggattacaggcatgagccaccacgcccagccaataattttttttaaattgtgtgtttgaatttcccattttagccttcacttaatggatgagttggctgtaaaaatctagcttcaaaatagtttttctcagttttaaaggcatcacttcattttttaaaaaaaatcatttagtgttacaattagaaataagcccatctgtttcttgtaagttggtaagtactgctgaggggaatttccctccctcccttcttgccaccttgccgagg

SEQ ID NO: 110342 - DNA, 416 bp, Homo sapiens
gatgtttggctaggatataaaataaggcttcagaatataaaatatcctgcagattgagaagttttaaaagtagttacatacaagttttatttttccaacgttcctgccttttctaatgtctaaggatgaagcagtgtacagagaggaaagaatgttatatgtgtggtctgcttgcaagtgctggatgcctcctctgcctgctccaactaaactgtctgcttatgagaaagtcattgctcctctgagttcctgcctccctatatattcaacattagaattttgccaggttatcttttagggtcgttcaactctaacatatatatgagtctgtgacactgaactcagacacttcagaacaggaaccctggatttctctggatgtggaaatctttaaatctatacctgactggtaggac

SEQ ID NO: 110343 - DNA, 287 bp, Homo sapiens
ttatcctggacatttccttccctgaatctgccattactccagagcgcccaatttccttttattagaaaatggggttgggcatggtagctcacgcctgtaatcccagcactttgggaggccaaggtgggcggatcacttaaggtcaggagtttgggactagcctggccaacatggggaaactccgtctctactaaaaatataaaaattagctgggcatgtggtgacgcacacctgtaattccagttactcaggaggctgaggcaggagaatcacttgaacccgggaga

SEQ ID NO: 110344 - DNA, 306 bp, Homo sapiens
gttggggagatacatgcctcatctatcatagagaggagtcaatagctactacttcatattgatgaatcaagaaatgcaaatataagcatattatttgagttatgaacaaaaccaccaccaatgctttctcccctcaagaaagttgagtgaagaacaggactagcaatggaggtgaagaggaagacttatgttttatttcatacctttctgtactattttaatgatttttccccaggcgcatgtacttaatattcttttctttcttttaactttaaaagaagtcaggattcagagacagcactccag

SEQ ID NO: 110345 - DNA, 160 bp, Homo sapiens
gtaactcagccaacatgctaacattttctttccttcccattaatttatttactagcccttcctatgtttgccaagtggctatgttactgaaaccagcccaattgtcccatagaaccgatgtttacagtcttctaaaataaacatagatattgacccttcc

SEQ ID NO: 110346 - DNA, 443 bp, Homo sapiens
aggcttaagatccaggcaagagtgaggcgcttaggagcccaggaagccagaagagcctggtagcactgaaggaacactcaggccaccttggaacagagaggatgggattgccatgtggttccacatggctctgaaaatagacaatggctaagctgtgcaacagactgcctatgacatttggttgcccagagcttctgtgaaaatacttcaggacaaggctttcccccacccaggggtgggttggggaatagagtgtatgcactttgttttgtccaattttagactttaaaatcctctgaggcatcaactggtgagggtgaggaagtggccccatagactgaattgggcctgccccaccctggtacctttctgttctgtcacagtgacaattcacagctcagaggtcctttgggaaactttctctgacatcgcccctatcctct

SEQ ID NO: 110347 - DNA, 493 bp, Homo sapiens
atttatctacctttaatttctaccaatttttttcaaactttttggattaatgtaggactctactaagaattttgttagatacacctttccaagaaacttggattggaagtttctattaggtgttagataattgcttaacctgctctgaaggaaacttcagccctgggagaattgtgaagctcatggacatttagaaggtggttggatttgtcatggaaagcagccctttttgaaatctttgtcatgggtcaagaccatttcctgctgagctttgtgggataagaaggtaaaatgatttgtcctgggatctcttccttcaaatgatatatgtgaagaatcccacagggaaccagcacatgcatgtactcaacaaatgtagttctttcccattgacaaaagagatgtccgggttatttgaccagttgcctattccttaacctctttgattaaagggcattctacaatcaaagggattagatcccagactacctat

SEQ ID NO: 110348 - DNA, 396 bp, Homo sapiens
agtgatgaagctggaaagatttgaaagtgtgagcacagaggtaattgaagtctggggatggttcttggctcattgtttattggttgcgtgcttctctcctatttcaagtggctctgctggtgaatgcttgaactgttcctcttgtcttcctgtgattgtttaaccccttagtttgggcttcccacctcctcctgtgcacttgaagggtagctctggggtacaaacttgtctttgcaatgctccctcctccattcgtcatcagggctcagcttggaacagccgttgatacctttaagcttcacaggggtcttgaggttagaagacttgagtcctcagaactggaaagaaaaaaaaaataccggactttctgaggtggttatttgggaggaggtaagc

SEQ ID NO: 110349 - DNA, 381 bp, Homo sapiens
ggtctccagccatctttccttcacttctccaaattcatctaaacgtggcatagagcaagacgctcgaatgacgttggacagcttccttttcacacctgagccccggtagccccactaggcaaaatgcaaacaggaaccccgggccttgctccgcgccctttgcttcatgaagcaacagaaaggccaccttcctggctgtaaaggcagaagcgccttcttccccataaacatccttgggcagctcatcattcccctcctgctcgttcttctccctcttcccaggcagcctgagaaacaaaacttaaactggacttgttgcctaatctaaattaggatccctctgctcttctccgtagctccatcttctcccacacaccagtt

SEQ ID NO: 110350 - DNA, 485 bp, Homo sapiens
attcaagtgatcacaatctttcttcaatccgttaatgtgaatttcctttactaacttttcttatgtacaattaatccatgatcttgaaatgaacacaacttggttatctgttttttaaaaaactgctatatttggtttactaaaatattgtttagacctttttaaattattattattattttttgagagtctcactctgtcacccgggctggagtgaagtggcatgatctcggctcaatgcaactgcctcccaggttcaagcgattctcatgcctcagcctcccaagtagctcggactacaggtgcctaccaccatgcctggctaattttgtatttttagtagagataggatttcaccacggtggccaggctggtcttgaactcctgacctcaggtaatccacctggcttggcctcacaaaaggttgggattacaggcatgagccaccatgcccagctgtttagcctttttatacctaggtaatg

SEQ ID NO: 110351 - DNA, 263 bp, Homo sapiens
tatcttctgtgcagctgtttttttaagattttcctttaatgtatttcctctcatttttcttgcgtcttatttggagtctgtagtagcatagttcttaatttgcttatcaagtaatttacatcatattaaacatgaatttcaaccagcaaagaatattattaaaacttctggactaatgttattcacttgtattctttcctactacccggaaatgcttttgctggcaatgatttctcctttgatgttgtggcacatcttccaat

SEQ ID NO: 110352 - DNA, 333 bp, Homo sapiens
tatagattctgagtattagattttgtcaggttcataggttatgaatatttttgccattctgctagctttggggtaagttagtttttatttttctagtttctctaagtgtgatgttaaattgttagtttgagatcattctaacttcttgatgcaggtatttagcactctcaactttcctcttaacagagctcttcctacaacccagacattttgttatattgtgtctcttctatttcaaaatctttttaattttctgccttaatttttttgtttatccaaaattcattcaggagcaagttgtttaatttcaatatcattctgtgattttgtgag

SEQ ID NO: 110353 - DNA, 470 bp, Homo sapiens
tccttctgtttttcctatgctctcgggaacatttgacctttagttcctttctaaatgcctcagttcattagaaatgttttgtgctcattcaataagtcatttatttgaggtcagatttatattttgaaaaggtcattttggcaagttatttggtcttcccaaagtccagagtgtccagtataaaatagggatatcattcctatctgtttcctataattgttgtgaggatgaatgtgttaatgtaagtgaaaatgcttggtaaacaagaaggagatatatgtattattcatagagcgattagcacaatttggttgcagtggatgagtagaaaaacagatgttaggtgaggtgcggtggctcacgcctgtaatctcaacagtttgggaggctgaggcagagggatcgcttgagcccaggagtttgaagccaactctgacaacttagtgagatccccatctctacaaaaagta

SEQ ID NO: 110354 - DNA, 889 bp, Homo sapiens
agctatggctcacacctgtatcccagcacttgggcaggccgaggcgggtggatcacgtgcggtcaggagtttgggatcagcctggccaacatggtgaaaccctgtctctattaaaaatacaaaaattagctgggcatgggggcgggcgccacttgggaggctgaggtaggagaatcgcttgaacccagaagccgacattgtgccactgctctccagcctgggtgacagagtgagactccatttcaaaaacaaacaaaaaaacaaaggtcaaatattgtggccaggcatggtggctcatgcctataatcccagtactttgggaggctgaggcattgcggatcacctgacgttgggagttcaagaccagtctgaccaacatggagaaaccccgtctctactaaaaatacaaaattagccaggcgtggtggcgaatgcctgtaacgcttgaaccccggaggcggaggttgcggtgagccaagatcgtgccattgcactccagcctgggcaacaagagtgaaactccatctcaaacaaacaaacaaaaaacaaatattgctaagactgctccacctccacccttctttattttctcctagaacataactgaatggttaagagcataaactctggagttaggctgtctgctttaacagttattaactgtatagacttgggcaaaccagttaaattctctgaactttcatttcttaaggacacctatgatacctaccatatggttgttgtgaggacaaaaggagtgaatacgagtgctcagatcactacctggcagtattcgttaagtgttagctattattataaatctccagaaaaactttttctcctcaattacagcaagggcttctttctagaaagggtgaaatgtttgtgt

SEQ ID NO: 110355 - DNA, 211 bp, Homo sapiens
gatgatcctgttaataggactgctccatatgccattcatgcatcaaaactttcaaaaaatcatgtgcaataaatcagactttgctgtaaacttaccaacacatttaatttctgatgatctactatttgtttcttgccatgccccagaggtatcctgataatatccttcagccttgcattgtgtatgtgtgcaagaatgagttgatacaatg

SEQ ID NO: 110356 - DNA, 449 bp, Homo sapiens
gctggactgagctgccttccttggtctgggtgggaaggtattcctggaagtggcgagcagcaatccgcacaggacagtgtgctgtgctgagtgccttgtgggtgtttaaattaaatatcccattgtacgactatggctggctgtaataaacccacagtaacagtctagtcttctcatcactctcagattattgaggaatggaggaaaacacaataaaccattttaaaagattgatttgcaagcttttttagccagcgggggtgtagacagcctgtacctttaagtcgcttctccgcgctcttcccggcaggacggggaactgggcggtgaggggaagaattgtacttggctcttcattctgttgacatctttgtcgtgccctaaatgcttatgtgtgtatagagtttctctcctccacctgccagaataaaccatcctcgaagcagctg

SEQ ID NO: 110357 - DNA, 564 bp, Homo sapiens
gcagcatcactctggtcttccattccaaagtccatggtaactgacttgggcacacggaatatttttgtttatcatgttctgattgctggaagagataggattatcctgtgactgcctctgggtcccatggcttttatttgacaattaatggtggtggctcccggtgttccttccttccctggcttccttgttagggatcgtgaatgaatagcaagtgtgggttttgagtattgattcttcactcctttcagagggcttctgagctgggagagctgccaatgggatcgaattttcacttcctgaaacttcaaccaaacctgtaactggggagataggacagccgagaaaccagaggcatgaggatgtgtttggttaggcaggactctttgaaagcaatcttaggatggtactgagttctgtcctgcttatgagacaagaatgcgggatttattgtgttgtcaagcctgaggatcctctctcttcacaaagcagacataggcaaggtctgttaagatgtggctaaaaggcttaaacgtttttgatacattttaaatggtgatcctt

SEQ ID NO: 110358 - DNA, 255 bp, Homo sapiens
gcctcccaaagtgtaaggattacaggcgtgagccaccatgcctgattatctatcggtttttgccttatgtatttggtgctctgtcattaggtgcgtacacattaaggattggttatgttttcttggagaattgacacttttattatatgtaatgctcccctttatgcctgataattttccttgctctgacgccagctctctgtgaaactaacatagctatttctgctttcttttggttagtgttagcatgatatt

SEQ ID NO: 110359 - DNA, 732 bp, Homo sapiens
gcaaatgaattttacctgttgatccaaatgtgatggcacgcttatgaagggttgatagtctacgtgttgccactattcgctgccgtcattttcaatgatgcacagctttccagtgtgtggatgcgccgtcatgtcttaaccacttccctgcgtggatctttaggtcggttttgccttttcattgttataaacagtgatgcaaggaagggagtgtttgtggttaaatctttacattcatcatatgttacaatgaactggatccctggtttgtttagcgccaaacatattttaattttgttctcaattagcttttttatatagcaaactacccccaagatgtaatggcttaaaacaacaaatgtattggcttaaaatttagcccacaattctgtgagctggctgggcttgctcttccgatctgggccagctcagctgatttctgctgggctctctcgtgtatctgtggtcagctggtgggttggctgaggcaggatgctctagggcggcctcactcatgtgtctggaaagtagtaggctatttcctggggcaatgggtcgtttgtgtctaggtcacacgccttttatctgtcaggttaccctgccttctttacttggtagtagtggcaggggttccccagacagcaagaaggcaagccgccatgtggaaacacctttcaagcctctgtttgcatcccttttgctgacatttctggccaaagccagtcatgtgcc

SEQ ID NO: 110360 - DNA, 249 bp, Homo sapiens
caagatcatgccattgcattccagcctgggcaacaaaagcaaaactccgtctcaggaaaaaaaaaaaaaaaaaaaaaaagcctccccaccgccgcccccaccatgtgcccatttgctaacctttcatgtgaagacaagtgtctgtcagtaaatatttagcaggttcttacttagcagatatatttggaaaacacagtctgtccctttgaggtacaggtgacatttgaatgagttagaaagtaactgcaa

SEQ ID NO: 110361 - DNA, 249 bp, Homo sapiens
ctaacatcacataatcaggaccctccctgtccttggcattgatattcaaagatgactgaagatgtggtcccttctgcatggaactcagtctagtggagaggacagaagggagaaaaggccgggtgtagtggctcacacctgtaatctcagcatttcgggaggccgaggcaggagaatcattagagctaaggagttcaagaccagcctatgagaccctgtctctattttttttttaagtagttagaaggg

SEQ ID NO: 110362 - DNA, 154 bp, Homo sapiens
ataatgataatcaacacacatttaatgacgtaagtgtctctaggttacaatcttcaagtccagcctgtgccagaaaacaaagctaggttcaaattgaaatgggtattcttgtcattccggcgagttccacagaaaccatttttctatttctaca

SEQ ID NO: 110363 - DNA, 605 bp, Homo sapiens
gcatgtgagtgcatgcgtgtgtgtgtgtgtgtgcactccctgtctggagccccaggctgtctgtgagactcttgcacacagggaggctggtgggaacaggcagtagttataaaaatataggaaacaaagcatttgtttctatcacgtgtctgatttctacagcaggcttgtattttgtacgaaagatgcttcctgctaaaaaaaacaaaaacctctccagagtaaatgacggcagcccaggcacagccgcatcctttagcaatgcccccaggcctaggagtgcctgtccctcccacacgggacccttcctggcccacccttcccttgagaatcacttgaagccagttcagagattccttaggtgacagtgctcagggctggctgagagctggctgagagctgacagcgcatttgcacagcccgcctttctcttctcaagtggaagtagctcccgtttccgacacagctgcaggcagtggcatgctgagtggaaaaagctatgggctcagtcccagctctgatctccccttcccacatcattggtgatagaggaggggaaatgagggaaagctctgtatagaacaggaggccttcctgtagcatgg

SEQ ID NO: 110364 - DNA, 288 bp, Homo sapiens
tgggaatatacaacaagtttatcttttcttctatgaaaagactttcacctggcaagtatttaattttttttgatgttattataaatggacttttttccccctaaatttcagttttaggttgttcattacaagtgtatagaaacagtttacttttgaatatcaatcttgaatatgcagccttgccagactcgtttattagattttttgtttgtttttgtgaattttttaggattttctataaacaaggccttttcatctgcaaaagagatagttttatttctttctttc

SEQ ID NO: 110365 - DNA, 365 bp, Homo sapiens
cggcacagcacaaagagctaaactaccactcgaggcagttaacctaagggcagggtggtggctacagctccaggtgaacagtctgggaccagaggaaataatgagcccccccttgtactggctgcttccaccctaaagtgtcatccagatggtgtttccaattctttctacttccagtattagctgcagaattacggaatcaaggaggcttctctgcatgaatcaataaaggctatagcactttgagacacaagctttggccctttaaaaatgtgagaaatcaaactggcacaggcagagtgtctcagtggtctccagggagcaagagagaatgaggttcagcttgaaggctacaagggtggagc

SEQ ID NO: 110366 - DNA, 387 bp, Homo sapiens
tccccacaacctaaacaacacttgctgtctttcatcctttttgatgtagctttttttttaacaggcatgagatattatctcctagtggttttaatttgcactttcctgatgattagtgatgttgaacactttttttcatctacctgttggccatttgtgacttggttgtgatttttactgttgaggaattgtcaacattgttttagtcagttctgactttttcttcatggctctggtggattgtgtcatattgtcatacataaggagaaaagaatttatgaatgtgatgaacataatggaatgtggctcccttccttccattctcatctccgctctgttaattgacctctgggttcaatgagtggctaatgtaactgaagtccctgg

SEQ ID NO: 110367 - DNA, 91 bp, Homo sapiens
ttatagcatgagtattgtaccttgattgtgttggaaaagatgtgttctcctttcccgtcacaaaattgagtcctaaatcatatccttagtg

SEQ ID NO: 110368 - DNA, 191 bp, Homo sapiens
aaatctacataaattatgctgagatgtcttcaacttaaagcttttttttgagacagaatctcactcggtcactcaagctgaagtagtgcagtggcataatcacagctcactgcagcctcaacctcccaggcacaagcaatcctcccacttcagcctccacagtatatgggactatagataggcatgtgcca

SEQ ID NO: 110369 - DNA, 508 bp, Homo sapiens
ttctctaccccccgaggaggtaccgtccatgggctcaggagcactgggcttagagtccatgcccatgcattccgtgtctacaagggtactgcttcacagtggccgccgaggacgcacacgagtgcttcacactcatccaggggcatctcgattctcactgggaccctggataagaagcacttttgtagctaaagcaataaggatggtgcctgaggctgcatgaacccccggaacacttttaagtgaccaaaagcatgacaagactctccgacagagtgggcattgcttatgagagggggaagttcagctgtgttacagtatttcataggggacttgtacaatctaccttgtgcctctaaacacttctgacccctaagaatcgtggccggatgctaaggataatctttcgttgtcattgccagagataattattgcattaatgtaacaccatcctcatcatatcttattaggaagaattttagaataacagagcttctactgaatctca

SEQ ID NO: 110370 - DNA, 686 bp, Homo sapiens
gaatttcagtaattcagttaaagacatcttcaagtaagaacatgtcatattttgaggatataatttactattagcagtttatcatgggataaaaattttgcattaactagataacttcttcagaatgcttctgcagaggaaaattatccacaaaataaattttggtgcttgaaagaatatggtgttaagttcagaaataatttgttctgtaatttgagaacaagctcagaagtattatttctcagagagccaattatttatttgttttaaaaacatcaaccctgaatttgtggaagcatgagtaagagtagatatattattattcttggtatctcacttatgttggttatatttattttttgcatatgccttatacatgctttctttgggaactcaaggtagaatttacaggctggagatgctttttaactctcaggataataacctcagtctggtttcatgaactgtgctttcattaagtattgatatgtttaggaaaggagatgtcttaatatttaaatagcagttcaaactccagtttctttagtattcattgactttctaattgtcaaatttgtcaggacagtaaaaattgtattaacatatagtgtctagagaggaagttcttaaatttgccgattgtggtagctgttagaattggcagactgaagacattgatacacatg

SEQ ID NO: 110371 - DNA, 376 bp, Homo sapiens
ctgtgaacaaaccccaacccatttattctgtggttaatccatgttttaataggtgtaatgattcaactgcctccactaacaaatgagttcactggaatgtaagaatttgagtggatccattagaaacatctgtggatagacacagacccatggcatacatcctctatacattgaaatgcaggcaatgcaaagatgaagagaaaagatgtcagaggcaacaagcacagacgctcccccactgggttagagttctggcctgaagtggggccatctcaggcacccacacctgtgtctgctgtgcagtcctctaggactcccctgggagagttgtcggacatgccccagggccagctccctgcctgcccttaccttacct

SEQ ID NO: 110372 - DNA, 158 bp, Homo sapiens
aaaaagagattactttttaagctatttgtctatttttaaataagcatatgattgtgatactaaatcattttgacattattttaataactggcttttactttaaaaaaaactgaaagacttttatcgaggtgatcatttttattttttagatcacatgg

SEQ ID NO: 110373 - DNA, 755 bp, Homo sapiens
ctgatgaacatagatgcaaaaatcctcaagaaaatactaatgaaccaaattcaacaacatatcaaaaagaaaatccaccatgatcaagtgggtttcatgccattaatgcagggatgatttaatatacacaagtaataaatgtgatagagcacatacacagatttaaaacaaaaatcacatgatcatctcaatagatgcagaaaaaagcatttgacaaaatccagcatccctttatgattaaaaccctcagcaaaatcggcataaaggggacataccttagagtaataaaagccatctacaacacaaacaaagggaaacgcatcccatgctcatggatgggtacatatggaaccaaaaaagagcccaaatagccaaagcaagacaaaaaaaaaaaaaaaataggcgcatagaccaatggaacagaatagagaacccaaaaataaagccaaatacagccaactgatctttaacaaagcaaacaaaaacatgaagtggagaaaggacaccctattcaacaaatggtgctgggataattggcaagccacatgtagaagaatgaaactggatcctcatctctcaccttatacaaaaatcaactcaagatggatcaaagacttaaatctaacacccataaagattctagaagataatattagaaaaacccttctagacattggcttaggcaaagacttcatgaccaagaacccaaaagcaaatgcaacaaaaacaagaataaatagatgggacttaattaa

SEQ ID NO: 110374 - DNA, 408 bp, Homo sapiens
ccatggctttatgtaggtcagttagggcagcaaggaaggcttttccatgagatagaaggtatcaataagctggctggaaaaacaaggatcacattgctaacccacatcaggagagctggtgtgccttggctctcccatggcttgtttagagccagcagaatcatctccatgaaactaacacatgaaccttcaaaatgaaccaaatttcacaaagctaagagggaaactccatacaattttgttagcaagactccttaagcacattcactatttgtttcttgtccccttgctgtttctgggttcagaatccttctagagcccgtaagttcttgctgtcattcgcgcttattttcatccaatcagaggctgacatagagtttccaaccttagccggacactattcttgat

SEQ ID NO: 110375 - DNA, 319 bp, Homo sapiens
accagtgaattccctgtaagccatttagagaggttctttgtatattatattgtagaaaatcgacagaaagaacgagaccatttacaggaaggaacttggtgctcatttgatttggatactttgtgcgtctcctgtggcctttgaaatgaaaaatttccaggattgattgggtgtgtgttttaacttcgtagcacattcagtggactgttttgtagagcaggtggtcagcgctgtaacacttatccggccctgtctcagggactttgcatcatccacttggacctgttcccgtgggtttcctgtggttctgtcttacccg

SEQ ID NO: 110376 - DNA, 506 bp, Homo sapiens
ttatcattcatgacgagccaacttatgctcggagttccaaaaatgctatcaaagttcccattgttatcaatccaaatgcatatgacaatctagctatctacaaaagttttctgggaacaagtggagaactctcagtgaaggaaaaaaccacaagtgtaataagccatacttatgaagaaatagaaacagaaagcaaagtgcctgataacaccactagcaaaaccactgactgtcttcaaactaaagggttttcaaacagcacagagcataaaaggggctcagtggctcagaaggttcaagagtttaacaactgtctcaacagaggtcagtcttcaccacagagaagctatagttccagccacagctccccagcaaagatccagagagccactcaagagcctgtggccaaaatagaaggcactcaggagtctcagatggtgggcagcagtcagcaccagagagaaagcaagcacagtgctttctcagattgtggcttcaatccaacc

SEQ ID NO: 110377 - DNA, 290 bp, Homo sapiens
attgaagaggccactaaaacactcaatataaatatcttaatgcagtattttttaaaaatcaaattcaaagaacccatgatgaacaaaaatgccaaaattttaaattgaaggatcagtattgctgatactttgtctcaaactccaaaatggctctgcatgaacagcactattggtaatctcatctttatttaaaattgtgatattttattcatgattttcttttacattaatttttaaaaatattgtatttgtatattatttgacgactaagctttttgtcacccccttcc

SEQ ID NO: 110378 - DNA, 854 bp, Homo sapiens
ctaaaaaattccactgcatgctaatgagagaaacagtgaacatggcaaatcacaccttagtattcccatcatagtagtttcgaactcatgatactctgaaagattcttgggagttcccatgtttccaggccacaacttgagaacctcttggctagagtgtagctgagaagacgcagaaacacagagaaacaaaacaacagcatctggagaccgactaggcttagtgggagctgcaaaggaaatgatctgattcagtatgatgcaatacatcaaacctgggtgacctgggaaatttgcaatgcctcttgcagaatggggaaacccatgggggaaggcaatctgatggggaagttggcaatttctggtttgggtgatttaaatgtgaaagaacatagatatccaagtaaatacagaattaggtcacagaaactgagagactcattgtcaataaaactgaatgtttttaagttaatttaaaaatgaaatagacacatgtactgtaatttctatccagttcatcacaaaatttttattcatttttgtttcttttaatgagtggaacattataggagctcaactgtatttgaaaaatttacttttctaagatgaggagtgaatacatgggcattttccatgttattctttattcattcgatatgtctgggacaatttataatatattaaaaattttaagttcacatcacatgctaacccacacatatttctctctctctctctctctctcacacacacacacacacatacacacacagacacacactatatatattttccttagatcagatgccatcttatttccagatgctagtgctagagattcccatttgggaaaa

SEQ ID NO: 110379 - DNA, 576 bp, Homo sapiens
gtgcgcggtgttctagaggatcccggaagaacatgatcccagaaagcacacagagttacaacatagcaatagcccctccgagctcaacaaaaacatctattgtgtcatgggctgcaaagaaagaggtatgctgggaaccaataacaagatgctaggaatttttttttctgttctattttagcttgaaaaacttgttttccccatatgagttgtgcatttactcttggatcttaaaagaggacaatttattaatctgggtttaaatcctggcccagccacttggatgctgtttgattttaggcaaattatttgactttgtgctattgtgtcgtcatcgacatcatcatcatcgtcatcttttagctgaattctgtgactcttctagggcatttatggtagacagaaatctgttcttgtaatgtagaaatcagtcatttagtgtatctgaaaattcccatcttcaaaaactagggccagatttagtcattcttttactcttaactgttgctaccaggtcatacctaatttgtatttttccaagttacgtatattaaagtcatactaattggtgcctga

SEQ ID NO: 110380 - DNA, 663 bp, Homo sapiens
gaacatatagatcaatggaataaaattcagagcccagaaataaacatgtctattttcaactgactttgcaacaaatgtgcctagaccattcagtatggaaagaatagttgtttcaacaactgggactctgtcaacttgatatctacaaacaaaagaaggaagttgggtccctccctatcttacatcatgtatcaaaattaacttgagttaaattcataaatttaagaggaaaaagtataaaactcttagaataaaatgtgtaaaatcttcatgaccttggatttgatggtggtttttcatatgacactaatagcacaagcaacaaacaataaaaacaggtaaattggacatcaaaatttaaaaattttgaatctcaaaggacactatacagaaagtgaaaagccagtacagatgttcctcaaattatgttggggttacatgcttataaactcatcataaattgaaaatacactgttaaactgaaatgtatttagtacacccaacctaccacacatcatagcttagcctagcctaccttaaacatgctcagagcacttatgttagccttagttgggcaaaatcatttaaacacaaggcatattttataataaagtattaatagcttatataatgtattaattattatactgaaagtaaaaaaca

SEQ ID NO: 110381 - DNA, 243 bp, Homo sapiens
tttttttttaattcccaattgccctgagcttcagaagtatccacaagagtcacaaggtaagacatttggcaaaggaaggcaggtagtaatcttttcaagcaacatatacatcatatgtgaacagaaaatgacaagtcacagatgggaaatagctcacagccaacagccaaggatcgaaaccaacaagaagcaattcttgtagctcccactggtagtcaagaatgaaagagaagctcctttcac

SEQ ID NO: 110382 - DNA, 397 bp, Homo sapiens
cccgggaggagttagcttttaaggtaggatcttttggctattggcataagaaaaaaaagtcagttccacttagtgacattttaagagccaagaattttttttttaagatagtagcagggtaaaccagaaagatcactagatgtaaaggcaaaatacctggattctacttcctcttaacctctctatatctcagcttctcttctgcgaaatgatggcattgaactagctagtctctaaggattcttttagctttagctttctatgttttacacttatgctaagaacatagtagatgttcattataataatgaaaaattggaaatcacttcaatgttcatcaaaatgggattggttaaaccaattatggtgtgaacgcatgcacacacacacacacaca

SEQ ID NO: 110383 - DNA, 522 bp, Homo sapiens
attttcatggtcaatacaacagaggggtgtcgttcctctttgaagcgtttcccaaccgacagtgacgggtttctaccagggagatgttacggcaggcagcgttttggctctgacggccctgttcgttcctgcctccctgggattttccatcccgaagtgctgttcctcactcagcacaacctagaaggtcccacaaaaagctattctttggggcttatttgcaacgcaggggaacccatgaattatgcaaatcgaggtccaaggaggcgttgttggcttgtccaccttcactcagttttagggctggggggccgaatggcggggcaagcagaagaaacataaccaacagaacgacatggcgaaggttgtaggttccaaaaagggcgacagggacaagggctcgagctgaggaatgccttctgaggaccccatagccaaatttttgctgtttccagcctctttttgactcttctcttagaacgtcaccatgctaacttgtggtttggggcccacccatgtttc

SEQ ID NO: 110384 - DNA, 417 bp, Homo sapiens
aactccgactcaaaaaaaaaaaaaaaaaaaagatttatggtttattcacattttaaaataatattatcaaattaaatacagagaataggaagcatcttgtcagtgaacttttaaaaatctgatattggtaaaccactccccctacaacctgttcctgttcatgattgtttaggattattatttataacatttaggttatatactccccaaaaagactcaaaaactatccttgactccttcattcaaaattgtcttctcggttcattaaattgtatttgcaaacagtgtttatcttgttaaattgtttgtaatggtggtaaatgttggcacagagattttcccatctgaagccagggaacctgctgctctctgccctgctctcctgtttcccggctttgtttgctcctatggccatcg

SEQ ID NO: 110385 - DNA, 2595 bp, Homo sapiens
  misc_feature (295)..(295): n is a, c, g, or t
  misc_feature (361)..(361): n is a, c, g, or t
  misc_feature (413)..(413): n is a, c, g, or t
  misc_feature (416)..(416): n is a, c, g, or t
  misc_feature (438)..(438): n is a, c, g, or t
  misc_feature (505)..(505): n is a, c, g, or t
  misc_feature (1165)..(1165): n is a, c, g, or t
  misc_feature (1452)..(1452): n is a, c, g, or t
  misc_feature (2086)..(2086): n is a, c, g, or t
  misc_feature (2238)..(2238): n is a, c, g, or t
  misc_feature (2585)..(2585): n is a, c, g, or t
  misc_feature (2593)..(2595): n is a, c, g, or t
ctaataaagagcatcaatgaaaactctatagcgaatgtcatatttaactgtgaaagaccaaatgcttttcctctaagattatcaacaaggcaagaatgcctgctcttagaactgattagcattgtactagaggttctagttattgcagtaaggcacgaagaaggaataaacccattcaaattagaaagcaagaagtaattctccattaaatttttaaatttttatttatttatttatttatttttattttgaggtggagtctcactctgttgcccaggctggagtgcagggcacnatcttgactcactgcaacctctgcctcccaggttcaagcgattctcctgcctcagcctcctgagtngctgggactacaggtgcgtgccaccatgcctggctaattttttgtatttttngtngagacggggtttcacggtgttngacaagatggtctaaatcttgtgaccttgtgatccgcctgtctcggccccccgaagtgctgcgattncaggcatgagccaccgcaccagccttaatttttaaatttttattattaattttttgagtctccctgtcatgcaggctggagtgcagtggttcaatcatggctcactgcagcatcaaccttccaggctcaagcgatcttcctgcctcagcctccgaaataccaagtaggtgggactacaggtgtgcaccaccacacccagcaattttttttttttgagagagaaagacattccctctatgttgcctaagctggctttgaactcctgggctcaagtgatcctcccatcttggcctcccaaagtgctggaattaaaggtgtgagccaccatgctggcagacaacataatcgtcatctgccattaaacagacatcctaaatttgtaggattagaaaatcctatgaaatctacaaaactgctagaattgatgagtgaatgttgcaaaataattctaaaatgtatatagaaatggaaaagttataaagtagccaaaattacttcataaaagaacaaagttaagggatgtatgttacctgatttgaagggttattatgaagctatcataagcaagacatcctagtattggtgtaaaattagacaaatagatcaatggaacatcatagtgacttgagagatcaactcagacatatttggttaactganttttggcaaaggtgcaatggtaaatggagaaagaataatctttttaacacatgctggaacaattggctagggatttttttaaaaaaagaaaaatgggaaaaaagaacattgacttctattgcaaattattacaaaactaacttgtatcatatatataaatttaattaaaaatgtatcatttcgagacctaaatgtaacatgtaaaattataacatttctggaaaaaattgagaaaatatttgttatcttcatttaggtaaagattttttagatatgacatcaaaaanacagtccataaaagaaaattttgataagttggagtgcatcaaaacataaaactttggtttcttccaaagacaggattaacagaatgaaaagacagcttacatactgggagaaaatatttgcaaatcgcagtccagtaaagagctttatctgcaatatataaagaactgttggaactcaataggaagattgacttctggcataacagcatgaggagttctgctgacacattccccggtgaaactagtgaaagttattattttttctgtctctgctgcttgaaggagaaaaacattgttaaaatctccagccatttagagtctctggaaatggtcctcaggacaaagagcaaatgaagaaacatctcttttagaaaatttagtaagaaaggtgagattctgtgatatttgaaccaagacttcttccaccctccccactcccagctcagcaaggtagtgactccactctagataactgcagccaacaacacaaggctctttccctccttggttcccaatcaaaggctttttttttttttccagtagagatagcacttaacaactctcatcctgccccttcttgcctgttgctgaggttaaatcccaggtgaatgtgactgagaggtggaagctcctntcttctaccgaactcttactcttggaatggaggttctaccttaggtgtagcaaacagaaaatattgggtccttataacccttctcccatgcagagaatattgagcccttattaaggtggtaggtccatgccagaagaggcaagctgagaggnccagactgcagctactccccattcccactgaattctcagctcctagtatgtgagaatcacttggagagaagcttgccattgtccttactctccagctccaaagtcagggaaagatggaaaggagccctaccagtaccactgtcatccccagtgactgtaggcatacccaaagctgtaccatcctgaagagcaacatcagaggctggacactgtaggggagaaatagacttcactaaaataattcaaccagtcactagaccagcagacaagcaacaacaaagctcagagtggggtattcattatccagtgttcctacaatatattatctaaaatattcagtttccaanaaaaaaannn

SEQ ID NO: 110386 - DNA, 770 bp, Homo sapiens
ctatgagataattgacattagagaaacacacattttagcagaacccactgtacttctttcttcattctctgagtctatctctccaagtactgctatgcattaaacagcaatagcagcaaaacctgcctcataataaccagcaaaaaatcaagcagatatcaaataagcattaaaaatttcaggtcagcatttatgtcaagacagcatgtatataccacaatatatattaaatccaaagagaaggaagaataaaagtgtgactagaatgtccttagtcacttaatccttcttgtgccatcaaaagcccctcactccctcgctatggctcctgacttcagaagccctcagctgctgattgagtagacctggggtgttcaatcacaagtggagggcagaggacaacatagtttttaatgccaccaaaattcgaggtagtaaggtaagtatggtttttaaaaggtacacacgtaaggttggatatttataaatacatacgaaacatacatagggcatgacaattaaaaaatgaaaagttttgacaatatgacactagggaaacataaagccactgaagataatattgggtatttttgggaggaggaagaaatgcagatgattaggcttgataaatgcttattgaaaggaagatcgatttagcagggttttttgtagtttttacttagggcatattacacataacggtcatatcggttctaatagagttggggaattatggaacaactaaaaagctgtgctattcaacagcaaat

SEQ ID NO: 110387 - DNA, 429 bp, Homo sapiens
atgagggacttctgtttttagcaattgcaaactcagaaatcaagtgacacctcctcctaaggatgagaaaactcagactaaatatgaaaaatatgcttcaaagcttgaaaaagctcatgatatagtaaatatgttctcagtcagagtccagggaaaggtagaggccacaggaggtgagcctatggtttaggactaggggtgtctgccagttacaaaggagacgattaagcagcaaggtgcttttggagcatcacaggactaggagggcagaaattagagtccgtggtctgccaactgagcacatcctggtgaaccttttacttgaggttgggatcttgaagggaagcacctgaagagtaaatgtgaaccgaagcagacaggccctcagagagtgtgcagtttaccctcagatcatctcagtcactgacc

SEQ ID NO: 110388 - DNA, 792 bp, Homo sapiens
taattatgcttatgtgaatgtctcagcttgattgtgagaattggaattctgcagggctttgcccaaaagtaggtgcttggccttactattatgatagtaagcacctacaaaaaaatggaattaacagagctgcgtctgcaaaatcatgcactactgaaacccccaagtttccaagcttttcaaagtttcctgaccaaacacgttggtaaatgttatttcactatagccttgcaggccggggtgatgcatgtggacacacgtggtaggtgactttgctactactggactgaaaggaatacaaatgatctcatcagttaacccacagcacaggacaaaatactggattcttttgattcagcatgttttcttgatgtcagatgtcctgtgaattagacgtagtcagtgagaaaaattaccacaggagaatttagtaagggatttttgatgccccctagaggtagtgggaggtaaaagaattctcatggtcatcacaaattcttatttagaacactgtcacatgtggggaattttgccacaccagagtcaaagcagttctttactgttctaagcttctcattacagatgagaaaattgaagctcaagatggttagcttgcccagagtttgccttaactcacattttaattttacccacgagaagagtttgaacttaagaattgaaattcatgtaaatggcattgcttatcagatatatgataaggtgtataaaactttcaattttggagtatcctaaagcacttgccatgttaattaaaggtaagttttaagggga

SEQ ID NO: 110389 - DNA, 442 bp, Homo sapiens
tttctttggcccctaggcaattcctgtttagtccaaggcgtaaggggaggggctgtatttctgcatctggcccccaggtgaatgcagctgttttaaactgcgagcgctcagctatcctggaaaaggggaagtggccagagagttcattgaagctgctcattgaatggaatctgagccgcttctaatggtctttgaaggctccacaacagtggttttcaaacctgagtgtgcatctgaatcacctggaacacttgttaaactacagattgctggggcaaccctcagagtttccaattcagtaggtataggatagggtccaagaatatgcgtttctaatgcctgtccaggtgatgctggtggtgctagtctggggactaccatttgagaaccactggtctaggaggaaggacatagtgatggcagatggtgcctgtttggtcaa

SEQ ID NO: 110390 - DNA, 499 bp, Homo sapiens
tcttccccaaggagcccacaggtagagggaaggggcacccctgccgcctcctcagagctggtcttgagtctttctttctccccctgactattcaagagggccccctacctagagacaaatcccccaggagaaatgttttctgggtataaccctgagtgtatataagacccgggggtatctgaaagtcacagcaagactgggatgaaggggaacaaaataagtaattgacaagcagtgtgggtcccaccaggaaacaagagaaatccagtcccgaatcacagattgaggacaaagcaaatataaggcatgttcatcacggaaggtggctgccgagtacacaggtgtccactgtacaaagccttgacgtttccagatgttcgaattttcagagtaaaatgttggggaggggatatccccaaagctcagagatcacagctactgtagtgatgctaaaaataagggggaaatggctgggcacagtggctcacgcctattatcc

SEQ ID NO: 110391 - DNA, 1383 bp, Homo sapiens
cagaccaggttttggccccggtttgctgcagtctacagagctggtgccccctgaccctcagcagccacaggcctccgccgaagccccatttgctgccagagggatctactcggaggagatgccgtcggtggcccggcctcggcctgtcgggggtaccacaggctcccagatccagcacctgacacaggtggggattgccagcagaattggagctcagccagtggaaatcccgccaagcagaggcagccagtatggggggccaggctggccttcgtacggggaggacgaagcggggcgaagagaggccgtgccaaggacttcaggcagggagccctcagctccttccgggaacctcccccaccggggactgcagggccctgggctgggttaccccaccagctccacggaagacctccagcctggccactcctcggcctctctcatcaaagcaatccgcgaggagctcctccggctctcccagaaacagagcaccgtgcagaacttccacagctgatcggcctcgcctcgcagatttgccaagtatccgcttcctgtggaagcaagaccaaaaggaaatcaactgagtgggtgtttggaagaggaaggagcaactctcgggcagcctgcccaagggagggagcaagttgcaatttagaagatgccatacgtcgtgtgacagctcatgagcctttcactgggctggcaattgtctgaacacttgggttcagttgaaatatatgtattttggccaaaagccagcagcacttcacaaaaacaaaacacaaacctaagctaacaaaatgactgcattcgtctcttttttaaaggtagagattaaactgtatagacagcatagggatgaaaggaaccaagcgtttctgtgggattgagactggtacgtgtacgatgaacctgctgctttgttttctgagaagaggtttgaagacattttattaacagcttaatttttctcttttactccataggaacttattttaatagtaacattaacaacaagaatactaagactgtttgggaattttaaaaagctactagtgagaaaccaaatgataggttgtagagcctgatgactccaaacaaagccatcacccgcattcttcctccttcttctggtgctacagctccaagggcccttcaccttcatgtctgaaatggaactttggctttttcagtggaagaatatgttgaaggtttcattttgttctagaaaaaaaaaatccctcccaaagtggggcaaaaagctttatatttatttgattatccaaaatacagatcaaagtttagatctcaaaaaaaaaaacaacaaacaaaaacacgaaacacacataaacaaaaacaactcaacaaacacaaaccaggggg

SEQ ID NO: 110392 - DNA, 613 bp, Homo sapiens
gcctgtgacgtcagactccagaccatgtatttcctgactcccatcttggtagccattctctgcattttggttgtgtggatctttaaaaatgccgacagaagcatggagaaaaagaagggggagcctagaaccagggccgaagctcgcccctgggtggatgaagacttaaaagacagcagtgacctgcaccaagcagaagaagatgctgatgaatggcaagaatcagaagaaaatgttgaacacatccccttctctcataaccactatcctgagaaggaaatggttaagaggtctcaggaattttatgaacttctcaataagagacggtcagtcaggttcataagtaatgagcaagtcccaatggaagtcattgataatgtcatcagaacggcaggtttgtaattgcagatggggtctttggaaatgttagtcaccttactggtgtgactccaacaatggaaaaatgtcaaagtttaaacatagcgaataaagcctagagtgatatgtttatctataaagtcttacccaaatgctgagtgagtgccagaaacacaatgacttctactttccacattttgactattacaagcttcttggaagaagatgtgacaat

SEQ ID NO: 110393 - DNA, 907 bp, Homo sapiens
gcctgtgacgtcagactccagaccatgtatttcctgactcccatcttggtagccattctctgcattttggttgtgtggatctttaaaaatgccgacagaagcatggagaaaaagaagggggagcctagaaccagggccgaagctcgcccctgggtggatgaagacttaaaagacagcagtgacctgcaccaagcagaagaagatgctgatgaatggcaagaatcagaagaaaatgttgaacacatccccttctctcataaccactatcctgagaaggaaatggttaagaggtctcaggaattttatgaacttctcaataagagacggtcagtcaggttcataagtaatgagcaagtcccaatggaagtcattgataatgtcatcagaacggcaggaacagccccgagtggggctcacacagagccctggaccttcgtggttgtgaaggacccagacgtgaagcacaagattcgaaagatcattgaggaggaagaggagatcaactacatgaaaaggatgggacatcgctgggtcacagacctcaagaaactgagaaccaactggattaaagagtacttggatactgcccctattttgattctcattttcaaacaagtacatggtttcgccgcaaatggcaagaaaaaagtccactactacaatgagatcagtgtttccatcgcttgtggcatcctgctagctgccctgcagaatgcaggtctggtgactgtcactaccactcctctcaactgtggccctcgactgagggtgctcctgggccgccccgcacatgaaaagctgctgatgctgctccccgtggggtaccccagcaaggaggccacggtgcctgacctcaagcgcaaacctctggaccagatcatggtgacagtgtaggcagggcccccca

SEQ ID NO: 110394 - DNA, 325 bp, Homo sapiens
tatgtaacaaacctgcatgtgtacccctgaacttaaaagttaaaaaaaaaataaaatatatgtatcctcaaaataatttttaaaaagtaaaattgctgtgaagggccaggcacggtggctcacacctgtaatcccagcactttgggagcctgaggtgggtggattatctgaggtcaggagtttgaaaccagcctggccaacatggcaaaaccccatcactaataaaaataaataaattagccgggcatggtggcaggtgcttgtagtcccagctacttgggagactgaagctagagaattgcttaaacccataaggcaaagcttg

SEQ ID NO: 110395 - DNA, 3352 bp, Homo sapiens
acttcccaattctgtgccttctcaggtccctgagcaaaatgggaaatggttcagtgaaacctaaacattctaagcacccagatggacactctgggaacctcaccactgatgctctgcggaacaaggtgacagagctggagagagagttgaggaggaaggatgctgagatccaggagcgggagtaccatttgaaggagctgcgggagcagctgtcgaagcagactgtggccattgctgaactcacagaggagctccagaacaagtgcatccagctgaacaagctgcaggatgtggtgcatatgcagggaggaagcccgcttcaggcctctccagataaagtgcctcttgaggtccaccggaagacctctggattggtctctctccatagcaggaggggagcaaaggctggcgtgtctgctgagccaacaacccggacctatgacctgaacaaaccccctgaattttcctttgagaaagcaagagtcagaaaagactccagtgagaagaagctcattacagatgcccttaataaaaatcagtttctgaaaagactggatcctcagcagatcaaagacatggtggaatgcatgtatgggagaaactatcagcaagggagttacattattaagcaaggagaaccaggaaaccatatctttgtgctggcagagggtcgactagaggtgttccaaggggagaaattgctgtcctccatccctatgtggaccacatttggggagcttgccattttatacaattgtacaaggactgcctctgtgaaagctattaccaatgttaaaacatgggcactagatcgagaggtattccagaatataatgaggaggacagcccaagctagagatgaacaatacagaaacttcctcagaagtgtatccttgctgaagaatttacctgaagataaattaaccaagatcattgactgcttggaagtggaatactatgacaaaggagattacatcattagagagggcgaggaaggaagtacctttttcattttggcaaaaggaaaggtaaaagtaacacagagcacagaaggccatgatcaaccacagctgataaaaacactgcagaaaggagaatactttggagaaaaagctcttatcagtgatgatgtcaggtcagctaacattattgctgaagaaaatgatgttgcatgcctggttatagatcgagaaacattcaaccaaactgtcggtacatttgaagagctgcaaaaataccttgaaggatatgtggcaaacctgaaccgtgatgatgaaaaaagacatgcgaagcggtccatgtctaactggaagctgtccaaagcactctctctggaaatgattcagctgaaggagaaggtggccagattttcctcatcatccccattccagaaccttgagattattgcaacactgggcgttggtgggttcggaagagttgagcttgttaaagtaaaaaatgagaatgttgcttttgctatgaagtgtataaggaagaagcacatagttgacaccaagcagcaggagcatgtctactcagagaagaggatcctagaggagctgtgctctccattcattgtgaaattatatcgtactttcaaggacaataagtatgtatacatgcttctggaggcctgcttaggtggggagctctggagtatattaagggacagaggcagctttgatgaacccacctccaaattctgcgttgcttgtgtgacagaagcatttgattacctgcatcgactaggtattatctacagagacttgaaaccagaaaacttaattctagatgctgagggttaccttaaattggttgactttggatttgcgaagaaaatagggtctggacagaaaacatggacattctgtgggactccagaatatgtagctcctgaagtcattctcaacaagggacatgacttcagtgtggatttctggtcactgggaattctagtgtatgagctcctaacgggcaacccacccttttctggggttgaccaaatgatgacctacaatttgattctcaaaggaattgaaaaaatggattttcccaggaagataacacgacgacctgaggatttgattcggaggctttgcaggcaaaatccaacagaaaggctgggaaatctgaagaatggaataaatgacattaagaaacacaggtggttaaatggttttaattgggagggactgaaagcacggagccttccatcacctttgcaaagagagctcaagggacccatagatcacagctactttgacaaatatcctcctgaaaagggaatgcctccagatgagctatcaggctgggataaagacttctgacagaagaaaagttgattactgcctgtactctacagaagaggacctcaaggatcaataatccaacacattattttcttttcagagtattataatatctttggaagaccattagggaaaagaaattcctgcacaatgggaagaggagaatggtgtggatatggttctgagttatagtgtcttatttagatgctgtgaattattgatgtattacattatttgcttttctcaactgctagaggctaccccattttcctttccacaatcagagccatttttgttaaagtggcagttttttctgcaatctattgttccattccaatcatatccttctcgtttgagtactactaacgtttaaaaagggtcttgcccttgaataactaagtcatacaaatagaaggaaaaacaatggtgaattttggagagctccccagctctcagcaacttcatataagcatggtggtatcttaaaatggtggtttgcagaaaccatggtagccaacagaacctcctgactttcacctgcttttaacctgaaaatatattaatacgcctctgacatgagtccagggagaggcaagattgagcaatagtcagtggcaccatttcctaaagtaactgaatcaatcaatccagtcaggtaattattttctattggggaacttagaaaaaaaagtaaagcaagaaatattttctctcctttatgatcagtgataccttagagacttttcgaaagtccttgttaaagatagttacaatgtgtggttaaatgatgctaaaatattttcacaaccagagtagaaaacgtgctggaacaaaattgcgaaggcttttgcctcccagtaaatagaaaggaaaatatattctagtaggtaagactgctgactctttgaaaatctgaggtattttgaaaaattctgtgatagttgctattaataaaccaaaattgtatagaatcatcgttaatttttaatataaatcccattgacaaatgttgatgcactgtagtcactgctgagttaatagcg

SEQ ID NO: 110396 - DNA, 355 bp, Homo sapiens
acagggatggaagttctcactttgggcttcagcttttaggcttgaagatggggttttgccgaggacacacccccatctgcctagaatttctctgcctcctgcctctatcaatgtgtgtgtgtgtgtgtgtgtgtgtgtgtgtgtgtgtagggggggaggcagagggagggagggagagagtgagagagagagagagaacttacaaaccaccaagaaaaatatggacaactctctagaaaaataggcaagagactaacacaggtacttcacaaaagagggtattcaaatggtcaataaacatatgaaaaggcagttaaaccttattagcaatgaggaaattttaattaaaaccaca

SEQ ID NO: 110397 - DNA, 2536 bp, Homo sapiens
gcggccgcaacgtgtcgagagccgtaagtaaagtgtcgcaaagcagaaggaaggcgggagtcccgactgcaaacattgaggaaagccaggcagtagaggccgctatggcgaacgttccgtgggcagaggtctgcgagaaattccaggcggcgctcgctctgtcgcgggtggaactgcataaaaatccggagaaggaaccatacaagtccaaatacagcgcccgggcgctactggaagaggtcaaggcgctgctcggccctgcgcctgaggacgaggatgagcggcctgaggccgaggacagcccgggtgccggtgaccacgccctggggctgccggctgaggtggtggagcccgaggggcccgtcgcccagcgagcggtgaggctggcagtcatcgagttccacctcggggtgaaccacatcgacacggaggagctgtcggcgggggaggagcacctggtgaaatgcctgcggctgctgcgcaggtaccggctctcgcacgactgcatctctctctgcatccaggcgcagaataacctgggtatcttgtggtctgaaagagaagaaattgaaactgcacaggcttacctagagtcatcagaagcactatataatcagtatatgaaagaggttgggagtcctcctcttgatcctactgagcgttttcttcctgaagaagagaaacttactgaacaagagagatcaaaaagatttgaaaaggtttatactcataacctatattacctagctcaagtctaccagcatctggaaatgtttgagaaggctgctcactattgccatagtacactaaaacgccagcttgagcacaatgcctaccatcctatagagtgggctatcaatgctgctaccttgtcacagttttacatcaataagctatgctttatggaggccaggcactgtttatcagctgctaatgtcatttttggtcaaactggaaagatctcagccacagaagacactcctgaagctgaaggagaagtgccagagctttatcatcaaagaaagggggaaatagcaaggtgctggatcaaatactgtttgactctcatgcagaatgcccaactctccatgcaggacaacataggagagcttgatcttgataaacagtctgaacttagagctttaaggaaaaaagaactagatgaggaggaaagcattcggaaaaaagctgtgcagtttggaaccggtgaactgtgtgatgccatctctgcagtagaagagaaagtgagctacttgagacctttagattttgaagaagccagagaacttttcttattgggtcagcactatgtctttgaggcaaaagagttctttcagattgatggttatgtcactgaccatattgaagttgtccaagaccacagtgctctgtttaaggtgcttgcattctttgaaactgacatggagagacggtgcaagatgcataaacgcagaatagccatgctagagcccctaactgtagacctgaatccacagtattatctgttggtcaacagacagatccagtttgaaattgcacatgcttactatgatatgatggatttgaaggttgccattgctgacaggctaagggatcctgattcacacattgtaaaaaaaataaataatcttaataagtcagcactgaagtactaccagctcttcttagactccctgagagacccaaataaagtattccctgagcatataggggaagatgttcttcgccctgccatgttagctaagtttcgagttgcccgtctctatggcaaaatcattactgcagatcccaagaaagagctggaaaatttggcaacatcattggaacattacaaatttattgttgattactgtgaaaagcatcctgaggccgcccaggaaatagaagttgagctagaacttagtaaagagatggttagtcttctcccaacaaaaatggagagattcagaaccaagatggccctgacttaatccttgtttttaaagaaaggaaatgtgcaatattgaagtgatctttttccctagtcagacaggcccaattccattgtgatgtttacctttatagccaggtgagtgcagtttgaacttgagatacagtcaactgagtgtttgctaggatcctaaggaacataaagttaattaaaaacttacacctaattatgtaaattgccttgttaaagacatgtgatttgtattttagatgcttgtttcctattaaaatacagacatttctaccctcagtttctaaatgtagactatttgttggctagtacttgatagattccttgtaagaaaaaatgctgggtaatgtacctggtaacaagcctgttaatatattaagattgaaaaagtaacttctatagttactccttctaaaatatttgacttcctaaattccccccacccaaaatctttcccttttgaaaatactaaaaactaagttatgttattataaagtgtaaaatggtttgtcttaattataggagaaaaaggccttgttagaaataaaataaactgacttatttcactaatgaaaa

SEQ ID NO: 110398 - DNA, 435 bp, Homo sapiens
cccatattaaaagaaattatgcaagtatcagttgcaaataaagctgtgtgatagttgcattcactgttgtttatttccccaatagctatgctttatggaggccaggcactgtttatcagctgctaatgtcatttttggtcaaactggaaagatctcagccacagaagacagtaagtttacctttgcatgttttacatagcttttaaaaaaagttttattttgaaattattttaaacttttgaaaagttgcaagaacagaagagctatcatatgcccttctaaatgcaccaatttttagtattttcctcgcttggaatcaaattttatttttctctctgaaccattggagagaaggttacatacattaggctcttttaccctttcatactttagtatatatttcctaagaagaatattttcttacataatcataga

SEQ ID NO: 110399 - DNA, 367 bp, Homo sapiens
cagctattctcaagatggcttctgaatttgccataatggaaagatacatttaatgctgcaattttaaagttatagccaaccatttaaagcctttcagctatgctttatggaggccaggcactgtttatcagctgctaatgtcatttttggtcaaactggaaagatctcagccacagaagacactcctgaagctgaaggagaagtgccagagctttatcatcaaagaaagggggaaatagcaaggtgctggatcaaatactgtttgactctcatgcagaatgcccaactctccatgcagaggctgcgtgagccgagattggaccactgcactccagcctgggcaacagagcgagactccatctctaaa

SEQ ID NO: 110400 - DNA, 2032 bp, Homo sapiens
  misc_feature (67)..(67): n is a, c, g, or t
ctgaagatacataactgctaccaagtacaatgtcatagacaagaacatggactctggagcccaactncctgggttcaaatctcagctctctgactaaccagccgtgggaactcggtcaagttagtcagagagtctccgtcgaactagttcgacggagactctcttgttcagaagagaaacttactgaacaagagagatcaaaaagatttgaaaaggtttatactcataacctatattacctagctcaagtctaccagcatctggaaatgtttgagaaggctgctcactattgccatagtacactaaaacgccagcttgagcacaatgcctaccatcctatagagtgggctatcaatgctgctaccttgtcacagttttacatcaataagctatgctttatggaggccaggcactgtttatcagctgctaatgtcatttttggtcaaactggaaagatctcagccacagaagacactcctgaagctgaaggagaagtgccagagctttatcatcaaagaaagggggaaatagcaaggtgctggatcaaatactgtttgactctcatgcagaatgcccaactctccatgcaggacaacataggagagcttgatcttgataaacagtctgaacttagagctttaaggaaaaaagaactagatgaggaggaaagcattcggaaaaaagctgtgcagtttggaaccggtgaactgtgtgatgccatctctgcagtagaagagaaagtgagctacttgagacctttagattttgaagaagccagagaacttttcttattgggtcagcactatgtctttgaggcaaaagagttctttcagattgatggttatgtcactgaccatattgaagttgtccaagaccacagtgctctgtttaaggtgcttgcattctttgaaactgacatggagagacggtgcaagatgcataaacgcagaatagccatgctagagcccctaactgtagacctgaatccacagtattatctgttggtcaacagacagatccagtttgaaattgcacatgcttactatgatatgatggatttgaaggttgccattgctgacaggctaagggatcctgattcacacattgtaaaaaaaataaataatcttaataagtcagcactgaagtactaccagctcttcttagactccctgagagacccaaataaagtattccctgagcatataggggaagatgttcttcgccctgccatgttagctaagtttcgagttgcccgtctctatggcaaaatcattactgcagatcccaagaaagagctggaaaatttggcaacatcattggaacattacaaatttattgttgattactgtgaaaagcatcctgaggccgcccaggaaatagaagttgagctagaacttagtaaagagatggttagtcttctcccaacaaaaatggagagattcagaaccaagatggccctgacttaatccttgtttttaaagaaaggaaatgtgcaatattgaagtgatctttttccctagtcagacaggcccaattccattgtgatgtttacctttatagccaggtgagtgcagtttgaacttgagatacagtcaactgagtgtttgctaggatcctaaggaacataaagttaattaaaaacttacacctaattatgtaaattgccttgttaaagacatgtgatttgtattttagatgcttgtttcctattaaaatacagacatttctaccctcagtttctaaatgtagactatttgttggctagtacttgatagattccttgtaagaaaaaatgctgggtaatgtacctggtaacaagcctgttaatatattaagattgaaaaagtaacttctatagttactccttctaaaatatttgacttcctaaattccccccacccaaaatctttcccttttgaaaatactaaaaactaagttatgttattataaagtgtaaaatggtttgtcttaattataggagaaaaaggccttgttagaaataaaataaactgacttatttcactaatgaaaa

SEQ ID NO: 110401 - DNA, 2661 bp, Homo sapiens
  misc_feature (2545)..(2545): n is a, c, g, or t
gcggccgcaacgtgtcgagagccgtaagtaaagtgtcgcaaagcagaaggaaggcgggagtcccgactgcaaacattgaggaaagccaggcagtagaggccgctatggcgaacgttccgtgggcagaggtctgcgagaaattccaggcggcgctcgctctgtcgcgggtggaactgcataaaaatccggagaaggaaccatacaagtccaaatacagcgcccgggcgctactggaagaggtcaaggcgctgctcggccctgcgcctgaggacgaggatgagcggcctgaggccgaggacagcccgggtgccggtgaccacgccctggggctgccggctgaggtggtggagcccgaggggcccgtcgcccagcgagcggtgaggctggcagtcatcgagttccacctcggggtgaaccacatcgacacggaggagctgtcggcgggggaggagcacctggtgaaatgcctgcggctgctgcgcaggtaccggctctcgcacgactgcatctctctctgcatccaggcgcagaataacctgggtatcttgtggtctgaaagagaagaaattgaaactgcacaggcttacctagagtcatcagaagcactatataatcagtatatgaaagaggttgggagtcctcctcttgatcctactgagcgttttcttcctgaagaagagaaacttactgaacaagagagatcaaaaagatttgaaaaggtttatactcataacctatattacctagctcaagtctaccagcatctggaaatgtttgagaaggctgctcactattgccatagtacactaaaacgccagcttgagcacaatgcctaccatcctatagagtgggctatcaatgctgctaccttgtcacagttttacatcaataagctatgctttatggaggccaggcactgtttatcagctgctaatgtcatttttggtcaaactggaaagatctcagccacagaagacactcctgaagctgaaggagaagtgccagagctttatcatcaaagaaagggggaaatagcaaggtgctggatcaaatactgtttgactctcatgcagaatgcccaactctccatgcaggacaacataggagagcttgatcttgataaacagtctgaacttagagctttaaggaaaaaagaactagatgaggaggaaagcattcggaaaaaagctgtgcagtttggaaccggtgaactgtgtgatgccatctctgcagtagaagagaaagtgagctacttgagacctttagattttgaagaagccagagaacttttcttattgggtcagcactatgtctttgaggcaaaagagttctttcagattgatggttatgtcactgaccatattgaagttgtccaagaccacagtgctctgtttaaggtgcttgcattctttgaaactgacatggagagacggtgcaagatgcataaacgcagaatagccatgctagagcccctaactgtagacctgaatccacagtattatctgttggtcaacagacagatccagtttgaaattgcacatgcttactatgatatgatggatttgaaggttgccattgctgacaggctaagggatcctgattcacacattgtaaaaaaaataaataatcttaataagtcagcactgaagtactaccagctcttcttagactccctgagagacccaaataaagtattccctgagcatataggggaagatgttcttcgccctgccatgttagctaagtttcgagttgcccgtctctatggcaaaatcattactgcagatcccaagaaagagctggaaaatttggcaacatcattggaacattacaaatttattgttgattactgtgaaaagcatcctgaggccgcccaggaaatagaagttgagctagaacttagtaaagagatggttagtcttctcccaacaaaaatggagagattcagaaccaagatggccctgacttaatccttgtttttaaagaaaggaaatgtgcaatattgaagtgatctttttccctagtcagacaggcccaattccattgtgatgtttacctttatagccaggtgagtgcagtttgaacttgagatacagtcaactgagtgtttgctaggatcctaaggaacataaagttaattaaaaacttacacctaattatgtaaattgccttgttaaagacatgtgatttgtattttagatgcttgtttcctattaaaatacagacatttctaccctcagtttctaaatgtagactatttgttggctagtacttgatagattccttgtaagaaaaaatgctgggtaatgtacctggtaacaagcctgttaatatattaagattgaaaaagtaacttctatagttactccttctaaaatatttgacttcctaaattccccccacccaaaatctttcccttttgaaaatactaaaaactaagttatgttattataaagtgtaaaatggtttgtcttaattataggagaaaaaggccttgttagaaataaaataaactgacttatttcactaatgaaaaaaaaaaaanaaaaacaacattgcggccatcgaccaaaacttaaacaatcgtgggggggccgaggtcagaaagggccacggcccgaagacggcagacgggtgtctcacaaagcgggccacgttgaa

SEQ ID NO: 110402 - DNA, 1695 bp, Homo sapiens
gcggccgcaacgtgtcgagagccgtaagtaaagtgtcgcaaagcagaaggaaggcgggagtcccgactgcaaacattgaggaaagccaggcagtagaggccgctatggcgaacgttccgtgggcagaggtctgcgagaaattccaggcggcgctcgctctgtcgcgggtggaactgcataaaaatccggagaaggaaccatacaagtccaaatacagcgcccgggcgctactggaagaggtcaaggcgctgctcggccctgcgcctgaggacgaggatgagcggcctgaggccgaggacagcccgggtgccggtgaccacgccctggggctgccggctgaggtggtggagcccgaggggcccgtcgcccagcgagcggtgaggctggcagtcatcgagttccacctcggggtgaaccacatcgacacggaggagctgtcggcgggggaggagcacctggtgaaatgcctgcggctgctgcgcaggtaccggctctcgcacgactgcatctctctctgcatccaggcgcagaataacctgggtatcttgtggtctgaaagagaagaaattgaaactgcacaggcttacctagagtcatcagaagcactatataatcagtatatgaaagaggttgggagtcctcctcttgatcctactgagcgttttcttcctgaagaagagaaacttactgaacaagagagatcaaaaagatttgaaaaggtttatactcataacctatattacctagctcaagtctaccagcatctggaaatgtttgagaaggctgctcactattgccatagtacactaaaacgccagcttgagcacaatgcctaccatcctatagagtgggctatcaatgctgctaccttgtcacagttttacatcaataagctatgctttatggaggccaggcactgtttatcagctgctaatgtcatttttggtcaaactggaaagatctcagccacagaagacactcctgaagctgaaggagaagtgccagagctttatcatcaaagaaagggggaaatagcaaggtgctggatcaaatactgtttgactctcatgcagaatgcccaactctccatgcaggacaacataggagagcttgatcttgataaacagtctgaacttagagctttaaggaaaaaagaactagatgaggaggaaagcattcggaaaaaagctgtgcagtttggaaccggtgaactgtgtgatgccatctctgcagtagaagagaaagtgagctacttgagacctttagattttgaagaagccagagaacttttcttattgggtcagcactatgtctttgaggcaaaagagttctttcagattgatggttatgtcactgaccatattgaagttgtccaagaccacagtgctctgtttaaggtgcttgcattctttgaaactgacatggagagacggtgcaagatgcataaacgcagaatagccatgctagagcccctaactgtagacctgaatccacagtattatctgttggtcaacagacagatccagtttgaaattgcacatgcttactatgatatgatggatttgaaggttgccattgctgacaggctaagggatcctgagctacttgagacctttaaatttcgaacgaagccagagaacttttcttatagggtcagcactatgtctttgaggcaacacgagcttctaacagatc

SEQ ID NO: 110403 - DNA, 1243 bp, Homo sapiens
gcggccgcaacgtgtcgagagccgtaagtaaagtgtcgcaaagcagaaggaaggcgggagtcccgactgcaaacattgaggaaagccaggcagtagaggccgctatggcgaacgttccgtgggcagaggtctgcgagaaattccaggcggcgctcgctctgtcgcgggtggaactgcataaaaatccggagaaggaaccatacaagtccaaatacagcgcccgggcgctactggaagaggtcaaggcgctgctcggccctgcgcctgaggacgaggatgagcggcctgaggccgaggacagcccgggtgccggtgaccacgccctggggctgccggctgaggtggtggagcccgaggggcccgtcgcccagcgagcggtgaggctggcagtcatcgagttccacctcggggtgaaccacatcgacacggaggagctgtcggcgggggaggagcacctggtgaaatgcctgcggctgctgcgcaggtaccggctctcgcacgactgcatctctctctgcatccaggcgcagaataacctgggtatcttgtggtctgaaagagaagaaattgaaactgcacaggcttacctagagtcatcagaagcactatataatcagtatatgaaagaggttgggagtcctcctcttgatcctactgagcgttttcttcctgaagaagagaaacttactgaacaagagagatcaaaaagatttgaaaaggtttatactcataacctatattacctagctcaagtctaccagcatctggaaatgtttgagaaggctgctcactattgccatagtacactaaaacgccagcttgagcacaatgcctaccatcctatagagtgggctatcaatgctgctaccttgtcacagttttacatcaataagctatgctttatggaggccaggcactgtttatcagctgctaatgtcatttttggtcaaactggaaagatctcagccacagaagacagtaagtttacctttgcatgttttacatagcttttaaaaaaagttttattttgaaattattttaaacttttgaaaagttgcaagaacagaagagctatcatatgcccttctaaatgcaccaatttttagtattttcctcgcttggaatcaaattttatttttctctctgaaccattggagagaaggttacatacattaggctcttttaccctttcatactttagtatatatttcctaagaagaatattttcttacataatcataga

SEQ ID NO: 110404 - DNA, 593 bp, Homo sapiens
ctgagcctatttctcatcacttattgcttttatattataattgtacatgtgctatctatttaatgtctgcctgtcccactaaaatgtcagtcccaagaaggcagggtctatgtctgtcttgatcactgaacagtgcctggtacctaataggtgctcagctgacattaattgagtaaattaattatacccatttggttgatggggaaactgaggctgagacaagttcaggaatgcacctgaaatcactcagatagaaatcagccatggacctggttcctttttactgatgccaccctggggccagccacctcatgtgccgggcatggtgctggccttggcaagggccccatcatccccagcttcctcgtctgtctcatacagagggaggagactccgaggtaagctgcattcttgtccaagaatagtaatgattcactccagggtgggatccaaaaaagaactgcctggacgtctgttttgagtcggccgccctgctgccgtccagccggcactcagagatgtaaatacgtcctcctagcgggccaaatcgtttccttttgactgcacgccagccatttattggccatggctct

SEQ ID NO: 110405 - DNA, 731 bp, Homo sapiens
ctctgttatttgacaaattttgagactgagactttgagaggttgagtaacttaggtggaatcacacaggagggccaaagccaactccttttctactttcatcacatatctagggactctgacacctagattctaattgctgattcctggaatggttgcttgtctttgtcatttttatggcttctttctcatgatataaaatgcaattctgggctcagccacactctcagagcctaattaagttggtgttttaaatacttacctgggaggcatcgaggtttggacgtatgattgtgtgtcagacaactcctgtttgaatgtcatttgtaccacttcttaactgtgtcagtatgaacaaggcacttaacctcttggattctagtttcctcatccataaacgaggaaaataatagttaccttttgaagtcattttgaaaattaaaaagatactacctatataaagctacttactagtcataaatttatactcttgctaaaaacacttttgcctttttcgttagacgtgtttagcgtatctgtgtttatgtgtgtgttccatttgtctatttataagcatactatgtggtctgataatttatgaatgagaaaaacagatgcagaaaacatctgggagagatgtttttgggagatgttttgggagatgtttgggagatgttttgggagagatcttaataatggttagtagtatacatttaaagacaaagcagaata

SEQ ID NO: 110406 - DNA, 395 bp, Homo sapiens
agaggatcgcattggcgaggagtctcctgagtcttggagtcttggcttaaatgctgctacttctatttctgtaacctgattttcagaattaactcattatttttctcccacacagtgctagcctgatacctctacttatctattttttccttatgactttttagtttatatacatgaaggtctttcctggattataaactccttgagagatgtagaggaaaatcttaatcatttctgatttcctctagtgtgcaatatagtcttttacatagtactcatttgttaaatgtttgactgaattaactcaaaatttacagtctctgatttcaggaggaggaggatagagttggaataactttgtatgagaacttagtgaatccacgtgacacactcag

SEQ ID NO: 110407 - DNA, 2355 bp, Homo sapiens
  misc_feature (981)..(981): n is a, c, g, or t
  misc_feature (1744)..(1744): n is a, c, g, or t
tcagttcttattctctggtcttattggttcctctgcataaggatgcagtcttttatctttacagtttctttgacattttcctctgtcccatcattctctgtttctcaccacttctgtttcattttggtctcaatctttaatattggagacattcctcaaatgcatgaagatcctcagtggtcatttatatttaaaagatgtgaaaagctgaccgaaagctctgggtgtgaagtcagagctcttgtctattggtaaactatgctgtaggaaatcttcatatcacaatttttctttaggttagttttgttttctctagttttgaatcctttccagaggaaatctatagtcttctctgtgggggctgcttatgttttagagaaatactgaagaaagggactttgggtctctttagagttgcacataatcttctggttttagtcatatctacttctgtatctattgaagtccaaagcatcttgagtttagtttttccagaaattatgccttctgatttctgcatgattgggaagtcactgagtacaccaactggagttggagacctggaattccagtagttccaggaacctcctagtcctgaacttaatggggtttcatgagaattgactggcttctttaggcacttaaatttaacattcctcacctctggtgaggtttttgtttgttgtttgttttttctccctgtctttgtatattatggtttagggttacagttttccagcttcatcaaaaaaagagtttttctcattctccttgtttagaaatgattggtgacacaaaggtctgtactctgatattttaagatccgaagtgtattctaccccttttttataaactattttgcagctgttccttcacgactttgctacatcttggagatcttttcatgtcagtacctacaagtctatatcattgatattatcagctatatagtactccataaaatgctttattataatttangtaatcatcttcctattgatgaagattttggtggtttctagtttttgctttcatgaatattgttgcaatgaatattgtttggcttacttttgggtgaatttttacaaagacatccatataataagttcccagtagtggggttgcctaatctaagaataagtgtatttaaaatttgaatcatattgtcagactgtctcccagaaagtttacattcctaccaacaatctgagagagctgtctttgcagttactaggtttcatcaaacttgtttttttcagtatggtaggtttaaaaatggggatacatttttgtttttatttgcatttttaaatattttcttaggttagttggctacttaaatttctttttctgaaaactttgtatttatagccttttaaaattcttattgacttgcctgaactatttgtaaattacagaaattagccctttgtcgtatgtgttgcaggtgcttttccagtttgccagtggtcattcattttggtttatggtacttttgatagaccagaatctttgacttttatttagtgagatttatccatctttttctgtgtggcatcttggtattatagcattaatattctcttttcttttttttttttttttgagatggagtctcactctgtcgcccaggctggcgtgcagtggcctggtctccactcactgcaacctccgcctcctcgtttcaagtgattctcctgcctcagcctcctgagtagctgggattacaggcatctgccaccanacccagctaatttttgaatttttagtagagatggggtttcatcatgttggtcaggctggtctcaaactcctgatctcaggtgatccgcccgccttggcctcccaaagtgctggaattacaggcatgagccaccacgcccaggctatagtttttctttatctgaacaataactaattataaagtatagtggaagagaaaaacccattcagaaaattaacaaaaagatcacttatctagaaataaacttaaaccatagcagagcttacatgaagaaatcttttaaaactgagcaaggatttgttggacaggacacagcactaatctcaaaagaaaatttgatgaataggtcttattcatagtttttgctcatcaaaagacagcattaagaaaatgaatagacaagccacagaatgagttaaaaaaacagaaattcccagcatttacaagggattaaagatgtgtatcagaatatataaagaacctctgaaggccaggtgtggtggtttacacctttaatcccagtgctctgggaggccaaggtgggaggatcatttaaagctaggagttcaagaccagcctggtaacatagtgaaacaagattctgtctttac

SEQ ID NO: 110408 - DNA, 341 bp, Homo sapiens
agcgatctagggcagccctgcagaggtgcctgttctactgtaatcgctatattaaccacatgcagatgcctgcgctttgagcacaaaacataccaaggaccagaatgagaggagatgctcaggaaggagaatgatacaagcgatggacggaagtcacaggattcaggaactaagggaacatgaggggtgaggggtcaaaaacaataaagaggatgcctggctttcaggcatgaatgactggacagatgaggatgaaatcagcaaatgcaggcaacccaggaagatgagcaggcaccaaagaaaagatgacaaatcccatctcagaaatgcctatgtggaga

SEQ ID NO: 110409 - DNA, 379 bp, Homo sapiens
ttggaactcatggtgtgaattctgacagatcagggagaagtttttcttgagcactaatataacttgtcctttcaattcagatttttgagaaaaggtttcaccattggactgtttatgctcattttacagttgagactttttctttttatattacatggaaataatttgcacatatattctccctaactaaaaacatcacctatcagtcttactgaattcctgtgcccagtgtctgcaaggtgcccactgtctgcagggtgcccactgtctgcaaggtgcccagtgtctgcaagggtgcatgtgacaaagtcatccctgcttcagtgagagaatagatggcccaactctccatgcctgtaatcccagcactttgggaggc

SEQ ID NO: 110410 - DNA, 645 bp, Homo sapiens
gcctctttgccagtcacaaagaacccttaattgccttgtaaaatgtagtccagccctcttcacagattcgcagattacagagttattcatccaaacaatttccacgtactgcatagagggtttcatggacagtagccttgattcagaccaacctgtatctctgcaaccctcactacagaccactttttcacagtggagttgctatttggctatggcttaaaggatgacccagaattcctcaagcatagaaagaggggaagggcagtaagaagaccagtgtggttggaacagaggatacaaggatgtgtgtgtgtatgtcaggaagggataaaagttgaggctagattattcacaagactattcacctagttgagtttggacttcatattgtgcaggtcagcatttcacagaagactagcccatgaagatgctaatcaatgctccaagatcaaggagctcacttgtttaataagttggggatttgaatgctgaatcccctttttaaagagtcacagttgattttagaaaactgaaggctctgagaagtcctgcaatgaaaagaaaacctgcttaattttgtataaaggttaatccaactttttttttttttttgcaaggaaatgatttccccccttccccagcccc

SEQ ID NO: 110411 - DNA, 393 bp, Homo sapiens
ctcgtgcgtctaatttttcaatattttccagaaagctcacagaatcataaaaaatatattgttattttaggccacttagtttggggagtttgttgcagagtaatagataagtgaagcagcaaagtacagaggggcttttatctaagagagctgatttatcattggatatctcagaaaaccacaacatttccaaaagaactgtatcagcttgagctgaaaaagattgagacagttcaaaatgaaagaagtttctgggtcctcaaacttctatggggaataagcaggttaagaaactttctccagttgcaagcatgggtcgttcctaatgaaaaaggcaggatgtcacggagggcggaggcaagagccactgctttcttaagcaggttacgaaag

SEQ ID NO: 110412 - DNA, 675 bp, Homo sapiens
tttaaaaaactgataaattagattttattaaattaagaatgtctgctgatcaaatcacatcaagaaagttattaagcaactgtgatggttaatattgagtgtcaatttgattgggttgaaggatgcaaagtattgttcctgggtgtgtgtgtgagggtgttgccaaaggagattaacatttgagtcagtgggctgggaaaggccacgcacacttaatcagggctgccagtgaggccagtataaaagcagtcagaggaatgtggaagggctagactggctgagtctttgggctttcatctttctcccgtgctggatgcttcctgccctcgaacattggattttggactcttgaaggacttataccagtggtttgccagggaatcttgggccttcagccccagactgaaggctgcactgtcagctttcctacttttaaggttttgggactcagactggcttccttgctccttagcttgctgacaacctattgtgggatgtcaccttgtgattgtatgtgtcattactccttaataaactccctttcatgtatacatctatcctgttagtcctgtccctctaaacaaccctgattaatagagcaactaatagactggaagaagatattcatgatacaaatgtctgacaaagatcttgtatccaaaatatataaagaac

SEQ ID NO: 110413 - DNA, 555 bp, Homo sapiens
gcggctcggacccagagtccaaaagggaatccatctcaaataatttagatgctaaactattgaccttccttgtggggaagaccgttaagtgatagctttgtcctaaattggttttgtttgctgtaaataaggcatttcttttatgggtgagtgattgagtgcacagacccacagtagtgagaacattcctgccctcgtaccctggtctagttctgcaggcgcaaagcccagaaagtcactgaaatatggcatatttgggggaggaaaggaaattacataagtaacctcagatcatttgtccttcagctgtctttaccactcaatctgcaattgtcacttgatgcatcactttctgttacttgatggaaaagttttactgaagaacttgagagatttggaaatatttgaacaaatgataatatcagtacactaatgaaacttggagattaatcttgaaagtttgtgaggaaggtggaggtgatgaataaggcagtccaggtgaattcatgcagaggcagaggtgagagaacagggggagagtagttgtagtgagca

SEQ ID NO: 110414 - DNA, 526 bp, Homo sapiens
ccaaaagagttgtgttaaaaaagttactatctccccttccttgtgggcaagacagatgaattttggcgtagccctaaatggggttttttcctggaaatgggggacttccttttatggggcctcctatgatggcaaatacagctcctattgagaacattcctgccctcgtaccctggtctagttctgcaggcgcaaagcccagaaagtcactgaaatatggcatatttgggggaggaaaggaaattacataagtaacctcagatcatttgtccttcagctgtctttaccactcaatctgcaattgtcacttgatgcatcactttctgttacttgatggaaaagttttactgaagaacttgagagatttggaaatatttgaacaaatgataatatcagtacactaatgaaacttggagattaatcttgaaagtttgtgaggaaggtggaggtgatgaataaggcagtccaggtgaattcatgcagaggcagaggtgagagaacagggggagagtagttgtagtgagca

SEQ ID NO: 110415 - DNA, 379 bp, Homo sapiens
ggatggggaggccatggtcaggagcttctgtgctgggccttgcggccacagagagctgaactggggtgacatgcggagcctgggctcataaccaggtggtgcagccgttgggaggggtgtgctgctgcctgagggactcagaggagactagagggtatgaaagagattcctgggagtggcataacaaatgaccacaaacagtggtatagaacaacaggaactgatcgggcgtggtggctcacgcctgttatcccagccctttgggagaccgaggtgggcggatcacctgaggtcaggagtttgagagcagcctggccaacacgacaaaacccgtctctactgaaaatacaaaaattagccgggtgtggtagtgcgcacc

SEQ ID NO: 110416 - DNA, 470 bp, Homo sapiens
tttttttttttgagatgggggtctcactttgttgcctaggctggagtgaagtgatagtcacaggcacaatcatagctcactgcagcctcaaactcctgaccgtaagctatcttctcacttcaacctcccaagtagctgggacaacaggcacgtaccatattttgacacgatctacctggagatagtgtcagatcctataggttgagggctcaagactgcaccccccccttaccccacccccaccttcagatgccagtcacaagctccaggttacctgtgcttctgattgacctgctataaagtggggctcccacgaccacttccttgggttcagttaatttgctagagcagctcccagaactcagggaaacacttactttctttttcacagctatgtgaattttggaacagaaacacttatacttaccaatttatttaaagaatattacaaagaacacagatgagaagat

SEQ ID NO: 110417 - DNA, 259 bp, Homo sapiens
aactcccaatattaataaggtcagaatggcaggggtagaacagaaggaaactgaaagtaagaaaaaaactcaatgatgagaaaaatgtctattaatgacactggaagatataccagtgccaccagttcatagataagtgaccaaatggccaacgttctcactgcttgtccattgcaaggatgctgcagcacagcagggctcctaatgaaagaagcaatgccacacaggtgtggtggctcacacctgtgtaatcccagca

SEQ ID NO: 110418 - DNA, 731 bp, Homo sapiens
gtcaagaagagcatgcttcagttggctggagtgagcaattcaacttgtggaggagtgagaaatgttagtgttgagacaagaaacgtaaaaccccagggtaaggtaggaatcagtgaaaggcagaggaactgccgtccagtaatgagttaggctttgctggcttctggccctacagatgactctttggagaggaaaaaattaagctaggcccgagggcacagatcctaagggaatgctggcagcctaggctgtctatggaagagaagcagagggtggcacctggttgaaagagggggttgggggacagagcttgaggctgtgtttacagatggagtcctctgattcctgtgactggggaaggagatcgtgctggatcagggcacctcaaatcagaactcttcccacccacaccccttcttttcagggcgtctttcattgcaaacagtagataaactagttggaaaactcagcagattctcacggtggtgcctagcaggccaggcctagctgccgtttaagctgtgactgagggtgatgccactggcctgtaaacacacattggacaatctttacgtccgtggacacgccatgccccacagagacagctgtgcatggttctttaggtttggggtgctgtgctggcagttgcctgataaatgtgtaggattaaaatgggatgccctggagcttagctaacctttatcccccctcccccctctaaaatgaagggg

SEQ ID NO: 110419 - DNA, 640 bp, Homo sapiens
gtaattgtgaagcaatagggtccaccagtctgcagctcaaaattctaggctggaggccgaggcgggcgattacctgaggtcaggagttcaagtctagcctggccaacatggcaaaaccctgtctctactaaaaatacaaaaaattagcctggcatggtggtgcacgcctataatcccagctacttgggaggctgaggcaggagaatcacttgaacccgggaggcggaggttgcagtgagctgagatcacaccactgcactccagcctaggcgacagagtgagactccgtctcaaaaaaaaaaaaaatctaggctggaatacttatttgggatctttgttgttcaatacagtaaccactagtcatacactagtatgtattaaataaactactattaaataaactagtattaaatttcatagtaatgaaatttaaatttatatttattaggccgggcgcggtggctcaaacctgtaatcctagcgctttgggaggccgaggtgggaggattgcttgaggccaggagttcaagaccagcctgggcaacaaagtgagacccctgtctctacccccccaaaaatatattaaaattatcatttcagttatagttctttagtgggtctcagtcacactaagaactag

SEQ ID NO: 110420 - DNA, 382 bp, Homo sapiens
ggtatgtgttgtgttgtgtgtgtgtgtgtgtgtgtgtgtgtgtgtgtgtgtgcgcaggtgcgtgcgtgtgtgtgtaagaatatcacactttagacggtattttcacatcagagaactgtgaggctggatgagatcattaaggagaggaggagtacgtagagaagataagttcaagggcagagtgagtttaggggcactccagtgttatgaggttaaggaggtgagatggaaccattacaggagacctgagaggattggctagggaataggagaaaaaccgtaagagtatagagttctggaagtcaagtgtggaaagtgtttcaaggaggaaggtgtgatcaactatgttaaatgctgctgatagatgaggaggaagtattaa

SEQ ID NO: 110421 - DNA, 296 bp, Homo sapiens
agatctagaggatccagagagagaagaagtgtcaataactatggagtatttaaataagacagcaaggcaaagagctcattaaccttggcaaatgagaagtctatcattattgagggcctgctctgccagattcagtttatgcatcaccccagatgaacacaactaccttgctgctggctgaaacagtctgcccagttcctgttgcaatggctgttcctgggccttcatatgttgttgatgcaccagcctgacagtgcattgacttctaccccttctgtcgtcttctctcaatccca

SEQ ID NO: 110422 - DNA, 140 bp, Homo sapiens
ctgttaggaagtgattcagtcatgaagggagagtcttcatgagtggatttagggtccttacacaagggctagagggagtgggcttcccctgttttgcccttctgccttctgccatgtgaggacacagtgcatcccctcct

SEQ ID NO: 110423 - DNA, 280 bp, Homo sapiens
cagtcattcatcaccatagaggccatcacaatcaaaaaccacacatccacctttaggataggcctgcattgttgtgacaaagagtgtgcacacatcaagactatgcaccgtttaaaacgtgttgccaaactgctcctcagaaacacactgatccatgttccttctaacgggtgtgagggtgcccctcaatgcacattatacactgagtattataattcttaagtccacctgggtggtgagtagaaactggcctcctttctgagtgtcttcctcccttctc

SEQ ID NO: 110424 - DNA, 682 bp, Homo sapiens
acctacttgcagaaacacaccaaatcaccataggaaagaatcttacggatatttcatcagattcccacaatgtataatcagataagtattagttcacaaccaaagacatgaagcgacaagaggaaataagccatctatattagaactgttagacatagaaatgctgtttatgaagtacttaaaaagtaaaatataggatcaaaatagtgagcaaacaacagaaaattatcaggaataatcaggcaattcttacaaataacacaatggaatgtctacataaaatacgtaaacattgaaagaaaacacaagacatgttaaaaagcagactagccacagatgaaaagagaattaatgaatttgtaggttgaagtgaataaattaaccagaatataatcttgaaagaaaaagggccagaagaagttagaataatttaaaatgttgaggataaaataagaaggtctaacataagtcaaatcagagtcgcagaagaaaagaattaagtcaaccaagaagtgataataaaattaatcaaggagaagtgttcagaaatgctgaaagctgtgaatccccagtttcataaaggacagtattcccaagcaagacgaaaaagaaaaccaatagctggcatagtggtggctctctagagaaacaaggcaaaaatgtttaaaagagccagagagta

SEQ ID NO: 110425 - DNA, 1985 bp, Homo sapiens
ctggagtactagatacttaggtacttaagaaatagcctttaatcccaaggccttacttaaaacttaagtttaaacacaatctctgatgtgatgagtggaaataattcttttgtgttaaaacatacagacaaaacaaagctatatggccagaataataaccgttattgtatcttgtggaacaaaaaagggcatggtgattgctctgttcctcagggaaacacattgaatgtcttgttttcagacaccacatctgatgcatatacagatgtatgattggagtagattatttctaatgccccttaagctctactactcagattctttccttctccagagtaatggtaatggattttaagctgtgaaaaagcagttaagtactgccttcacccgctaagtaaaggcctattctaggctacttaccttgcacccattatgaggtgtaaaaccaaaaatgttgtgaaatcaaatttcattgaagtctcatataactttatggagatggttgagtatttcttcttggaaagaaggaggagaatcatcacttgattgtgattaattacaacataggaaacaagaaacaatagttttatcctaacctgtccttacgaacattagtaactgtgctgttcattatttttagtaacagcacataggtaatacaggtgttatatcatgttttccttcacactggaagttaataacacattcttcttatggatgaaaatgactgaagaatcaagaattactagcaactcttctttccagtagcttagaaaactgcctttttcaagacagatgcaattttacttaatatctctgaagcttattttatcatctatgaatttaaggagatgagaattaatactaaatgattttttaggtccccttcagtttatgaagtactcctgcagtagaagttcatggccttgaaaaagcgtactcaaaattactctatttccacctagtggtgaaaccgtaatatttctctgaggctttacttgataaacgtgagtagtttttcagcttctcattctgtaatcacacacagctttggagcatattgtgtcatttttatttaaagacaacttcccagttaaagtttatgtacatagatgtgccttccacaaagttgattattgtatattagttcttcctaaggacagttaagtgttggtggcttagcaacaggcagttggtagagaaatggagagtactacattaaattattgcagagaatattcaaagtaatccattttcagggaactgagtcttctctaagtacatggccagatgatcaaaaaagggaaaaaaattaatcactaaggttggagaatatgtttatttaaacctagtgtctcccttaaattttataactagatttttgaccctcactcatctggctttccttgctatagacatgctttgcatacccagcttctagccacatcttccctaagaaaatttcacctggaatcagttccaaaagaaaatcttaagagatagagtatggatctgcatgttgtcagctacctaaagcagcaaaaattcctagatgagaataaaatcagggaaccttgcagtttaaggcacaccttaaatattaaatttttaatccttcaatgcatccagccaaaacaagaaattgcaaatagctaccatccatcaatgcaaggtttttttggtttgtttttcataataagattggttttaattaaagcacttataaagatggagttatattttgaactttgtccttttacttaaagcagttagagtcttacacatcataactgccacggctaaccattaaaattttccagctccttaaatgatccatcataaacttgtgcttgctgagttaactggactagaggatagctggagggaaaatgaggcattgcaaaagttacagtaataaaaagtgaatggcttcaaaataaggcagaggacataatggctcattttataataaaagctttcagtat

SEQ ID NO: 110426 - DNA, 207 bp, Homo sapiens
tgtgtcagaggtttgggggtaggtgttgtagcaggagcttcctgtgggtcaggacccaggtggtgttggggctggtcttctattagcacagaccttcaagatcagggattgggtgtcctgggcaggcagagcctggaggcaggggcatggctgtcatgacctctttgaagaccttcctgcctggagaattctctccccattccctcc

SEQ ID NO: 110427 - DNA, 2884 bp, Homo sapiens
catttgctatgaatattctctataacaaagcaagacaaatttagcagcacttcattgcatctggatgggggagagagctggacaatttcttgctaacaagagatggttaactgccctcacctcagccgtgaattctgcacacctcgcatccggggcaacacctgcttctgctgtgacctctacaactgtggcaaccgggtggagatcactggtgggtactacgaatacatcgatgtcagcagttgccaagatatcatccacctctaccacctgctctggtctgccaccatcctcaacattgttggcctgttcctgggcatcatcactgccgctgtccttggaggctttaaggacatgaacccaactctcccagcactgaactgttctgttgaaaatacccatccaacagtttcttactatgctcatccccaagtggcatcctacaatacctactaccatagccctcctcacctgccaccatattctgcttatgactttcagcattccggtgtctttccatcctcccctccctctggactttctgatgagccccagtctgcctctccctcacccagctacatgtggtcctcaagtgcaccgccccgttactctccaccctactatccaccttttgaaaagccaccaccttacagtccctaaagaggaatgcctgctggctattgagattattgtggcttttgtatttctgcttcagtggaagtgtgtagggtacaaaatttaaagtgtgactcttatgcataaagttttacaatggcctgccaggctagggaaagatagggacgaagcttattcattattagtgcagagcaggggtggtcaggctgaacgcagcacagaagggcagctcacattctctaagcaagactggggagccagcccagcaagaagcttgtttggacttgcattaccctatgctccacctctgtattcagcagaagtgtggttgccatctttttcactttatgtaaaggagtgttgccctcgggcccttggcagattgccaccccagcacctaggttgaagcacctggtttataggccctatctttccctacccctaaagtcagtccctaaggacaatttcccagctgatggggctacacagtagttccaatacagagagttctggctaagattttgtttgcttgtgtctggatgttgaaaaagactgcccgtatctcttactccttccttctctgtgagtattgtaaaaatggctgttgtgatcactcagctcagcttttgttattggtacctcctaaagggaaaagtgcaatattcttgcatcttcagtagtggggaacaggatgtattgttccggaaacactgaaatacacagcaacatgtgagatgttttaagtagatcacttaggagacagtggttctactacatgttgcattattacaaaatacatttgctacaggagatataaatcttatggttgtaattcagagtttaaaaatgttataaattaggttcttgggtcgtgatatgaattgttactaatctttgtgactatttaatcttcaaatattgtgcttaaccccagcaatccgcacgtatcctgcaccccaccccaaaagagtcatctgtattttaatgccactggtcttatcggtccttttgtctgttgagaccagtcatgacagcattcaagattatgaaagtgttacaatgccgcttcaagtctgcaaaacctcaaacgtagccaacttgacaaatatttaagtgttacggcagatttaaaatccatctggcacaccgtggtaggtatttgtacagttcttttaattacacatagctttaaaccatcaacctgatgagtttaaagcttttgcacccatgccttcacttcagaatgaacaccttcattgtgatcttatgttaacctgagaattgatttaaaggaagattgataatcctatactttataacgtaaaaatacaggggctacaggagggtacctaattagacagttctccaaacacagaacacacactggaaaattttccggccaattttgctacctcccaacttgatggattagaggtagcgcaaatgctggtgctcccatctaccttgtagacacttagccatcaagaatcaaggcacaagaagtgcactctctcattaacagtaaatgtttgcaagatattcagtttaactttcagcatcatgaatgttcttatccagattttgaatccgaaaaactataatccttttatgttatacaaaattactatgattttttacagttctgagcatattaaaattctactggatttcaaaaagagactaatacccaactgactaactaaacaaatatcaacttgtaatactcaatgaatttttttgccatttacatttgaccgttggctttagtgaatgtccatatttaattttttaaggcaccattacacagtttatcctacatttatcacatttcttaaagtgttaagattctatggctcatttctatgtatttttcttactttacaaaataacctgaaacagtatagattttgtaacacttaatttgagcagcttttttattacattgaattatataaagtgcatgttaccttagaaaaattaatatttgctgctttactcttttgcaaaacatttgctgtaatgaatggatttgtatttccaatatgtatcttgactgcattttgtaatatttactgctttattcctaattctgctttaaagtactgaactgggcatgaaacattaaaatattaatccagaaactgtataaactggatgttgcttaaaatctgtatcactgccatgttgaaaactcagactgcttttgtgatgtttcaaatgaataaaactatcctcccctcgttatcca

SEQ ID NO: 110428 - DNA, 506 bp, Homo sapiens
agagcagagggaggcagaagaggagggagggagaagagtggaagggagggggaggcggcacttgggctgcagctcgcaaccagaggcagtgtctctcagctctcggaaggaccgagagaggcaaccgcggagtaggatgctctgcggggcgcccagagccgggggcgcttgaagcagcttcggggactggggcaaccgggcagttttcaccatgcatcagtccctgactcagcagcggtccagcgacatgtccctgcccgattccatggttcctgccatcagtctgctcaggtcttctccgatgaatttgcgggaacatctcgagtggagggggcagggagaagatcgaaccccctatataatctccctactgcccgcagaagactcagtgtcaacaaaactcgttcaccggaggggccccagaaagtgttatctcctggatggtggaaagatccgtatcctcaatggttttgcatattcagtataagaatttgctttttcatttt

SEQ ID NO: 110429 - DNA, 3413 bp, Homo sapiens
agagcagagggaggcagaagaggagggagggagaagagtggaagggagggggaggcggcacttgggctgcagctcgcaaccagaggcagtgtctctcagctctcggaaggaccgagagaggcaaccgcggagtaggatgctctgcggggcgcccagagccgggggcgcttgaagcagcttcggggactggggcaaccgggcagttttcaccatgcatcagtccctgactcagcagcggtccagcgacatgtccctgcccgattccatgggagcattcaatcggaggaaacgaaactccatctatgtcaccgtgactttgcttattgtgtccgtgttaattctcacagtgggccttgctgcaaccaccaggacccagaatgtgactgtaggaggttattaccccggagttattctcggctttggatcgttccttggaatcattggatcaaaccttattgagaacaaaaggcagatgctggtggcttctatcgtgtttatcagctttggtgtgattgcggctttttgttgtgccatagttgacggggtctttgctgccagacacattgatctgaaaccactctacgctaaccggtgccattatgttcccaagacatcacagaaggaagctgaggaggttaactgccctcacctcagccgtgaattctgcacacctcgcatccggggcaacacctgcttctgctgtgacctctacaactgtggcaaccgggtggagatcactggtgggtactacgaatacatcgatgtcagcagttgccaagatatcatccacctctaccacctgctctggtctgccaccatcctcaacattgttggcctgttcctgggcatcatcactgccgctgtccttggaggctttaaggacatgaacccaactctcccagcactgaactgttctgttgaaaatacccatccaacagtttcttactatgctcatccccaagtggcatcctacaatacctactaccatagccctcctcacctgccaccatattctgcttatgactttcagcattccggtgtctttccatcctcccctccctctggactttctgatgagccccagtctgcctctccctcacccagctacatgtggtcctcaagtgcaccgccccgttactctccaccctactatccaccttttgaaaagccaccaccttacagtccctaaagaggaatgcctgctggctattgagattattgtggcttttgtatttctgcttcagtggaagtgtgtagggtacaaaatttaaagtgtgactcttatgcataaagttttacaatggcctgccaggctagggaaagatagggacgaagcttattcattattagtgcagagcaggggtggtcaggctgaacgcagcacagaagggcagctcacattctctaagcaagactggggagccagcccagcaagaagcttgtttggacttgcattaccctatgctccacctctgtattcagcagaagtgtggttgccatctttttcactttatgtaaaggagtgttgccctcgggcccttggcagattgccaccccagcacctaggttgaagcacctggtttataggccctatctttccctacccctaaagtcagtccctaaggacaatttcccagctgatggggctacacagtagttccaatacagagagttctggctaagattttgtttgcttgtgtctggatgttgaaaaagactgcccgtatctcttactccttccttctctgtgagtattgtaaaaatggctgttgtgatcactcagctcagcttttgttattggtacctcctaaagggaaaagtgcaatattcttgcatcttcagtagtggggaacaggatgtattgttccggaaacactgaaatacacagcaacatgtgagatgttttaagtagatcacttaggagacagtggttctactacatgttgcattattacaaaatacatttgctacaggagatataaatcttatggttgtaattcagagtttaaaaatgttataaattaggttcttgggtcgtgatatgaattgttactaatctttgtgactatttaatcttcaaatattgtgcttaaccccagcaatccgcacgtatcctgcaccccaccccaaaagagtcatctgtattttaatgccactggtcttatcggtccttttgtctgttgagaccagtcatgacagcattcaagattatgaaagtgttacaatgccgcttcaagtctgcaaaacctcaaacgtagccaacttgacaaatatttaagtgttacggcagatttaaaatccatctggcacaccgtggtaggtatttgtacagttcttttaattacacatagctttaaaccatcaacctgatgagtttaaagcttttgcacccatgccttcacttcagaatgaacaccttcattgtgatcttatgttaacctgagaattgatttaaaggaagattgataatcctatactttataacgtaaaaatacaggggctacaggagggtacctaattagacagttctccaaacacagaacacacactggaaaattttccggccaattttgctacctcccaacttgatggattagaggtagcgcaaatgctggtgctcccatctaccttgtagacacttagccatcaagaatcaaggcacaagaagtgcactctctcattaacagtaaatgtttgcaagatattcagtttaactttcagcatcatgaatgttcttatccagattttgaatccgaaaaactataatccttttatgttatacaaaattactatgattttttacagttctgagcatattaaaattctactggatttcaaaaagagactaatacccaactgactaactaaacaaatatcaacttgtaatactcaatgaatttttttgccatttacatttgaccgttggctttagtgaatgtccatatttaattttttaaggcaccattacacagtttatcctacatttatcacatttcttaaagtgttaagattctatggctcatttctatgtatttttcttactttacaaaataacctgaaacagtatagattttgtaacacttaatttgagcagcttttttattacattgaattatataaagtgcatgttaccttagaaaaattaatatttgctgctttactcttttgcaaaacatttgctgtaatgaatggatttgtatttccaatatgtatcttgactgcattttgtaatatttactgctttattcctaattctgctttaaagtactgaactgggcatgaaacattaaaatattaatccagaaactgtataaactggatgttgcttaaaatctgtatcactgccatgttgaaaactcagactgcttttgtgatgtttcaaatgaataaaactatcctcccctcgttatcca

SEQ ID NO: 110430 - DNA, 3485 bp, Homo sapiens
agagcagagggaggcagaagaggagggagggagaagagtggaagggagggggaggcggcacttgggctgcagctcgcaaccagaggcagtgtctctcagctctcggaaggaccgagagaggcaaccgcggagtaggatgctctgcggggcgcccagagccgggggcgcttgaagcagcttcggggactggggcaaccgggcagttttcaccatgcatcagtccctgactcagcagcggtccagcgacatgtccctgcccgattccatgggagcattcaatcggaggaaacgaaactccatctatgtcaccgtgactttgcttattgtgtccgtgttaattctcacagtgggccttgctgcaaccaccaggacccagaatgtgactgtaggaggttattaccccggagttattctcggctttggatcgttccttggaatcattggatcaaaccttattgagaacaaaaggcagatgctggtggcttctatcgtgtttatcagctttggtgtgattgcggctttttgttgtgccatagttgacggggtctttgctgccagacacattgatctgaaaccactctacgctaaccggtgccattatgttcccaagacatcacagaaggaagctgaggaggtcataagttcctcaaccaaaaattctccttccacgagggttatgaggaaccttacccaggcagctagagaggttaactgccctcacctcagccgtgaattctgcacacctcgcatccggggcaacacctgcttctgctgtgacctctacaactgtggcaaccgggtggagatcactggtgggtactacgaatacatcgatgtcagcagttgccaagatatcatccacctctaccacctgctctggtctgccaccatcctcaacattgttggcctgttcctgggcatcatcactgccgctgtccttggaggctttaaggacatgaacccaactctcccagcactgaactgttctgttgaaaatacccatccaacagtttcttactatgctcatccccaagtggcatcctacaatacctactaccatagccctcctcacctgccaccatattctgcttatgactttcagcattccggtgtctttccatcctcccctccctctggactttctgatgagccccagtctgcctctccctcacccagctacatgtggtcctcaagtgcaccgccccgttactctccaccctactatccaccttttgaaaagccaccaccttacagtccctaaagaggaatgcctgctggctattgagattattgtggcttttgtatttctgcttcagtggaagtgtgtagggtacaaaatttaaagtgtgactcttatgcataaagttttacaatggcctgccaggctagggaaagatagggacgaagcttattcattattagtgcagagcaggggtggtcaggctgaacgcagcacagaagggcagctcacattctctaagcaagactggggagccagcccagcaagaagcttgtttggacttgcattaccctatgctccacctctgtattcagcagaagtgtggttgccatctttttcactttatgtaaaggagtgttgccctcgggcccttggcagattgccaccccagcacctaggttgaagcacctggtttataggccctatctttccctacccctaaagtcagtccctaaggacaatttcccagctgatggggctacacagtagttccaatacagagagttctggctaagattttgtttgcttgtgtctggatgttgaaaaagactgcccgtatctcttactccttccttctctgtgagtattgtaaaaatggctgttgtgatcactcagctcagcttttgttattggtacctcctaaagggaaaagtgcaatattcttgcatcttcagtagtggggaacaggatgtattgttccggaaacactgaaatacacagcaacatgtgagatgttttaagtagatcacttaggagacagtggttctactacatgttgcattattacaaaatacatttgctacaggagatataaatcttatggttgtaattcagagtttaaaaatgttataaattaggttcttgggtcgtgatatgaattgttactaatctttgtgactatttaatcttcaaatattgtgcttaaccccagcaatccgcacgtatcctgcaccccaccccaaaagagtcatctgtattttaatgccactggtcttatcggtccttttgtctgttgagaccagtcatgacagcattcaagattatgaaagtgttacaatgccgcttcaagtctgcaaaacctcaaacgtagccaacttgacaaatatttaagtgttacggcagatttaaaatccatctggcacaccgtggtaggtatttgtacagttcttttaattacacatagctttaaaccatcaacctgatgagtttaaagcttttgcacccatgccttcacttcagaatgaacaccttcattgtgatcttatgttaacctgagaattgatttaaaggaagattgataatcctatactttataacgtaaaaatacaggggctacaggagggtacctaattagacagttctccaaacacagaacacacactggaaaattttccggccaattttgctacctcccaacttgatggattagaggtagcgcaaatgctggtgctcccatctaccttgtagacacttagccatcaagaatcaaggcacaagaagtgcactctctcattaacagtaaatgtttgcaagatattcagtttaactttcagcatcatgaatgttcttatccagattttgaatccgaaaaactataatccttttatgttatacaaaattactatgattttttacagttctgagcatattaaaattctactggatttcaaaaagagactaatacccaactgactaactaaacaaatatcaacttgtaatactcaatgaatttttttgccatttacatttgaccgttggctttagtgaatgtccatatttaattttttaaggcaccattacacagtttatcctacatttatcacatttcttaaagtgttaagattctatggctcatttctatgtatttttcttactttacaaaataacctgaaacagtatagattttgtaacacttaatttgagcagcttttttattacattgaattatataaagtgcatgttaccttagaaaaattaatatttgctgctttactcttttgcaaaacatttgctgtaatgaatggatttgtatttccaatatgtatcttgactgcattttgtaatatttactgctttattcctaattctgctttaaagtactgaactgggcatgaaacattaaaatattaatccagaaactgtataaactggatgttgcttaaaatctgtatcactgccatgttgaaaactcagactgcttttgtgatgtttcaaatgaataaaactatcctcccctcgttatcca

SEQ ID NO: 110431 - DNA, 253 bp, Homo sapiens
gaggaaaatacactcaagggttctgaaatttcttttgtgtaagaaagaactttttataaataataatttcagttatgtccataactaaaaatcaaggattccatttatatgaaatatctgaataggaaaacctatgagatagaaagtgattagtggtagtcaagggctaagaggatatggggagactgggaatgacagctaagggatgtggggcttcttttgagataatgaaagcattctacaaccctgtctc

SEQ ID NO: 110432 - DNA, 735 bp, Homo sapiens
catgttttgaaccacgtccaagcctaacttctaagttcgaataaggatttgaaaatcagcctgaggctcccacggaatctaaatccaggttactccgtatatcttccttataaagtcatgggatatctgtgtttggggaatggaatgagtgagggtgaatgtttcactgcttttttttttcatctcttttcttttcaagaaaacactcggccgttgcattgccaagcaccttgcagttcacaaggaacttttatgcctttcactgcattgttggtccctgagaggggaagggggttccccccattttatagcagaggaaacacaggcccgtggaggagagcctcaagatcgcacagcaaatcaggggcagagtctggactgttgtcttccagctccaagcacagcactccttttgttccaccaatatctccctattaactcgctaccttggctttccacagtcagaggctggatagctgacaataaccttggatagacggagctcataaagtacaactaattcccagtgatctgtacatgtgttttaaaacatactttccttttaaattgtataacctatatacaactatactctgtttattaaacatttcagctgggcatggtggctcacacctgtaatcccaacactttgggaggatgaagcgggcagatcacctgaggtcaggagttcaagactggcctggccaacatggcgaaaccctgttctctaataaa

SEQ ID NO: 110433 - DNA, 274 bp, Homo sapiens
gaacaatacactagcttttctgtaagacaaatacagacactgactgtttattccacaatttatacagccatttattgtttaatcatttctaattatattaacaagaattctaggaataaaggagccctactctagagtattattttctcttaagttctaagtctgggtttcagcttctgtcctctgaagtggaagagcaaggcatgagtctttcctaaagttctcctcacccagcttgttttaccattgctttttaccagccagctggctctgt

SEQ ID NO: 110434 - DNA, 425 bp, Homo sapiens
ctcaaagactccaagatcagtttataattagttattaatctgacagatttttatacatttttaagatatatttaggttgaaaatccattttaaaaaattagcttatttcctggttcttaaagtgtagaccttaaattccagaagactgatatatacatatatatgttttgtttgtttgttctgtttagagatgacgtgttgctgtgttgcccaggctggactcgaaccaggctcaagcgatcctcccacctcagtcttccaagtaactgggactataggcacaagccatggctcctggcttcggagactgatagactttttatccaagttttacagggcaaattctattgctacaaatactatataatttgatttagaagatcttcatttaacatgtgatggcccatttatttcaagccatcttt

SEQ ID NO: 110435 - DNA, 374 bp, Homo sapiens
tccttgtctaggtttcacacctgcccagcactgcccttactgaggggcctcagtttccttatctgtaaaccaggctcctgatagacctatcggggcaggtggggaggatgctttgggagctcccagcacatgcaccagtgactcccaggtcactcttctagcccagggactaacctgggagtcctcaaggggcacaggccaggaaggtcaggcccatcctcggacagtggtgaggcttctcaggaaaaggtcatttcagctctaacctctgtacaacacggctgcaggcctctgtgtgcagggcactcggcctcgtgtcattccaaggggtcttgcacactgcatggtgctggtttttgtgtagacgtggacct

SEQ ID NO: 110436 - DNA, 338 bp, Homo sapiens
cattagcttcagtgtcacccgggaacaggttagaaatgcacattcccaggtaccaccccagaagtactgaatcgtaaactgggggatgggggggtgacctgtgatttaacagtcctccaggttgttgtgattcatggaagtttgagaatccccagacctgagctgttgagctcaaccctgaaagtattccagcccaggagcaggtcttctccaatcccgtgttcattctttccttgagcttctctctagtcctaagaaagacattaattccatggccaaaaaaaatgaattatagtcaagtcattcaatatctctttattgaatatctgttgtactga

SEQ ID NO: 110437 - DNA, 191 bp, Homo sapiens
atcgccttctccagaccacacgtggcactgccttctccagaccacacgtggcattgttttctccgggccacacgtggcatttgttttctctggaccacacgtggcatttgttttctccggaccacacgtggtgtttttttctttatttttagaaacagggtcttgctctgtcacccaggctggagtacagc

SEQ ID NO: 110438 - DNA, 252 bp, Homo sapiens
ctgtggggcactgagctctgcattacagtcattcatagcaaccacgtgtgaaaccacacatacacacacacacacacacactgatggtggctgtaaggggcgtgtgtgtccactcactgtatgtttctccaggtgtatccattgtgctgctgacacactttgtctgaggctctgtgcaaagaggtctcatcctatcctgagacgcaggtgtgtacgaggctgtcagccctaggaaggcagcaatcccaccat

SEQ ID NO: 110439 - DNA, 728 bp, Homo sapiens
tacgtgtccagcactgtgttatgtgtgatcaaaggcatgatagaatctaaaggcaattctcaagagtccttgtctttaagtgggatggcaacaagatgtctaccctctaccaatctgttatttatttggaactaattgttaaatcacccttattctccacttttccaggctaatatttctttaaagtttttagcttttaaagtaattcttaatattcggttctgtcagttcttacaattcttacttacaaacatatgccttttaatagctttaacctagtgcccttaatatttttcaaaggcacctgagaaaagtataagaaaaaatttaaattcattttattctaatttttgaagtagagaggaggttttcggttccactgtggcattctatataatgtcaatcaaccaaacaaaaagcaaagcaaacaaacaccaacccagctcttcatgtattggtattaaatagatataatagcggggctggacgtggtagctcagacccataatcccaacactttgggaggccgatgcaggtggatcacttgaggccacaagttcgagaccaacctggccaacatggtgaaatgttgtctctactaaaaatacaaaaattagccgggtatggtggcctgcgcctgtaatcccagctacttgagaggctgaggcaggagaatcacttaaacacggtaggccaaggttgcagtgagccaagatggtgccactgca

SEQ ID NO: 110440 - DNA, 396 bp, Homo sapiens
agagaccagaggcagggagactagtcaggcaagtattgcagtaacctggcttagtgacggcttgaaatagaaagcaggagaaattagagaagtgagaactgagcagtacttctgtaagccacagtcgtgttctggatagatgtagaatgagggaagagtcagaagtatctcaggattttagcctgcttaggcccaggctcagtgttctgcccctttcaccttcctcttgctcttctgctcactgaagtctggctttgctcctgtcatgttactgaaactgtttctcactaagatgtattacagattctgcaagttcaatgtgggcaaaactaagttctatgccttgtctcacaaatttgtgtctcctgctgctgcacttggtgaacggccccacca

SEQ ID NO: 110441 - DNA, 194 bp, Homo sapiens
gagatataattatattagcaaaattaacaggtaccgaaaagtagagttttacattatttcaaatgtttctgatattgtctgatcccaaaataactacttgattaactaatttgtctcataagaaatgtctctatgtaggtcaggatgagatcatttgaaaaatctactcctttgagaacttttaaaccaccacc

SEQ ID NO: 110442 - DNA, 716 bp, Homo sapiens
tgattttggtatcaaattttactaagtacttgatataacttgtataatacatacttatcattaggatttgatattcctatatatttatactatcagaaacacaattaaaacattgttagccaaggaaaaggtgatacttctacattttaaagacaattttagctatttctgtttaacatacattttaagataataatgggacacaaattttagggaaatagtagaaaattatttttaaaatggaatctctacctgaaaaggcagaccataactgttgtacagatatactatccactcagtgattaaataatcaatgacagagcattttcagctgcaacattttattctaagagttgggggcaggaaacacattttcagctattgacacacagccaccccaaaatcatgacaacatgttgccctttttgaaagatgaaatctttaaaattagaggactttttaaagggtatatttaatagatatgctatacaactgttagaatggtaaaaaaaaaaaaaagataaaacaatttcttacaaaattaaccacatgcttgccatataacccagcaacctcactcttaggtaattacctaagaaaacttaaaaccaatatccacaccaacacctgtgctatgatgttgataatcattatcattaaaaactataaatatcattgtgcattctgaatatcatttatattcataatcattaaaa

SEQ ID NO: 110443 - DNA, 103 bp, Homo sapiens
attgtaaattggagttatatggcctcttttcctttcagcctaaaggatttatgtaatatttcttacagatcaaatcttctagcagtgaattctctcagtcttt

SEQ ID NO: 110444 - DNA, 305 bp, Homo sapiens
tgtcacattttccatagatattgacatcagcaatgacttttctgaaacattaagtggagcactgtcatgaataacattttcaataaaactttttaattgaaatttcaaaatacttttaaaaacacattcaacatccccagtgcctcaatttactgctggaaaatagcatgtttttataagtataggttgtgtatcctaaaatttttttccttactatattatcctatagagttattaattctctggaaataaaatttgtctcatgagatctcaaaaacctgctaaaatttgagtatttttttttc

SEQ ID NO: 110445 - DNA, 1105 bp, Homo sapiens
agcattaacccaaaagtccacagttcaaagcctcatctgagacaagccaggcgtgctttatggacaatgcgctcctcaggccttgaccgcgtacttccccagcgggtacagccgctccttccgctgctgcttcttggtcttcgggttctcctcatgcttgttgagccggcggcgcatggcgcgtgtcttcttaggccgcaggtccaggggcttgtagttcctgcccttgtagaatttcctgaggttttctttctgagtctagttaataacagtgagaacacaggcaatggatttgcggacgactcggatcttagagagcttggaggccgcaccgcctgtcactttggcgacgcgcagctgggacagctccaccttcaggtcgtccagctgtttcagcagctcctccttcttcccgcgaagatctcgagccttgatcttggccattgctgcacaggccgccgacgccgccgcgccgcccgctccgagggaaagagcgtagattcaaatataaacttacctaatgatacggcaagtacatgcccagaaaaaaatgaaaatatatgtcttcaacaaatgtgtacaaaaatatttatagcagattattattttttgagacagggtctcactctgtcactcaggctggaatgcagtggcgctgtcttggctcactgcagccttcgcggcctgggctcatgtgatcctcccatcttcacttccttgagtaggtgggattacaggtgtgtgccaccatgcttggctaattaaaaaaaaaaaattgtagaggtgaagtctcactatattgcctaagccagtctagaactcttggattcaagtgatcctcccaccttggactcccaaagtgctgggattacaggcgtgcaccatggcgcctggcctgtagcagcattattttatttagttactatttaaaatttttaatttttgacaaattataattttacatctttaaggggtacaaagtgatattattatatatgtttatagtttggaattattgaatcaagcgaattacatatccatgtccttaaatacttaccatttattcctcctgtctaactgcaactttatacaatttgaccaacat

SEQ ID NO: 110446 - DNA, 268 bp, Homo sapiens
gtctttcagaggcaaatcttagtattacttatttttttttccatttaatgagagttgcttagcttgattagctcccagttttgtctttacaatggtcataccacagagcttgtgaatatcaattcttttacatttccttattataaacgatacatgttttgagcatcatgtctttacaaaagtagcctgatagtagaaattgttttgtaatagagaaaaaaggatttggttttatgttactaaagatgttacaattaatcaaaagaaa

SEQ ID NO: 110447 - DNA, 162 bp, Homo sapiens
tccactaggacaagagtcactggaaacttccagctaagtccattgaagcaggcagaatcttcaaggtcaatagtgcatcagttactctgatcccagtggtttcagtggaagggatggaagaagtgagggttgctgaagtttctacttggatgcatttctaag

SEQ ID NO: 110448 - DNA, 512 bp, Homo sapiens
tgaggaacaactggaggttctggcccacctacttgtactgcctggtgggtttggcccaatcagtaactgggggcctgagatcttcactgaaattggcaccatagcagctgggatcccagacctggctctttcagcactgctgcggggacagatccagggcgttactcctcttgccatttctgtcatccctcctcctaaatttgctgtggtgtttagtcccatccaactatctagtctcaccagtgctcaggctgtggctgtcactcctgagcaaatggcctttctgagtcctgagcagcgacgagcagttgcatgggcccaacatgagggaaaggagagcccagaacagcaaggtcgaagtacagcctggggcctccaggactggtcacgaccttcctggtccctggtattgactatcagcttccttggccacctgctatgagcctgtctctacagtagaaggagattgtggggagagaaatcttaagtcataatgaataaagtgcaaacag

SEQ ID NO: 110449 - DNA, 430 bp, Homo sapiens
ccttgaacctaggaggtggaggttgcagtgagctgagattgcaccactgcactccagcctgggcaacagagcaagactccatctcaaaaaaaaaaaaaaaaaaaagaaaagtgaccaccaaggactctccaaaaaaacttcagggctaagttcagttaggtcatgggataaaagattaacatacaaaaatgaactgtatttctatatagtaagaatgaatgagtggaaactgaaattaaaaacgctttataggccaaacatgctggctcgcaccagtaatcttagcacttaccatcctgggcaacatggcaaaatcctgtctctacaaaaaaatacaaaaatcagccaggtgtggtgatgcatacctgttgtcctcccagctacccaagaggttgaggtggaaggattacttgagcccaggaagttgagg

SEQ ID NO: 110450 - DNA, 452 bp, Homo sapiens
agctttttatacagaaatagctcagtgagaacaccccagcctactcagactgcagaacaaatcccaggaacttgcttttgtgcaatctcccccttgaagctcaagtctaaacacatcagagcttggcagggctgcatgggtacattagcgaacagacagaacaccctggctcctcaggcgctccttgtttttttccctctggaccagcagatttttcttacagcttacacctgctcctccccgacccccaacaacatgcagaaaaggaaagcccctcaagttttccttgatcaagaggttaaataaaaaaaacaactctctttcacactctaagggaaaggaaaataaaaaccaccagtagctaagacacacacacacacacacacacacacacacacacacacacacacacacacaaaattccccagagtgaacttttgccaactgtacca

SEQ ID NO: 110451 - DNA, 815 bp, Homo sapiens
actcaataaatacacatatattttatgaatgaataaactttttcaaaattcataggcctggttccactctgaaatcctcgtgcagtttggggtagagcctacatgtgtattttggaaaggcctttctgatcgttttgccaagtgctcctggctaattaataaccaccaagagccactaaactcaacaatctccaaggtcccttcacatgcagttgccacatttagcaaacaaaaatgcagagcatccagccaaatttgaatttcagataaacaatgaatacttttttagtgtaagtataggtcatgcagtatttggttgctgcaacttaaataaacataaccagataagacttctgcttagactgatagtttgggccagagagtggcaccttgaaactggcccagatttgaaaatcagacagagatagtcttggtttgagtctctgccctgatcttagcagattgcttaacttcactgggctccacaactacagtgtctaccctgtagagttggtgaaagtattagagataatagaggtaagatgcccagcacttagcaggcatttaataaagcttagctattattactattttttatctgctccacggggtttgaagaaaaataatagtatcaatgagactgttattggcaatactgtttactcgtaaattggcacttgaaataaccaagattatagttaacagttctaggtagagcttggcaaagttagattgaatgctgaccttgtattaaacaatacctctatgtctgggggaacaaaaccgtactaagtacagatcatccagaataaata

SEQ ID NO: 110452 - DNA, 690 bp, Homo sapiens
gaagtaaacaaataattacatgtagagtagtagtgtcaatggtagaggcatgaacacaacacagatttaacactagagaaagagtgatcacaaaagaaatgatgtttcagttgagttttaaatggcagctggagttcatctgaatgattaggtgtctaggacaggtttaaaggttagggagtaaggaagataatattcaaaataaaaagaacctgaggatattcacagaggacatttgcagaggcctgaaatagcattggtacattcctagaaccataaatagtttgatggtaatgtaaattacagtatgttttgaaaaatcatggaagatttataccacgataagaaacttcaactttattctaaagttgatgagcatttgacagattttaagcaagaaacaaatattaaatttatattttagaaagaattctagatacataaaaagcacttattataatccagtatccattcatgataactctcagctaactggaaataaaagggaacttccttggtctaaggaagaacatctacataaattctacaaccagccacatacttaatggtgaaataatgaatgtttttctcctaagatcaggaaaaagaaaaagatgtctcctcttacttctattcaggatggtactggtagttcaggccagtacagctatgcaagaaaaagaaataaaa

SEQ ID NO: 110453 - DNA, 428 bp, Homo sapiens
ttttggtagaattctctgatcccctacctccaatctgaattaggtctttcatgttttcctcacttggctcagtcttctacacctttacatagttgtatttttatatatttgtttaatgtctgactgtcaactccatgagagtgagaatcatgtctatttccttcactataatttatcctctgcctggcacatagtgggtgctcaagaatggcagcttcatcactaactccataaacaacacgcaattgtaagttactgtttcttgctcgatcaagaaagctcagattatttcagaatttgctgacaaactaatctctacaactttaaaacgttccaagaactgtattaaaagagtttctatagttgagtttgcccttcaaagtaagagagatttagagtgtaggataaaataagagtaagaagagagt

SEQ ID NO: 110454 - DNA, 745 bp, Homo sapiens
ctggctattaacaccacactgcaaagaaacttatttagtagataacaagttatatccatatatttttagatatcaatatatatgttgtggatcggtagcttggggcacattactgctttgaattgtggtatcttttattagatattgaaatactggattattgataagaccatgtagcagtgagaaaaatagtttttgctttgatttgtgtcagttatactatgttgttggagcttttgaagtagggagtgatcaggtagagacaggcagaagagattagtttgtatgtgttatcctgaaatctgagttatttgacatttttaaggcaaggcattgattgagttttatgaagataaattggcaaagaaaagtaatcccatctgctcaataacaattctttgcttttagccaagaaaattgatttcaacttgagagtaataatcatatttatcacacttgttaattgcatgaactgtatacaaattgtcaggcttattaaggtagatatttacggtcactgggcgttcctcacattccacattttcattgttatggcattaactattttttctgtttctctctttgtcactgaagacttcacgtagtataatagccagtattttctgtgattatatagcaatattctcaaacctaattgttcatacaaagtacaaatcagggactttttctactaggttctgaagtacttgttctctagatttaaactccagtgttgtactaatgg

SEQ ID NO: 110455 - DNA, 826 bp, Homo sapiens
actcctgacctcgtgatccacccgcctcccagtcccgttttgatggacacttgcgttgcttccagtggctgctgctgtacaccttgctgccgtgattagaccatgtgcatccggagccctttcctttcttttggtggccacctctccttgaggggccttgtgaccgtgccgagagcaagaactctgcaactgggctgactgggttcagattccaaatctgtaatttacgggctgagcaactgagcaagttgcttaaggacgctgttttttcatccagaaaaatggagataatagcagtacttcctttagaggttgttgtgaagattaacctattagtgtctgtgaagcgcttagtactatgaggtgtttaacataattattatgcagctaaaacttgaacatggggatgtgcttacttatttgtgggagctacaaattaaaacaattgaatttatggagacagtagaaggatggttaccagcgactaggaagggtagatggcggggtggagttaggggagaaagaggggatagttaatgggtacaaaaaaatagttagaatgaataagatctagtatttggtagcacaacagggtggctatagtcaacaataatttaattgtacatttaaaaataactaaaataatataattggattgtttgaaacacaaaggataattgcttgaggggatggatacccaatttaccccgatatgattattatgcattgcatgcctctatcaaaatagctcatatgccccataaatgtatacacctaccatgtatccacaaaaaattaaaaatggaaaaacattgagcatgggagg

SEQ ID NO: 110456 - DNA, 422 bp, Homo sapiens
acagcatggggtccagtgatactaaccgtgtggaaatagaactcctccagattacagggcacctgagaatttcttactgacttttgtttaataattcaaaaacacatcaaatcaaacttaatcaaggcaaaagctgtctctggagccttcttcgtgcttcctggagtcaagctcttacagaatcacggcagcacccccctccctagctcacgaaggaagctggaggactccacagctgcttcaggaaacagactgtccccagggaacccttcagagatcttgggaccagacaggatgtacctggactcctggaattccctctccagcctccaggtcccgtgaggatgtgagctggagcagtacgggcttccctgatccttcctgtgtccaggtgagcagcctcctgccacagagctgccctc

SEQ ID NO: 110457 - DNA, 762 bp, Homo sapiens
cgaggcgggtggatcacctgagatcaggagttcgagactagcctggccaacatggcaaaatcccatctctactaaaaatacaaaaaaaattagctgggtgtggtggcgggcgcctgtaatcccagctacttgggaggctgaggcaggagaattgcttgaacccgggaggcggaggttgcaatgagctgagattgtgccattgcactttagcctgggtgacaagagcgaaactcggtttaaataaaatagaataaaataaaagttagagaacaccaattttacaaatatctcatgtgatagtaaagaaaaggaggtaagtacacagcctctgatttcagacttcccaagttcaaactctagctttttcatttctgtgtaacatgggccaagtgtctggggtataaacctctctatgcctcagtttccttggctgcaaaatgggtataatgattgccctatttcctaattttgtgtgaagatttaaggagatagaggtagcatttaggctgcaggctggaacatagtaagctctaatcaaatgttgtttttgttatttttaaaattagcccacaagtgacatatctggccactgagaaaacagatactaatgttttaatcactcaagaatgtttatacaaaacagttcaagtttacataaagcaattaagtgctaaccttattgagctctaaatattcagcagatgttcacccttctaaacatcttgcctagttaaaccaatcctggtaatttcagtccccttg

SEQ ID NO: 110458 - DNA, 342 bp, Homo sapiens
tcgagaccagcctggccaacatggtgaaactccacctctactaaaaatacaaaaattagccaggcgtggtggcaggcgactgtagtcccagctactcaggaggctgaggcgggaggatcacttgaacccgggacgtcaaggctgcagtgagccaagaatgcgcgactgcactccagcctgggtgacagagactatctttaaaaaacaacacaaacaaaaaaaaaaaacaaccctgttgaacacccagatgttcactagaggtgccagaggtactgaattatgcccatccctacaagtgccaaaaattcatcatgacaagatccagcagattgacaagtaagt

SEQ ID NO: 110459 - DNA, 281 bp, Homo sapiens
actgacaccatgtgtatgtttcctccaactcatctccttggtgggttttgagatcttgaaggcaaagaactataactcatcagaaggtccaattcaggtatttgccttgggtgtgagcttggctatgaaacaatagagactactgtggaccaatgcaatgccaggtgaaccactcctttaattgtttatcagtgttgacccatctctcatatatcattagcttcaagaatctttggagtagccccaaattcccatctacagaggatctaccactgtggttt

SEQ ID NO: 110460 - DNA, 368 bp, Homo sapiens
accaccccaacattcaggaactaccaccctgattagtcacaagccatcaacattgagacaagaccctccatcagcaaaaagcttaagactcactaaaggctcagatgatcattagcatcttttggcaataaagtatttttttaattagtatttttcctttttttagacatagtgttattgcacactgaatagactgcagtataatgtaaacagaacttttatatttactgggaaaccaaaaaaattgtgtaattcactattgtgatacttgctttattacagtggtctagaacagaactcataataataactctgaggtatgcctgtacaaactttcagttgttctctcccagtggagtgcttaattc

SEQ ID NO: 110461 - DNA, 1371 bp, Homo sapiens
gctaaaattaattggagtctttttaaatgaagaaattgataactataggaagctttcaccagtctacaaatgtgaccagtaaatccaagaaaatgcagagtgtctgtgtactttgtggaggagcaatgtttatgttctaaggtaataataatggtattattattaaaataataatagctaccttgaaacctttttattttttttttgacagagtctcttttgtcacccaggctggagtgcagtggcgcgatcgcggcttactgcaacctctgtctcccagggttcaagtgattctcccgcctcagcctcccaagtagctgggattacaggcacacaccaccactcctggctaatttttgtattttttgtagagacaaggtttcaccatgttggccaggctgatctcaaactcctggcctcaagtgatccacccaccttggcctcccaaagtgctgggattacagtcgtgagccaccatgcctggcaatagatgccattttgagggcatattgcgtgcttaacactgtgcttttcctgtgctatcttattatacaactctaaaagggaaattactattatactcatcttctagatgaggcttagattgtccactgtcaagcttgttggtagcataggtaggatttaactccagagctcaagttcttttttgtttgtttatttttattttatttttattttttgagacagagtctcgctttaacacccagtctggagtacagtggcacgatctcggctcactgcaacctttacctcctgggttcaagtgattctcatgcctcagccacctgagtggctgggaccacaggcacgtgccaccatgccacgctaattttttaatttttactagagatgcggtctcatcatgttggccaggctggtcttgaattcctggcctcaagtgatccccctgcctaggcctcccaaagagctgggattacaggtgtgagccactgcgccagcctggagcccaagttcttacttgcaatactcttacttctcctccagcaaagaaacatgattatcaaggcactggggaccctgtgcagaacctgctttttcttgaatctcatggatctttttttctaacttgctggaattggagctccagaggtggaggtgtgtgagcaagtctattaatggccatcccttggcaagcttcaaaaccagacagaacaagaaaaacaattgaccaagagagaatagagaccccaatgcttctgaatgatctagttaaagatgcctttcggccaaataggattttttcttaactatcatttttgagcatgtttcttgtgtcttactgattttgagaagtgccttaaaattttaattggcaagttatatgtggga

SEQ ID NO: 110462 - DNA, 294 bp, Homo sapiens
ctgcaacctctacctcctgggttcaagcgattctccctgcctcagcctcccaagtatctgggattacaggcacgcaccaccatgtcgggctaatttttgtatttttagtacagacggggtttcaccatgttggccaggttggtctcaaactcctgacctcaggtgatccgcccaccttggcctcccgaagggcctccctgggattacgggcgtgagccaccgtgccccgcctccagtgtagcttttagtgactgcagaacattctttcaaatgggccaggcacctgtaatccca

SEQ ID NO: 110463 - DNA, 431 bp, Homo sapiens
gaaacagtggattagtgcctggttcttacccaggaaatagaagaattctgtattataataacaccattgtaaacagtagaaggttttttcccacataacattttcctcagataaggttttacaaaatttgggatgcacttccgaactccttcccttttggatgccctggcccttgccagccctccccttcccaggagcatggtgccccctcttcctagctgttcagggccccacccccattagaatcttcctttgcctgagaaccctactctctgctagatgacagcaaatgcagtgaattcatgttgtaattatgactttctgcaccttgaaatttggtgactggaaattttaggcattgctgttgattagtagggaaacatacatttaatttttcttcctctgctcctgtctgcctgcaaatagaattt

SEQ ID NO: 110464 - DNA, 327 bp, Homo sapiens
gccatagaaagctccaggattcaaaaaacatgattttgagctgggtgctggggatacatagactgcaaccgaattcttgtcttgaggagcatgtaatacagcaggaggctgcatggccctgcaaggttggttaaaggcacaattatggagaagagactcagggtagctatattcaacaagtagagcagcaattacagaagcaggacactcagaggcaatgtgcttttagcttttgtaggacctaccctcagacatgccatacatattaatattccaaaacaaaattaagcaaacctattccacaaatccataggaaagataaaatac

SEQ ID NO: 110465 - DNA, 470 bp, Homo sapiens
tttagactgctgtggttctactcagccaggacaagtgtttggtgctaagacaaaatagcatggtgtccaatcagtatgactacttttactcctcaattgtgatctctggttccttatgtattcacttattcattcactcacaaagcatttctcgagcacccactccatagcaaatagtgtgttggagacaaccaagtcttatccctgctatcaaaaaggtggcgtttagagccatacccctgcacttagttaaaaatggaaaaagcacgaaatttgtgggtagaagacgtgaacagaaacgtgttcctgattgacagcaatcaggttcagtaccatgcatggtttcaggcatcccttgagggtcatggaacatatttcccagagaaggagagactgctgtattagaaagcgcattttaattcttaacgtaagtgtagtcaaacaggaactcaggatcttatcatatatgc

SEQ ID NO: 110466 - DNA, 385 bp, Homo sapiens
tgccacttggtcaggtaaaaacacctatactatatgtatgtaaaaaaattcacttactcctgttttttactatcttatctcttacttcaatatggtgataaacaaagattatattcaattttattttatcttttccatgtcccatgatttcaatctagaaatagtgctgttattttttattttattgtaaatactttgtatttttccatggagtctattatcttcaaagtcttaaactcttcttctgtgttcgaacagtgtcatttgttttaacacacattgtcagttgtttttatttttgcaatattataactattgttgctcctcctctgctcaggaccctacaagggttctatgttgcatgcagcttaaaaacctgagataa

SEQ ID NO: 110467 - DNA, 221 bp, Homo sapiens
ttatggtcctaaaactttagtccatcagaattacctgtagtgcttgttaaagttttttgtttctttgtttgggtttttttgcttcaggatactttgtccttaagaaaataataggtttttattccccaagggttgccaaaaaaaaagcccagtttttttgtttgtttttttgagaggagtctcgctctgtcgcccaggctggagggcaatggcgccatctt

SEQ ID NO: 110468 - DNA, 681 bp, Homo sapiens
tctgtacataaaccccttgggagtagctgacagcttgtcatttctattgatattggatggtctacttagattcctctttttacatagttcaaattcttttttttaccatgtgccttgggggaaacatataaaaataaataaacaaggccctctctaacagacatttaagcctttaagcaaagttaaacagactcagcaaatggtattaagccattgagcagagcttccaagtagttcacaaggttgtggcttccggtgatgcatgagagtatgtgtgagattatgagggaagtgacatagtaactagaaatgttattgttttcttccaacaaaaaaaaagtcatatactcttcttaaaaccaaataactttatataagaagtgatggttcttatatattaaggatatataagaagtgatggttcttatatattaaggatatataagaagtgatggttcttatatattaaggatatataagaacctgacaacaagaatatctaacataataatctaagaagtaaacaaacaacaataaagacaaaaactccccaactaatgtaattcactgtagaatgagagtcattgagcttatttttatctttgttcaacaagataaaaacatcacttgttttttattctctgcacatgaactcttaactattaccttagggtgatcaat

SEQ ID NO: 110469 - DNA, 199 bp, Homo sapiens
acctcagccccctgagtagctttgattagaggtgtgtgccaccatacctggtgtgtgcgtgtgtgtgtgtgtgtgtgtgtgtgtgtgtaaagaaagcaattttcctaactcagcctgtcaaagtactgggattacaggcgccatcccctgcacccagcctaaactttgattgcatcactgcactccagcctgggccaca

SEQ ID NO: 110470 - DNA, 430 bp, Homo sapiens
ggcgtggtggctcatgcatgtaatcccagcactttgagaggctgaggtgggcagatcatgaggtcaagagatcaagaccatccaggccaacatggtgaaaccctgtctctactaaaaataccaaaattagctgggtgtggtggtgcacgcctgtagttccagctactcaggaggttgaggcaggagaatcacttgaacccaagaggaggaagttgcagtgagccgagattgtaccattccactccagtctgggcaacacagcgagactccatctcaaaaaagaaaaaagaaaaaaaaaaaagaagaagaagatggacttcttaggctaaggaatggtagaaagccagtggacctctgaatggccacggtgactcacgctttaaaagggccctgaactcagtacacttttctttttaacttctctgcagga

SEQ ID NO: 110471 - DNA, 542 bp, Homo sapiens
tattagagaactgaaatacttgactatcaataggtatatttttagacacaggttttgctgttgctgctgctgtatttttgtcttcaacttgtcttcgagattacacaaattaacaacacacaaacaactcagttttctcctagtctctttaacatcagatacatgtttagagagatagtcaattaatcattctttttttttttttttttttttgagactgagtctcactctgttgcccaggctggagtgcagtggcccaatctcggctcactgcaagctccgcctcccgggttcacgccattctctagcctcagcttcctgagtagctgggactacaggcaccagctcccacacctggctaattttttgtatttttagtagagacggggtttcaccgtgttagccaggatggtctggatctcctgaccccgtgatccacccgcctcagcctctcaaagtgctgggattacaggcgtgagctaccgcgcccggcctaatcattatattacctaaagttaaaactggtctctaatctgtccaga

SEQ ID NO: 110472 - DNA, 1187 bp, Homo sapiens
gatttttgctcttgtttttgtactttcatgttaatttttcaatcaacttatcaaattttgtgggaaaaaaatggcattatgtttagaattataatgaatgtatggatgaaattggagaaggctgacatttttacaatatcaattctttttgaccatgaagatagaaaaactgtggtggccagaattccaagatgaccccagtgatccttacccttacataatctcctcccgtgaataagtcactcccggaattgggatatgttaggtggcacacaggacttttaaggatgggcagttgtcctggtgggtctgacctaatcaggtgaaactgtaaaccacacaggcttttcctagagattcaaagggcgagtgggagtcaatgtgaggcagcttctttgttgctgactttgaagatggaggggaccctatggcaaggaatgtgggtggcctctagtccctaagagcagcccctggctgacagccagcaggaaacggacatcagcccaacacctgcaagcaactgcatttggccaacaacccaagtgagtatgggagcagactcttccccggagctcccagaaggaacccagcccactgacaccccaatttctgctgaacggaggacctaccaagccgtgcctggatgtctgacctgcagcttggagctaagaaatgaggttgtgataagctaccaagtatgtggggacttgttacacagcaacagaaaactacatagtctcaatttacttgtatctacagtcatgggctttaatgaagttttatagttttctgtatataggccttgaatatctttccttccatttatttttagaaaccttaagaatttttaatcttatttaaatatcttttaaaaaatgaatataactgaatccttgaatataatttataagcttattgctagtgtctagaaaagcaattgatttcagtatataatctcagggcaggccaggtgcagtgactcacacctgtaatctcagcactttgggaggccaaggtgggaggatcacttgagcctaggaattcaagaatagcctgggcaacatagagatactccatctctacaagaaataaaacaattagccagacctggtggcatgtgcctgtagttacagctactcaggaggccaaggtaggaggactgcttgagcccacaagttggaggctgc

SEQ ID NO: 110473 - DNA, 120 bp, Homo sapiens
gtatggggctacggccgcttcccctcctgcacagtctccgagcacagcactcacgagcctcacatccctctcccttccatcctccaaggaagaagtggtcacccccatcttgaacaggtg

SEQ ID NO: 110474 - DNA, 540 bp, Homo sapiens
ctaactcagggctcttccagacagtagacaaaaacccacatggattctgacagtctcatagacctctctgcggaccctgttttctgtcagtttagcgagtggtgcctctcccgcctgtggccatgtggaaaaagcacagcttctgcaaagcctgatcatctgggctggccttagtgactgtgcttagtcaacagaatgtgggggaagggatatttggaaatgctgagggtcatacataaggggccttgcagctccaacctgattctctctgaatgataccatgtgtgaagtccaactaccccgagacctgccatgctggctggaaagtacaagtcagccatgtcaagaggtcagagtggaacccaggcagccccagctgttgcatccatcccagcccagtcaccagggtcatacagcagacaagacatggagaagagctgacagactctgcccacagccagagccagtcacaagtggggcaatgtcacactatcacagccactccaactgagttcctgattatggaggaactatcactac

SEQ ID NO: 110475 - DNA, 257 bp, Homo sapiens
atgccatgccatgccatcttttgcctgtattattatttttcagcttttattttagattcagggtgtacatgtgcaggtttgttagaaagagtatatcgtatgatgctgaagtttgggatacagttgaaccagtcacccaggtagtgagcatagtactcaatagataacgttctaacattactcctccttccctccctgttcttgtctctgtctattgtatctttatgtccatgtgtaccaaatgtttagctcattct

SEQ ID NO: 110476 - DNA, 257 bp, Homo sapiens
aagtattggtatactgtcaagttttctgaaattctcatttttacttgaaagatggaattttatttttggcataaaatactttaaattgtttttgttctttaaaaaaatcagttcagagggacctgattagtaataggcagagaccttatcagttatgttttggaagagtataaaggctgaagtactgtggttttattatagaaaccatttaatactaatctgatggcagttctcagtggcttgagtttgcagagcac

SEQ ID NO: 110477 - DNA, 406 bp, Homo sapiens
cggggggaaagtttttcttcacaaagggaagtcaaataatgagtgtacagggaacaagagaaatggagagtcatcatttttacaaccaccatagtaacaactgattctggaaagatgcacctgtggatgctaacctcattaggtgaaaggctattagaaaacaagatattcagaatcttagttattgattgcaaaagagaaaaagatatctttacaatggggaaatctggcaaatacacctttaccaaataatcaagtttaatatcatcaacaaactaacatcataagcctcctggtattatatactatgaaggacacaacaacgcccatgaaggatgcctaatacatttagccaaaatctactcaggaggaaacttcagacacgtcaaaattgagagatactctg

SEQ ID NO: 110478 - DNA, 359 bp, Homo sapiens
ttaaaagaaagaagatattcagaacccagctggttgcagtggctcacacctgcaatcccagtattttgggaggccagggtgggaggactgcttgagcccagaagtccaagactagcctggccaacatagtgggtcagtctgtctctataaaaaaattaaaacaaaaaaattatcccagtgtggtggtgctcacctgtagtctcagctacttggcaggctgaggcagaagaattgcttgagccaggggttggaggctgcaatgagctgtgatcatgccactgcactccaacatggacaacagagcaagatcttatctcaaaataaataattatgaacagtattttaaaatttctcaataa

SEQ ID NO: 110479 - DNA, 309 bp, Homo sapiens
atcctgccaaaaagagatttgtttcctcctctgttcttagaccaattaccaaataaagcactccacagagaatccagatgaaatatttctccacccagttggtaagaaaagtaattaaaccaacctgctgtgctgagcaggcctgcagcaatgtaacacttagttatagcaacagccatagataggaactcagctgcaggctcctgtcagaccgatctgggcatttctaaccactgtccttagcaacgttcacaaagggccccgtcttagactcagaaaggcagctcacagcccttaggggtatggttt

SEQ ID NO: 110480 - DNA, 817 bp, Homo sapiens
gtcaccatgttggctgggctggtctcaaactcctgacctcaagtgatccacctgccttggcctctcaaagtgctggaatgacaggtgtgagccaccgtgcctggccaaattttttaaaaataaaactaatgttgaccaggttatttttttgtaaaagagaaaatacgaatccaaggttattttagctctgcttaattacgtacagcttgttttctgaaaaactctttgtatttgaagatgaggatattgatgatgataggtatggtacaagaagcctgatctatgaacagtagtcctttctgccctatgtctgtacagctttaagactatatttggtcagtagttattggctgagccttgtactatttttgattcagtcttaatcttttgctgaaggcactcctctccttgcttcatcccccactgcacctccatattcttgacttaaaattgaggtagatgtgcagctactgtttcttagaagtttaaaactttgtcttgaagttggttacaggattttcttaatcttgtaagcatcatatttgaacattattttggtaataatgtttttgtcctagcccccaaaattctggcctactaaagttggattgagattattattctttaaaatagctagattttctattttccaaagacttggtaacaaggcacttttcaactcttgagttttaagttaaccatagtcttttcttctgttggtgtgaagggacagtttaagagtggcctggcaacaatggtcttcagcccttggaaggacgctttttttttaaaacccgctgggggcgggcccgggcgg

SEQ ID NO: 110481 - DNA, 319 bp, Homo sapiens
aatgaaaaggtgacggtgcgtttcaagcaaaagaggctaggccaggcctagtgactcatgtctgtgatcccagccagcactttgggaggctgaggtgggagaatcacttgagcccagtaggtcaacactgtgaccagcctgggcaacatcatgagaccatggctcttcaaaaaattaaaaattaaaaaattagcgaggtatgctggctcacgcctgtaatcccagcactttgggaggccgaggtgggtggatcactggaggtcagcagtttgagaccagccaggccaacatgatgaaaccctgtctctactaaaaatac

SEQ ID NO: 110482 - DNA, 333 bp, Homo sapiens
agtttttgaacagagttgagattgatggaaaggaagattgctctgataattctgtagaaaattgattgttgggagcaagaggtgaactggagccccaggaccagtcaagagttggtgaacagtccaggcacaaatttaagaagacctgaactaataaggtagatttcagaaggaatgaatctgagacaatgttaaagaaacagaaaaaaaaaatggaggtgtgactaattggatgtgggagtttacaatcctgttgggatgagaaatcctacccatagaacctctccctgactcctataggataaaattcaaacttctaaacatggtacatac

SEQ ID NO: 110483 - DNA, 467 bp, Homo sapiens
tagaaagccctcaccagttccaccactgtatcctcctacctagctttagtttttgtcatagcacttaacaccatgtgacatacatagcagcttttctgtattgtcttctcccactggaatgtgagcttcttgtgggcaaggccttttctgttcttgggcagtgctgaatccttagagcctagaggacagcccaacacagagaaggtactaagtagtattttgatgagtgaatgatagaatgatagagatagaactattgaatgagttccctgagttcaacttttagtggaatgtttgccctcctaaaggattgtgccctttcccatctaagctgtcctttctcccatggccagaagagggcactgtgtggtcaggaagctcagccacactttactgcatagcacattgcagtttgatagtaaagacctcggtgcaaagggcttttttcatgacaacatttaaaatgt

SEQ ID NO: 110484 - DNA, 404 bp, Homo sapiens
gaaggtggctgaggttggagaggcatctgggaggagccccagtcacagaggagaagcggtgggagcaagtggcacaggggttgggggagccggctgcctcctggaccccctacctctccctagctgttccccgagcccctccaagccagtggttcctttccctccacagcggcccctcctcctgagctctgtctccaccatttacggaagacagaaacctggagtcaccttggccttcctgtctccttggcctgccacagccgatctgtcaggaatgtatttcacctccttaagttccctctaactgcctctcctcctccatccctacagcctgggcttaaattcagattttcctcctctcctgcctgaataatttcaacagtggcccacctggtcttgtcctc

SEQ ID NO: 110485 - DNA, 168 bp, Homo sapiens
agacaggatctcactctgtcacccaggctggagtacagtggcacaatcacaacacactacaacagccttaacttcctgggctcaaggagtcctctcaccttagcccctcggatagctgggactacaggcatgtgccaccatgcccaattaaatttttaattttttgta

SEQ ID NO: 110486 - DNA, 281 bp, Homo sapiens
tgagacggagtctcgctctgtcgcccaggccggactgcggactgcagtggcgcaatctcggctcactgcaagctccgcttcccgggttcatgccattctcctgcctcagcctcccgagtagctgggactacaggcgcccgccaccgcgcccggctaaatttttgtatttttagtagagacttctttccagtttttaatgacagtgtctgaaatgcttcacttgtgtgaggtggacctccaaaatttggtcagcattctctctgccatactctggttatagt

SEQ ID NO: 110487 - DNA, 439 bp, Homo sapiens
aaaccattggagaagctcgatgccacagaagccatgtgcccatgactttaccactttctctggaattgttttggctgtcattcctttgaacccgctctgaatcaactagccaggacatgtggactcgcatacataagcccctcttttcgcactcatcctgctcttttatccttctattcttctgaaaagggtttttttaatgtacaggtttactaattcatatctcgttagaccccagagacaaaactgcgtggaagcagtccagtccactgctttgaacaaggcggtcttcgcggtgtaatatctctcagctgcttgaggtttcacacattcacaaaaataacagcatttttagctgatcccaatagatttttctctgcagctgcatcacttgaaaaagctttttgttccagttcttaaagtctaagtattgaaagta

SEQ ID NO: 110488 - DNA, 415 bp, Homo sapiens
cagtgtgcccatgatgaaaatgcagactaagaatgatgcaaatcaaatggcaagccacagattcctttaagaactgactgagcctaagtcataccaggaagtcaatcctgaaagcagcgagagaggggctgctctggaaggtcctgtgcccggcatgacggggcttggacatctgctgcctccaaacctcatgttgcgaccgattccctttgttggaggtggggcccgaggggcggtgtctgggccatggggatgggtcccttacgaatggcttggtgctcattgcaacgagtgagttctcgctgagttcacgcgagatctggcggtttcagagtgcgtggcaccttcccttctctctcttgctcccgctcttgccatgtgacacatgggctccccttgatcttccaccatgatc

SEQ ID NO: 110489 - DNA, 233 bp, Homo sapiens
ttttgggggtaatggctgaagtagaaagtcaaagatcataaatttagggaatacctgatattcatggccaaatatcaataaaagtttcgattgattagtcagttggctatcgtgtgatgatttcagcaggctgatttacattacatagacaatgtaagaaaaatttgtctgctgctatgtaattaacctttgagtagccacattattagagtggagcggtggtagagataatg

SEQ ID NO: 110490 - DNA, 288 bp, Homo sapiens
ggtcgactgaaaaattcatgtaagccgcgtctttggtccacagtccttgctctgctgcattctgtggccagagcgccgttgaccataaccctgctctgggtctagaactctaaccagtgtagggatcccccacagtcccaacctctcatccaagatgtgtttggaactcaggcttttttgtatacatcatacattatgtggcacctctttggaacctggggctgctcctcataatcagacccatttatattttcggggcaaaacatatgtattcaggtgaactggaag

SEQ ID NO: 110491 - DNA, 277 bp, Homo sapiens
agaaaagaaaaaggatttaaaatcaataacctaagtatctaacttacgaaactagaaaaggaagatcaaattaaacccaaagttagcagatgaaaagaaaaaaagaattatagcagaaatcaatgcaactgaaaataggaaatcaacagagaaatgaaagtcaataaaactgacaagcttctaaccagcttaaccaagaaaaaaagagaaaagacacaaattactaacataaaaacagaaaaggcggccaggcgcggtggctcacacctgtaatccc

SEQ ID NO: 110492 - DNA, 345 bp, Homo sapiens
ggaggagtttgggagagttctgtgctgagaagcagggcacccaggagggaacctaagtcagaacacctctgagtgcaagagcacgtctgaacgctgctgaccactggagggcccctgcctccgttcacaccagcaataagaacaaaccctatgggttcctaccctttggcttccctgcttcattcctctgcactgtggcccagaaggacctatggtaggaagggctgacgcctgctctctggtgccctgtgaggaccaacctgggctcagagcagtgtgtagccagtgggaagtgacccgcaagcagggtccaagaaggctgctcgaggacacgcacctgagctg

SEQ ID NO: 110493 - DNA, 268 bp, Homo sapiens
ataaattgcctaggactgggactgtggcttggatagctattcctgcccttcctatcatcccaggaaggttgggcccacctggggagagaagtagaataaggaattagtacctaccaccctcgatttgttaatctgagcccaaattttgagtcttactggatctgtaaagtgaagtgacaccaggcttgtttttgttcagtgctgtatatagcaactaattgtgagaggattgtagctgagacctttattatctagctttatgtctttg

SEQ ID NO: 110494 - DNA, 358 bp, Homo sapiens
cattatacaaaaatgatgaatgctgaaatgaaaagaacttaaaaatgtacttggaatttcaacaggctatatttctagatacagataaaataagtgatgccacaaaaggcaattatgtattaaatgaaaaaactgccaggggttgaaagcttttttaagcagtagttttataaaagtgtttgttgagtacaacagaaattatgttataaacaagcatttgcaaaggtaggaaatacttttgttcaggatgtcaaacatcgatggctaaacattcttgggccagatttagtcaaaaagttaaattatttttggagatttacatagcagctggttacaacagattaaaaactccatccac

SEQ ID NO: 110495 - DNA, 347 bp, Homo sapiens
agcagttgcccagtatgcagcctcagtggaatgtctcattgaagagctgttcctagatcctcccacaaaaacctaagagcagaggtcaccttccccaggtgattttgcattgctcatcggcagcctagactatggtactcaatagtagcttctgatatcgaacctcacatttctcatgctcaaagaaggcacaacctaagtcagacacagctgtggtcggcttccttctcccactcctcttccaggcttccgccaacaaattggtacagcagagtctcatttccttaggggtcctggaacttccttttcactgtgatttcaaaaacatttattagaggatacattta

SEQ ID NO: 110496 - DNA, 861 bp, Homo sapiens
gagaagagccaggaagaaattttctttcccaacctgtgtccaaggggcacacgcaaatcccaaattctcccctgaaccctcccaattcacctctgcagactcttttccccttgtttttttgttttttgttgttttttgttttttgatttctcatgtctgactttgggtccatcctggaatgagaggagggggctccctcagcactgagccctgtgtagtgaaaggggcttcacagagaaaaaaggaggaagggtcctcagggtcaagttcctgctctctgtcaccaacaattccctttctgtcacttctttgtgttcttttacctactccataagctacaagggacaaggaggttttgaaatgagctcacactttttccttaaatgagaagaggaagccccttgggtgatggaggagcagctcagactctgcccccatctctgctcccagcacccccagtgactgactgaccccaccctgaagccacctaaggtggaaccagggcatatggagaaggtgcccaggtgtctgtcctgaatcaggctaaatcaagatgctaatcaacaccaaagcctcccctggatcaggccgcaggaaaatgggaagacatggagcctcatgacagactgctgagctgtgtcctggctctgaagtcactggctgtataagactgtgggcacagcacatgggacacagcacagaggacagcaagtgacgcacacttggagacatagggagattcagccatggggactctgcatggcagggaaggggcagtgccaaaaagtgtgtatttatagagaggataagactaccagccactatgtatctaatataggacttaccttttcaacccttcca

SEQ ID NO: 110497 - DNA, 256 bp, Homo sapiens
aacctctggatgcccctctgctagcagataatgtgccatgccacgtcttgtttgcactccattaggctaaataattatcttgttcaaatgcactttctggggacgcagagctttttctattcctggtgtcctggaggaaccctcacagctgaagcactggaagtctgactggaggggggaagggggttgaccacctcccaggtggaataaggagtctttcccagagtcaggttccccacaggggcagtcgccccag

SEQ ID NO: 110498 - DNA, 243 bp, Homo sapiens
gtactcaaaaacactcaacagattaactagaaaaagccagtgatccaataggaaaaacatggtaaagaatatgaatagacagttactagaaaggattttatgcacatgaaaaaaatgctcggacatggtggctcacacctataatcccaacactttcggaagcttaaggtgggaagatggcttgagcccaggagtttgagaccagcctgggcaacaataagagaccccatttctgcaaaaagt

SEQ ID NO: 110499 - DNA, 302 bp, Homo sapiens
tacttcctaccaagatcctaacccatacaacatccaatcaaagtttccaatgggaaacttaagtcatccacaacccctttatagcagtcttgaaaaagccacatgcaacttctattgattcctcagggacaacacaggtggaagggggaatgaaagacgtaaaaagtgcatcaaactcttaggtcatcagtgattaaaaagggtttcatcatttgccaactttatgcccttaagaaagttacttaacctccattctttttttagtttttttttttttttttgagacggagtcttgctccgtc

SEQ ID NO: 110500 - DNA, 638 bp, Homo sapiens
ggttcacaggtctcagctgtgaaattgtgtttgtacacggtggctttttctagaaaaatgaaccgcaaagtatttctttcctcgtgaatgtcgaccattttctcgagtctggttgttgttggccagtgacacaaacctgcagcttctccccttcttgcttccctccccgccccttggctccgggcacagcgtggctgaaccggcttatctggcctcgtctctggaggcctccccagctgtcatgtccgttgacatttcactgttcctggcagtggctgtgcccagacgcgccgtggcacgtgggagtgatgctggtctttgccagtgctctgcacacctgtggggaggcctctcggggtttcctgccaggtctctgtgcaccccccggtgagagatctgaggaggaggaggaggaaccgagggcaggtagggcgctcttcagatgtggagggttggaatctccagtttaataacaaactttatcctaccttaagttttcaaaagtcttgtaaagaacgggtccattcatttttagctgctccgtgaaaggtgagaaagctgagtagggggctgtgtcccaagaccagggtttgctgtggcctggctcgattgagaatcccctgggccccaggagggtg

SEQ ID NO: 110501 - DNA, 300 bp, Homo sapiens
cttggcaaccgctaatctgtctctgtaggtttgcctcttctgaacatttcacataaatggaatcatatagtatgtggtcttttgtgactggcttctttcatttagcaaggttttcaaggttcatctgtgttatagcatgtatcagtactttatccgaggactatgattttttgattgcttactgtaaacctatggcataaaaatctctgggaacaaggcctggaaataattcttttttttttttttttcctgagacagtcttactctgtcgcccgggctggagtgcagtggcgtgatctc

SEQ ID NO: 110502 - DNA, 213 bp, Homo sapiens
acagcttataaacagagccacgcggcacggcacctcccgagcctgcttccttccctccgtgagataaagtcaagactcatccaggttgcctgcatctgtaggtcgctgcttttcatccactcattggcagaggcacatgcgggtagtgtgctggctctgagttggtggctggcatggacgtcggctaccagcctctgcttccatcccttgagg

SEQ ID NO: 110503 - DNA, 213 bp, Homo sapiens
ggtcaccctcattaccttagctttgaagcttctcttacattttctttcttatatgtcagttcaagaaacgggctttcagagacaagtacactgaccctctcagccaatgatccaccaagtgactattccacacgtaggcagctgtacacatagccacttgccggggggaaagaaaatcaattcattccagaagattattgaagctattttatt

SEQ ID NO: 110504 - DNA, 723 bp, Homo sapiens
accatgttggtcaggctggtctcgaactcctgaccttgtgatccacctgcctcggatcccaaagtgctgggattacatgcgttagccaccacgcctggctcacaataatattattttaagaagtattttccaatattgaagaatctttgtgtcatccaagaacacatactacttacttctacatcacccgttaagaactctaaataccttattcattagtatagaaaatcttttaactctttcacagagaagaatgacataggcaaatggaatttgtatccccaggagtgtcaatttttttaccaaaatccaaacttaattttcatcagtgtgcccatttttataatgtgcttaccccagttgcaaatcactagttaacagtgtggagtgagaagttatactactgaagatttcaaaatgtgcctcagcttatctaccttattatgactagaataattataagaattaaataatatgcataaagcacttagcatattgcctattatcattactatgtagagagatagaaatgtgtgaaaatgggagtttttaccttaaggatgtaatttttcatccgtgtaagattacccaatattctataaaataagagatgttacataactagaaagttgtagccattcaaccatttttctggaactagctttattatcctctacttttttaaatccagcagattctctccacaatgtctttctgctcttt

SEQ ID NO: 110505 - DNA, 375 bp, Homo sapiens
gtaagcatagttgtaagcgtgctgaatgaagtttatttgcactttgtgtattcccactttttagttatgtactttataagtggaatttatttgactctaacttttgtaatttagataatcattgtttgtgttcaaattcaaatgtgaggaactttgaatgcatttgtgatccaagtcattaccaaaaattgtgtaaatataaatgagataaacaaaatagaaatggtggtctcatatgaaaggtatagattggtgtctgatgttgtatcctaattttatgtaccagattcacatgttaaaattctatctagaggtcctgggattattctctctcccttttttttaacatgtgttttatagtcaagttactaagtg

SEQ ID NO: 110506 - DNA, 646 bp, Homo sapiens
cttaaggatgtaatttttcatccgtgtaagattacccaatattctataaaataagagatgttacataactagaaagttgtagccattcaaccatttttctggaactagctttattatcctctactaaaatggttttggccactataactttggtctttcaaatacagatcattattaagtttttaaatccagcagattctctccacaatgtctttctgctctttacctttgaggagtttttttaaatggcaaattattctatatcatctttttaaaagttatgacaattaaagatttaaaatctcagctaaaatattatatatggatttttagttacattttatgcccaatcgctagttgtaagcatagttgtaagcgtgctgaatgaagtttatttgcactttgtgtattcccactttttagttatgtactttataagtggaatttatttgactctaacttttgtaatttagataatcattgtttgtgttcaaattcaaatgtgaggaactttgaatgcatttgtgatccaagtcattaccaaaaattgtgtaaatataaatgagataaacaaaatagaaatggtggtctcatatgaaaggtatagattggtgtctgatgttgtatcctaattttatgtaccaga

SEQ ID NO: 110507 - DNA, 399 bp, Homo sapiens
tggggaatcagatacagtatatgagggaaaagttcaaatcaagaatgactccaaggtttctggtctaagcaactgggaagagggacttggcactaattaagacaggggagacggtaagtggtacaaatcttgggggaaaaggctaagtgtagtcataacaacaaaaatgtggagatcaataccagtcataagcttacatgcaaaaagccttaaaaatgttagcgacagaatccagcaatatataatataaaagagacaatatacatgaccaaactggatatacttcaggaataaaaggttggtataaaaatgtaatgaactcggctgggcgtggtggctcatgcctgtaatcccagcactttgggaggctgaggtgggtggatcgtggggtcaggagtt

SEQ ID NO: 110508 - DNA, 216 bp, Homo sapiens
gaaaaaaaaaatcagtagcaccaaatggaattttaatacaaatattattttgctacactctttattgccctcctagctaaatcaagttatccaagttaatgaaattttccacactcagaaatttggacagggcagttggtgcctgtcagtaaacatagtaaatctaggataacatattttttcgtgcctttttgagttcgtgtgattttgaatgag

SEQ ID NO: 110509 - DNA, 1411 bp, Homo sapiens
cgggaaacggcaaacagcgagatatccgagcgagagtcccgccctgcatcagtttgcggaaccgccttggtagaaggagagaaggggagtggaggaagcacgggactggagggaccaaagttccccgatggcggcccaggggtgcgcggcatcgcggctgctccagctgctgctgcagcttctgcttctactgttgctgctggcggcgggcggggcgcgcgcgcggtggcgcggggagggcaccagcgcacacttgcgggacatcttcctgggccgctgcgccgagtaccgcgcactgctgagtcccgagcagcggaacaagaactgcacagccatctgggaagcctttaaagtggcgctggacaaggatccctgctccgtgctgccctcagactatgacctttttattaacttgtccaggcactctattcccagagataagtccctgttctgggaaaatagccacctccttgttaacagctttgcagacaacacccgtcgttttatgcccctgagcgatgttctgtatggcagggttgcagatttcttgagctggtgtcgacagaaaaatgactctggactcgattaccaatcctgccctacatcagaagactgtgaaaataatcctgtggattccttttggaaaagggcatccatccagtattccaaggatagttctggggtgatccacgtcatgctgaatggttcagagccaacaggagcctatcccatcaaaggtttttttgcagattatgaaattccaaacctccagaaggaaaaaattacacgaatcgagatctgggttatgcatgaaattgggggacccaatgtggaatcctgcggggaaggcagcatgaaagtcctggaaaagaggctgaaggacatggggttccagtacagctgtattaatgattaccgaccagtgaagctcttacagtgcgtggaccacagcacccatcctgactgtgccttaaagtcggcagcagccgctactcaaagaaaagccccaagtctttatacagaacaaagggcgggtcttatcattcccctctttctggtgctggcttccaggactcaactgtaactggaaactgtgttgctctaaccctcctccagccctgcagcctccccttgcagtcatcattcgtgttctgtgtataccaaatgattctgttatctaaagaagctttttgctgggaaaacgatgtcctgaaaatggtatttcaatgaggcatatgttcaggatttcagaaacaagaagttagttctatttagcaggttaaaaaatgctgcattagaattaaagcaagttattttcttatttgtataatgacacaaagcattgggagtcagactgcttgtatattatcaaacattttaagagaattctaataaagctgtattttacatc

SEQ ID NO: 110510 - DNA, 2022 bp, Homo sapiens
cgggaaacggcaaacagcgagatatccgagcgagagtcccgccctgcatcagtttgcggaaccgccttggtagaaggagagaaggggagtggaggaagcacgggactggagggaccaaagttccccgatggcggcccaggggtgcgcggcatcgcggctgctccagctgctgctgcagcttctgcttctactgttgctgctggcggcgggcggggcgcgcgcgcggtggcgcggggagggcaccagcgcacacttgcgggacatcttcctgggccgctgcgccgagtaccgcgcactgctgagtcccgagcagcggaacaagaactgcacagccatctgggaagcctttaaagtggcgctggacaaggatccctgctccgtgctgccctcagactatgacctttttattaacttgtccaggcactctattcccagagataagtccctgttctgggaaaatagccacctccttgttaacagctttgcagacaacacccgtcgttttatgcccctgagcgatgttctgtatggcagggttgcagatttcttgagctggtgtcgacagaaaaatgactctggactcgattaccaatcctgccctacatcagaagactgtgaaaataatcctgtggattccttttggaaaagggcatccatccagtattccaaggatagttctggggtgatccacgtcatgctgaatggttcagagccaacaggagcctatcccatcaaaggtttttttgcagattatgaaattccaaacctccagaaggaaaaaattacacgaatcgagatctgggttatgcatgaaattgggggacccaatgtggaatcctgcggggaaggcagcatgaaagtcctggaaaagaggctgaaggacatggggttccagtacagctgtattaatgattaccgaccagtgaagctcttacagtgcgtggaccacagcacccatcctgactgtgccttaaagtcggcagcagccgctactcaaagaaaagccccaagtctttatacagaacaaagggcgggtcttatcattcccctctttctggtgctggcttccaggactcaactgtaactggaaactgtgttgctctaaccctcctccagccctgcagcctccccttgcagtcatcattcgtgttctgtgtataccaaatgattctgttatctaaagaagctttttgctgggaaaacgatgtcctgaaaatggtatttcaatgaggcatatgttcaggatttcagaaacaagaagttagttctatttagcaggttaaaaaatgctgcattagaattaaagcaagttattttcttatttgtataatgacacaaagcattgggagtcagactgcttgtatattatcaaacattttaagagaattctaataaagctgtattttacatcatctatattttcctatatctccagcagcacggacactgcatgcttgttgattgcttaagacatatgtatactatataaatgtatgcatatatggtctgcaaagttttcatttttcatttatttgggtataaagatgttcagttaatggttccctttttgttttgagagaccagagtttcgctcctttgcccaggctggagtgaggtggggagatctcagctcactgcaaacctctgcttccaggattcaagcgattctcctgcctcagcctcccaagtagctgggattgcaggtgcctgccaccatgtccagctaatttttgtatttttggtagagatggggtttcaccatgttggccaggctagtctcgaattcctgacctcaggtgatccacccacctcagcctcccaaagtgctaggattacaggcgtgagccaccacatccagccataatagttacttataatgagggaaaaacccaaaatatccagtaatatttacatatttactgaaactgtttggaacttgtattagtttgttcttgcattgctataaagaactgcccgagactgggtaatttacaaaaataaaaataaaaaagaggtttaatt

SEQ ID NO: 110511 - DNA, 1207 bp, Homo sapiens
cgggaaacggcaaacagcgagatatccgagcgagagtcccgccctgcatcagtttgcggaaccgccttggtagaaggagagaaggggagtggaggaagcacgggactggagggaccaaagttccccgatggcggcccaggggtgcgcggcatcgcggctgctccagctgctgctgcagcttctgcttctactgttgctgctggcggcgggcggggcgcgcgcgcggtggcgcggggagggcaccagcgcacacttgcgggacatcttcctgggccgctgcgccgagtaccgcgcactgctgagtcccgagcagcggaacaagaactgcacagccatctgggaagcctttaaagtggcgctggacaaggatccctgctccgtgctgccctcagactatgacctttttattaacttgtccaggcactctattcccagagataagtccctgttctgggaaaatagccacctccttgttaacagctttgcagacaacacccgtcgttttatgcccctgagcgatgttctgtatggcagggttgcagatttcttgagctggtgtcgacagaaaaatgactctggactcgattaccaatcctgccctacatcagaagactgtgaaaataatcctgtggattccttttggaaaagggcatccatccagtattccaaggatagttctggggtgatccacgtcatgctgaatggttcagagccaacaggagcctatcccatcaaaggtttttttgcagattatgaaattccaaacctccagaaggaaaaaattacacgaatcgagatctgggttatgcatgaaattgggggacccaatgtggaatcctgcggggaaggcagcatgaaagtcctggaaaagaggctgaaggacatggggttccagtacagctgtattaatgattaccgaccagtgaagctcttacagtgcgtggaccacagcacccatcctgactgtgccttaaagtcagacggggtttcaccgtgttggccaggatggtctcgatctcctggccttgtgatccgccttccttggcctcctaaagtgctgggattacaggcgtaagccaccacgcctggcccacaccaccttttatgtaatcctttctgagtcatgggctggcttggttgtatgttgttatagtagttgttttgctattataaacaatgctgaaatataatccttgattatatactt

SEQ ID NO: 110512 - DNA, 1503 bp, Homo sapiens
cgggaaacggcaaacagcgagatatccgagcgagagtcccgccctgcatcagtttgcggaaccgccttggtagaaggagagaaggggagtggaggaagcacgggactggagggaccaaagttccccgatggcggcccaggggtgcgcggcatcgcggctgctccagctgctgctgcagcttctgcttctactgttgctgctggcggcgggcggggcgcgcgcgcggtggcgcggggagggcaccagcgcacacttgcgggacatcttcctgggccgctgcgccgagtaccgcgcactgctgagtcccgagcagcggaacaagaactgcacagccatctgggaagcctttaaagtggcgctggacaaggatccctgctccgtgctgccctcagactatgacctttttattaacttgtccaggcactctattcccagagataagtccctgttctgggaaaatagccacctccttgttaacagctttgcagacaacacccgtcgttttatgcccctgagcgatgttctgtatggcagggttgcagatttcttgagctggtgtcgacagaaaaatgactctggactcgattaccaatcctgccctacatcagaagactgtgaaaataatcctgtggattccttttggaaaagggcatccatccagtattccaaggatagttctggggtgatccacgtcatgctgaatggttcagagccaacaggagcctatcccatcaaaggtttttttgcagattatgaaattccaaacctccagaaggaaaaaattacacgaatcgagatctgggttatgcatgaaattgggggacccaatgtggaatcctgcggggaaggcagcatgaaagtcctggaaaagaggctgaaggacatggggttccagtacagctgtattaatgattaccgaccagtgaagctcttacagtgcgtggaccacagcacccatcctgactgtgccttaaagtcgaaactgtgggaaccatgatggggaagatactgactgtcagagagtccaaagatgtaaatgccttccactcccacagcaaggaagccgaaatctccagaggctctggcaagagttgagtcaattgcatgcctgcctagtccagctccgtccacatgaatgctctccacaagcttcagaggaaacaggataaaatggactcccaaatatttagggtggtgaaaatactctgcatgatactagaattgtggatacaggtgattatatatgtgtccaaacctacagaaggtacaacaccaagggtgaaccctcaggtaaactacagaggctgggtgaccatgatgtttcaatgtcggttcattagttgtgacaaatgcaccactccaccactctggtggggatgctgccagtgggggaggctatgtatgtgtggggacagagcgtatgtgggaagctctgtactttctgctcaaatttgctgtgaacctaaaactgctctaaacattaaagcctattcaaaaaaatga

SEQ ID NO: 110513 - DNA, 530 bp, Homo sapiens
gccgaagcaaaacggagatttgtctgtgtgtaaagttctcattcttcctaccacaccacactgccttaaaatgtctctgggtctcacaccacagcagggcagcagccgctactcaaagaaaagccccaagtctttatacagaacaaagggcgggtcttatcattcccctctttctggtgctggcttccaggactcaactgtaactggaaactgtgttgctctaaccctcctccagccctgcagcctccccttgcagtcatcattcgtgttctgtgtataccaaatgattctgttatctaaagaagctttttgctgggaaaacgatgtcctgaaaatggtatttcaatgaggcatatgttcaggatttcagaaacaagaagttagttctatttagcaggttaaaaaatgctgcattagaattaaagcaagttattttcttatttgtataatgacacaaagcattgggagtcagactgcttgtatattatcaaacattttaagagaattctaataaagctgtattttacatc

SEQ ID NO: 110514 - DNA, 632 bp, Homo sapiens
agatcgccaagggcagagaccctgtatgtaacatgctgcaacttcagttgcctacacttcagcgtctggatgtacataggtagtacttccagtagctgatggatgatggatgaatacatacatgcatctaagggaagtcacttgacattcttgagctctcatttgttaaggtgggaaatcgtgtcaaataagttcttgtttccaactttaggggaagagatgatatgaatccagggtagtgtttggcatatagtagatgctcaagacaatgttacttccattctggggacagcctgcccactgtccacagcaggggagtctgggtggctccggagcacagatgctgctcagcttgcaggactagaatgggaaggttgtagtgatttatcaaatatcgtttactttagaagtaacataattttaaaataaacatttaaatttattaaacatatatgtagttcttattgctgctgtaagagatactataaactcagtggcttaaaacaacacaaatttgttatcttgcagttttggaggccagaggcctcagtaggtgaaacgccttcactcccagcactcttggggagagtctgtctccctgccctcctggcttctgcaggctgcctgcatct

SEQ ID NO: 110515 - DNA, 224 bp, Homo sapiens
aaagaataccagcttttttccagatggctgcatgcctgatgttcctttatgtttagctgtcattcaaatatgaatgcccagtgattataagtgtctctttctcttttctggactgaaatgaaaccttttatgcattgtgtgttaaaacagattaactgtttggctcatcagtagggaaattagaacaatagctgccaattcaatggtatagtagaagaatgtcc

SEQ ID NO: 110516 - DNA, 217 bp, Homo sapiens
tgcagtgagccaagatcatgccgctgcacttcagcctgggcgacagagaaagactctgtctcagaaaaaaataataatttaaaaataaaaaaaatgaataataaaaaaaagatgcaatgtattattatttattgtaagatccatgaaggcaagaatgtatctatcttgttctctgctatgtccgtagtgactagcaaaaatgcctggcccagacaag

SEQ ID NO: 110517 - DNA, 444 bp, Homo sapiens
ctccttctaggtcaaaatcttcaagaactgagtcaaccctaaaaatacaaatgaaaaactagctacaaaattgtggtgctatacagtcattttggaaattcctaattcctagcccttcattttaagaaacggcaaaactggtgaaacataaaaattaagtgattgaaatacacagcaggtcctaaaactcaggtctccagttctcttttcttttttgagagggagtctcgctctgtcgcctaggctggagtgcagtggcaggatctcggctcaccgccaacctccacctcccgggttcaagcaattctctgcctcagcctcccgagtagctgggattacaggtgcccgccaccacgcccggttaatttttgtatttttagtagagacgaggtttcaccatcttggccaggctggtcttgaactcccaacctcatgatccacccg

SEQ ID NO: 110518 - DNA, 128 bp, Homo sapiens
ttttgacgcagagttttctgtcttatgaccacattacattacaaaccttgcattttcccaattctatcaacttcaacccccccttgattgttgatcccaacagcattcaccaaataaacttcctcttc

SEQ ID NO: 110519 - DNA, 332 bp, Homo sapiens
atctcttctagactatcagaacctttcaagcaaggaccatgagtttttttattcatcttaacataataataagttgtaataattataataaattataataagttataacaacttttaaaactatcacgatgcctcccacagactcaacactcaagaagtatttgttgaatagacaaatatgatatatttcaaagtatctcacagtttgcaacgcattttcttataatacctcattctattttcatgataagcccctatggtgagtatttaaataagaagaaacctgagacacagagaagctaagaaacttgtctagattcacaaatcctgca

SEQ ID NO: 110520 - DNA, 245 bp, Homo sapiens
ggcctgtgacacagtttatacagtttttgcttcttttcattgcttaagtcaagtgtgcttggttttatgtaacaatgaagaatagtactaattattcagactctaccattccttgaagactgaatatgtcaattactctgagaaattcacgtaattcaaaatgtttgcagtaagtgcaatctcatatattattagccaacatttactgggtgtcagtatggttctaaggttgtcccaaaataatt

SEQ ID NO: 110521 - DNA, 343 bp, Homo sapiens
ctgtcttcagtgttggtcaagattagctgtcttaaagtccaaaggattggaccggctagatattttgttgtacctcagaaaaattatcttaatttcctagatattttgttgtacctcagaaaaattaccttaattttctaccctctccaaattttttcaccacagaatatttttttggagaaaaattatcaatattttatggaactagtgggctatagaaaacacacaggatgtactgataaaacacagtagtaaaacacattggtttatgaatgatctctgtattaaaccatctgtacatattggtttaataaaagttcattgctagatctatctgctgaat

SEQ ID NO: 110522 - DNA, 402 bp, Homo sapiens
attttttctgtagagatggggcctcactatgttgcttaagctggtgttgaactcctggcttcaagcaatcctcctgcctcagcctcctaaagtgctaggattacaggcatgagccattgtacccacccccatggaggtaatttttaaccaagattgtttgtcttctgcccctcacatcccaccattcagagcttagttacatgccacagaaactaattatggctaatttacacaggaaaggatttatttacagaaacttgggggtgaagaactaggataggaagacaagtaggaacaagtgaagcatcagccaagaccacagccaagatcaaaccaccaaggccatccataaagggcaccattgtagccagtgagccctttatggcacagagagccctattc

SEQ ID NO: 110523 - DNA, 290 bp, Homo sapiens
aggaagtctatcatggaaagacataccaccatgtgcttggacaagataacgaccgggcgcagtggctcatgcctgtaatcctatcactttgggaggctgagacaggcggatcacgaggtcaagaggtcgagaccatcctggccagcatggtgaaaccccatctctaccaaaaatacaaaaattaactgggcatggtggtgggcgcctgtagtcccagatactcaggaggctgtggcaggagaattgcttgaacctgggaggcagaggttgcagtgagctgagatcgcacc

SEQ ID NO: 110524 - DNA, 439 bp, Homo sapiens
aggtcatggtgaggagagaaaggaaagtagtgagctgtgaagtgtatctggtggcatgagcttattctagtgggagagtgccaagcatccctgaatatttcagagttaatgtactggggcaggaaatcaatatgtgaatacatttttattttgctgcagaatgattcaatctgtgttcttgccagcaaagggatgggttgggaggggcaccagggaagaaagcttatggccatgctcaggcttccccaggcacccaatgggaggctcccagagctggaaaacttgttctagccttctcatttaccctctagagggcaaagatactgcttgaaaagccttaaaagttaaactcaagtttgtttcaagcctgccaagacctctccttaaaccaaaggcagtattttttcctagaatgcctttaaggtgtcctcaatggatg

SEQ ID NO: 110525 - DNA, 189 bp, Homo sapiens
cgtccccgcgcacggccggggtggagcacgggagtggcgagcttcaggtccaccggctgccaccgaaagatgggacctgaagacaggagaggtcgctcagccaagagccccggggaggcggtggtgtctcggcggggtcagcaacggtctgtggggggtcccctgcagcgcgcagccggtttccgcctc

SEQ ID NO: 110526 - DNA, 478 bp, Homo sapiens
  misc_feature (179)..(179): n is a, c, g, or t
cagaacattatggtatgttaagaagcaaggaaaaattgaatagtaatattgggccaggtggcaaccaggaagtactgagaatcccataagcaaaagttcctggatattttctgccatttataagattcagatccagcgactccagatcaggttgagacatggctgctcagagcctcccnttatgtactgggagcagttccgagagaaggcagaacaatcatgggatggacagccattctaaggggtactttccagctttcaccccttcatgctacacatcaaagagcagcagactcagctctaccaggcataactgcaaaccctttctcactaataggagacagtacaagctcagacagtaatgagatctggagtgatgccataggcaccctgttctttgagtcgttgctgagaagtttttttttcttgtcctattacaacattttataaccttatgaatcaatggatacttttattg

SEQ ID NO: 110527 - DNA, 720 bp, Homo sapiens
aaaagagtttgtatcttgagatacagacattcctgggagtttaaaaaaaaactgaaattattcagtttaaaaaatatctgttgtgggtagggccttgtgctgagtgcttggtgataagacttagtgactggagcctcagaggtccccgtgtgagtgagagacaaatacatagaagacgctaatagaatactcagtgtgtattgattccttattgtgtgccaagcaccatgctaggtgcttaatataatcatcttactcaattttatttcatcctcagaatatctctatgtactttgttctataattcctgttttatccataagaaaacttagatatagagaggtcacattctctactctgtcttttacacataaggaaacttagagggatcaagtcacgcttccaggtatacagagttcgtgagtggtgggctttggattcagccccaggtccccttgatgccagaaatctcaaccactgtgcaaaaatcaggtgaatgttggatggctgtagagaccacattctcactctgaccgaggtgctcaggagagtctttccagaagacagcatttgagctgaggctttggaaaatgcaggagagcagtgaaaggggcccttctcatcctgggttgcttactttaataacttggcttttgtaaattaagaaggaggaagaaaagagagaattgcctttccaaattcccttttccttcattattt

SEQ ID NO: 110528 - DNA, 717 bp, Homo sapiens
gttgtgagagttctatatacgtgtatcccggatgcaggacttctcagctgagcgatttgcaccacctgggatgttttcagcgtgtaatgccagtgcatttccttcccgtctcttctctctggctagattcacagccaccgctagataaaaataaagctgtgaggatactgtagatacagttgaatatcctgcttctgcacttcatttttccgtttttttagaaagcatgatttaaagtacatcactgggctgttgtaattcattctagccatttccgcattgctgagcgtttaggtcctttccagttttcagttgcatagataatgcagtgatgttcgtccttgtccataaatcttcatgctcatcacacgggtagccttcttagaaaaaattcttagaaggtgattttaccaggtcaaagggaaggaacattggaagtctcagatactggctgtgcccacattggacagtgagtgttgagggctagggttctgtcgtcatagtcaccactgtagctttagatttttttctgagagagggtctctctctttttttctgcttttgaggtttaaaccatggccagagacagggtctcgatctgtccctcaagctggagtgcagtggcgtgatcttggctgactgcaaactccacctcctaggctcaagccattctcctgccttagcctcccgagtagctgggattataggcgcgcacca

SEQ ID NO: 110529 - DNA, 387 bp, Homo sapiens
ccttgcactctccatgcccttactcactgtaaaacctggcatagggctagtccagcagcctcctctcacactcccaccccaggcttctggcacagccatcagaccccctctccagtgaccatcacaacaggatcaagctttctaacctcagctgagcctcggttgctgcttgatagacttttggtgtcctgctccattttctctcccagtacccataacagcaattccaaaccttaagcatggcaatgtcctctccactctccacagagaaacctacctgcttctgaggagagacctccagagagaagcatcagcttccccagccccacacctacaagcatgcttgcacccagcccatctttgttctcctcactccaggtagacggg

SEQ ID NO: 110530 - DNA, 476 bp, Homo sapiens
ctggtggaaataggaattagtgtgataaccacttaggaaaattctttggcagttatttcagttatctatcgctgtatccaggccactctcaaagttggggaaataattggcatcctgttttcagataatatttagagcagggaaaatgaaactattatttgaatggagaaatttaggaaaattttcacattaacaaaagaaaaaagttggaaagaatggcagtttgactagcccaacacaaatagagggaagaagaggaaacattatacaataataaaagtaaggggaaggaataagatcattgtatcaattattaggctaaatgtgagcagactgaattttgccattaaaaagggcatgtcaggttgcacgggtggctcacacccgtaatcccagctctatgggaggccaaggcaggagggtatcttgagcccaggagttcgagactagcctgggcaacatggggaaaccccatc

SEQ ID NO: 110531 - DNA, 394 bp, Homo sapiens
  misc_feature (361)..(361): n is a, c, g, or t
  misc_feature (377)..(377): n is a, c, g, or t
  misc_feature (379)..(380): n is a, c, g, or t
  misc_feature (382)..(382): n is a, c, g, or t
  misc_feature (385)..(385): n is a, c, g, or t
  misc_feature (389)..(389): n is a, c, g, or t
  misc_feature (392)..(392): n is a, c, g, or t
  misc_feature (394)..(394): n is a, c, g, or t
ttttccattataaaaatgatatttgtccatcatggaaatttggaaaatacagagagaaaagactgtggcaatggcttgtattttcctcccccaggtgaacaaatattactttaagggttttccccagtgtctccccttcacttgagggtcctttgtggaaatgtgtgtcttgcgttggctactttgtgtgttaatgagagacccttactggacgcattaaaatttgagctgggcacagtggctcgtgcctataatcccagtgctttgacaggccgaggtaggaggattgcttgaggcctggagtttgagaccagtaaacaacaacaacaacacttgagggtaggagatagttttttttccntttttttttttttttncnncnttngganaancn

SEQ ID NO: 110532 - DNA, 259 bp, Homo sapiens
tccttcctgagtatatgattagttttgaaaaacatacatttaggcctttgtttcagtaagataatatgtgcaaaatgttttggaagactatttgattcctaccaaatttttgtagcctttctgttataattgatcattttctgcttggtacattattgattgtggcatcatttttgtctatgttatcaacgcctatttatgttgtttctactaataggccagtacttcgctacttataaggaggcacacaaaaaaggca

SEQ ID NO: 110533 - DNA, 421 bp, Homo sapiens
cagaaaaacagaaaccacactcctatttcaaacatagggaaatataatacaggaaattggttatataggtgttggaaggcaaaaagagaaaaaaaagggagtggggggacacagttattaaaaagatagtaactgcaagaagcaactaccacactaagagctgggaaataaaagggatgaggttatcattactcgggagctacagggatccctaagctggcacccagacttctaaggaggggacagtgttcaactgctgcttatattgaagtccatattactaaaagatgttcatatacataagaaatctaaatatttaaattgtgtttgaacatgtcttccctctcaaatgtagttctgaaaataaagcataaagctaatttgacttttatcaaattaatgatctatgctgcttctgtat

SEQ ID NO: 110534 - DNA, 365 bp, Homo sapiens
cgtgccctccagcacatattagtacaaagtaagcaggaaatgcagaagttattcagaagcttaaactaagacaactgatgaaggtggctgcactaaacaacagctcaggagtgtgaggcaaccaagccaggagttaaggcaggcaggaaccacaggtgtggcacattcagctgatttagggatgaagaactaaattgaaagctggattaagaacccttgcagagaaagacttttgtgaagctctgcccaaggcagcactaatgacaaagcaccaaagggtcacatgatgctcttagtgaacatgtgttattgcatgtcacacccctgtcctggaacataagttctcggtagctggagacagaatg

SEQ ID NO: 110535 - DNA, 767 bp, Homo sapiens
acaggtgggcatgaaaacacggaaaatcacagacgcacaggtgggcatgaaaacacagaaattcacagacacacgcaggtgggcatgaaaacacggaaattcacagacacacaggtgggcgtgaaaacacggaaattcacagacgcacaggtgggcgtgaaaacacggaaattcacagacgcacaggtgggcgtgaaaacacggaaattcacagacgcacaggtgggcgtgaaaacatggaaattcacagacacgcaggtgggcgtgaaaacacggaaattcacagacgcgcaggtgggcgtgaaaacacggaaattaacagagacgcacaggttggcatgaccaggctcgcatgggcaagatgtggtgtttcttccagattaccgggcagcagagcggggaccctgtagggagtccccactgggagtgtcttgggccctaaaaattttgtcagaatgtttattttctttatgacctaaggaagttttaaaaaaatctgtcattttccaaacccttagcaatataaggtatctggtaagaggcagacagtttagaagcatccgttttattctagaattcaacatattgcatggtaaagtattttcaagcctacttattttggttgttttagggatgtttgttgatacaaacataataaagtgtttcttgttccgtgagcgctcactcagcctcgctgcagtgcggatccctcggttatgtgcacggatctgactccagtgtgaaatcgtagcattttctttgattgt

SEQ ID NO: 110536 - DNA, 386 bp, Homo sapiens
tctagaggatcccgagaagacgacagaagggaggaagagaaggaaggaagtatctcaagcagaaggggggaagacgacagaaggagagaagacgacagaaggggaagaccctgctgctcccatctcagtaaatgcacatcatccactcactcacttgtctgagtcagaagtctggacagcagcctcgattccttatttacagtcacagcagtggggaaatagagcagtggacagatgaatggattccaaagatgtcctaggtcctagtggtctattcttttccagtccaactcattcattatcaaagtcctgttgatcacagggcctcactctgtcacccaggctaggagtacagtggtgcgatcatagctcactgcagcctcaac

SEQ ID NO: 110537 - DNA, 489 bp, Homo sapiens
tgctgttgttctggggaccacacctagaaccattagttgtaaagcattacgtgttgataggtaaagtttttaatgattcatacacacatgtatttatacatatacacacacacacgtatatatacgcacatactttttaccataaaaaagctaatgttttcaaatgtaaattgtgattgagggtttagagaatgttacgattagagaatggtccccacgtgcctgtgatcctaattggtacttttagggataatcatgggaaaatctcatggacctatggaactggctaattactcctagaggtaatacttgcagtttattagggtcaaatagtaattgtattgcttctttttatggttggaagtcttacagaaggtggggaaaagatcacaatttgttaggttagttatgaaatgttcagtaggccctcaaagtatgagcagtttaacttgagaatgttccaacactcgggtgactaattctattatg

SEQ ID NO: 110538 - DNA, 547 bp, Homo sapiens
  misc_feature (146)..(146): n is a, c, g, or t
  misc_feature (467)..(467): n is a, c, g, or t
gagtgttcttggagtccggggaagttggcctttaaaaatcaaactgccatggacactgctttacccaaaatttggttcacattcttcactggattaactattggggcaaacaacgtataaccatgtaaaaccagtacgcttgtatnggcatttcatggctagagttctaagtcacaagcacctcttcggcaaagcccacctccctctctcgcttgattccccggccatccttatcaaagaccttccaggtgaacaggcagccatcctcagcagcagtcagcaggaactgatcatcaaagaatcttgctctgttgcccaggctggagtgtagtggtgcgatctcggctcactgaaacctccgcctcccaggttcaagcgattctcctgcctcagtctcccgagtagctgggactacagaaacttgcaaaaatagcacagagagagtggacttctggaatggcacggcnaacaaaattttccccccttaaccggggcaagcacccaaaggcttgaaattcagccaatttcccaaaaagggttgggatgg

SEQ ID NO: 110539 - DNA, 510 bp, Homo sapiens
ctcaaacgaatcacccaccttgacctcctaaagtgctgggattacaggcgtgagccattcgtgctgggcccaaattttaaaatacagtataacaaatatttgtatagcatttatattattaggtattataagtaatctagagattatttaaagtatacaggatgacgtgaatttaagttacatggaaatactacacccttttatgtcagggacttgaacatctaagggtttttagttagggggagccggtcctagaaccaatcccctgtaaatgccaagggatgactatatatatatatatacatacatttctgtattactattattatttttgccctcattttaccctatttcacaatttctcttcggttgttatatgtttggaatttattctacaaaattgtgaggtttttttcttttgcagtattccttatgatatgttttagtcaaactgcagaagctaaatatatagttttccagtgaaataagtagtcttttgactctatggtc

SEQ ID NO: 110540 - DNA, 362 bp, Homo sapiens
aggggacaagatccaggctgaggtagcagtccaggactcagatcagccagtccctggccctgtatgctcccctccatggccagtcctgcccttttgttcttgtagctataaatcacactttagtattttttccatctcttctacatttacaaatcaaaatcatctcaagccataacaacttgcctctttccttacctttcgcaaagcaatgaacttaatgcactaggcattagcaaagggaatcgttcactagctgcttccatcactgggcctgccaatgtcccagcacttcacacctggaacacaagtgttattgccacaaagcacacccaggtgtgctatcacacacttgtgtggagatg

SEQ ID NO: 110541 - DNA, 317 bp, Homo sapiens
tgagtgggggagatgatggtgaggggttagcagtgtctgcaatttcagaggggttgatcccttcattctagatagtcaccttatcacccttgtttgctgtcgttactgtatatcatgtctgatttcagaaattttatttcacccaaagccttcagaccagcagctcttgggttgagaggaatggttcccagccctttttgcacatcagtgttcccagggttgctttgaaagagtacttgggccacttttgagagtgtgcattcctgaatctcctttccagagactgtgatttgaatggcctgagttgctccaagctg

SEQ ID NO: 110542 - DNA, 303 bp, Homo sapiens
atggtgtgtgcctgtagtctcagctactcaggaggcttgaacttggggcttggagaccagcctagaagtaaatctaggcatcttcccccttcccatagcctattaccctgcatgtgaccctgccaacagaagacaagacaaatggacaagaatcctctaactttaaacatcagtatgagggtgaattaagcacctggaacagaagtagataccagatatacataacacagccctcatttccatcttcacacctccccaacctgttttttttcataaaaccaccagtctacaactcagcaacag

SEQ ID NO: 110543 - DNA, 714 bp, Homo sapiens
ataacaggcatgcaccaccatgcccggttaattttgtgtttttagtagagatggggtttctccatgttggtaaggctggtctcaaactcccaactcaggtgatccgcccacctcagcttcccaaagtgctgggattacaggcgtgagccaccgcgcctggccgacagttgtatttctcactcctgcttgggggtagagaggaatgctgtctccctttgggtgtaaggtcttctccagggtgattctaaaagccctgccccccacttctaccccaccccactgcatcctgttattgcagtcactactacatgctttcagcccttgctgatgggggtgctgcttggcaaactgccagcaagccagtctatattaggaagtgttcaagttttccctagaatgaaaacagagagataagggctagtgtcaggcttggaagaatgatctcattaaagtattaaaacctgcatcctacatagctgagaaaataatatcctttccaaagcacatggctttcttttccttggaaattcagtgaatccccaaaacttgtggtttttaatgcaggagactcagctccctttggcatctcagcagacacagaaagatgtaaaactgtcaccccacagacaaattccttttgatgccttctcttggccaccacacgtggaccaggagataaggggagctacgtgctcatccgtgtagccactgcca

SEQ ID NO: 110544 - DNA, 248 bp, Homo sapiens
cagacacccttacacacatgcatgcacgttccgtgatctgattatgattttcaagatctctctgtagtcgtaagctagatgtgaatacctaggtgcttattatagcatcatctatactttgttatatgcctgacacattccacagttttcaaaagctattattatggaagtctaagcaagaaataatagtggcagcgagatgcataaaagaacaacctggggaggtaaagtgaataggacttggtatt

SEQ ID NO: 110545 - DNA, 408 bp, Homo sapiens
ggtttcctacaattcaattcaattatgacactgattacccagagtaagcattcgaatccacaggtttaagggctcagtcccaaagactgctcccactttaggcactagtcataaatatcaggtctccaggctatccatatttttgtccaacatggctacaaatttggggtttcccaccacctcccttcaggtttgatgatttgctagaatgaatcacagagctcaagaaaacactgcgtactgttacaggttgagcatcctaaattggaaaatctggaattcaaaatgccccaaaatccaactttttgagtgtccacataatgctcaaaggataatgcttattgggaagtattttgcattttctgacatagaatgctcagttggtaagtataatgcaaataatctaaa

SEQ ID NO: 110546 - DNA, 608 bp, Homo sapiens
tgagacagagtctcattctgttgcccaggctggagtgcagtggtgcaatcatggctcactgaaacctcgacctcctgagctcaagctattctcccacttcagcctcccaagtagctaagagtataggcacgtgccacaatacctggctagtttaacaattttttgaagagacagttcttactccattgcccagactggtctcaaactcctgggctcaagcaatcctcccatctctgcctcccaaaatgctggaattacaggtgtgagcccctgcacctgatacttatcataccattttctacccagtcacctaaaccagagacctggtagtcactcctgactctgccctctctcaggctcatccttatccccattctatcagtccatatcttatcaattctaccttctaaacaactgaatgcttctctgtatttcccagaaaaaatatctctgcctaggcccttaacatttctcacccggaatactgcaatcaaaggccagtgacctgatcatgtcctgaccctcctcccagtccagcttccatagctgccaaagttatttctctaatatgcaattctgagcacagcaactttacttcaaatcttcat

SEQ ID NO: 110547 - DNA, 302 bp, Homo sapiens
cgtccctcaagttccctaagcttgccaggggctgaaacccagatcaaagctttttggaggaatcagccttctgaggactttcctctgcatctgctcagtgggtggcatctggaaatgacaggcacttctcgcctctgtccactgctctctgtgggcatcccagtctacctggacagtcctcctgcccaagcagggcaagcctctgacggattcccctaatgggcagcatggggctgggcagggcaggccatccagagtgagaccaagcctgcagcaggagagaaggccggtcgctggttggt

SEQ ID NO: 110548 - DNA, 462 bp, Homo sapiens
gtgccatgtacttacttcctgccgggctttgactgaaacaccaggcttgttccaactggatggctttgcacgtgatggctcccttcttgaacactcttccctcagatctcagcacggtcggctccttctgagggtgtccagcctcagcacacatgtcagcgcctccgaggggcctcgtctgtttaccctctcatcgtccatcctagtaccatgcgtcattttctttatatcactttgaccctctgaaatgatcaatacttggttggctgactgggcttgtccagggcatccacaccctcctaagtagatgaggagttggcaaatatattctgttgaggggcagagggtaaatatttttggctttgcaggccatatggtctctgtcacaactactgaagtctgctgttgtagcaagaaagctgccagagacattacataaatgagtggacatgcctgtgttcc

SEQ ID NO: 110549 - DNA, 333 bp, Homo sapiens
aactgtacaggccaccaggaggcaggaggtgggccctcagagcttggctggagaaagttcggggcctacaaaggcggttgggagctgggcaggagttgagccaaaagagcttgcttacttgctgggaggcagggccgggagagcccgacttcaggacaacttgggcctgcggcggtcgccgggaggcccaaccttggcgtggaggagcccaccgaccggagaccatttggggcctggagatgccatcggagggcaggagctcatcctggagaggccaccgtgaggcctgacctgggcctggggagcttggcttgaggaagctgtgggccgacc

SEQ ID NO: 110550 - DNA, 236 bp, Homo sapiens
gacctgagtcgggccagagtccggcctggagatgcggccgggagagcccgacttcaggacaacttgggcctgcggcggtcgccgggaggcccaaccttggcgtggaggagcccaccgaccggagaccatttggggcctggagatgccatcggagggcaggagctcatcctggagaggccaccgtgaggcctgacctgggcctggggagcttggcttgaggaagctgtgggccgacc

SEQ ID NO: 110551 - DNA, 192 bp, Homo sapiens
taccaagctcacattttaggcacttacttactccatttgggacatttctttttaaaatcatttttatctattcacaagaatgattagtcagaaaacatagtttggaaacctattaattatctcccctaactcaagaatggtggggagcagaaataaataaaacaaggttttccattgtaaaagactaggggg

SEQ ID NO: 110552 - DNA, 637 bp, Homo sapiens
tgtcttgagataaatggacaacaaatatgagcaattaacaaaaatgaagaatgataagcctgtagaaaaaatgttcagcttcactgataataaagaaatgctaatctaagtaatgaaatatcatttccatgatgaaaatttaaaagatgaacaggtagtaagaattcctgatgctagcaaggatatggtaaagaactcttataccccaaatatgaatttgtatggccatcctttgacaggttgtccacaaaaacacccagaagtagaaaacttctaggccctgcagcaaaatatagataagaattcattgccctagtgcaacaaagcagtatttcaaagccaagaacctagactttaggcctagatgacacttgctgaatagccaagcaattgccttatatgttgagggaggagacccataaagggtaagaccctacaattctagtcttctctgacctggctgagatgttacttcacttttagaccaagaccactaaagttcagtgtgtctccaagagatacaaggaaagcaagcaggagcaaactgagctgcatcactttctggtatacattctgcaaactgcttcagggctaagccaacaccatgttcccattttggcctgtctttgaatcccaa

SEQ ID NO: 110553 - DNA, 312 bp, Homo sapiens
caactggttttaatttttcacttaccaagtaagtgatttaaagtccaacaagatcaagtatcagtaagtatactagggaaatggcaactttcaaacacttggtgtaaggataaactgatataacctctttggagagcaatcagacagcatttattaaaatatgtgtttcctcccatccagtgattctgtccaaggtaagtactccagagaagttctcccacctcatggcagagagacatgcaccagagtgttgatgaaacgctgaaaacaccaaaatggccccagtgcagtggctcacgcctataatcccag

SEQ ID NO: 110554 - DNA, 258 bp, Homo sapiens
ctcccaacaaaataacccagccagaacaccccacattattgagtaccacaggtgcagaacttccaattgtctttttagtgtcacagtcttaaatatgggcaactaaggcacaacagatacttgagggacaaatctaatattaaaaagcagagaaaaaatcaacagattcaatgaggaagaaacaaataatgaggggagatgaaaatttcaagaaattattaatattcagagagaagagaagatactgtatccatgaaa

SEQ ID NO: 110555 - DNA, 322 bp, Homo sapiens
tctgttgttatatgcatccaaacagaggccggaaaatcatttgtctgagatgaggtagtgatttctgcaaatagggatattacactgatgacttctacgtttctggatgtaacatctcatgattctattcccagttacgtggacttgggaccatccttctcctctctagacctcatttttattccatggagttatatgatcattaaggtgccttgtaggccttgcattaaaaggttcctagttttaaagggcagagatggaggccaaggacactgagcactggctaggatttctctcactgagggtcctgtttagccaaggg

SEQ ID NO: 110556 - DNA, 236 bp, Homo sapiens
gggattatagatgagccacggcaccaggccggttctttctgttttgtttttgtgataagtagcagatccagtcctgcactttcctgtaggggagagtctctttctttcaaatggttgatcttcagaaataactggccacacccagatggaaatagcttgatttgttttcttttctttttttttgagatggagtttcgttcttgttgcccagactggagtgtggtggcgtggtctca

SEQ ID NO: 110557 - DNA, 182 bp, Homo sapiens
cactgaagcctctgttcctcagattgtgttccactgtgttttggcagagatttctttggaagcctggagctaagcaaacaaaacaaaacaaaacagagcacttctcctagtttttgcatttaactctgtgactccaggtttgcattgagccaggtgatcagtctgaggtgaaagccgagaaa

SEQ ID NO: 110558 - DNA, 230 bp, Homo sapiens
tctaccccagggcgtcggactcctgaacccaactctctttactgtgaggttgtgctgtgttgagcagcatggagggctgaaggcagggaaatgttagcctggatgtatttctctctggatatatttcctataaattacatcctccccctcttgtatatgagcatctggtaagaagacactgaataaattagcttttttttttttaagccttataaattccaagtgttagt

SEQ ID NO: 110559 - DNA, 284 bp, Homo sapiens
cccttcctctcacccaggcccaacccatggagcgaagagtgaatgcacctggctcagctttcagactggaggctgctcgagagcaaggcctgaggccgaggtttcttgggggcccagcagcaccagtgtgagggggcgccgaggagaagaccagcaatttctgcctgtgggccattgaggcatcaggcctccaggtcaggggggataccaccccacccaccaataataaagcccctgtgatttaagcccaataaaaaggcccggggaaggaattcaggcttggc

SEQ ID NO: 110560 - DNA, 258 bp, Homo sapiens
gacacagccacgccaacacccaggcaacattcaaggatgtgcatgcagtcacacaaacacctaaaaaaacagccacaccaacacccaggcaacacccaagggtgcacatactgtcacacgaatacctccagacacagccacgccaacaccccaggcaacactcaaggatgtgcacactgtcacacgaatacccagaaactcccacagttacatggatgataaccaaagactgtttatttttgtttttgtttggagaca

SEQ ID NO: 110561 - DNA, 406 bp, Homo sapiens
aagctaccaacactggctcaagaagagatagatagcatgaatgctcctatatctgttaaagaaattggatttgtaattttaaacttttgacaaagaaaactctgggcccgtatggtttcattgacaaattctaccatttaaggaataaataataccaaattctacaatttctttcagaaaataaggaacacttctcaacttattctatgaggctcacattatcatgataccaaagaaaaaaacttagaccaatatcgtaagtatagttgtcaaaattttcaacaaaatactagcaaatccagcaatatataaaaaggataatgcattgttacgtagtacagtttattccaagaatgaaaagctgtttgaatatttgaaaaagtcaatgtaattcactaataatgac

SEQ ID NO: 110562 - DNA, 446 bp, Homo sapiens
gggggcgattgatacggcttccacagtgctcccacccacagagcccagggcagaggcccgaggtgcgccaggcttattttacagctttaattcccatgagcaggattggagaaagggttagtaaaggagaaaaggactcagatgtgtcgggtttcagggaaggaactagtgagatcggggtgacaaggggttcatttgtccatttggtaagtgtttattgaaagtccactatattatgtgtaaggtccttttgacccagaaagtctgaaatttgggtagcagtcattaatttgtattagataccacatatgttatagaagtggtagaaataatgttaataatgtcatacttccgttcccgatggtcacatgctaagtgcgtcacatctattccattgaatcctccccacaactgggatggggtggtattgtcctcgctgtgcaggg

SEQ ID NO: 110563 - DNA, 1094 bp, Homo sapiens
ttatggatattttaactggaattgcagttctgatttttatgttgtgtttcattaaggcagtttttgaagttgatctcaatgaagaccagagagaacaaagttcatgttcacttgtttttctgccagctctggaagttatggatacagtttccttatgcaaatagaataaactttcttcctgttatcaaaaagtcttggggctaaaatatttcatacttggtccttgcctcaaactatttgttatgaatatagaacagtgttccatgtatggaaaaatagctgcttcttaaatttccaaattcactaattcactgtatagaaaaatagctgcttcttaaatttccaaattcagtaattcactgttccaaatccaaggcttgtcttttcagtaatggcttttccttcttttttttttttctttctctctaaaacagatagtctgtactactaaaagttaaatgcttaacatggtgcagttctcaaagttataatgtatctggatactgaataatttgaatattactaatttgtcattttttgcatgtaagcagatagctaggatacgttctcataatgatttgtcatttaaaaatatacattttttattgagtatgaatcagattgtctgaaataggtactagtacaaggctatgaagagcatttctagtttcttattatatatattaccaattgcttcctaaaagtggtgacacttttactgatacacatagtaatcattttactatgatatgcatagtagttacatcttttggcttctagttggattactttttttttccctgcaaatttgggttttgattacttgagcatagtgatcaaaaaagatcactgggcatccatataccgtttcattaatgattaatggactacaatattgacttgtctcatgttatcaaagttataatctgctttatatagcaagttcactttgctttaaacagcttttaatttatattattgttcttgaaaaggtgagtaaatatgcaaattgaataattttaaaatccaaggcaggttttgtaagaaacttagaggcagagagaatttttgtaaagagaaaaattatttatttt

SEQ ID NO: 110564 - DNA, 154 bp, Homo sapiens
tgcagtgagccaagatcctgcctttgcactccagcctgggtgacagagcaagactccaactcaaaaaaaaaagatttcttcttgtattaggggtgttcacagaataaaaaagaaagtttattaattaaacaaactgaagtgaattacacatcta

SEQ ID NO: 110565 - DNA, 325 bp, Homo sapiens
tgcagcttctacccaagtgtggaaaatgaacccagcagggacctgcagcttctacccaagtgtgaacattgaacccagcagggacctgcagcttctactcaagtgtggacactgtaccaagcagggacctgcagcttctacccaagtgtggacactgaacccagcagcaacctacaagtgtggacactcaaactgctttatgacctaagtttactttttctttcttttttttttttttttgagactgagtctggctctgttgcccaggctggagtgcattggtgcgatctccgctcactgcaagctccgcctcctgggttcacgc

SEQ ID NO: 110566 - DNA, 301 bp, Homo sapiens
cctattccaccagctcattccagcctctcatatctaatatttgcctccaaattactcaaaatggcaatcaggaaagttatgaatgcttcctgatttaacgaaaacctactcaataacttgatattaataaatttccttcccattatcatcagcttttttccagtatacctactttggcaccaattatttttcattctctactcaccgtcagaagttaaagtatctacagctaggagtaatataaaaacaacagtgaaagtttctttttttttttttttttttttctgagacagagtttcac

SEQ ID NO: 110567 - DNA, 424 bp, Homo sapiens
acaacaacttcctgtggaatgccaaatataatgtgaaataccaaatataaagcattgcgtctttacatacttcagcctttaccacatacaaacaattctaattttacacagagtcctttctgagaaattttacttcaaaccaaacttagaatactcagtgagtgagggatccagagagccactaacaatcccttgtggttgactgaaatatattagttatcccttacttaacattccttggtgatgaactcatgatcagaaaaaccagtttgtaggtagacggtatagatacagatataaataggcatatacatatgctataataactctaatgcacttaaaataaaacctgtagttttttaaaatatttatagggtagacctagtaacaagaaatcaaccaactcactcatccattatctaag

SEQ ID NO: 110568 - DNA, 930 bp, Homo sapiens
agtagaattttaccttaattcacttaaagaaaattaaccattttttggtccaacttcagatattttcttaatccagaagctgtgactgttcccagaagaaacctcttatatcacatttaaaacataaaaaataattacactttcactcattctaatgggtaaattgttgaattgtaataaacaactgtatatttacaaacaggtttataaggtatttgtctatcaaattaataataaaataaaacttacggggtctgcaaggaaaactatgaaggccacttaaagtggttcaggtatccctttgtcttgtagggcatagctgttggtttagccaggcttttacagtatttaattttaaagtatcctataactatcaacttcccaggttgaagacgatgtgttgagtttcctactgattgattgattcctgtcctccccagtgtttccgtcactggttcactaaaacagtatttatatagctccactggctctaaagctcttagtccttctaatattttggattttacaagtaaaaatggaaaaaaaatagaaaagagacaatcaaatgcctggagcttaaaacaaagtatgtgcaacctaccatctcacttgaaatttaataaaataataagtaattatgtaaatataacatagagttatagatttatattttgttcataacacatagtgtaatataagttgtatattttcatgtttttggttttatgttatcattcatgccacaataaaaataaaacaggagtttatgtgctcttaaaaaaaagatgtgggttgccaccaacctgtttttcgtttttgttttttgtttattttattttatttttttgcattctcctttttcagtattactgccatgcaaggcaccaataaaaacagcaaatgtgttcttcacttattatactgtgtttc

SEQ ID NO: 110569 - DNA, 383 bp, Homo sapiens
agtgatttttatatttaaaatatattaattaatggtcttatggttgtatagaagaatgtccctctaattaggaagcacgtgctaaaatatttaggggtcaagtgtcttcatgtctgtgctttcaaatggttctagataaaatgaacatgtcagaatgctaataattgatgaatataattatggatgtcctggtgattattatacgttttttcaacgttactgtatgtttgaattttttaataataaatttggggtctgggcacagtggcggtaattccagcacttccggagaccaaggtgggaggatcacttgagtccaggagttgagcctggggaatatagtgagaccctgtctctaaaacaaaacaaaacaaaacaaaacc

SEQ ID NO: 110570 - DNA, 1608 bp, Homo sapiens
ggcagccgcggcggcagcaggagaaggcggcggcggcggctagggatcagacatggcggcggatctgaacctggagtggatctccctgccccggtcctggacttacgggatcaccaggggcggccgagtcttcttcatcaacgaggaggccaagagcaccacctggctgcaccccgtcaccggcgaggcggtggtcaccggacaccggcggcagagcacagatttgcctactggctgggaagaagcatatacttttgaaggtgcaagatactatataaactgaatagatttccttttcattcttcctgggaatagaagatgtaatggaagttccagtatctgtatgcaggcctatgactagcttcacttcttggtgactaatactagttgacaaaacagcatattctaaactgattgtcttcgttatccagtagctttcctattctccataacaaatgttccaaatctttgattactcacctcagaatgcttgtctcactcctcttttcctcattcctagtagatcataccttggagaagaaagtagaaactatcaggcctgaacttcattagctttttcttcctcttcaatccaaatctgtctgtatcttcattcatttttcttaaccctttccttgcttgctatttctgctttccaaaaccaaggaaggaattttgacagaggtacccaaggaattcactgggggaaaatgaatgattcaataaatgatgttatgataattagatagatagctatatgtaagcataaaaaatttttaaaaccttaggcccttattatcatatcatgcacaaaaattaagtggattattgatttaaatgtaaaaacaaaaagtataaaacttttagaaaaaagagattatttgtgacattgggtctggcaaagatttcttagatgcgattaaagatttacaaaagaaaaaattgataaattagacttcatcaaaatttagaaattttgctttatctgtgtaggatactgaagagaatgaaaagacaagtcacagactgggagaaagtacaggcaaatcacatatttgtcaaataactcatatccagaatttttaaagaacttttacaactcaataataacaagacaaacagctcaattttttaaatgagggaaaaatttaaatatatttcacatgagaatatactcaaatagccagtgagcacatgaaaagatgttcagcatcattagacattagcaaattgcaaattaaaaccacactgaggaacccactaggaatggctataatcaaagacgatcagtatcaagtattgcggagaatgtggagaaactcaaactctgttacactagtaatagaaatataaaatgttagaaccactttggaaagagattggcagtttctggaaaaaattaattgtaaatttgaccaagcaattttactacgtaagtatgttaagaatgaaaacgtgtgcacacaaagatctgtactaaaatgttgatagcattattcataacagcctaacagtgcaaatgtctgtcaactactgtgaatggagagacaaaatgtgtttattaatacaacaaaactacccagcaataaaaagaaataattgactgat

SEQ ID NO: 110571 - DNA, 427 bp, Homo sapiens
gttgctatatgatttttttcttatagctgtcacaagatgaaggtagaggcacattatacaaatacagacctgaagaagtagatattgatgtaagtattagtatgatatatgtggtcagtactctgtcgtattctccgccaaaaacactggaaataagcatgaccaaaaaacttctttctcccaagtcctccaaagtgacatcaggtaaattcatattttatgtgtgtgctctaaattattattccctgccctctacgtcccactgctccctattgttagcagtccaacgttattaagcatcacttaaatgaaagtaaaaactgtttctgatttttagaagttacagattggctggtctcgacctcctgacctcaggtcatccacccaccttggcctcccaaagtgcagagatacgggggtgagccac

SEQ ID NO: 110572 - DNA, 368 bp, Homo sapiens
gaaacaaagacaaaatgcctgaggatgttacattcagccctcaagatgaaacacagaccgcaaatcataaaccagaagagcatcctgaagaaaatacaaagaacagtgttgacgaacaggaagaaactgttatttcttacgaatcaactcctgaggtttctagaggaaatcaaacaatggcagtgaaaagtctgtccccatctcctgagtcctcggcatcgccagttccatccactcagccgcagctcacagaaggatcacatttcatgtgtgtgtagtcttagaagaactatactgacttctgttgaaaccattcaaagctaaagacatggaccttcagcagtaccacgattcgctaagccctggag

SEQ ID NO: 110573 - DNA, 3756 bp, Homo sapiens
gcgtcggtgactctagaggaccccgtcaatttctacacagacgaggttggctttataaacaggacagtactggcatgaaattgtggaagaaacgctggtttgtgctttctgacctttgcctcttttattatagagatgagaaagaagagggtatcctgggaagcatactgttacctagttttcagatagctttgcttacctctgaagatcacattaatcgcaaatatgcttttaaggcagcccatccaaacatgcggacctattatttctgcactgatacaggaaaggaaatggagttgtggatgaaagccatgttagatgctgccctagtacagacagaacctgtgaaaagagtggacaagattacatctgaaaatgcaccaactaaagaaaccaataacattcccaaccatagagtgctaattaaaccagagatccaaaacaatcaaaaaaacaaggaaatgagcaaaattgaagaaaaaaaggcattagaagctgaaaaatatggatttcagaaggatggtcaagatagacccttaacaaaaattaatagtgtaaagctgaattctctgccatctgaatatgagagtgggtcagcatgccctgctcagactgtgcactacagaccaatcaacttgagcagttcagagaacaaaatagtcaatgttagcctggcagatcttagaggtggaaatcgccccaatacagggcccttatacacagaggccgatcgagtcatacagagaacaaattcaatgcagcagttggaacagtggattaaaatccagaaggggaggggtcatgaagaagaaaccaggggagtaatttcttaccaaacattaccaagaaatatgccaagtcacagagcccagattatggcccgctaccctgaaggttatagaacactcccaagaaacagcaagacaaggcctgaaagtatctgcagtgtaaccccttccactcatgacaagacattaggacccggagcggaggagaaacggaggtccatgagagatgacacaatgtggcagctctacgaatggcagcagcgtcagttttataacaaacagagcaccctccctcgacacagtactttgagtagtcccaaaaccatggtaaatatttctgaccagacaatgcactctattcccacatcaccttcccacgggtcaatagctgcttatcagggatactcccctcaacgaacttacagatcggaagtgtcttcaccaattcagagaggagatgtgacaatagaccgcagacacagggcccatcaccctaagcatgtctatgtgcctgacagaaggtcagtgccagctggcctgactttacagtctgttagtccccagagcctccaagggaaaacgctgtcacaagatgaaggtagaggcacattatacaaatacagacctgaagaagtagatattgatgccaagttaagccgattatgtgaacaagataaagtggtgcatgctctggaagagaaacttcagcaactccacaaggagaaatacacgcttgagcaagctttgctatcagccagccaagagatagaaatgcatgcagataacccagcagccattcagacagtggtgttacaaagggatgatttacaaaatggactgcttagtacgtgtcgagaactttctcgagccactgccgaattggaacgagcatggagagaatatgataagttagaatacgatgtaactgttaccaggaaccagatgcaagagcagctggatcaccttggtgaagttcagacggaatcagcaggaattcagcgtgcacagattcagaaagaactttggcgaattcaggatgtcatggaagggctgagtaaacataagcagcaaagaggtactacagaaataggtatgataggatcaaagcctttctcaacagttaagtacaaaaatgagggtccagattatagactctacaagagtgaaccagagttaacaacagtggcagaagttgatgaatctaatggagaagaaaaatcagaacctgtttcagagatagaaacttcagttgttaaaggttcccactttcctgttggagtagtccctccaagagcaaaatcaccaacacccgaatcttcgacaatagcttcctatgtaaccttgaggaaaactaagaagatgatggatctaagaacggaaagaccaagaagtgcagtggaacagctctgtttggctgaaagtactcgaccaaggatgactgtggaagagcaaatggaaagaataagaagacatcaacaagcgtgcctgagggagaagaaaaaagggttaaatgttatcggtgcttcagaccagtcacccttacaaagcccttcaaatttaagggataatccatttaggactactcagactcgaaggagggatgataaggaactggacactgccattagagaaaatgatgtaaagccagaccatgaaactcctgcaacagaaattgttcaactaaaagaaaccgaaccccaaaatgtggacttcagcaaagagttaaaaaaaactgaaaacatttcatatgaaatgctttttgaacctgagccaaatggagtaaattctgtggaaatgatggataaagaaagaaacaaagacaaaatgcctgaggatgttacattcagccctcaagatgaaacacagaccgcaaatcataaaccagaagagcatcctgaagaaaatacaaagaacagtgttgacgaacaggaagaaactgttatttcttacgaatcaactcctgaggtttctagaggaaatcaaacaatggcagtgaaaagtctgtccccatctcctgagtcctcggcatcgccagttccatccactcagccgcagctcacagaaggatcacatttcatgtgtgtgtagtcttagaagaactatactgacttctgttgaaaccattcaaagctaaagacatggaccttcagcagtgtaagaagatattgtacagtatattttaaatctatgaaattcatagttctgatgcttttggtcacagagcatcattttatcacttctggaaaatgtttattccaaaacagctttaatggcccatatgtacacttcgtaatctcaaggttattattctgacaccagcttgctgctatgatttcagagcacataagtaaaggtgctttttaatgtgcagtctatttccagagcttacttagttgctgatttccagatttcgatgtttcttaagtctaggtgaatttatatatatatttttttgcttttcattttctaaagttagttattatttccattgaagcttgttttctttttttcttcccattttagctactgcagtgcttttgtttcacacttgatttgtaaaaattttatatatatgtatttaaaatgtgccattttattgctaagtgaagtatgtcctgttttctgctataattctttctcggtcagattgcaatgtcagcagttactgccacactcctgtcagcttaaacacaaatgttactgcttatcttttcttaaaaaaaaaaaaaacaaagtgtaggtattttgaagtactgggcttatatttcattggaatacatgtgtacagcaataagcaggtttccaaatccggtacttagtttgtgtacaaatgtaattatgttcattgtgtatatattatacaatgagcacatgtaatgtattaaaggctacttactattgtttaaatgcaaatgttcatatctcatttctttttttatcatgttaaataaatgttgatgttcttaaa

SEQ ID NO: 110574 - DNA, 4075 bp, Homo sapiens
ggcagccgcggcggcagcaggagaaggcggcggcggcggctagggatcagacatggcggcggatctgaacctggagtggatctccctgccccggtcctggacttacgggatcaccaggggcggccgagtcttcttcatcaacgaggaggccaagagcaccacctggctgcaccccgtcaccggcgaggcggtggtcaccggacaccggcggcagagcacagatttgcctactggctgggaagaagcatatacttttgaaggtgcaagatactatataaaccataatgaaaggaaagtgacctgcaaacatccagtcacaggacaaccatcacaggacaattgtatttttgtagtgaatgaacagactgttgcaaccatgacatctgaagaaaagaaggaacggccaataagtatgataaatgaagcttctaactataacgtgacttcagattatgcagtgcatccaatgagccctgtaggcagaacttcacgagcttcaaaaaaagttcataattttggaaagaggtcaaattcaattaaaaggaatcctaatgcaccggttgtcagacgaggttggctttataaacaggacagtactggcatgaaattgtggaagaaacgctggtttgtgctttctgacctttgcctcttttattatagagatgagaaagaagagggtatcctgggaagcatactgttacctagttttcagatagctttgcttacctctgaagatcacattaatcgcaaatatgcttttaaggcagcccatccaaacatgcggacctattatttctgcactgatacaggaaaggaaatggagttgtggatgaaagccatgttagatgctgccctagtacagacagaacctgtgaaaagagtggacaagattacatctgaaaatgcaccaactaaagaaaccaataacattcccaaccatagagtgctaattaaaccagagatccaaaacaatcaaaaaaacaaggaaatgagcaaaattgaagaaaaaaaggcattagaagctgaaaaatatggatttcagaaggatggtcaagatagacccttaacaaaaattaatagtgtaaagctgaattctctgccatctgaatatgagagtgggtcagcatgccctgctcagactgtgcactacagaccaatcaacttgagcagttcagagaacaaaatagtcaatgttagcctggcagatcttagaggtggaaatcgccccaatacagggcccttatacacagaggccgatcgagtcatacagagaacaaattcaatgcagcagttggaacagtggattaaaatccagaaggggaggggtcatgaagaagaaaccaggggagtaatttcttaccaaacattaccaagaaatatgccaagtcacagagcccagattatggcccgctaccctgaaggttatagaacactcccaagaaacagcaagacaaggcctgaaagtatctgcagtgtaaccccttccactcatgacaagacattaggacccggagcggaggagaaacggaggtccatgagagatgacacaatgtggcagctctacgaatggcagcagcgtcagttttataacaaacagagcaccctccctcgacacagtactttgagtagtcccaaaaccatggtaaatatttctgaccagacaatgcactctattcccacatcaccttcccacgggtcaatagctgcttatcagggatactcccctcaacgaacttacagatcggaagtgtcttcaccaattcagagaggagatgtgacaatagaccgcagacacagggcccatcaccctaagcatgtctatgtgcctgacagaaggtcagtgccagctggcctgactttacagtctgttagtccccagagcctccaagggaaaacgctgtcacaagatgaaggtagaggcacattatacaaatacagacctgaagaagtagatattgatgccaagttaagccgattatgtgaacaagataaagtggtgcatgctctggaagagaaacttcagcaactccacaaggagaaatacacgcttgagcaagctttgctatcagccagccaagagatagaaatgcatgcagataacccagcagccattcagacagtggtgttacaaagggatgatttacaaaatggactgcttagtacgtgtcgagaactttctcgagccactgccgaattggaacgagcatggagagaatatgataagttagaatacgatgtaactgttaccaggaaccagatgcaagagcagctggatcaccttggtgaagttcagacggaatcagcaggaattcagcgtgcacagattcagaaagaactttggcgaattcaggatgtcatggaagggctgagtaaacataagcagcaaagaggtactacagaaataggtatgataggatcaaagcctttctcaacagttaagtacaaaaatgagggtccagattatagactctacaagagtgaaccagagttaacaacagtggcagaagttgatgaatctaatggagaagaaaaatcagaacctgtttcagagatagaaacttcagttgttaaaggttcccactttcctgttggagtagtccctccaagagcaaaatcaccaacacccgaatcttcgacaatagcttcctatgtaaccttgaggaaaactaagaagatgatggatctaagaacggaaagaccaagaagtgcagtggaacagctctgtttggctgaaagtactcgaccaaggatgactgtggaagagcaaatggaaagaataagaagacatcaacaagcgtgcctgagggagaagaaaaaagggttaaatgttatcggtgcttcagaccagtcacccttacaaagcccttcaaatttaagggataatccatttaggactactcagactcgaaggagggatgataaggaactggacactgccattagagaaaatgatgtaaagccagaccatgaaactcctgcaacagaaattgttcaactaaaagaaaccgaaccccaaaatgtggacttcagcaaagagttaaaaaaaactgaaaacatttcatatgaaatgctttttgaacctgagccaaatggagtaaattctgtggaaatgatggataaagaaagaaacaaagacaaaatgcctgaggatgttacattcagccctcaagatgaaacacagaccgcaaatcataaaccagaagagcatcctgaagaaaatacaaagaacagtgttgacgaacaggaagaaactgttatttcttacgaatcaactcctgaggtttctagaggaaatcaaacaatggcagtgaaaagtctgtccccatctcctgagtcctcggcatcgccagttccatccactcagccgcagctcacagaaggatcacatttcatgtgtgtgtagtcttagaagaactatactgacttctgttgaaaccattcaaagctaaagacatggaccttcagcagtgtaagaagatattgtacagtatattttaaatctatgaaattcatagttctgatgcttttggtcacagagcatcattttatcacttctggaaaatgtttattccaaaacagctttaatggcccatatgtacacttcgtaatctcaaggttattattctgacaccagcttgctgctatgatttcagagcacataagtaaaggtgctttttaatgtgcagtctatttccagagcttacttagttgctgatttccagatttcgatgtttcttaagtctaggtgaatttatatatatatttttttgcttttcattttctaaagttagttattatttccattgaagcttgttttctttttttcttcccattttagctactgcagtgcttttgtttcacacttgatttgtaaaaattttatatatatgtatttaaaatgtgccattttattgctaagtgaagtatgtcctgttttctgctataattctttctcggtcagattgcaatgtcagcagttactgccacactcctgtcagcttaaacacaaatgttactgcttatcttttcttaaaaaaaaaaaacaagcttcaatggaaataataactaactttag

SEQ ID NO: 110575 - DNA, 4264 bp, Homo sapiens
ggcagccgcggcggcagcaggagaaggcggcggcggcggctagggatcagacatggcggcggatctgaacctggagtggatctccctgccccggtcctggacttacgggatcaccaggggcggccgagtcttcttcatcaacgaggaggccaagagcaccacctggctgcaccccgtcaccggcgaggcggtggtcaccggacaccggcggcagagcacagatttgcctactggctgggaagaagcatatacttttgaaggtgcaagatactatataaaccataatgaaaggaaagtgacctgcaaacatccagtcacaggacaaccatcacaggacaattgtatttttgtagtgaatgaacagactgttgcaaccatgacatctgaagaaaagaaggaacggccaataagtatgataaatgaagcttctaactataacgtgacttcagattatgcagtgcatccaatgagccctgtaggcagaacttcacgagcttcaaaaaaagttcataattttggaaagaggtcaaattcaattaaaaggaatcctaatgcaccggttgtcagacgaggttggctttataaacaggacagtactggcatgaaattgtggaagaaacgctggtttgtgctttctgacctttgcctcttttattatagagatgagaaagaagagggtatcctgggaagcatactgttacctagttttcagatagctttgcttacctctgaagatcacattaatcgcaaatatgcttttaaggcagcccatccaaacatgcggacctattatttctgcactgatacaggaaaggaaatggagttgtggatgaaagccatgttagatgctgccctagtacagacagaacctgtgaaaagagtggacaagattacatctgaaaatgcaccaactaaagaaaccaataacattcccaaccatagagtgctaattaaaccagagatccaaaacaatcaaaaaaacaaggaaatgagcaaaattgaagaaaaaaaggcattagaagctgaaaaatatggatttcagaaggatggtcaagatagacccttaacaaaaattaatagtgtaaagctgaattctctgccatctgaatatgagagtgggtcagcatgccctgctcagactgtgcactacagaccaatcaacttgagcagttcagagaacaaaatagtcaatgttagcctggcagatcttagaggtggaaatcgccccaatacagggcccttatacacagaggccgatcgagtcatacagagaacaaattcaatgcagcagttggaacagtggattaaaatccagaaggggaggggtcatgaagaagaaaccaggggagtaatttcttaccaaacattaccaagaaatatgccaagtcacagagcccagattatggcccgctaccctgaaggttatagaacactcccaagaaacagcaagacaaggcctgaaagtatctgcagtgtaaccccttccactcatgacaagacattaggacccggagcggaggagaaacggaggtccatgagagatgacacaatgtggcagctctacgaatggcagcagcgtcagttttataacaaacagagcaccctccctcgacacagtactttgagtagtcccaaaaccatggtaaatatttctgaccagacaatgcactctattcccacatcaccttcccacgggtcaatagctgcttatcagggatactcccctcaacgaacttacagatcggaagtgtcttcaccaattcagagaggagatgtgacaatagaccgcagacacagggcccatcaccctaagcatgtctatgtgcctgacagaaggtcagtgccagctggcctgactttacagtctgttagtccccagagcctccaagggaaaacgctgtcacaagatgaaggtagaggcacattatacaaatacagacctgaagaagtagatattgatgccaagttaagccgattatgtgaacaagataaagtggtgcatgctctggaagagaaacttcagcaactccacaaggagaaatacacgcttgagcaagctttgctatcagccagccaagagatagaaatgcatgcagataacccagcagccattcagacagtggtgttacaaagggatgatttacaaaatggactgcttagtacgtgtcgagaactttctcgagccactgccgaattggaacgagcatggagagaatatgataagttagaatacgatgtaactgttaccaggaaccagatgcaagagcagctggatcaccttggtgaagttcagacggaatcagcaggaattcagcgtgcacagattcagaaagaactttggcgaattcaggatgtcatggaagggctgagtaaacataagcagcaaagaggtactacagaaataggtatgataggatcaaagcctttctcaacagttaagtacaaaaatgagggtccagattatagactctacaagagtgaaccagagttaacaacagtggcagaagttgatgaatctaatggagaagaaaaatcagaacctgtttcagagatagaaacttcagttgttaaaggttcccactttcctgttggagtagtccctccaagagcaaaatcaccaacacccgaatcttcgacaatagcttcctatgtaaccttgaggaaaactaagaagatgatggatctaagaacggaaagaccaagaagtgcagtggaacagctctgtttggctgaaagtactcgaccaaggatgactgtggaagagcaaatggaaagaataagaagacatcaacaagcgtgcctgagggagaagaaaaaagggttaaatgttatcggtgcttcagaccagtcacccttacaaagcccttcaaatttaagggataatccatttaggactactcagactcgaaggagggatgataaggaactggacactgccattagagaaaatgatgtaaagccagaccatgaaactcctgcaacagaaattgttcaactaaaagaaaccgaaccccaaaatgtggacttcagcaaagagttaaaaaaaactgaaaacatttcatatgaaatgctttttgaacctgagccaaatggagtaaattctgtggaaatgatggataaagaaagaaacaaagacaaaatgcctgaggatgttacattcagccctcaagatgaaacacagaccgcaaatcataaaccagaagagcatcctgaagaaaatacaaagaacagtgttgacgaacaggaagaaactgttatttcttacgaatcaactcctgaggtttctagaggaaatcaaacaatggcagtgaaaagtctgtccccatctcctgagtcctcggcatcgccagttccatccactcagccgcagctcacagaaggatcacatttcatgtctatactgacttctgttgaaaccattcaaagctaaagacatggaccttcagcagtgtaagaagatattgtacagtatattttaaatctatgaaattcatagttctgatgcttttggtcacagagcatcattttatcacttctggaaaatgtttattccaaaacagctttaatggcccatatgtacacttcgtaatctcaaggttattattctgacaccagcttgctgctatgatttcagagcacataagtaaaggtgctttttaatgtgcagtctatttccagagcttacttagttgctgatttccagatttcgatgtttcttaagtctaggtgaatttatatatatatttttttgcttttcattttctaaagttagttattatttccattgaagcttgttttctttttttcttcccattttagctactgcagtgcttttgtttcacacttgatttgtaaaaattttatatatatgtatttaaaatgtgccattttattgctaagtgaagtatgtcctgttttctgctataattctttctcggtcagattgcaatgtcagcagttactgccacactcctgtcagcttaaacacaaatgttactgcttatcttttcttaaaaaaaaaaaaaacaaagtgtaggtattttgaagtactgggcttatatttcattggaatacatgtgtacagcaataagcaggtttccaaatccggtacttagtttgtgtacaaatgtaattatgttcattgtgtatatattatacaatgagcacatgtaatgtattaaaggctacttactattgtttaaatgcaaatgttcatatctcatttctttttttatcatgttaaataaatgttgatgttcttaaa

SEQ ID NO: 110576 - DNA, 1819 bp, Homo sapiens
ccggtacctggatatagtgaggagttaacaacagtggcagaagttgatgaatctaatggagaagaaaaatcagaacctgtttcagagatagaaacttcagttgttaaaggttcccactttcctgttggagtagtccctccaagagcaaaatcaccaacacccgaatcttcgacaatagcttcctatgtaaccttgaggaaaactaagaagatgatggatctaagaacggaaagaccaagaagtgcagtggaacagctctgtttggctgaaagtactcgaccaaggatgactgtggaagagcaaatggaaagaataagaagacatcaacaagcgtgcctgagggagaagaaaaaagggttaaatgttatcggtgcttcagaccagtcacccttacaaagcccttcaaatttaagggataatccatttaggactactcagactcgaaggagggatgataaggaactggacactgccattagagaaaatgatgtaaagccagaccatgaaactcctgcaacagaaattgttcaactaaaagaaaccgaaccccaaaatgtggacttcagcaaagagttaaaaaaaactgaaaacatttcatatgaaatgctttttgaacctgagccaaatggagtaaattctgtggaaatgatggataaagaaagaaacaaagacaaaatgcctgaggatgttacattcagccctcaagatgaaacacagaccgcaaatcataaaccagaagagcatcctgaagaaaatacaaagaacagtgttgacgaacaggaagaaactgttatttcttacgaatcaactcctgaggtttctagaggaaatcaaacaatggcagtgaaaagtctgtccccatctcctgagtcctcggcatcgccagttccatccactcagccgcagctcacagaaggatcacatttcatgtgtgtgtagtcttagaagaactatactgacttctgttgaaaccattcaaagctaaagacatggaccttcagcagtgtaagaagatattgtacagtatattttaaatctatgaaattcatagttctgatgcttttggtcacagagcatcattttatcacttctggaaaatgtttattccaaaacagctttaatggcccatatgtacacttcgtaatctcaaggttattattctgacaccagcttgctgctatgatttcagagcacataagtaaaggtgctttttaatgtgcagtctatttccagagcttacttagttgctgatttccagatttcgatgtttcttaagtctaggtgaatttatatatatatttttttgcttttcattttctaaagttagttattatttccattgaagcttgttttctttttttcttcccattttagctactgcagtgcttttgtttcacacttgatttgtaaaaattttatatatatgtatttaaaatgtgccattttattgctaagtgaagtatgtcctgttttctgctataattctttctcggtcagattgcaatgtcagcagttactgccacactcctgtcagcttaaacacaaatgttactgcttatcttttcttaaaaaaaaaaaaaacaaagtgtaggtattttgaagtactgggcttatatttcattggaatacatgtgtacagcaataagcaggtttccaaatccggtacttagtttgtgtacaaatgtaattatgttcattgtgtatatattatacaatgagcacatgtaatgtattaaaggctacttactattgtttaaatgcaaatgttcatatctcatttctttttttatcatgttaaataaatgttgatgttcttaaa

SEQ ID NO: 110577 - DNA, 3234 bp, Homo sapiens
ggcagccgcggcggcagcaggagaaggcggcggcggcggctagggatcagacatggcggcggatctgaacctggagtggatctccctgccccggtcctggacttacgggatcaccaggggcggccgagtcttcttcatcaacgaggaggccaagagcaccacctggctgcaccccgtcaccggcgaggcggtggtcaccggacaccggcggcagagcacagatttgcctactggctgggaagaagcatatacttttgaaggtgcaagatactatataaaccataatgaaaggaaagtgacctgcaaacatccagtcacaggacaaccatcacaggacaattgtatttttgtagtgaatgaacagactgttgcaaccatgacatctgaagaaaagaaggaacggccaataagtatgataaatgaagcttctaactataacgtgacttcagattatgcagtgcatccaatgagccctgtaggcagaacttcacgagcttcaaaaaaagttcataattttggaaagaggtcaaattcaattaaaaggaatcctaatgcaccggttgtcagacgaggttggctttataaacaggacagtactggcatgaaattgtggaagaaacgctggtttgtgctttctgacctttgcctcttttattatagagatgagaaagaagagggtatcctgggaagcatactgttacctagttttcagatagctttgcttacctctgaagatcacattaatcgcaaatatgcttttaaggcagcccatccaaacatgcggacctattatttctgcactgatacaggaaaggaaatggagttgtggatgaaagccatgttagatgctgccctagtacagacagaacctgtgaaaagagtggacaagattacatctgaaaatgcaccaactaaagaaaccaataacattcccaaccatagagtgctaattaaaccagagatccaaaacaatcaaaaaaacaaggaaatgagcaaaattgaagaaaaaaaggcattagaagctgaaaaatatggatttcagaaggatggtcaagatagacccttaacaaaaattaatagtgtaaagctgaattctctgccatctgaatatgagagtgggtcagcatgccctgctcagactgtgcactacagaccaatcaacttgagcagttcagagaacaaaatagtcaatgttagcctggcagatcttagaggtggaaatcgccccaatacagggcccttatacacagaggccgatcgagtcatacagagaacaaattcaatgcagcagttggaacagtggattaaaatccagaaggggaggggtcatgaagaagaaaccaggggagtaatttcttaccaaacattaccaagaaatatgccaagtcacagagcccagattatggcccgctaccctgaaggttatagaacactcccaagaaacagcaagacaaggcctgaaagtatctgcagtgtaaccccttccactcatgacaagacattaggacccggagcggaggagaaacggaggtccatgagagatgacacaatgtggcagctctacgaatggcagcagcgtcagttttataacaaacagagcaccctccctcgacacagtactttgagtagtcccaaaaccatggtaaatatttctgaccagacaatgcactctattcccacatcaccttcccacgggtcaatagctgcttatcagggatactcccctcaacgaacttacagatcggaagtgtcttcaccaattcagagaggagatgtgacaatagaccgcagacacagggcccatcaccctaagcatgtctatgtgcctgacagaaggtcagtgccagctggcctgactttacagtctgttagtccccagagcctccaagggaaaacgctgtcacaagatgaaggtagaggcacattatacaaatacagacctgaagaagtagatattgatgccaagttaagccgattatgtgaacaagataaagtggtgcatgctctggaagagaaacttcagcaactccacaaggagaaatacacgcttgagcaagctttgctatcagccagccaagagatagaaatgcatgcagataacccagcagccattcagacagtggtgttacaaagggatgatttacaaaatggactgcttagtacgtgtcgagaactttctcgagccactgccgaattggaacgagcatggagagaatatgataagttagaatacgatgtaactgttaccaggaaccagatgcaagagcagctggatcaccttggtgaagttcagacggaatcagcaggaattcagcgtgcacagattcagaaagaactttggcgaattcaggatgtcatggaagggctgagtaaacataagcagcaaagaggtactacagaaataggtatgataggatcaaagcctttctcaacagttaagtacaaaaatgagggtccagattatagactctacaagagtgaaccagagttaacaacagtggcagaagttgatgaatctaatggagaagaaaaatcagaacctgtttcagagatagaaacttcagttgttaaaggttcccactttcctgttggagtagtccctccaagagcaaaatcaccaacacccgaatcttcgacaatagcttcctatgtaaccttgaggaaaactaagaagatgatggatctaagaacggaaagaccaagaagtgcagtggaacagctctgtttggctgaaagtactcgaccaaggatgactgtggaagagcaaatggaaagaataagaagacatcaacaagcgtgcctgagggagaagaaaaaagggttaaatgttatcggtgcttcagaccagtcacccttacaaagcccttcaaatttaagggataatccatttaggactactcagactcgaaggagggatgataaggaactggacactgccattagagaaaatgatgtaaagccagaccatgaaactcctgcaacagaaattgttcaactaaaagaaaccgaaccccaaaatgtggacttcagcaaagagttaaaaaaaactgaaaacatttcatatgaaatgctttttgaacctgagccaaatggagtaaattctgtggaaatgatggataaagaaagaaacaaagacaaaatgcctgaggatgttacattcagccctcaagatgaaacacagaccgcaaatcataaaccagaagagcatcctgaagaaaatacaaagaacagtgt

SEQ ID NO: 110578 - DNA, 3808 bp, Homo sapiens
ggcagccgcggcggcagcaggagaaggcggcggcggcggctagggatcagacatggcggcggatctgaacctggagtggatctccctgccccggtcctggacttacgggatcaccaggggcggccgagtcttcttcatcaacgaggaggccaagagcaccacctggctgcaccccgtcaccggcgaggcggtggtcaccggacaccggcggcagagcacagatttgcctactggctgggaagaagcatatacttttgaaggtgcaagatactatataaaccataatgaaaggaaagtgacctgcaaacatccagtcacaggacaaccatcacaggacaattgtatttttgtagtgaatgaacagactgttgcaaccatgacatctgaagaaaagaaggaacggccaataagtatgataaatgaagcttctaactataacgtgacttcagattatgcagtgcatccaatgagccctgtaggcagaacttcacgagcttcaaaaaaagttcataattttggaaagaggtcaaattcaattaaaaggaatcctaatgcaccggttgtcagacgaggttggctttataaacaggacagtactggcatgaaattgtggaagaaacgctggtttgtgctttctgacctttgcctcttttattatagagatgagaaagaagagggtatcctgggaagcatactgttacctagttttcagatagctttgcttacctctgaagatcacattaatcgcaaatatgcttttaaggcagcccatccaaacatgcggacctattatttctgcactgatacaggaaaggaaatggagttgtggatgaaagccatgttagatgctgccctagtacagacagaacctgtgaaaagagtggacaagattacatctgaaaatgcaccaactaaagaaaccaataacattcccaaccatagagtgctaattaaaccagagatccaaaacaatcaaaaaaacaaggaaatgagcaaaattgaagaaaaaaaggcattagaagctgaaaaatatggatttcagaaggatggtcaagatagacccttaacaaaaattaatagtgtaaagctgaattctctgccatctgaatatgagagtgggtcagcatgccctgctcagactgtgcactacagaccaatcaacttgagcagttcagagaacaaaatagtcaatgttagcctggcagatcttagaggtggaaatcgccccaatacagggcccttatacacagaggccgatcgagtcatacagagaacaaattcaatgcagcagttggaacagtggattaaaatccagaaggggaggggtcatgaagaagaaaccaggggagtaatttcttaccaaacattaccaagaaatatgccaagtcacagagcccagattatggcccgctaccctgaaggttatagaacactcccaagaaacagcaagacaaggcctgaaagtatctgcagtgtaaccccttccactcatgacaagacattaggacccggagcggaggagaaacggaggtccatgagagatgacacaatgtggcagctctacgaatggcagcagcgtcagttttataacaaacagagcaccctccctcgacacagtactttgagtagtcccaaaaccatggtaaatatttctgaccagacaatgcactctattcccacatcaccttcccacgggtcaatagctgcttatcagggatactcccctcaacgaacttacagatcggaagtgtcttcaccaattcagagaggagatgtgacaatagaccgcagacacagggcccatcaccctaagcatgtctatgtgcctgacagaaggtcagtgccagctggcctgactttacagtctgttagtccccagagcctccaagggaaaacgctgtcacaagatgaaggtagaggcacattatacaaatacagacctgaagaagtagatattgatgccaagttaagccgattatgtgaacaagataaagtggtgcatgctctggaagagaaacttcagcaactccacaaggagaaatacacgcttgagcaagctttgctatcagccagccaagagatagaaatgcatgcagataacccagcagccattcagacagtggtgttacaaagggatgatttacaaaatggactgcttagtacgtgtcgagaactttctcgagccactgccgaattggaacgagcatggagagaatatgataagttagaatacgatgtaactgttaccaggaaccagatgcaagagcagctggatcaccttggtgaagttcagacggaatcagcaggaattcagcgtgcacagattcagaaagaactttggcgaattcaggatgtcatggaagggctgagtaaacataagcagcaaagaggtactacagaaataggtatgataggatcaaagcctttctcaacagttaagtacaaaaatgagggtccagattatagactctacaagagtgaaccagagttaacaacagtggcagaagttgatgaatctaatggagaagaaaaatcagaacctgtttcagagatagaaacttcagttgttaaaggttcccactttcctgttggagtagtccctccaagagcaaaatcaccaacacccgaatcttcgacaatagcttcctatgtaaccttgaggaaaactaagaagatgatggatctaagaacggaaagaccaagaagtgcagtggaacagctctgtttggctgaaagtactcgaccaaggatgactgtggaagagcaaatggaaagaataagaagacatcaacaagcgtgcctgagggagaagaaaaaagggttaaatgttatcggtgcttcagaccagtcacccttacaaagcccttcaaatttaagggataatccatttaggactactcagactcgaaggagggatgataaggaactggacactgccattagagaaaatgatgtaaagccagaccatgaaactcctgcaacagaaattgttcaactaaaagaaaccgaaccccaaaatgtggacttcagcaaagagttaaaaaaaactgaaaacatttcatatgaaatgctttttgaacctgagccaaatggagtaaattctgtggaaatgatggataaagaaagaaacaaagacaaaatgcctgaggatgttacattcagccctcaagatgaaacacagaccgcaaatcataaaccagaagagcatcctgaagaaaatacaaagaacagtgttgacgaacaggaagaaactgttatttcttacgaatcaactcctgaggtttctagaggaaatcaaacaatggcagctatactgacttctgttgaaaccattcaaagctaaagacatggaccttcagcagtctactgcagtgcttttgtttcacacttgatttgtaaaaattttatatatatgtatttaaaatgtgccattttattgctaagtgaagtatgtcctgttttctgctataattctttctcggtcagattgcaatgtcagcagttactgccacactcctgtcagcttaaacacaaatgttactgcttatcttttcttaaaaaaaaaaaaaacaaagtgtaggtattttgaagtactgggcttatatttcattggaatacatgtgtacagcaataagcaggtttccaaatccggtacttagtttgtgtacaaatgtaattatgttcattgtgtatatattatacaatgagcacatgtaatgtattaaaggctacttactattgtttaaatgcaaatgttcatatctcatttctttttttatcatgttaaataaatgttgatgttcttaaa

SEQ ID NO: 110579 - DNA, 1045 bp, Homo sapiens
tgtgaattaagctatggaaatgaagaaaaatatcctttgatgtattgtattttaggattttcatggccatgcttgtcagttctgttgttacagaatgtcacccttagttactttgggaaatggtaattaattaacgttgcaggtgtcaaagtaatttcctctctcttatttttcagctatactgacttctgttgaaaccattcaaagctaaagacatggaccttcagcagtgtaagaagatattgtacagtatattttaaatctatgaaattcatagttctgatgcttttggtcacagagcatcattttatcacttctggaaaatgtttattccaaaacagctttaatggcccatatgtacacttcgtaatctcaaggttattattctgacaccagcttgctgctatgatttcagagcacataagtaaaggtgctttttaatgtgcagtctatttccagagcttacttagttgctgatttccagatttcgatgtttcttaagtctaggtgaatttatatatatatttttttgcttttcattttctaaagttagttattatttccattgaagcttgttttctttttttcttcccattttagctactgcagtgcttttgtttcacacttgatttgtaaaaattttatatatatgtatttaaaatgtgccattttattgctaagtgaagtatgtcctgttttctgctataattctttctcggtcagattgcaatgtcagcagttactgccacactcctgtcagcttaaacacaaatgttactgcttatcttttcttaaaaaaaaaaaaaacaaagtgtaggtattttgaagtactgggcttatatttcattggaatacatgtgtacagcaataagcaggtttccaaatccggtacttagtttgtgtacaaatgtaattatgttcattgtgtatatattatacaatgagcacatgtaatgtattaaaggctacttactattgtttaaatgcaaatgttcatatctcatttctttttttatcatgttaaataaatgttgatgttcttaaa

SEQ ID NO: 110580 - DNA, 1975 bp, Homo sapiens
ggcagccgcggcggcagcaggagaaggcggcggcggcggctagggatcagacatggcggcggatctgaacctggagtggatctccctgccccggtcctggacttacgggatcaccaggggcggccgagtcttcttcatcaacgaggaggccaagagcaccacctggctgcaccccgtcaccggcgaggcggtggtcaccggacaccggcggcagagcacagatttgcctactggctgggaagaagcatatacttttgaaggtgcaagatactatataaaccataatgaaaggaaagtgacctgcaaacatccagtcacaggacaaccatcacaggacaattgtatttttgtagtgaatgaacagactgttgcaaccatgacatctgaagaaaagaaggaacggccaataagtatgataaatgaagcttctaactataacgtgacttcagattatgcagtgcatccaatgagccctgtaggcagaacttcacgagcttcaaaaaaagttcataattttggaaagaggtcaaattcaattaaaaggaatcctaatgcaccggttgtcagacgaggttggctttataaacaggacagtactggcatgaaattgtggaagaaacgctggtttgtgctttctgacctttgcctcttttattatagagatgagaaagaagagggtatcctgggaagcatactgttacctagttttcagatagctttgcttacctctgaagatcacattaatcgcaaatatgcttttaaggcagcccatccaaacatgcggacctattatttctgcactgatacaggaaaggaaatggagttgtggatgaaagccatgttagatgctgccctagtacagacagaacctgtgaaaagagtggacaagattacatctgaaaatgcaccaactaaagaaaccaataacattcccaaccatagagtgctaattaaaccagagatccaaaacaatcaaaaaaacaaggaaatgagcaaaattgaagaaaaaaaggcattagaagctgaaaaatatggatttcagaaggatggtcaagatagacccttaacaaaaattaatagtgtaaagctgaattctctgccatctgaatatgagagtgggtcagcatgccctgctcagactgtgcactacagaccaatcaacttgagcagttcagagaacaaaatagtcaatgttagcctggcagatcttagaggtggaaatcgccccaatacagggcccttatacacagaggccgatcgagtcatacagagaacaaattcaatgcagcagttggaacagtggattaaaatccagaaggggaggggtcatgaagaagaaaccaggggagtaatttcttaccaaacattaccaagaaatatgccaagtcacagagcccagattatggcccgctaccctgaaggttatagaacactcccaagaaacagcaagacaaggcctgaaagtatctgcagtgtaaccccttccactcatgacaagacattaggacccggagcggaggagaaacggaggtccatgagagatgacacaatgtggcagctctacgaatggcagcagcgtcagttttataacaaacagagcaccctccctcgacacagtactttgagtagtcccaaaaccatggtaaatatttctgaccagacaatgcactctattcccacatcaccttcccacgggtcaatagctgcttatcagggatactcccctcaacgaacttacagatcggaagtgtcttcaccaattcagagaggagatgtgacaatagaccgcagacacagggcccatcaccctaaggtaaaatagctgctgattttgtgttaactcactaccttataaatgctgtgttttctttctagtatactattttaaatgtgagagacaaaagaatggggataaagtaagcaaggcagctcttttttgttttaaaaaataaataaaaatattttacaacattaa

SEQ ID NO: 110581 - DNA, 3021 bp, Homo sapiens
ggcagccgcggcggcagcaggagaaggcggcggcggcggctagggatcagacatggcggcggatctgaacctggagtggatctccctgccccggtcctggacttacgggatcaccaggggcggccgagtcttcttcatcaacgaggaggccaagagcaccacctggctgcaccccgtcaccggcgaggcggtggtcaccggacaccggcggcagagcacagatttgcctactggctgggaagaagcatatacttttgaaggtgcaagatactatataaaccataatgaaaggaaagtgacctgcaaacatccagtcacaggacaaccatcacaggacaattgtatttttgtagtgaatgaacagactgttgcaaccatgacatctgaagaaaagaaggaacggccaataagtatgataaatgaagcttctaactataacgtgacttcagattatgcagtgcatccaatgagccctgtaggcagaacttcacgagcttcaaaaaaagttcataattttggaaagaggtcaaattcaattaaaaggaatcctaatgcaccggttgtcagacgaggttggctttataaacaggacagtactggcatgaaattgtggaagaaacgctggtttgtgctttctgacctttgcctcttttattatagagatgagaaagaagagggtatcctgggaagcatactgttacctagttttcagatagctttgcttacctctgaagatcacattaatcgcaaatatgcttttaaggcagcccatccaaacatgcggacctattatttctgcactgatacaggaaaggaaatggagttgtggatgaaagccatgttagatgctgccctagtacagacagaacctgtgaaaagagtggacaagattacatctgaaaatgcaccaactaaagaaaccaataacattcccaaccatagagtgctaattaaaccagagatccaaaacaatcaaaaaaacaaggaaatgagcaaaattgaagaaaaaaaggcattagaagctgaaaaatatggatttcagaaggatggtcaagatagacccttaacaaaaattaatagtgtaaagctgaattctctgccatctgaatatgagagtgggtcagcatgccctgctcagactgtgcactacagaccaatcaacttgagcagttcagagaacaaaatagtcaatgttagcctggcagatcttagaggtggaaatcgccccaatacagggcccttatacacagaggccgatcgagtcatacagagaacaaattcaatgcagcagttggaacagtggattaaaatccagaaggggaggggtcatgaagaagaaaccaggggagtaatttcttaccaaacattaccaagaaatatgccaagtcacagagcccagattatggcccgctaccctgaaggttatagaacactcccaagaaacagcaagacaaggcctgaaagtatctgcagtgtaaccccttccactcatgacaagacattaggacccggagcggaggagaaacggaggtccatgagagatgacacaatgtggcagctctacgaatggcagcagcgtcagttttataacaaacagagcaccctccctcgacacagtactttgagtagtcccaaaaccatggtaaatatttctgaccagacaatgcactctattcccacatcaccttcccacgggtcaatagctgcttatcagggatactcccctcaacgaacttacagatcggaagtgtcttcaccaattcagagaggagatgtgacaatagaccgcagacacagggcccatcaccctaagcatgtctatgtgcctgacagaaggtcagtgccagctggcctgactttacagtctgttagtccccagagcctccaagggaaaacgctgtcacaagatgaaggtagaggcacattatacaaatacagacctgaagaagtagatattgatgccaagttaagccgattatgtgaacaagataaagtggtgcatgctctggaagagaaacttcagcaactccacaaggagaaatacacgcttgagcaagctttgctatcagccagccaagagatagaaatgcatgcagataacccagcagccattcagacagtggtgttacaaagggatgatttacaaaatggactgcttagtacgtgtcgagaactttctcgagccactgccgaattggaacgagcatggagagaatatgataagttagaatacgatgtaactgttaccaggaaccagatgcaagagcagctggatcaccttggtgaagttcagacggaatcagcaggaattcagcgtgcacagattcagaaagaactttggcgaattcaggatgtcatggaagggctgagtaaacataagcagcaaagaggtactacagaaataggtaaattagctttgcattttattttgtgactgaccacagtattacagtcatgtgtcgcttggtgacagattacattctgagaaatgcattgttaggtgattgtgttgtacaatcagagtgtacttaaacaaatctagttgtatggcctactacacacctaggctatgtggtatatagcttattgctcccaggttgcaaacctgcacagcatgtgactgtactgaatactgtagacagttgtaacacaatgttatttgtatatctaaacatagaaaaggtaatgtgttacactctgacatgagggcaacaactaggcaatagatatttctcagctctggctgggcacagtggctcacacctgtaatcccagcattttgggaggctgaggtgggcagatcacctgaggtcaggagttcaagaccagcttggccaacgtggtgaaaccctgtctctactaaaaatacaaaaaaagccaggcatggtggcgcatgcctgtagtcccaaatactcaggaagcttagacaggagaatcgcttgaacccgggaggtggaggttgcagtgagccaagatcatgccagtgtgctccagcatgggcagcagagggaaactgtccca

SEQ ID NO: 110582 - DNA, 1880 bp, Homo sapiens
ggcagccgcggcggcagcaggagaaggcggcggcggcggctagggatcagacatggcggcggatctgaacctggagtggatctccctgccccggtcctggacttacgggatcaccaggggcggccgagtcttcttcatcaacgaggaggccaagagcaccacctggctgcaccccgtcaccggcgaggcggtggtcaccggacaccggcggcagagcacagatttgcctactggctgggaagaagcatatacttttgaaggtgcaagatactatataaaccataatgaaaggaaagtgacctgcaaacatccagtcacaggacaaccatcacaggacaattgtatttttgtagtgaatgaacagactgttgcaaccatgacatctgaagaaaagaaggaacggccaataagtatgataaatgaagcttctaactataacgtgacttcagattatgcagtgcatccaatgagccctgtaggcagaacttcacgagcttcaaaaaaagttcataattttggaaagaggtcaaattcaattaaaaggaatcctaatgcaccggttgtcagacgaggttggctttataaacaggacagtactggcatgaaattgtggaagaaacgctggtttgtgctttctgacctttgcctcttttattatagagatgagaaagaagagggtatcctgggaagcatactgttacctagttttcagatagctttgcttacctctgaagatcacattaatcgcaaatatgcttttaaggcagcccatccaaacatgcggacctattatttctgcactgatacaggaaaggaaatggagttgtggatgaaagccatgttagatgctgccctagtacagacagaacctgtgaaaagagtggacaagattacatctgaaaatgcaccaactaaagaaaccaataacattcccaaccatagagtgctaattaaaccagagatccaaaacaatcaaaaaaacaaggaaatgagcaaaattgaagaaaaaaaggcattagaagctgaaaaatatggatttcagaaggatggtcaagatagacccttaacaaaaattaatagtgtaaagctgaattctctgccatctgaatatgagagtgggtcagcatgccctgctcagactgtgcactacagaccaatcaacttgagcagttcagagaacaaaatagtcaatgttagcctggcagatcttagaggtggaaatcgccccaatacagggcccttatacacagaggccgatcgagtcatacagagaacaaattcaatgcagcagttggaacagtggattaaaatccagaaggggaggggtcatgaagaagaaaccaggggagtaatttcttaccaaacattaccaagaaatatgccaagtcacagagcccagattatggcccgctaccctgaaggttatagaacactcccaagaaacagcaagacaaggcctgaaagtatctgcagtgtaaccccttccattttataacaaacagagcaccctccctcgacacagtactttgagtagtcccaaaaccatggtaaatatttctgaccagacaatgcactctattcccacatcaccttcccacgggtcaatagctgcttatcagggatactcccctcaacgaacttacagatcggaagtgtcttcaccaattcagagaggagatgtgacaatagaccgcagacacagggcccatcaccctaaggtaaaatagctgctgattttgtgttaactcactaccttataaatgctgtgttttctttctagtatactattttaaatgtgagagacaaaagaatggggataaagtaagcaaggcagctcttttttgttttaaaaaataaataaaaatattttacaacattaa

SEQ ID NO: 110583 - DNA, 352 bp, Homo sapiens
cctgcctcagcctcccgagtagctgggactacaggtgcccgccaccactcccagctaattttttgtatttttagtagagacggggtttcaccgtgttagccaggatggtctcgatctcctgacctcgtgatccgcccgcctcggcctcccaaagtgctgggatcacaggcgtgagccactgcgcccggccgtgattgttcaataaactttattttggaattattttagatatgctaatctaatgtgataagaattctttgaaaagaaaatttttctttttattctacagttaaaaaaaactgaaaacatttcatatgaaatgctttttgaacctgagccaaatggagtaaat

SEQ ID NO: 110584 - DNA, 761 bp, Homo sapiens
tgccggaggtattgagagtaggcaatggtaacattctcgaaggagaacagagaaaacgttaaataaataacattttaaaatacagtagtcaaggaaggcctcattgatgagacctttgagcaaagcctgaaggatgtaaccaagaaagccatgtatttgtctggggatagaatggttgggcatttaaatcctatcagagatgtgggtgggttaatgccattacttatatgccagtatgtttttcagtgaatgacatgtaaaggggctttgtagaatgcagtatatataccaaagtataaattcttgtgctatttgatattttcatttaaaaccttataaaggcctgcctgaacatgaatatagttcatttatgtacaagaaccttttgatttggcaaaaatagatcttgaaaaactttgcttcataagaacatttaaaattctaatcagatgttaaattatctcttagatgagaaagaagagggtatcctgggaagcatactgttacctagttttcagatagctttgcttacctctgaagatcacattaatcgcaaatatgcttttaaggtaaggaaataatgcagtttttaattctgtgttcaaaacttgcgttggttaaaatggatattgagccatagattattacaaaaaagctaccttatagtgatttttatatttaaaatatattaattaatggtcttatggttgtatagaagaatgtccctctaattaggaagcacgtgctaaaatatttagggg

SEQ ID NO: 110585 - DNA, 4283 bp, Homo sapiens
ggcagccgcggcggcagcaggagaaggcggcggcggcggctagggatcagacatggcggcggatctgaacctggagtggatctccctgccccggtcctggacttacgggatcaccaggggcggccgagtcttcttcatcaacgaggaggccaagagcaccacctggctgcaccccgtcaccggcgaggcggtggtcaccggacaccggcggcagagcacagatttgcctactggctgggaagaagcatatacttttgaaggtgcaagatactatataaaccataatgaaaggaaagtgacctgcaaacatccagtcacaggacaaccatcacaggacaattgtatttttgtagtgaatgaacagactgttgcaaccatgacatctgaagaaaagaaggaacggccaataagtatgataaatgaagcttctaactataacgtgacttcagattatgcagtgcatccaatgagccctgtaggcagaacttcacgagcttcaaaaaaagttcataattttggaaagaggtcaaattcaattaaaaggaatcctaatgcaccggttgtcagacgaggttggctttataaacaggacagtactggcatgaaattgtggaagaaacgctggtttgtgctttctgacctttgcctcttttattatagagatgagaaagaagagggtatcctgggaagcatactgttacctagttttcagatagctttgcttacctctgaagatcacattaatcgcaaatatgcttttaaggcagcccatccaaacatgcggacctattatttctgcactgatacaggaaaggaaatggagttgtggatgaaagccatgttagatgctgccctagtacagacagaacctgtgaaaagagtggacaagattacatctgaaaatgcaccaactaaagaaaccaataacattcccaaccatagagtgctaattaaaccagagatccaaaacaatcaaaaaaacaaggaaatgagcaaaattgaagaaaaaaaggcattagaagctgaaaaatatggatttcagaaggatggtcaagatagacccttaacaaaaattaatagtgtaaagctgaattctctgccatctgaatatgagagtgggtcagcatgccctgctcagactgtgcactacagaccaatcaacttgagcagttcagagaacaaaatagtcaatgttagcctggcagatcttagaggtggaaatcgccccaatacagggcccttatacacagaggccgatcgagtcatacagagaacaaattcaatgcagcagttggaacagtggattaaaatccagaaggggaggggtcatgaagaagaaaccaggggagtaatttcttaccaaacattaccaagaaatatgccaagtcacagagcccagattatggcccgctaccctgaaggttatagaacactcccaagaaacagcaagacaaggcctgaaagtatctgcagtgtaaccccttccactcatgacaagacattaggacccggagcggaggagaaacggaggtccatgagagatgacacaatgtggcagctctacgaatggcagcagcgtcagttttataacaaacagagcaccctccctcgacacagtactttgagtagtcccaaaaccatggtaaatatttctgaccagacaatgcactctattcccacatcaccttcccacgggtcaatagctgcttatcagggatactcccctcaacgaacttacagatcggaagtgtcttcaccaattcagagaggagatgtgacaatagaccgcagacacagggcccatcaccctaagcatgtctatgtgcctgacagaaggtcagtgccagctggcctgactttacagtctgttagtccccagagcctccaagggaaaacgctgtcacaagatgaaggtagaggcacattatacaaatacagacctgaagaagtagatattgatgccaagttaagccgattatgtgaacaagataaagtggtgcatgctctggaagagaaacttcagcaactccacaaggagaaatacacgcttgagcaagctttgctatcagccagccaagagatagaaatgcatgcagataacccagcagccattcagacagtggtgttacaaagggatgatttacaaaatggactgcttagtacgtgtcgagaactttctcgagccactgccgaattggaacgagcatggagagaatatgataagttagaatacgatgtaactgttaccaggaaccagatgcaagagcagctggatcaccttggtgaagttcagacggaatcagcaggaattcagcgtgcacagattcagaaagaactttggcgaattcaggatgtcatggaagggctgagtaaacataagcagcaaagaggtactacagaaataggtatgataggatcaaagcctttctcaacagttaagtacaaaaatgagggtccagattatagactctacaagagtgaaccagagttaacaacagtggcagaagttgatgaatctaatggagaagaaaaatcagaacctgtttcagagatagaaacttcagttgttaaaggttcccactttcctgttggagtagtccctccaagagcaaaatcaccaacacccgaatcttcgacaatagcttcctatgtaaccttgaggaaaactaagaagatgatggatctaagaacggaaagaccaagaagtgcagtggaacagctctgtttggctgaaagtactcgaccaaggatgactgtggaagagcaaatggaaagaataagaagacatcaacaagcgtgcctgagggagaagaaaaaagggttaaatgttatcggtgcttcagaccagtcacccttacaaagcccttcaaatttaagggataatccatttaggactactcagactcgaaggagggatgataaggaactggacactgccattagagaaaatgatgtaaagccagaccatgaaactcctgcaacagaaattgttcaactaaaagaaaccgaaccccaaaatgtggacttcagcaaagagttaaaaaaaactgaaaacatttcatatgaaatgctttttgaacctgagccaaatggagtaaattctgtggaaatgatggataaagaaagaaacaaagacaaaatgcctgaggatgttacattcagccctcaagatgaaacacagaccgcaaatcataaaccagaagagcatcctgaagaaaatacaaagaacagtgttgacgaacaggaagaaactgttatttcttacgaatcaactcctgaggtttctagaggaaatcaaacaatggcagtgaaaagtctgtccccatctcctgagtcctcggcatcgccagttccatccactcagccgcagctcacagaaggatcacatttcatgtgtgtgtagtcttagaagaactatactgacttctgttgaaaccattcaaagctaaagacatggaccttcagcagtgtaagaagatattgtacagtatattttaaatctatgaaattcatagttctgatgcttttggtcacagagcatcattttatcacttctggaaaatgtttattccaaaacagctttaatggcccatatgtacacttcgtaatctcaaggttattattctgacaccagcttgctgctatgatttcagagcacataagtaaaggtgctttttaatgtgcagtctatttccagagcttacttagttgctgatttccagatttcgatgtttcttaagtctaggtgaatttatatatatatttttttgcttttcattttctaaagttagttattatttccattgaagcttgttttctttttttcttcccattttagctactgcagtgcttttgtttcacacttgatttgtaaaaattttatatatatgtatttaaaatgtgccattttattgctaagtgaagtatgtcctgttttctgctataattctttctcggtcagattgcaatgtcagcagttactgccacactcctgtcagcttaaacacaaatgttactgcttatcttttcttaaaaaaaaaaaaaacaaagtgtaggtattttgaagtactgggcttatatttcattggaatacatgtgtacagcaataagcaggtttccaaatccggtacttagtttgtgtacaaatgtaattatgttcattgtgtatatattatacaatgagcacatgtaatgtattaaaggctacttactattgtttaaatgcaaatgttcatatctcatttctttttttatcatgttaaataaatgttgatgttcttaaa

SEQ ID NO: 110586 - DNA, 4115 bp, Homo sapiens
ggcagccgcggcggcagcaggagaaggcggcggcggcggctagggatcagacatggcggcggatctgaacctggagtggatctccctgccccggtcctggacttacgggatcaccaggggcggccgagtcttcttcatcaacgaggaggccaagagcaccacctggctgcaccccgtcaccggcgaggcggtggtcaccggacaccggcggcagagcacagatttgcctactggctgggaagaagcatatacttttgaaggtgcaagatactatataaaccataatgaaaggaaagtgacctgcaaacatccagtcacaggacaaccatcacaggacaattgtatttttgtagtgaatgaacagactgttgcaaccatgacatctgaagaaaagaaggaacggccaataagtatgataaatgaagcttctaactataacgtgacttcagattatgcagtgcatccaatgagccctgtaggcagaacttcacgagcttcaaaaaaagttcataattttggaaagaggtcaaattcaattaaaaggaatcctaatgcaccggttgtcagacgaggttggctttataaacaggacagtactggcatgaaattgtggaagaaacgctggtttgtgctttctgacctttgcctcttttattatagagatgagaaagaagagggtatcctgggaagcatactgttacctagttttcagatagctttgcttacctctgaagatcacattaatcgcaaatatgcttttaaggcagcccatccaaacatgcggacctattatttctgcactgatacaggaaaggaaatggagttgtggatgaaagccatgttagatgctgccctagtacagacagaacctgtgaaaagagtggacaagattacatctgaaaatgcaccaactaaagaaaccaataacattcccaaccatagagtgctaattaaaccagagatccaaaacaatcaaaaaaacaaggaaatgagcaaaattgaagaaaaaaaggcattagaagctgaaaaatatggatttcagaaggatggtcaagatagacccttaacaaaaattaatagtgtaaagctgaattctctgccatctgaatatgagagtgggtcagcatgccctgctcagactgtgcactacagaccaatcaacttgagcagttcagagaacaaaatagtcaatgttagcctggcagatcttagaggtggaaatcgccccaatacagggcccttatacacagaggccgatcgagtcatacagagaacaaattcaatgcagcagttggaacagtggattaaaatccagaaggggaggggtcatgaagaagaaaccaggggagtaatttcttaccaaacattaccaagaaatatgccaagtcacagagcccagattatggcccgctaccctgaaggttatagaacactcccaagaaacagcaagacaaggcctgaaagtatctgcagtgtaaccccttccactcatgacaagacattaggacccggagcggaggagaaacggaggtccatgagagatgacacaatgtggcagctctacgaatggcagcagcgtcagttttataacaaacagagcaccctccctcgacacagtactttgagtagtcccaaaaccatggtaaatatttctgaccagacaatgcactctattcccacatcaccttcccacgggtcaatagctgcttatcagggatactcccctcaacgaacttacagatcggaagtgtcttcaccaattcagagaggagatgtgacaatagaccgcagacacagggcccatcaccctaagcatgtctatgtgcctgacagaaggtcagtgccagctggcctgactttacagtctgttagtccccagagcctccaagggaaaacgctgtcacaagatgaaggtagaggcacattatacaaatacagacctgaagaagtagatattgatgccaagttaagccgattatgtgaacaagataaagtggtgcatgctctggaagagaaacttcagcaactccacaaggagaaatacacgcttgagcaagctttgctatcagccagccaagagatagaaatgcatgcagataacccagcagccattcagacagtggtgttacaaagggatgatttacaaaatggactgcttagtacgtgtcgagaactttctcgagccactgccgaattggaacgagcatggagagaatatgataagttagaatacgatgtaactgttaccaggaaccagatgcaagagcagctggatcaccttggtgaagttcagacggaatcagcaggaattcagcgtgcacagattcagaaagaactttggcgaattcaggatgtcatggaagggctgagtaaacataagcagcaaagaggtactacagaaataggttcccactttcctgttggagtagtccctccaagagcaaaatcaccaacacccgaatcttcgacaatagcttcctatgtaaccttgaggaaaactaagaagatgatggatctaagaacggaaagaccaagaagtgcagtggaacagctctgtttggctgaaagtactcgaccaaggatgactgtggaagagcaaatggaaagaataagaagacatcaacaagcgtgcctgagggagaagaaaaaagggttaaatgttatcggtgcttcagaccagtcacccttacaaagcccttcaaatttaagggataatccatttaggactactcagactcgaaggagggatgataaggaactggacactgccattagagaaaatgatgtaaagccagaccatgaaactcctgcaacagaaattgttcaactaaaagaaaccgaaccccaaaatgtggacttcagcaaagagttaaaaaaaactgaaaacatttcatatgaaatgctttttgaacctgagccaaatggagtaaattctgtggaaatgatggataaagaaagaaacaaagacaaaatgcctgaggatgttacattcagccctcaagatgaaacacagaccgcaaatcataaaccagaagagcatcctgaagaaaatacaaagaacagtgttgacgaacaggaagaaactgttatttcttacgaatcaactcctgaggtttctagaggaaatcaaacaatggcagtgaaaagtctgtccccatctcctgagtcctcggcatcgccagttccatccactcagccgcagctcacagaaggatcacatttcatgtgtgtgtagtcttagaagaactatactgacttctgttgaaaccattcaaagctaaagacatggaccttcagcagtgtaagaagatattgtacagtatattttaaatctatgaaattcatagttctgatgcttttggtcacagagcatcattttatcacttctggaaaatgtttattccaaaacagctttaatggcccatatgtacacttcgtaatctcaaggttattattctgacaccagcttgctgctatgatttcagagcacataagtaaaggtgctttttaatgtgcagtctatttccagagcttacttagttgctgatttccagatttcgatgtttcttaagtctaggtgaatttatatatatatttttttgcttttcattttctaaagttagttattatttccattgaagcttgttttctttttttcttcccattttagctactgcagtgcttttgtttcacacttgatttgtaaaaattttatatatatgtatttaaaatgtgccattttattgctaagtgaagtatgtcctgttttctgctataattctttctcggtcagattgcaatgtcagcagttactgccacactcctgtcagcttaaacacaaatgttactgcttatcttttcttaaaaaaaaaaaaaacaaagtgtaggtattttgaagtactgggcttatatttcattggaatacatgtgtacagcaataagcaggtttccaaatccggtacttagtttgtgtacaaatgtaattatgttcattgtgtatatattatacaatgagcacatgtaatgtattaaaggctacttactattgtttaaatgcaaatgttcatatctcatttctttttttatcatgttaaataaatgttgatgttcttaaa

SEQ ID NO: 110587 - DNA, 6535 bp, Homo sapiens
  misc_feature (3895)..(3895): n is a, c, g, or t
  misc_feature (3910)..(3910): n is a, c, g, or t
  misc_feature (4019)..(4019): n is a, c, g, or t
  misc_feature (4135)..(4135): n is a, c, g, or t
  misc_feature (4985)..(4985): n is a, c, g, or t
  misc_feature (5051)..(5051): n is a, c, g, or t
  misc_feature (5762)..(5762): n is a, c, g, or t
  misc_feature (5923)..(5923): n is a, c, g, or t
  misc_feature (6068)..(6069): n is a, c, g, or t
  misc_feature (6117)..(6117): n is a, c, g, or t
  misc_feature (6127)..(6127): n is a, c, g, or t
ggcagccgcggcggcagcaggagaaggcggcggcggcggctagggatcagacatggcggcggatctgaacctggagtggatctccctgccccggtcctggacttacgggatcaccaggggcggccgagtcttcttcatcaacgaggaggccaagagcaccacctggctgcaccccgtcaccggcgaggcggtggtcaccggacaccggcggcagagcacagatttgcctactggctgggaagaagcatatacttttgaaggtgcaagatactatataaaccataatgaaaggaaagtgacctgcaaacatccagtcacaggacaaccatcacaggacaattgtatttttgtagtgaatgaacagactgttgcaaccatgacatctgaagaaaagaaggaacggccaataagtatgataaatgaagcttctaactataacgtgacttcagattatgcagtgcatccaatgagccctgtaggcagaacttcacgagcttcaaaaaaagttcataattttggaaagaggtcaaattcaattaaaaggaatcctaatgcaccggttgtcagacgaggttggctttataaacaggacagtactggcatgaaattgtggaagaaacgctggtttgtgctttctgacctttgcctcttttattatagagatgagaaagaagagggtatcctgggaagcatactgttacctagttttcagatagctttgcttacctctgaagatcacattaatcgcaaatatgcttttaaggcagcccatccaaacatgcggacctattatttctgcactgatacaggaaaggaaatggagttgtggatgaaagccatgttagatgctgccctagtacagacagaacctgtgaaaagagtggacaagattacatctgaaaatgcaccaactaaagaaaccaataacattcccaaccatagagtgctaattaaaccagagatccaaaacaatcaaaaaaacaaggaaatgagcaaaattgaagaaaaaaaggcattagaagctgaaaaatatggatttcagaaggatggtcaagatagacccttaacaaaaattaatagtgtaaagctgaattctctgccatctgaatatgagagtgggtcagcatgccctgctcagactgtgcactacagaccaatcaacttgagcagttcagagaacaaaatagtcaatgttagcctggcagatcttagaggtggaaatcgccccaatacagggcccttatacacagaggccgatcgagtcatacagagaacaaattcaatgcagcagttggaacagtggattaaaatccagaaggggaggggtcatgaagaagaaaccaggggagtaatttcttaccaaacattaccaagaaatatgccaagtcacagagcccagattatggcccgctaccctgaaggttatagaacactcccaagaaacagcaagacaaggcctgaaagtatctgcagtgtaaccccttccactcatgacaagacattaggacccggagcggaggagaaacggaggtccatgagagatgacacaatgtggcagctctacgaatggcagcagcgtcagttttataacaaacagagcaccctccctcgacacagtactttgagtagtcccaaaaccatggtaaatatttctgaccagacaatgcactctattcccacatcaccttcccacgggtcaatagctgcttatcagggatactcccctcaacgaacttacagatcggaagtgtcttcaccaattcagagaggagatgtgacaatagaccgcagacacagggcccatcaccctaagcatgtctatgtgcctgacagaaggtcagtgccagctggcctgactttacagtctgttagtccccagagcctccaagggaaaacgccagaggagcttacgctgctgctaataaagctgagacggcagcaagccgaactgagtagtatccgggagcatacgttagcacagctcatgcagctaaagcttgaggcccacagcccaaagaatgaaattctttcacatcatctccaaaggaacaccatatatttggatcatcagctgtcacaagatgaaggtagaggcacattatacaaatacagacctgaagaagtagatattgatgccaagttaagccgattatgtgaacaagataaagtggtgcatgctctggaagagaaacttcagcaactccacaaggagaaatacacgcttgagcaagctttgctatcagccagccaagagatagaaatgcatgcagataacccagcagccattcagacagtggtgttacaaagggatgatttacaaaatggactgcttagtacgtgtcgagaactttctcgagccactgccgaattggaacgagcatggagagaatatgataagttagaatacgatgtaactgttaccaggaaccagatgcaagagcagctggatcaccttggtgaagttcagacggaatcagcaggaattcagcgtgcacagattcagaaagaactttggcgaattcaggatgtcatggaagggctgagtaaacataagcagcaaagaggtactacagaaataggtatgataggatcaaagcctttctcaacagttaagtacaaaaatgagggtccagattatagactctacaagagtgaaccagagttaacaacagtggcagaagttgatgaatctaatggagaagaaaaatcagaacctgtttcagagatagaaacttcagttgttaaaggttcccactttcctgttggagtagtccctccaagagcaaaatcaccaacacccgaatcttcgacaatagcttcctatgtaaccttgaggaaaactaagaagatgatggatctaagaacggaaagaccaagaagtgcagtggaacagctctgtttggctgaaagtactcgaccaaggatgactgtggaagagcaaatggaaagaataagaagacatcaacaagcgtgcctgagggagaagaaaaaagggttaaatgttatcggtgcttcagaccagtcacccttacaaagcccttcaaatttaagggataatccatttaggactactcagactcgaaggagggatgataaggaactggacactgccattagagaaaatgatgtaaagccagaccatgaaactcctgcaacagaaattgttcaactaaaagaaaccgaaccccaaaatgtggacttcagcaaagagttaaaaaaaactgaaaacatttcatatgaaatgctttttgaacctgagccaaatggagtaaattctgtggaaatgatggataaagaaagaaacaaagacaaaatgcctgaggatgttacattcagccctcaagatgaaacacagaccgcaaatcataaaccagaagagcatcctgaagaaaatacaaagaacagtgttgacgaacaggaagaaactgttatttcttacgaatcaactcctgaggtttctagaggaaatcaaacaatggcagtgaaaagtctgtccccatctcctgagtcctcggcatcgccagttccatccactcagccgcagctcacagaaggatcacatttcatgtgtgtgtagtcttagaagaaagatgtcccccatgctggagtgtagtggcataatcacagctcactgcagccttgacctcctgggctcaagcagtcgtcctgcctcagcctcacaagtagctgggatcacaagtgcacgccaccacactcggctgatatttcgattttcttatagagacagtcttactaagttgtccacgctggtctcaaactcctgaattcaagctaccctcccactgcatgagccactgtgcctagcctctttgattttcacattctcaaaatatttcttttattttctctcctttttttttttttttcgaggcanggtcttactctgtcncccaggctggagtgcagtggtgcaagatcatggctcaatggctcactgaaggctgacctcccaggctcaagcaatcctcccacctcagccccctgagtagctgggactncaggtgtatgccaccatgccaggctaattgttttgcagagatggagttttcaccatgttgcccaggctgatctcaagctcctgagctcaagtgatctgtccgcctcagcctcccanagtgctgagattacaggtgtgagccaccacacccagccttttttcttccttttcaagcattttttaaatttcactagctttgggtacaagtggttttgggttacatggaagaattgtatagtggtgaagtctgagattttagtgcacccattacccgagtagtgtatgttgtacccaatccttcaccgaccttccaccctctcccttctgagtctccaaagtccattataccacactgtatgcctttgcatacccatagtgtagctccaacttataagtgagaacatatgatatttggttttcctttcctgagttactttacttagaataatggcctccagctccatccaagttgctgcaaaatacattattttgttcctttttattgctgagtagtattccatggtgtatataaaccacattttctttatccactccttggttggtggactcttaggttggttccatacccttggagttgcaaattgtgctgctataaacatgcatgtgcatgtatcttttttatgtaatgacttgttttcttttgggtcgatactcagtagtgggattgctggatcaaatgctggatctacttttagttctttaaggaatctccacactgttttccgtagtggttgtactagtttacattcccaccagcagtgtaaaagtgtttccttctcaccacatccataccaacatctgttgttttttgacttttaaattatggccattctttttttttgtttttgagatggagtctcgctctgtcagcaggctggagtgcagtggcgtgatcttggctcactgcaacctcctcctccagggttcaagtgattctcctgcctcngcctcccccgtagctgggactacaggcgtgtgccaccacacccagctaatttttgaatttttagtngagatggggtttcaccatgttggccagtatggtctcgatctcttgacctcatgatccgcccacctcggcctcccaaagtgctggcgtgacccactgcacccggccaattatggccattcttgcaggaataaggaggcatctcattgttgtgtaccttcttttgagaaatgcctattcgcgtcatttgcccactttttgatgggattatttgttttttttttttttttcttgctgatttgttttgagttccttccagattctggatattagtcctttgttggatgcatagtttgcaaatatttcctcccatcctgttttctggaatctacttcctttcacaccttattgtaggaactataatctgtgccctttttttcagcccaaagtattttgttgtcttttcatatttgtaacttttatttgagattatgtctacctggaacctcaaagaggcttctgtttttgtcagttggtatctgtgcaggactgaagtgcttgctggagagttacaaataacctaactgtgatagtcttacctgtgttctgcctttgtcacttgtgtttaagccttttttcttttttcttttttcttttttttttttttgttgagaccaggtctcaccctgtcacccacactggagtgcaatggtgagatcttggagccttgccctcctgggcttaagtgatcctcccacgacagcctcccaagtngctgggaccacacgcctgtgccaccaagcctggctgatttttttgtattttttgtagagtaggggtttcaccgtgttgcccaggctggtctcaaactcctgagctcaagcgctctgcccgcctcaatctcccaaagtgctgagattacaagattgagccancacgcctggctatgtttaaacttttaatttaatatgtttagaaatgactgttgaggccaggtgcggtaatgccagcactttgggaggccagggctggtggatcacttgaggtcgggagttcaggaccagcctggccaacatggtnnaaccccatctctacttaaaaatacaaaaattagctgggcatggtgtcnggcgcctgtnatcccagctacctgggaggctgagacaggagaatcgcttgaacctgggaggcagaggttgcagtgagccgagatcacaccatcgcactccggcctgggtgacagaacaagactttgtctcaaaaaaaaaaaaaaaaatctgggtgtggtggcccacacctgtaatcccagcactttgggaggccgaggcaggcagatcacctggctcctgaccagcgtgaccaacatggagaaacccagtctctactaaaattacaaaattagctgggcgtggtggcacatgcctgtaatcccagctacttgggaggctgaggcaggagaatcgcttgaacccagaggcagtggttgcagtgagccgaggtcgtgccattgcactccagcctgggcaacaagaacgaaactctgtctc

SEQ ID NO: 110588 - DNA, 2020 bp, Homo sapiens
ttttgccacttaaaaatttctcaaatttcttctttccacgtaattgtgacataggtattatttgtgttatatcccagatggctcactagggctactaatgtttagagtttgatttgtgtctttagcagtaaacattttaaaagaaacttttagcagttttttagggtaattacatgtcttcctttcaagggtccagattatagactctacaagagtgaaccagagttaacaacagtggcagaagttgatgaatctaatggagaagaaaaatcagaacctgtttcagagatagaaacttcagttgttaaaggttcccactttcctgttggagtagtccctccaagagcaaaatcaccaacacccgaatcttcgacaatagcttcctatgtaaccttgaggaaaactaagaagatgatggatctaagaacggaaagaccaagaagtgcagtggaacagctctgtttggctgaaagtactcgaccaaggatgactgtggaagagcaaatggaaagaataagaagacatcaacaagcgtgcctgagggagaagaaaaaagggttaaatgttatcggtgcttcagaccagtcacccttacaaagcccttcaaatttaagggataatccatttaggactactcagactcgaaggagggatgataaggaactggacactgccattagagaaaatgatgtaaagccagaccatgaaactcctgcaacagaaattgttcaactaaaagaaaccgaaccccaaaatgtggacttcagcaaagagttaaaaaaaactgaaaacatttcatatgaaatgctttttgaacctgagccaaatggagtaaattctgtggaaatgatggataaagaaagaaacaaagacaaaatgcctgaggatgttacattcagccctcaagatgaaacacagaccgcaaatcataaaccagaagagcatcctgaagaaaatacaaagaacagtgttgacgaacaggaagaaactgttatttcttacgaatcaactcctgaggtttctagaggaaatcaaacaatggcagtgaaaagtctgtccccatctcctgagtcctcggcatcgccagttccatccactcagccgcagctcacagaaggatcacatttcatgtgtgtgtagtcttagaagaactatactgacttctgttgaaaccattcaaagctaaagacatggaccttcagcagtgtaagaagatattgtacagtatattttaaatctatgaaattcatagttctgatgcttttggtcacagagcatcattttatcacttctggaaaatgtttattccaaaacagctttaatggcccatatgtacacttcgtaatctcaaggttattattctgacaccagcttgctgctatgatttcagagcacataagtaaaggtgctttttaatgtgcagtctatttccagagcttacttagttgctgatttccagatttcgatgtttcttaagtctaggtgaatttatatatatatttttttgcttttcattttctaaagttagttattatttccattgaagcttgttttctttttttcttcccattttagctactgcagtgcttttgtttcacacttgatttgtaaaaattttatatatatgtatttaaaatgtgccattttattgctaagtgaagtatgtcctgttttctgctataattctttctcggtcagattgcaatgtcagcagttactgccacactcctgtcagcttaaacacaaatgttactgcttatcttttcttaaaaaaaaaaaaaacaaagtgtaggtattttgaagtactgggcttatatttcattggaatacatgtgtacagcaataagcaggtttccaaatccggtacttagtttgtgtacaaatgtaattatgttcattgtgtatatattatacaatgagcacatgtaatgtattaaaggctacttactattgtttaaatgcaaatgttcatatctcatttctttttttatcatgttaaataaatgttgatgttcttaaa

SEQ ID NO: 110589 - DNA, 3705 bp, Homo sapiens
ggcagccgcggcggcagcaggagaaggcggcggcggcggctagggatcagacatggcggcggatctgaacctggagtggatctccctgccccggtcctggacttacgggatcaccaggggcggccgagtcttcttcatcaacgaggaggccaagagcaccacctggctgcaccccgtcaccggcgaggcggtggtcaccggacaccggcggcagagcacagatttgcctactggctgggaagaagcatatacttttgaaggtgcaagatactatataaaccataatgaaaggaaagtgacctgcaaacatccagtcacaggacaaccatcacaggacaattgtatttttgtagtgaatgaacagactgttgcaaccatgacatctgaagaaaagaaggaacggccaataagtatgataaatgaagcttctaactataacgtgacttcagattatgcagtgcatccaatgagccctgtaggcagaacttcacgagcttcaaaaaaagttcataattttggaaagaggtcaaattcaattaaaaggaatcctaatgcaccggttgtcagacgaggttggctttataaacaggacagtactggcatgaaattgtggaagaaacgctggtttgtgctttctgacctttgcctcttttattatagagatgagaaagaagagggtatcctgggaagcatactgttacctagttttcagatagctttgcttacctctgaagatcacattaatcgcaaatatgcttttaaggcagcccatccaaacatgcggacctattatttctgcactgatacaggaaaggaaatggagttgtggatgaaagccatgttagatgctgccctagtacagacagaacctgtgaaaagagtggacaagattacatctgaaaatgcaccaactaaagaaaccaataacattcccaaccatagagtgctaattaaaccagagatccaaaacaatcaaaaaaacaaggaaatgagcaaaattgaagaaaaaaaggcattagaagctgaaaaatatggatttcagaaggatggtcaagatagacccttaacaaaaattaatagtgtaaagctgaattctctgccatctgaatatgagagtgggtcagcatgccctgctcagactgtgcactacagaccaatcaacttgagcagttcagagaacaaaatagtcaatgttagcctggcagatcttagaggtggaaatcgccccaatacagggcccttatacacagaggccgatcgagtcatacagagaacaaattcaatgcagcagttggaacagtggattaaaatccagaaggggaggggtcatgaagaagaaaccaggggagtaatttcttaccaaacattaccaagaaatatgccaagtcacagagcccagattatggcccgctaccctgaaggttatagaacactcccaagaaacagcaagacaaggcctgaaagtatctgcagtgtaaccccttccactcatgacaagacattaggacccggagcggaggagaaacggaggtccatgagagatgacacaatgtggcagctctacgaatggcagcagcgtcagttttataacaaacagagcaccctccctcgacacagtactttgagtagtcccaaaaccatggtaaatatttctgaccagacaatgcactctattcccacatcaccttcccacgggtcaatagctgcttatcagggatactcccctcaacgaacttacagatcggaagtgtcttcaccaattcagagaggagatgtgacaatagaccgcagacacagggcccatcaccctaagcatgtctatgtgcctgacagaaggtcagtgccagctggcctgactttacagtctgttagtccccagagcctccaagggaaaacgtggggtagagaaaaggtggcgacggcgactggagcagcagaggctgtagcatcggatacccacctcccacgaaccggttcctcttccccctccttgctgtgtgtttgatgtgttgaagcaggagggagaacgccgcgagcagcgccgtgagcaacactaccatcgtccccagcactgcggatccgggccctagcggcgggcccagtagcggaggtggtggcggcggtggaggcggcggcatcgaggtaataggtgactgatctccccgggcgctagctctgagcagatgcggactctcttcggtttcctaggcaagatcgacgaaccacacctcttcccgccggataattcacctttgccaatcgcaatctcgttaaattccatgatccagactcagcagttgtcgcaccatgtctgacaaacactgtattccttgacagagctttgataacgtaccatatgcagaaggagttattcctgataaggctaaggcttgtctctgttggcaccagctaatgcaatggcaggtcttctgcttggtgttgggctcctgcctactcctaacccacttactcagactggcgctgttccaccggctgctttgggggctcctactcttgttcctgcccttgctgcgcttgggcttcctggagcaaacttgaactcaatctgttgccacagatagttgctgaagcttatgagcactgttggtcccaagttgaagcatgtagctgctggtcttgtttcaccaagtctgaaatcggatacctctagtaaagaaatagagaaaggggccccacatggtggctcaggccagtaatcccagagctttgggaggctgaggagggtggatcacttgaggtcaggagttcgagaccaacctgaccaacatggtgaaaccttgtctctactaaaaattcaaaattagccgggcatggtggcgcatgcctgtaatcccaaatacttaggaggctgaggcaggagaatcgcctgaatcctggaggcggaggttgcagtgagccgagattgtgccattgcactccagcctgggcaacgagcacaaaactcttggctcaaaaaaaaatagaggaagctatgaaaagagtacaagaagcacactgcctaatttcggctgctatagaaccagagaaagaaaaaagaaggcattcaagatcacattctaggaggaggaggactctcatcttctagacacagtcaaggagcagatcaagagagtgattacattgtcagtctaggagtcgttgatgattcaaaagcccaagacagagaagatctcattccagagagagaggcagaaggtcaaggagcacatcaaaaacgagagacagaaagaaagaagacaaaagaaacattcaaaaacacccccagaaagttacagcacggctagacattatagaagtacaaacagagagacaacaacgaagaagcaggagtggaacaagatctcctaaaaagtctcggtgtcctaaaagaaaattgtctctctcaccatcccctgggaaacataaaaagaagaagaaagataaagagagaaataggtatgaaagagaacgatcaacaagcaagaagaagagtaaagatagggaaaaggaccaggaaagaaaatcagagagtgatacagatgtaaaagttacacgggtttatgatgaagaggaacaagggtatgacagtgagagagaggaaaaaaagagaagaaagcaatagaagcagattcccctaaaacaaagaaacgttctgtggaaaagggaactggtgattcactaggagaacccatagtgaatgggaat

SEQ ID NO: 110590 - DNA, 3820 bp, Homo sapiens
  misc_feature (3771)..(3771): n is a, c, g, or t
ggcagccgcggcggcagcaggagaaggcggcggcggcggctagggatcagacatggcggcggatctgaacctggagtggatctccctgccccggtcctggacttacgggatcaccaggggcggccgagtcttcttcatcaacgaggaggccaagagcaccacctggctgcaccccgtcaccggcgaggcggtggtcaccggacaccggcggcagagcacagatttgcctactggctgggaagaagcatatacttttgaaggtgcaagatactatataaaccataatgaaaggaaagtgacctgcaaacatccagtcacaggacaaccatcacaggacaattgtatttttgtagtgaatgaacagactgttgcaaccatgacatctgaagaaaagaaggaacggccaataagtatgataaatgaagcttctaactataacgtgacttcagattatgcagtgcatccaatgagccctgtaggcagaacttcacgagcttcaaaaaaagttcataattttggaaagaggtcaaattcaattaaaaggaatcctaatgcaccggttgtcagacgaggttggctttataaacaggacagtactggcatgaaattgtggaagaaacgctggtttgtgctttctgacctttgcctcttttattatagagatgagaaagaagagggtatcctgggaagcatactgttacctagttttcagatagctttgcttacctctgaagatcacattaatcgcaaatatgcttttaaggcagcccatccaaacatgcggacctattatttctgcactgatacaggaaaggaaatggagttgtggatgaaagccatgttagatgctgccctagtacagacagaacctgtgaaaagagtggacaagattacatctgaaaatgcaccaactaaagaaaccaataacattcccaaccatagagtgctaattaaaccagagatccaaaacaatcaaaaaaacaaggaaatgagcaaaattgaagaaaaaaaggcattagaagctgaaaaatatggatttcagaaggatggtcaagatagacccttaacaaaaattaatagtgtaaagctgaattctctgccatctgaatatgagagtgggtcagcatgccctgctcagactgtgcactacagaccaatcaacttgagcagttcagagaacaaaatagtcaatgttagcctggcagatcttagaggtggaaatcgccccaatacagggcccttatacacagaggccgatcgagtcatacagagaacaaattcaatgcagcagttggaacagtggattaaaatccagaaggggaggggtcatgaagaagaaaccaggggagtaatttcttaccaaacattaccaagaaatatgccaagtcacagagcccagattatggcccgctaccctgaaggttatagaacactcccaagaaacagcaagacaaggcctgaaagtatctgcagtgtaaccccttccactcatgacaagacattaggacccggagcggaggagaaacggaggtccatgagagatgacacaatgtggcagctctacgaatggcagcagcgtcagttttataacaaacagagcaccctccctcgacacagtactttgagtagtcccaaaaccatggtaaatatttctgaccagacaatgcactctattcccacatcaccttcccacgggtcaatagctgcttatcagggatactcccctcaacgaacttacagatcggaagtgtcttcaccaattcagagaggagatgtgacaatagaccgcagacacagggcccatcaccctaagcatgtctatgtgcctgacagaaggtcagtgccagctggcctgactttacagtctgttagtccccagagcctccaagggaaaacgctgtcacaagatgaaggtagaggcacattatacaaatacagacctgaagaagtagatattgatgccaagttaagccgattatgtgaacaagataaagtggtgcatgctctggaagagaaacttcagcaactccacaaggagaaatacacgcttgagcaagctttgctatcagccagccaagagatagaaatgcatgcagataacccagcagccattcagacagtggtgttacaaagggatgatttacaaaatggactgcttagtacgtgtcgagaactttctcgagccactgccgaattggaacgagcatggagagaatatgataagttagaatacgatgtaactgttaccaggaaccagatgcaagagcagctggatcaccttggtgaagttcagacggaatcagcaggaattcagcgtgcacagattcagaaagaactttggcgaattcaggatgtcatggaagggctgagtaaacataagcagcaaagaggtactacagaaataggtatgataggatcaaagcctttctcaacagttaagtacaaaaatgagggtccagattatagactctacaagagtgaaccagagttaacaacagtggcagaagttgatgaatctaatggagaagaaaaatcagaacctgtttcagagatagaaacttcagttgttaaaggttcccactttcctgttggagtagtccctccaagagcaaaatcaccaacacccgaatcttcgacaatagcttcctatgtaaccttgaggaaaactaagaagatgatggatctaagaacggaaagaccaagaagtgcagtggaacagctctgtttggctgaaagtactcgaccaaggatgactgtggaagagcaaatggaaagaataagaagacatcaacaagcgtgcctgagggagaagaaaaaagggttaaatgttatcggtgcttcagaccagtcacccttacaaagcccttcaaatttaagggataatccatttaggactactcagactcgaaggagggatgataaggaactggacactgccattagagaaaatgatgtaaagccagaccatgaaactcctgcaacagaaattgttcaactaaaagaaaccgaaccccaaaatgtggacttcagcaaagagttaaaaaaaactgaaaacatttcatatgaaatgctttttgaacctgagccaaatggagtaaattctgtggaaatgatggataaagaaagaaacaaagacaaaatgcctgaggatgttacattcagccctcaagatgaaacacagaccgcaaatcataaaccagaagagcatcctgaagaaaatacaaagaacagtgttgacgaacaggaagaaactgttatttcttacgaatcaactcctgaggtttctagaggaaatcaaacaatggcagtgaaaagtctgtccccatctcctgagtcctcggcatcgccagttccatccactcagccgcagctcacagaaggatcacatttcatgtgtgtgtagtcttagaagaactatactgacttctgttgaaaccattcaaagctaaagacatggaccttcagcagtgtaagaagatattgtacagtatattttaaatctatgaaattcatagttctgatgcttttggtcacagagcatcattttatcacttctggaaaatgtttattccaaaacagctttaatggcccatatgtacacttcgtaatctcaaggttattattctgacaccagcttgctgctatgatttcagagcacataagtaaaggtgctttttaatgtgcagtctatttccagagcttacttagttgctgatttccagatttcgatgtttcttaagtctaggtgaatttatatatatattcacctanacttaagaaacaaagacaaaatgcctgaggatgttacattcagccctca

SEQ ID NO: 110591 - DNA, 3059 bp, Homo sapiens
ggcagccgcggcggcagcaggagaaggcggcggcggcggctagggatcagacatggcggcggatctgaacctggagtggatctccctgccccggtcctggacttacgggatcaccaggggcggccgagtcttcttcatcaacgaggaggccaagagcaccacctggctgcaccccgtcaccggcgaggcggtggtcaccggacaccggcggcagagcacagatttgcctactggctgggaagaagcatatacttttgaaggtgcaagatactatataaaccataatgaaaggaaagtgacctgcaaacatccagtcacaggacaaccatcacaggacaattgtatttttgtagtgaatgaacagactgttgcaaccatgacatctgaagaaaagaaggaacggccaataagtatgataaatgaagcttctaactataacgtgacttcagattatgcagtgcatccaatgagccctgtaggcagaacttcacgagcttcaaaaaaagttcataattttggaaagaggtcaaattcaattaaaaggaatcctaatgcaccggttgtcagacgaggttggctttataaacaggacagtactggcatgaaattgtggaagaaacgctggtttgtgctttctgacctttgcctcttttattatagagatgagaaagaagagggtatcctgggaagcatactgttacctagttttcagatagctttgcttacctctgaagatcacattaatcgcaaatatgcttttaaggcagcccatccaaacatgcggacctattatttctgcactgatacaggaaaggaaatggagttgtggatgaaagccatgttagatgctgccctagtacagacagaacctgtgaaaagagtggacaagattacatctgaaaatgcaccaactaaagaaaccaataacattcccaaccatagagtgctaattaaaccagagatccaaaacaatcaaaaaaacaaggaaatgagcaaaattgaagaaaaaaaggcattagaagctgaaaaatatggatttcagaaggatggtcaagatagacccttaacaaaaattaatagtgtaaagctgaattctctgccatctgaatatgagagtgggtcagcatgccctgctcagactgtgcactacagaccaatcaacttgagcagttcagagaacaaaatagtcaatgttagcctggcagatcttagaggtggaaatcgccccaatacagggcccttatacacagaggccgatcgagtcatacagagaacaaattcaatgcagcagttggaacagtggattaaaatccagaaggggaggggtcatgaagaagaaaccaggggagtaatttcttaccaaacattaccaagaaatatgccaagtcacagagcccagattatggcccgctaccctgaaggttatagaacactcccaagaaacagcaagacaaggcctgaaagtatctgcagtgtaaccccttccactcatgacaagacattaggacccggagcggaggagaaacggaggtccatgagagatgacacaatgtggcagctctacgaatggcagcagcgtcagttttataacaaacagagcaccctccctcgacacagtactttgagtagtcccaaaaccatggtaaatatttctgaccagacaatgcactctattcccacatcaccttcccacgggtcaatagctgcttatcagggatactcccctcaacgaacttacagatcggaagtgtcttcaccaattcagagaggagatgtgacaatagaccgcagacacagggcccatcaccctaagcatgtctatgtgcctgacagaaggtcagtgccagctggcctgactttacagtctgttagtccccagagcctccaagggaaaacgtggggtagagaaaaggtggcgacggcgactggagcagcagaggctgtagcatcggatacccacctcccacgaaccggttcctcttccccctccttgctgtgtgtttgatgtgttgaagcaggagggagaacgccgcgagcagcgccgtgagcaacactaccatcgtccccagcactgcggatccgggccctagcggcgggcccagtagcggaggtggtggcggcggtggaggcggcggcatcgaggtaataggtgactgatctccccgggcgctagctctgagcagatgcggactctcttcggtttcctaggcaagatcgacgaaccacacctcttcccgccggataattcacctttgccaatcgcaatctcgttaaattccatgatccagactcagcagttgtcgcaccatgtctgacaaacactgtattccttgacagagctttgataacgtaccatatgcagaaggagttattcctgataaggctaaggcttgtctctgttggcaccagctaatgcaatggcaggtcttctgcttggtgttgggctcctgcctactcctaacccacttactcagactggcgctgttccaccggctgctttgggggctcctactcttgttcctgcccttgctgcgcttgggcttcctggagcaaacttgaactcaatctgttgccacagatagttgctgaagcttatgagcactgttggtcccaagttgaagcatgtagctgctggtcttgtttcaccaagtctgaaatcggatacctctagtaaagaaatagagaaaggggccccacatggtggctcaggccagtaatcccagagctttgggaggctgaggagggtggatcacttgaggtcaggagttcgagaccaacctgaccaacatggtgaaaccttgtctctactaaaaattcaaaattagccgggcatggtggcgcatgcctgtaatcccaaatacttaggaggctgaggcaggagaatcgcctgaatcctggaggcggaggttgcagtgagccgagattgtgccattgcactccagccttgggtgacagagcgagactgttcaaaaaacactctgatactccaactgttcaaagttcagcgaactccagtaataacgtggtgggctgagtattagatactggtttaaatcctc

SEQ ID NO: 110592 - DNA, 1963 bp, Homo sapiens
ggcagccgcggcggcagcaggagaaggcggcggcggcggctagggatcagacatggcggcggatctgaacctggagtggatctccctgccccggtcctggacttacgggatcaccaggggcggccgagtcttcttcatcaacgaggaggccaagagcaccacctggctgcaccccgtcaccggcgaggcggtggtcaccggacaccggcggcagagcacagatttgcctactggctgggaagaagcatatacttttgaaggtgcaagatactatataaactgaatagatttccttttcattcttcctgggaatagaagatgtaatggaagttccagtatctgtatgcaggcctatgactagcttcacttcttggtgactaatactagttgacaaaacagcatattctaaactgattgtcttcgttatccagtagctttcctattctccataacaaatgttccaaatctttgattactcacctcagaatgcttgtctcactcctcttttcctcattcctagtagatcataccttggagaagaaagtagaaactatcaggcctgaacttcattagctttttcttcctcttcaatccaaatctgtctgtatcttcattcatttttcttaaccctttccttgcttgctatttctgctttccaaaaccaaggaaggaattttgacagaggtacccaaggaattcactgggggaaaatgaatgattcaataaatgatgttatgataattagatagatagctatatgtaagcataaaaaatttttaaaaccttaggcccttattatcatatcatgcacaaaaattaagtggattattgatttaaatgtaaaaacaaaaagtataaaacttttagaaaaaagagattatttgtgacattgggtctggcaaagatttcttagatgcgattaaagatttacaaaagaaaaaattgataaattagacttcatcaaaatttagaaattttgctttatctgtgtaggatactgaagagaatgaaaagacaagtcacagactgggagaaagtacaggcaaatcacatatttgtcaaataactcatatccagaatttttaaagaacttttacaactcaataataacaagacaaacagctcaattttttaaatgagggaaaaatttaaatatatttcacatgagaatatactcaaatagccagtgagcacatgaaaagatgttcagcatcattagacattagcaaattgcaaattaaaaccacactgaggaacccactaggaatggctataatcaaagacgatcagtatcaagtattgcggagaatgtggagaaactcaaactctgttacactagtaatagaaatataaaatgttagaaccactttggaaagagattggcagtttctggaaaaaattaattgtaaatttgaccaagcaattttactacgtaagtatgttaagaatgaaaacgtgtgcacacaaagatctgtactaaaatgttgatagcattattcataacagcctaacagtgcaaatgtctgtcaactactgtgaatggagagacaaaatgtgtttattaatacaacaaaactacccagcaataaaaagaaataattgactgataaatggtatacgatgactgaactttaaaaccttgatgctgcctaaaagagccagacacagactacacattgtataattccatttttatgaatttcccagaaaggcaaattatagagacaaaacaaatcagtggttgcctagggctggtggtggacgtggagattgactgtaaatgggacatgagggaatttttttgtggtgatagaaatgttataaaactagatgtggtaatagttgcacaactctgtaaattcactaaaagtcactgaactgtacacttaaccataggtgggtttaatgaaatgtgaattacactgcaataaaactaaataaaagctgagttagtaccacttgc

SEQ ID NO: 110593 - DNA, 375 bp, Homo sapiens
gcatatgggttggttccaagtctttaccattgtgaatagtgctgctataaccatacatggagcagatggttcgcaaagcaagatggacctctgagcaagatgagctccaagcttgatggagctcagagcagatggagctccaggtgagatggagctccgattaatatgaagctcggagcagatgtttctgagtatgatggagcaccaagcctgtggtctcagagcaagatggagctccgagcagatggtactcagagccagatggagctaggagtgactggggctctgagcaaggtggagctcagaacagatggtgctcagagcaagatggagcttggagtgattggagctccaagcaagatggagcttggagca

SEQ ID NO: 110594 - DNA, 276 bp, Homo sapiens
aaaaacaatccatgttcacaatccatttttaaaaacattctgattaattgccaacatttaaaaatccaggagattttatataaaggtctggatttctggttcatcttgaaaattggacagtcaggtcataccaagtccacatttcacacagtgacaaagattggagctgagcggctccctggcccgcctcactcattccatttcccccctgatccttggaagcatgtgggtttccaatgcctggagctagactgagcacccacaggctgcagcagt

SEQ ID NO: 110595 - DNA, 271 bp, Homo sapiens
tggaagtctgtgccatcagggactctcttactgtttattagatacttgacttacatgatttcatgtagtccctcacaagaacccagaaggtagctactgtgtccccattgtagggataaaaggaacaaggcacatggaagtcatggaacttgatgcagcagcagggttagggtttgctgattctctgactccagggcctgtgccctgaatcgcagtaatggcttcattccttctgtcatctttgtatccttagtaccttatacactgcctc

SEQ ID NO: 110596 - DNA, 787 bp, Homo sapiens
aagacagaagggcatttggcagagttagtcataaggaagtctgcatggtatactttaccaaaagcagctcacatttcattaagccctgatgttttagtcactttaaagaatgaattaacaatagtccaatccaaaagaactagaaaggcatcagacacattgaaagcacaggtattaccaacattaacctattaatttcaaatcacttttttttattttaaagcagtctgtttttatgtgtacagttgttttcttatagaatcactttctctgtgtacagtaagtagctaaatgtgtcagtttactagttctatttcataggatgagagacttttaaagctggaagcatctgtagaacttagctctttcagccctttccatttataaatgaggggactgaggcccaagccattcagtgagttagagagagagccagccctcaaatgtttagattcttcacccgtgagccagcatttttatttctttctactatattagctactagtgtaaataatgtgcctgccttggttttaaattttgtttttcagatattggaagaggtgcctggagaaatggatgctagaagaaaacactggaaggagaatatgtttactcctttttttagtgcacaagatgttctagaagagacttctgagcctgaatcttcttctgaacaaacgactgcagatagcagcaagggaatggaagaaatttataatttgtccagtagaaagtttcaggaagaaagtaaatttaagaggaaaaaatatattttccaactaaatga

SEQ ID NO: 110597 - DNA, 212 bp, Homo sapiens
ggacgagaggtgggaggggctccacgacgccaatcacaataagcagggagccagtcagattaggaaggaagcacgagaccagagactagtgtcatcaccggtcacggcaggacaagcgccccagaggtcggaaaatcctgggacaacgcgaaagcggtggtcgccccacactctgcggagaaagtggtttcgcgcacgcgcgccacgcccat

SEQ ID NO: 110598 - DNA, 306 bp, Homo sapiens
  misc_feature (142)..(142): n is a, c, g, or t
gtcagcacattaaaacatgcctgagggctctggagaatgtcccagtggtcccaggccctctggaaaaacactctctggaacagttgcaggaggtgagaccaagaacttgcctctgaagccccttggttggaggaggacacanggctcacaagaatggatcagggagagcccacggtgaacccaattctggattcattaaaagctaatcatgatgatgatgatgttaacagctacagtttattgagtatattatttgccaagcacttaacagtcatttattcaataaagatcacttcacattgtctt

SEQ ID NO: 110599 - DNA, 132 bp, Homo sapiens
tggccaagatccaaaagctcataaccagagagccaggatgtgaatccaggctggcctggctcctgagccaaggctcttacccattgcactacatccacttattattttttttttaagatggagtttcgctct

SEQ ID NO: 110600 - DNA, 745 bp, Homo sapiens
aacttatggctgtttcatagttgaatgattccatatagtactttaattccattactttggtctccattacataaatagtttaacttggagggtgcatcaggaagcaacactgcttaaagctaggcattctaatggaagctttattgacttttctctctctttttttcaaatgtgccatagtgggcttttggttacaccttccttaaacatttaacagagtaaaattattgagtctgtgctatatggagcagaaatctgggccctcaattgaccatttgtctgtgattaagagcaaattcagtttcttcctgaggagaaccttagccaggtcttaactacccctcggctcatcatggtgtggcagtatgatggctcttctggttaggctttttagcatgcagaaatatttctcctaaccctggtggatcctctagcagtttatacttgaatttgtactctcaatcatccaaacagaatggctatactccagatatttaccagaggtgttacacactttcacatttattctgctaactgtgatgtttagtcttactgcttccatcctttttttttataatctttctgtgacagatttatttcctatgggaaccaagtctgtgagttcacacccacataccagattttgcttcgtgattgtcagaggctagaactcatccatcttgtttaatatgtattttttgttgactgctctttattatagtgatttatttttctcttttctaac

SEQ ID NO: 110601 - DNA, 429 bp, Homo sapiens
  misc_feature (19)..(19): n is a, c, g, or t
  misc_feature (22)..(22): n is a, c, g, or t
  misc_feature (24)..(24): n is a, c, g, or t
cgcgggtgctctagagganctnanactgggtcgagttcatgatctcccaacatagggcaatattcagccagaaaagaggagaccagagcaaacagctcctcctttaacagctcatgtccaacaacagaagggtccagggccatcaaataagaatggtgactctgtggagggacacatgggaggaagcacaagaggaggatatggagggtgaaaatagatgtacgtggactgtgcagagaacagctttagaatgaggaaattgtcaggatctttttaatttctctaaagtatctaactaaaaaaaatattttaggccaggtgtggtggctcacacccgtaatcccagcactttgggaggctgaggtgggtggatcacttgaggccaggagttcgagaccagcctggccaacgtggtgaaacccggtctct

SEQ ID NO: 110602 - DNA, 332 bp, Homo sapiens
tgggaaggaaaaaaaattctcaatgacgtgtgggattgatttcttcctcttataatgaattctgaatctgacagatcttgttttttgtttgtttgttttgttttgttttgttttcttgagatggagtctcgctctgtcgcccaggctggagtgcagtggcgcaacctcggctcgttggaagctccgcctcccaggttcaagcaattctccacctcagcctccctactggctgggttacaggcacatgccaccatgcctggcgcggtggcaggcgctgggagtcccagctactcgagaggctgaggcaggagaatggcgtgaacctgggaggt

SEQ ID NO: 110603 - DNA, 579 bp, Homo sapiens
tctgctgccaagtcttactaacgcaacttggaaaattgcaccacagcttttaatgaggattctgaggtaacagccatttcatcagagaagactgttctttccttttaggggaataataacacctactgtttctatagcaccatccttccaagaagtttaacacatcacatttcatttatctgaacagcggccctgcaagtcaaactggtaactagcattgttactccttgtacactcatattgaaattgaggtcattaaatgtgaactaattttctcaaaatcttaacaccttctgacatggttaaagagccatgatccgcctatgttctaggtgatcagatagcccagaagtctctttccgctctttagctgtcatctcctgtgaatgcctgtaaggaaggccctttctgaaaagtcagggaaaagtcataaaagtgggagaactgagcttgtgcctcttctggagtcctgtggttctctcccttcctggccagtttgcctcccatctttatggcttttccctacctctcaatccaaacatccctccactcttcctgaccaacaggattttttctctc

SEQ ID NO: 110604 - DNA, 372 bp, Homo sapiens
gggctcaagcaattctccagcttcagcctcctgagtagctgggactacaggtgcatgccaccacagccaattaatttttgtatttttagaagagacggggtttcaccatgttggccaggcttgtctcaaattcctgggctcaggtgatctgcccaccttggcctcccaaggtgctgggattaaaagtgtgagccaccacacccagcagggggattctgttgaagaggcagtgatatgtcagccaaggtcgctatatgcctcacctgtgccaggttgtaggtgtagcacagttacaggacactgttggaagtatgtcatgtgggccaaggtcgctgtgtgcctcacctgtgccaggttgcaggtgtagcacag

SEQ ID NO: 110605 - DNA, 591 bp, Homo sapiens
agacttctctcaactcaacaaaaacccacctcccattgccatgtattgctgtgctctccgctcctgcagcgtccccaccggccctgccaccaccttctgctcatttgataaaagctgccgctgtggagtctgcctacccagcacctgcccacatgagatcagcctccttcagcccatctgctgtgacacctgccccccaccctgctgcaagcctgatacctatgtgccaacttgctggctgctcaacaactgtcacccgactcccggactgagtgggatcaacctgaccacctatgttcagcctggctgtgagagtccctgtgagccccgctgttaaccagccgagtctgcacaggttccgtgaggtggctgcccaatgtcctctgcaccatctgggcttcagcactcactactgcctacatcaaggctaaggccatcccaatccccggggccaagtcttgatgaatcttcttaattatttgcacatttgggtaccattggagacctcccttctgtcttttaggctatttcatcactctttgagaaataaccattttgaccatttgttaataaactttattctggcttagc

SEQ ID NO: 110606 - DNA, 657 bp, Homo sapiens
cgcaggtgggaccatctagttgcaggaaaacaagctcagggctcccattgattctacattatggggtccccaagccccgggttgcagagcgatacctgtccctggcctgttaggaactggatcacatggcaggagcgtccccaccggccctgccaccaccttctgctcatttgataaaagctgccgctgtggagtctgcctacccagcacctgcccacatgagatcagcctccttcagcccatctgctgtgacacctgccccccaccctgctgcaagcctgatacctatgtgccaacttgctggctgctcaacaactgtcacccgactcccggactgagtgggatcaacctgaccacctatgttcagcctggctgtgagagtccctgtgagccccgctgttaaccagccgagtctgcacaggttccgtgaggtggctgcccaatgtcctctgcaccatctgggcttcagcactcactactgcctacatcaaggctaaggccatcccaatccccggggccaagtcttgatgaatcttcttaattatttgcacatttgggtaccattggagacctcccttctgtcttttaggctatttcatcactctttgagaaataaccattttgaccatttgttaataaactttattctggcttagc

SEQ ID NO: 110607 - DNA, 232 bp, Homo sapiens
ttttgcatagactagcaccaagggttacagaaccaacacatccctattagttatgtgttctgataaacatttttttcatgtatcttggagtgtatattttataaatattatatggcattgattatttatgtgaaactaaagctaggataacagattgtacattaaaacagaaacttgaggattttcattgaccattggttttgaaataataaaaggaaacttgatcatttcc

SEQ ID NO: 110608 - DNA, 344 bp, Homo sapiens
cactgtgttgtgacagtctgtgtctaaggattgattcttgtaacattgagatgttaagggcaagtccatatctaattccatgcccctagcacaacagaacctttatccctgggcccccaggaaaggcctagtggactgattgtgggagacagaagtccatccaggtttctggctggcagatccctgagtggatacaggtggtggggcctggggctgccagtaggagaaacaaagcttgaggatccagatcagagctgaggatggatcctccaaggtcagtccccgagtctgggccaaagccacttgttacatctcccatcttctggcctcattttacctcctca

SEQ ID NO: 110609 - DNA, 2013 bp, Homo sapiens
  misc_feature (918)..(918): n is a, c, g, or t
  misc_feature (987)..(987): n is a, c, g, or t
  misc_feature (995)..(995): n is a, c, g, or t
  misc_feature (1002)..(1002): n is a, c, g, or t
  misc_feature (1235)..(1235): n is a, c, g, or t
  misc_feature (1263)..(1263): n is a, c, g, or t
ctgcacagctgagtcatgagctcggcacagcatgtgtgggagtgaggtgtgcccatcagctctgccagtggcacgtgccccttagggacattcaggaagacgcttcaccgagcatttggcatgagtgtggagaggacctgtgcacagaacagcttcaggaagacaaaatgccacctctaggaaacatcttggttttaatcttttgtggggagtggtggccccacagttttgtagaagcttgagggagtggagggaatctagcaaaatggaaatggaataaacccatgatcagactcaagtcaacccagagggatgcagagcaaaggaaataagaaccaagctgcagcgtctccccagaaagccctggcagccctgctggtgggtagggggtgggtctggtcatcggcacaggtgacctggctattttatcagccagggaacagtaaataacagcagccagtgtctacgtaaccctgacagctgatcaggcatcttcacaggtcttttcctcttttcttaactttccttagggtcatgtgaggtaggaaggagagagctgagttctctttctgtagaatatcctcatggtcgagcggctctgaccaggaagcagcgcctggtctgtgaaatggctgcatctggaatataggtgccgcctcctctcctagaaagaccgcaaaggagctttccatcatgtccatttgatgatgaaaagaaaccaggggagaggaaccagtgtggctaaataaatgccacagaactctccttgggcatcccacgcagcatggcacatttattccctaggggccctgggcagtgaagggttagggtccagttttatctacaaggagattgaggctaagcctaggcaggtgacccctgcgggtcttaaccagccaagtgcctccatggggtctnctgtgcctcctggctgtggcagggagtccttgaaccagcagcccattgtggttaggaacagaggccgtnctggagtncaaatgncctaccaaagaggtgcctcgtcccacggtggccctggaggactgctctcggaggaacatccaaaactgagccggacctgcactcagagtggacgtggcagtgctgaggcacaccgacacccacagccccatgctcacgcgtggcctggtgaaaacctaggaagtccatgctcttgcgacgtgttcagtgcttcttcgccctggaaagttccaatgttgaaatgtggctgcacncagtgctgcctgtggatggaattatganctgtgaaggccagcttcattctccctacatggtcgcatctttcagtgcacttgggggtgtgctgggccccgaccacccctgccgaagtgagccatccccgcctggactctgacacctctgttgtccctactccttaagaggcccaaggcctcatatcactcgttatccttcccatcaatgtcttttctccctggttgattacacattcggtgagaatgcaattttgcttacgatttccttggatcctcccatatagctaatatgtcatttaattcataggaatccaataaacacatatttattattaaagactccactgactctgtcatttcagatggttcaagatgcctttccctctccagattttttaggaaaaaccgaaacaaagaaaatgcatggaaaagatttatgtgtttggttgggggaggggaaattaaacttctcataatagtttttaaattaaattttgtgctcgtccaaatcctttccttctccaccccttcctctgatattcccttactcattaaagcccaggattttgatggtattcacagggaagctgatttactggaataaagaagttctttaagttttaaattttggaacgttcccagtgtgtctgaacctgggtttcagattttactggcattttgttggcaaagcagtctttggagcccttccttatttgagcgtgtttcctgacacctttggcggtatggtactgtgttttttagatttaaaaaaaaaaaa

SEQ ID NO: 110610 - DNA, 255 bp, Homo sapiens
tacaaacacatcttaagggagaccaggtcagttcaaagacctgccttgtgtttggaactgtcacagtgggtgggttgaataaaactccagggtaaagctatttagttgatccattgttttttctggaaagcagctttctccaaacttaggtttggagattgtctgctaatccccaaagcctggccctggctgttgaccttaagtgaaagagaaattggttagcaggagggttggcctaggtgacagacctgttaa

SEQ ID NO: 110611 - DNA, 1245 bp, Homo sapiens
gtgatcctagcctttaggaggccaaggcgggaggattgcttgagcccaggagtttaagaccagcctgggcaacagtgagatcccatctttacaaaaaattgaaaaatcatccaggcatacaccaccgcgcccagctaattttttatttttagtagagacagggtttcaccatggtggccaggctggtcttgaactcctggcctcaggtgatccacccgccttggcctcccaaagtgctgggattacaggcgtgagccactgcgcctggcctctctttacttttaaactcatttctagtttccaaatagtctccctaagtcctatctgcctaaatcttcctctgcaagtgtgatccctcagagcttgactgcagagcagtgcctcttaaccatccaactagaacagctctgagcaaaaacatttgtaggcatcattaatcttccctgcagtgtgcacacagaaagtcagatgcaccaaccatggaagaggatagtcaacacaaaagaccactggaaggtccacagcgtccgtcacaccacaccacagacatgcgccggcacacggccgcgcccaacccaccaagaacatcagcaccgatcacgcagtacagacacaccacacacgcacaccacgacgcaacatgggcgcctgccacaacgaacttcgacgataggcacccacaaaagagagccacatcacactcaaacatggccagaactcgagtacacaaaccacgacctggggtacggccacacctcacggaacgacacaagccggagcatgcacgcgagcgccacttgacgctgtaactcccccaccaaccataataacaccaaccaagacgagatcaagagatgactattacgcccacaacgaagatctataagaacccaaactaacaatacacaaatcacccagaccaaagacaactacgctgcaacatgactaacatcaaatcacacccacgaacacaacacccccacacatccacaagtacaacaatatattctaacacaatataaaaatctacaatcaatataataatcatatccaataacatgtctagacaaaaaaactacacaactaatataaccaacacaacacactccgaaaactgcacaaaccaaaaacatcccacacatatcaccaatcaataaactcaacaacatctgactcactcaaaagacgagcacataataccccaagctactcactaaacgacgagaacctcaccagaataacata

SEQ ID NO: 110612 - DNA, 441 bp, Homo sapiens
ggatggttcctgcagacccagtaacaggccgggtgctgcagatggccagaagagccctcagtcctgactacagccccatctgactgcctcacccttcaccatagtctgctcccagctacccagggattctcagagccctcctctggagaccagttccacattctggccacggggtgacaggaaaagggggttgtatgctgcagtgactctgcatctagggtcacttccagaaacaggcctggtcttgaggtcaggctccatcaaggctacccttttgcagctcagcaggccacgtccagcttctctggctccgaaacctgggctccaatcccagtccacaatttccagtggcctgaggccctcaggcccacccttctagagagagcccgaagccccaaagttgcccttcccttaaccagctacagcccaggtccgggaccc

SEQ ID NO: 110613 - DNA, 316 bp, Homo sapiens
attttataacatgctgctcgtcttcaaatgtttgctattgtaaataacagtgatatacatacacatacatatatgtccccccacccccagacagggtctcactctgtcagccaggctggagtgtggtggctcagtcatggctcattacagccttgacctcccagggtcaagtgatcctcccacctcaccctcccaggtagctgggactgtaggcacatgccaccatgccctgctcatttttgtagagatggggtctcactgtgttgcccaggctgatctcgaactcctgagctcaagcgatccacctgcctcagct

SEQ ID NO: 110614 - DNA, 475 bp, Homo sapiens
catcagtaagatcaccagggctatctgagttcccgttttccactcctcactctacgtggtctccatgcagtctctgactatggaccagccaccatttcctgagcatctcctcctgtggctctgggcaccttctcctgtggctgcactctttctgcttctgtgacttccagtgcccttcctccactcctactccttcagcattgaagttgctttatggcctggtgtgagaactgagttaccaggggccatctctccatgtccagtagctacctggatcatcaagaaggtgattactccccaaatcttcagttcccctttctcctgaggttacggtctagctatatcatattgtaccatgcccaaaataaagctgaaatcctttccatctattaatggaatcattctccagtttcccaaaataaaaaccttggtgtcttcttcatataaggtcatcaggaaaccttgatgcatttat

SEQ ID NO: 110615 - DNA, 360 bp, Homo sapiens
atgtagttcaatttttcttctaaaccctgtaactgcaatgtattttcactgatatttttaaagagttttcaaaggtacatttttttattgtggtaaaatatatattaaaaattgaccattttaaccatttttaagtgtacagttcagtggcattatgtatactcacactgttatgcaagtatcaaaaccacctccatctctagaacattttaacttttccatattcaaactgtgtaaccattacataataatcccatttccccttcctcctagcccctggtaacctctattctactttctgtctctaggaatttgactatactaggtacttactcggcacaatgcattaaagttttatcc

SEQ ID NO: 110616 - DNA, 729 bp, Homo sapiens
accatgttggccagggtgatctcgatctcttgacctcatgatccgcccacctcagcctcccaaagtgctgggattacaggcatgagccaacatgcccagcctcatcctctcctttttaatggtatatgttcttatgtcagaagtgtgttttatctaaggtcacagattattatcctcttgaggttttcctctgtctctctctttcctgtagatttctttcttcagttgatgtttgcttcttctagtttctcttcttcattatggagagtttccttaagaggctgttcattcttagttaaaagcaagacatatacaggtgcatatgcacacacacacaaaacaaagcaacaatgacaatgatggcaagaaacaatgtcagaagttctgtgatcatggatagggctcgtcaactgtagggttgcactgttgcatcataggttgttcaatcaaagccggtgtgttctttgaaatgtttccccaaggtcatgattagggggtaccccactttctgcctgcgagatttgcgcctggggcatataactgactgctaatgtctggggagcatgacaaataaaaaagttgggtttcttattgcaaactctataggctttcaaataagcacctatttcgcaacctgcagcctctcctagtttgctacagtgcctagtatcatcagtttcaaatctctctagccgatttcctccaaaaaagaaagactccgcttccagt

SEQ ID NO: 110617 - DNA, 174 bp, Homo sapiens
tccgttttgaattccagaaccacaggctgtacaactgccaattgcatctcaggtcctgaatgtccctctggtgcctcacagtgcataaatccacaacctgtcatcttctcctgcaaactgctccatcctctgtattcattatcatctccaatggcagccttatggattcaattc

SEQ ID NO: 110618 - DNA, 324 bp, Homo sapiens
ttgattattttatgtgaaagttagcttagtagaaaagttatactctgatcaattgaattctatgtatgccagacattgtttaaaacagaaattcatgagactgagaggtaggaggtgcaggctttggagtaggtttcctgtgttcaaatctcagttctactatattttagctgtgagacattagactagttattaactcttttaagcttgagtttccatatttgtaaagaggaataacagtagctacttctgatatcctgtgaggatttaatgagataatgcctgtgtgggtttaacatagtcagcatatggaaccatgtggaa

SEQ ID NO: 110619 - DNA, 452 bp, Homo sapiens
aagggtaagaaactctgctcgagtttattcattttaaccattttgtggtatttccgtacaaacattcccccttaaaaatgtgagaatgccatggcacgtgtatacctacgtaacaaacctacgcgttatgcacatgtaccccagaacttaaagtatgataataaaaaaaaatttgagaatgatcacttgttgaagagatcaggtaaagctttactgaaaagattaatatgctatgaaagaaaattttaattgaaaaagaagattaaaagatccattctccaaaaattattaaaattatcacaacactaaaatgtctacactcatttttataaaacaatgattagttttataataacttttgtaatacggttccattaaaatattataccgtgaaatggccaggcgcagtggctcatgcctgtaatcccagcactttgggaggccgaagcgga

SEQ ID NO: 110620 - DNA, 297 bp, Homo sapiens
ctttatctccagtaccattttgcttagtattcatggtgctcaagttgtcactgtggacatcagagcctataaatatatattgttgtggctccttcctgtacatctttccaagtcatacctgctattctccaaagtctgtgaatcccgacactaataacttggaaattgtttaaggtcctcttcagaaggtcagttagctcaaggcatcacatttttctcaggactcttaagaaatactccaaccacagaaaaaggcccttctttctggtatcaggagccattggccacaaacacaaa

SEQ ID NO: 110621 - DNA, 273 bp, Homo sapiens
atcccttccttttgagatttgactattaaatatatctctgtttagactctttctagggcagacttttatctccccttttacattaatactttatttgttgtaccccagaacttaaaaattaaaaaaaactttatttgtaaaattgttgaaacctgtttattcactgagaagactttactataaaattattcttaatctatatgaattcagttctattgtgttaccttcaaattgtatggatttcaaatggtggtaaaagttgtagacatattt

SEQ ID NO: 110622 - DNA, 547 bp, Homo sapiens
tgcggtcgcttacgcctgtaatctcagcactttgggaggccaagacgggtggatcacctgaggtcaggagttcgagaccagcctgaccaacaaggtgaaacccgttctccactaaaaatacaaaaactagctgggcatggtggcaggtgcctgtagtcccagctacttgggaggctgagacaggaggattacttgaaactgggaggcggaggttgcagtgagccaagattacgccactgcactccagcctgggtgatggagtgagactccatctcaaaaaaaaaaaaattaaaaaaagaacaagcaaagatataaaagcaaatgcaaacaaaatgctggggcaaaaatcttaatataaaatgatgcaaaatcacaacaaacctcactaaattagccaaagaagggcaatttattatgctaacggtataattcataatgcatcaaataatactgtagcaattttcagaatagaaaaattacagatactaggataaatatatcaaaacactaataagagattttaatttaccactttcagttcaagaaa

SEQ ID NO: 110623 - DNA, 329 bp, Homo sapiens
tggtctttattttaaccataattaaggggaacgtagaaaaatgattgcgtttatattggaacagaaatgatttcaaatttgaatgtagagtgttttaaaaaggaaaaagggattggtattagataagaggagaaagtatggctgtcttctcaccttaattatgtgaagagctagttaatggacagttgtaactcagtaaactgtcaagtgggagggcttaagttcatttgtctgatcttaatgaagtactttctttttgtaagatcattacacaatgatgtatacaaccagattagcatcttaaatagcttttcttaagagtggaagag

SEQ ID NO: 110624 - DNA, 770 bp, Homo sapiens
agagacataggtcaaaagtaaaggttttaagaaatataaatcttgttaacactaatttttaaaattgcatagaactttattagttgtgaacaaagaagatagcagagcaagaaaaattataagggaaaagaggtgcattacataacgataaagggatcaattctcaaaaaagacaacaatcttaaacatttattcacctaacaacagagcaaaaacacctaaaaatgatgcaaaagctgatggaactaaagggagaaatatacaaattcactattgcagttggagacttcaaacttcttttttagtaattcatagctcagcaggtagaaaatcagtgaatacagttgacttgaggaacactatcaatcaatatgatataattgacatttatataataaaatactacctacaaacagcataacatatgttcttcccaagcttctatagaacatacagcaagataggtcacattctgggccataaaacacacaggaacaaatgtagaacaataaaaattataggaaatatattatcaggtcacagtggaattaaactagaaatcgggaacagaaaagtagctagacaatcccaaatatttggagattgtcttaactggtttagtgtagctataaaagaatacatgaagctggataatttatgaagaaaagaggtttatttggctcacagttctataggctatacgagatgcatcatgccaccattttcctggagcccttcaggaagcttccactcatggcagaaggtgaagg

SEQ ID NO: 110625 - DNA, 376 bp, Homo sapiens
gagcttccttttaccctaggactgtttctaactgtatgacgggctgctagattccacagtgcctgatggttctcatgagctgtttggctcgtgaatggcagttcaaaggtaaacaaacaccttgtttggaaggctgctgctctggctaacgaagggtcaaaaaaatttatttttcctttatttccagtttagaacatttgggtgaagtatatttttgtaagcaaaattacatttctgagttctccaaaattcagattgtgattttatgacagtatagttgtttgcataagtttagtaagagtcttttagaacaaaacagttggagacactggttattttaccaagactttcactagaatagcatatttttaggtaa

SEQ ID NO: 110626 - DNA, 307 bp, Homo sapiens
cctgaggacccagtggaattgggggtggcgggctgagaaggcatggtcaggtgggcactcagcccaggctgctagcaggctcctagccttggaggacttcccatggggtcctgcctacagttgccctcatgagaacattctttgggtgtgagtcccaggccttttcttaagcccagtgttctcattctttccctggcacctgacaaagtgggttatctcacaatcctctccccgagttaagtgataattttaataactgcaggattttatgttggtaattggtccctgagaacagagatgttaattg

SEQ ID NO: 110627 - DNA, 268 bp, Homo sapiens
atgctatgcacatttaagtttgagaaatgctgagtcagaacaatacaagcactgtgtttttgaccccagatcactatccaacagaaccttctgcaatgatggagaccatctatttttttttgctgcctagtatgaagctactagctgttgagcaacttgataggtagctagtgaagctgaggaactggattcttatttctaaatctaaatttaaatagccacatggacctaatggctactatattggacaatgaaagagaagaaagag

SEQ ID NO: 110628 - DNA, 520 bp, Homo sapiens
tttgtatgccccctcactcctcatcattttatgcataaacatctctaaaaagatatgatcatctctaaaaagtaagacttctttataaaatgtaataacaacatcattatcacatctaaaaatgtaataatcctttaaaattatcaaatatccagttagttcaattttctctgtcacataatttttttaacaatttttttgttcaaactaggatccaaattgaaattggccaattggccaatatgtcttttaagtctcttttgaggctggctcatgcttgtaatccaagcactttgggaggctgaggcaggaggattacttgaggctagggaattcaagacgagcctgggcaacagagtgaaactccgtctctacaaaaaaaatttaaaaaactagccgggcatggtggcacatgcctgtagtcccagctactctggaggctgaggtgcgaggatggcttgagcctaggagttcgaagttgcagtgagctatgactggaccattgcactccattctgggt

SEQ ID NO: 110629 - DNA, 380 bp, Homo sapiens
ccttgaacttctgggctcaagtgatcctcctgcctcagtctcctgaggagctgggactacaggcatacgccaccatgcctggctaactttttctattttttgtagaggtagggtctcactatgttgatcaggctggtcttgaactcctgagttcaaatgatcctcccatctcagactcccaaaatgtgttggaattactggcacgagccaccatgcctggcctcttgcatattactaacaattctaaagacagtattaagcaatttgccgtcataattagctaagtaagttccaaaagagctactacaatggaattaccttactcaggaagttcacttctaaaacgatggcgtaactcaaataactaattgtattctgcc

SEQ ID NO: 110630 - DNA, 489 bp, Homo sapiens
tccagtagtgacaaatttaaaattgattgaactgatcattggatatactcgcagtgatagaatcttctccctgttctctttcgccattttaaaatactttttagtctgtcgtcttgatataacctttatgcaagtacttagaagaaagtggagatgcttaataatcatgtaaattaggcagaaaagatacatctttgataggagaaataactactagcaaaacatcttaataacaagtgaccagagatgtggcacatattttatgccaatggaattaatagtgaaacatgcagcaaccagctaattttttaaaaaatgagatgatcatagttaattctgtttcataagacacactaaggaaaaagatgttgtataggtggtttatgcaataaccatgcggttctttttgcaacatttttatatttgggaagaatagggcaaaatgtcaaatactcaatttcacagtagtctaaatggcatgcttcacag

SEQ ID NO: 110631 - DNA, 700 bp, Homo sapiens
caatctcttctgggctgtgtgcgagggcaggtggctctgctgtgtctagcggctctgtgtgtacgaggcatgcccaccaccatcggaatggaacatctgcgtggttccctctccccttctcctcctctcccaaccacacacaactcagtacacattctatgtggcagctggggttcaattcaagaagctgctggtctggagccaatttggtcctataacaaatgatatgggaaacatctggagatgtagcaggagagaaataagccctgcccctcacggcaggagcacacacatcacatgtggttgtcacacaaaaatactggcttcaggggtctccactggtcatcagaagaggcattagttccattcagcctctccttgcctcccatgtgactgcttgaggtgatcaaggccactctctaccctgctgctggtgacatctcactaaggcacaggccctgcttacagcctgcagcggttcccatcagccctgactaaatgccaagtggtctggctagcttgaaggtccaccacactgggacccctgtgtggcaggccctcccatcttctccccactggagagagtgtatcctccagccacgctgagctccctgggctagacactctctggactccagacacactgagctcttactgtccccagaatgcaccaggctgtcctgcccaacccccatgactc

SEQ ID NO: 110632 - DNA, 225 bp, Homo sapiens
gttgcactggagaatctaaactcttttggagatgtcccaaggcctaacctgcacctcttcacagcataggcaagaaaattctgtctgacctttctgccgggaggagggaatgtttaggtaaaaatgagaaacctatgaaatcagccaccaacatggctgtgtcactttggtgctcccacaacaacttgaagcatttttcatattaaacttaatagctgacctgtc

SEQ ID NO: 110633 - DNA, 406 bp, Homo sapiens
ggtcacagggacacggcagggagggcctggctcctctctcttcccacagtgcctcactggtggtgagcctgggattggattgtttggattcttctggagagtctcagctccaaatactctaacccttcaaatcagccgttttcaaacttctatatgcatgagaatcacttgagacactgattcaaaatgctgatttccaggtgttcctcattcataagcacaaagagtggcctacacatccccaggggatgcggctgtgggtggtcaccacactcaacatgccaccacaaaccatccaagagttagaaattccagtgtgctggcatcccagctggctctcccagattgcacttggtacccggaagcaacacagattcccgtgagatcaaacattggaaccctgtgg

SEQ ID NO: 110634 - DNA, 263 bp, Homo sapiens
gggtcatcagttgaggcaagatccacggtagatatgggtgtatattgcaaaacactagaaccagagtattatcaatggaaaggtctagacagtgaggcccactcatttgcctaattagaaacagttagaaactcctgcttaattagaaattcttgccctcagttttttcttgctgttgtttggttttttttaattattatttttgttttttgagacagagtcttactctgtcgcccaggctggagtgcagtggtgcaatgtca

SEQ ID NO: 110635 - DNA, 388 bp, Homo sapiens
ggaaattcccgggtcgactacaaccaataaattcgcgcccgcgtcgacgcacaaccagctgcatgttgtctcttgtcatgaaacttagcagctaccccatctcgagcaggcaaataacaccttaatacaaactgtcataggccaaggcaggtggatcacttgaggtcaggagtccgagaccagcctggtcaacatggtgaaaacctgtctctactaaaagtataaaaataagctgggcttggtggcacgtgcctgtaattccagctacttgggagactgaggcaggagaatcgcttgaatccagggggtggatattgcagtgagccaagatcatgccactgcactccagcctgggcgacaggatgagaccacgtatcaaaaagaaaaa

SEQ ID NO: 110636 - DNA, 455 bp, Homo sapiens
cagaccaggagtcctctgattcctactgctgtcttctgcagcctaccctccttccacaattacttatcaagggcctatgatgtgtcaggtgttcaccacacagtagtgaacctcagcacaaccagctgcatgttgtctcttgtcatgaaacttagcagctaccccatctcgagcaggcaaataacaccttaatacaaactgtcataggccaaggcaggtggatcacttgaggtcaggagtccgagaccagcctggtcaacatggtgaaaacctgtctctactaaaagtataaaaataagctgggcttggtggcacgtgcctgtaattccagctacttgggagactgaggcaggagaatcgcttgaatccagggggtggatattgcagtgagccaagatcatgccactgcactccagcctgggcgacaggatgagaccacgtatcaaaaagaaaaa

SEQ ID NO: 110637 - DNA, 1388 bp, Homo sapiens
cacaaaacttaagacttacctaggaaacccattcatattcccaccatgatgtaattataaccctacaattacttcaggtagctacacaatataccaggtaagaatcaatgcacagtataaagaacttatgttcttttctattctttcagttgaataagggccagttggtatgcagcccatgtatatgtgaatggagtaagataaaccccatgatctccttgcacagaattgcaaatgtcttttgccataccaagggccagactcagaacccttggagtcatgtggcagaatttccctcttacataaaccaatgcttgaaaatgctgcaaatgaccctctaatgatccctgaagatcaaaacaggggtaaatgactccctgcaaaacccaacccatgctgctggctgtgggatttttggtgtaagcctatctatgcactctatcagccagaatttggcatttagctcttagttaaatctagtaaaggacagtctattgtttaaagagaaggtgcatttgttcctcaatcaagcaagagcacctgtgttgtactgctttatatctcatgtatatttatagtaatgaaaagactttttaaattgtacacgtttcagtgcctttcttgtgttatgaaaggcaggtagatattatagccataggtaaaaatccatagttaaattgcacactgaccttaaatctctctgtgtatgcccttgtatcttgcatgttaaaagttggattattgggcatgtgtggcagcctgccctgctacatgctagacaagtgtgctttagtacatagccacaagttcttcattctttaaaatgttttgacagatcatctcataataaaaataattcaggaaaactatggggaaatagttacatttcacaaaagatattttaaactctttgtaaaacttagataatagagcctagcagttactttgtatctaattgatacattttatgttaatttaccaccatacattttattaatcaaaattgtatagcatgtgactcttttggctttcagagttctcaaaaatattattttgttgcatgtactgtatgtttagaggcaaccaattatatactcaatatggttttactgtgccttacacaaagagaaactctatacagaatgtatgtcatggggtggggtaacagagtctttactgcactgttaggtgatggcacacagagcatgtcccagaacatttctgtgcttaattacccaaccaaagagatctgaagtatgtatgtcgtactgtaatgggggtttatgcctggacaattaagtgttttatttgttttctgaaatgatgtgaacttatttttctaaacactatgctaaataaactttatatttatacataccttgcattga

SEQ ID NO: 110638 - DNA, 828 bp, Homo sapiens
aggtcccggctgagagcgccggctgccggctggggacctggtgagtgtgaagctgtaaccttctgctggggccggggccgaagtttttccgccagagcaaggaaggctgcccctggcagcaactgcactccttccttactcctgttgagattcattttatagtaggaaataggcatctaactaccatacaagttcagaccaatggaagaaaagagcagcaaaaattgaactgaatgaatcccaaaagcaagaaattaaagacgcctttaatttatttgatattgatgggtctggaaccatcgatgtaaaagaaggaaatgcttgatgaagctgatcatgatggagatggagaaataaacgaggaagatgttttgagagtgatgaaaaagactactcgttattaatagcgttgttttagtccttgtggaaaattaacaaatttgtatttgttatgcagttttataatttaatatctgaatgtattcattttcagtttttagtttatatgtacacattggcttcttgatgtctaatccatgtaagaagttacacatctctaccaatatgatgttaaatctacagcatcaagaaacaaaacataatgacttctttgagccattaatccaagaacagtattgattctagctgctcttttgagaaccttaggtcacaaagacttagaattttaaagtttgatgaagttggcttcacatccaaatgaatttggcaaacaaaacttatattttccttttgtgcaacccaaaaaaacctgatgaacatttgctttttagtcagttactcaaatacataaagtattaaatagaactg

SEQ ID NO: 110639 - DNA, 696 bp, Homo sapiens
aggtcccggctgagagcgccggctgccggctggggacctggcatctaactaccatacaagttcagaccaatggaagaaaagagcagcaaaaattgaactgaatgaatcccaaaagcaagaaattaaagacgcctttaatttatttgatattgatgggtctggaaccatcgatgtaaaagaaggaaatgcttgatgaagctgatcatgatggagatggagaaataaacgaggaagatgttttgagagtgatgaaaaagactactcgttattaatagcgttgttttagtccttgtggaaaattaacaaatttgtatttgttatgcagttttataatttaatatctgaatgtattcattttcagtttttagtttatatgtacacattggcttcttgatgtctaatccatgtaagaagttacacatctctaccaatatgatgttaaatctacagcatcaagaaacaaaacataatgacttctttgagccattaatccaagaacagtattgattctagctgctcttttgagaaccttaggtcacaaagacttagaattttaaagtttgatgaagttggcttcacatccaaatgaatttggcaaacaaaacttatattttccttttgtgcaacccaaaaaaacctgatgaacatttgctttttagtcagttactcaaatacataaagtattaaatagaactg

SEQ ID NO: 110640 - DNA, 567 bp, Homo sapiens
ctgcactccttccttactcctgttgagattcattttatagtaggaaataggtactttaatatagtttatcatcaattattctggttctgctaactattccagttatataatttatctttcacccatatgtgtgtgtattacaggcatctaactaccatacaagttcagaccaatggaagaaaagagcagcaaaaattgaactgaatgaatcccaaaagcaagaaattaaagacgcctttaatttatttgatattgatgggtctggaaccatcgatgtaaaagaaggttctgaaattatttctaattctaaatcattttaaaaaccatattatttgtggcaatctttaaggctttctttaaaagtagtcttctgaaagcttaatataaagtctcttcagtgcatatgcctgccctgcattagcaaaacgatatcttgttaagcattttaattgtgttttataaatgagtaggcaaaagcccagggtgtaacagtgatgtacatgatggcacagtaggactgaaacacaggcctgctgacctaattttctgtttatgctcagtccataa

SEQ ID NO: 110641 - DNA, 315 bp, Homo sapiens
caagcgattctcctgcctcagcctcctgagtagctgggactacaggcacgtgccaccatgcctggctaatttttgtattgttagtagagacggggtttcaccatgttggccgggatggtttcgatcccttgacctcatgatgttcccacctcggcctcccaaagtgctaggattacaggcatataggccaccgcgcttggctgaggaaaaaaatcttaaaactaacttatttcaaatctaacttcaacgtgtatctttttttttcttttgagacagagtctcactctgttgcccaggctggagtgcagtggcgcg

SEQ ID NO: 110642 - DNA, 572 bp, Homo sapiens
ggcaaagatttcatgtaagtgggaaaaaatgaggtatttgaagaaaaatgttcatctaggatttcaatccattaaaaagcacacaatcatggacacctacctacaagaggataagtgactgtctttcaatactgacatgttgtcttctgagacaggagctaatagaaatatatagcgcatgacatcctctttaacatgagctatgttgacacatatgaagttactgggtttattacttccaagagaggcagtgccattttcaaacaaaggatacattttaagcagagtgaattctggttggttctttatacagtgggttgatcttgtcacacaggcaaaaatggagcagttttgggcagatggttctagtgttacgcttgcttgttgccttactttgcaagaagaagttctctcatctttggtcaacgccctatgtctggcatgtcatgttaggcctcagcttttgaaattgatagggtctaattctggagctgatataagctgttaatacctacctcttagattgctatgagtactaaatggattaattcttgtaaaatgcttagaatctt

SEQ ID NO: 110643 - DNA, 325 bp, Homo sapiens
gtagctgggattacaggcatgtgccaccatgcctgactagtttttgtatttttagtagagacagggtttcatcatgttggccaggctggtcttgacctcctgacctcaggtgattcgcctgcctcaacctcccaaaatgctgggattacaggcatgaaccaccgctcctggctggccatttttaaataatgatctaattactgatccagaaacagccagtttagtaacatgcgtaattaacctgggacaatttcagcaggctttacaaaagtttagaactcaaagactccccacaccaggaactaaccagcaacccaaaatcagg

SEQ ID NO: 110644 - DNA, 192 bp, Homo sapiens
ggaaagacacccagaaagcgttgatttgctactttatgcacctctctttgaatttttacaatgatgttttactttttttattaatgagattcctaaggattttaaaaaataaatctattctacccatccttgccttcccgtcaaaaagaaactactggctgggcgtggtggctcatgcctgtaatcccagca

SEQ ID NO: 110645 - DNA, 230 bp, Homo sapiens
gcaggcggtttatcatgagacttcgcctctgtgatcataagaaccaattccccattgtgtggtttttgttttgttttgtttttttgatatggagtttcgctcttattgccctggctggagtgcaatgacacaatctaagctcactgcaacatctacctcctgggttcaagcgattctcctgcctcagtctcccgagtagctgggattacaggcatgtgccaccatgcctg

SEQ ID NO: 110646 - DNA, 240 bp, Homo sapiens
tcagagagataattgggccaggtctagtgggaacttgtatgccatcttaaggaattttccttttactttaaatgaaatgggccataatggacaaaattttaaagataggctcttaccctgtacttggcaagactgctctctccaccctaatctctacctagttcctgtctcaacaaggggccaatgtggcaggagcagagtgcatgagagagtgagtaggatataaggtcagagagataa

SEQ ID NO: 110647 - DNA, 400 bp, Homo sapiens
tcttaaggagggacataaatgtgagcacaaaaaaagatgcaggaaagtccttggaaagggaaacaggctcaaacgaagggctggggagaagtccaggagttagtttgtttctttccaaaacagggaagatgtactttcctgaaggcagaaaggaataaaatatggaaagaggcttatttattccaaatgtaggattataagccaaaagacaaaggcaaggggtattaatcaagtagacagacaagcaagcaatgttttttttactacaaatcatccagatattttagtaccatttattccaaaatttggttggctatggcaaagaaattttccaatacctcctcggtacttcagcatgtccttgtctctacatcagttcccttatccttactttcaatca

SEQ ID NO: 110648 - DNA, 155 bp, Homo sapiens
ccttgtaacaaatggagacactgcaatgtaagcagaggcccagtgacacaaagccaggtagatgctgctgtgtaaacagattactcaaaatgaccagctagctggcaaaatctcttactcacagcagggaatagagtaagacaagcttggagcca

SEQ ID NO: 110649 - DNA, 740 bp, Homo sapiens
ttaggaaaacgtgttctcatcacaaatcccctgagttatagtgtcaccaatgccaatgtaatatgagcctcttagattgaaaaaaccgaacagcttactggatgataaaggaagtagctatgctttcagtttattttccccatctttgaggctcctgagatgttctttatttaaatgaatgactaggaaagaagtttgatagcatattagtattcttttttagcaaaatttgaatccctgagccttgttgcaacatataaccacatttatttgcaggttttattgattatttctaacaaggactacagctgaatgacctcaggcatactggttttcacgttttctccttgggacttctccctcaaaatggcagcctctattgggcttgcccaggctctccagcctctctttaatcaaagcagttctagagcacctctgctttgaaaggactttcttgagaggaaaggtcttggggaatggtcacacaaaaagactgcatagaagagggttctcccaagtgttaggatacacaagaagccctaggttggattcaatagaatcaacctagtagctttagccaagatcagaatcccatgggccttgattttagagattttttttttctaaaatttatgtttgctcatagtgaaatgacagggataccaagtaggtctcatgttgtgtgtaattgtaatttattagtagtgtccagccacctaaaggagtataatgggaaggat

SEQ ID NO: 110650 - DNA, 281 bp, Homo sapiens
attccattctattgcattacactccaatccactctactccactccactccattccattgcattccattccattccactctactccactactctccaccccactccactccactccatcccattccatccaattcccccttcattcattaatgacttcagcacctggctctctacccttctttgccaactaaatccttggttgtttcaacatccaagaccagacccactggattataactttctcaatatctttgcttccaatattacccttccccacctca

SEQ ID NO: 110651 - DNA, 330 bp, Homo sapiens
aaaaaaatgaaaaggcaagccaaagactggagaaaatatttgaagtacacatatctgataaaggattatatctagaatttatagagaaattttatgacagtaagaaggtgaaaactgatatttactatatatttttaaaatatatttgcccgtgttcatacagtcatcccttggtatccatagcggattggttccaggactttccacagatactgaaattcatggaagcacacgtatatgatgtaaaacggtatatttgtatataatctatgcacatcatcttgtatacttacttatttacttattttgagatggagtctcgctctgtgc

SEQ ID NO: 110652 - DNA, 625 bp, Homo sapiens
ctcaccaccattagcacctgcatatgccacccaggggcctgcaaatcagcacacctggctccccattgccaccacagctgtgggggctgcatcctgcagagccacagggcagagcccaccccttgagccaatgtggcctggatacgagacacagggttgaaggagattattttggagctttaagatttaatgactgccctgctgggtttcaaacttgcatggggcctgtagcccctttgttttggccagtttgcctttttggattggtagtatttagtcaatgtttgtacccccattgtatcttggaagtaactaatttgtttttgattttacaggctcataggtggaagggactggccttgtctcagatgagactttggactgtggacttttgagttaatgccgaaatgagttaagacgtgagggactgttgagaagggatgattgtattttgcagtgtgagaaggatatgagatttgggaggggctggggcagaatggaatggtttggatttgtgtccccagccacatctcatgttaaattgtaggaggggtctggacagaggtgattggatcaagggggcggatttcccccttgctgttctcgtgatagtgactgagttctc

SEQ ID NO: 110653 - DNA, 625 bp, Homo sapiens
aagcaaggacaagcaaaactaatctatgattgtgataatattgataagtgattggcaatctatggtcagaatggtggttaccgctgagagtcaattattgacaggaaagggccaccagagaactttctgggataattaaaatgttttctactttcatctgagttgtggttacatgggtgtatacatatgagtattggagttcagctttatagctaagatctatactatatagctttgcatacattcattgagctttacagttaatatctacactttactatatataaattatacctcaataaaaaataattagcctgtgagattattcctcaggtatgtttatatagaattggtattggttgatcactggatcatatgtgcaatccacaagtgtgcctattttaccacatttatgccaacactcagcatcgttcagatttcttatcttgtggccaatataatggatgtaaagtggtattgtgttatcttcccccctttctagtatctgctgtccatttaggtttcccctttgttaattgcttgttcctattttgtctcatgtacttttcatagaggcttttttcccactaagatgcactagctaggggtaccatttctgtcttca

SEQ ID NO: 110654 - DNA, 491 bp, Homo sapiens
ctgggattacaggcattgagcctccgcacccagcccaaaatatcttattgcaccgtactgcaggtaaatgaaaccatggaaggtgaaactgcagattcaggggactactgtacccaatttctgtaagacaagaaccaacagaaagccagttttctgatttgtccctttatttagtaaccctatgccatgtaagagttgaaataactgagaggtgtgactttcttgcctagagtggaagaggacttgagtgggcttttcctccagttcatgtatttttaggaaagagtacctatggaatgtgaagacctggaaacggattgcataagagttatccaagcaaaaaaagaattatccaagcatatgtactccttagagattcctcgtgctccaaagtgaagacttccatactatgtcatgccaaatagctacttgtataagttttcctgactcataacacacttgttctttctattcttctgtttcaaagagga

SEQ ID NO: 110655 - DNA, 319 bp, Homo sapiens
attaattttagaacatttaggacattttcatcacacttccccccaaatccctactcattagcagtcactccacttcatatttatttaaaattcatttcacatataaaatatatatacatatatattttaattttttaaaaagtaattcttatgtgttcccatggagtggagtaggaaacctatcccaaacctctccccttcttgcaaaaaatattctatattcaagtttaggagaaaacagaatacttgctagccccactgtcctcaagaacctagcaatgcattaagctcacctcctctcctcttccaagaccaaaaa

SEQ ID NO: 110656 - DNA, 365 bp, Homo sapiens
attgaccttgtgaaaaagaaaagggcagaaaattgagctagaagttcttagtccaagatatttaaaggcatctaagaaattcttgtatttctgggctgacagggtaaccaacagtagagaaaagacactgggattggaaaaaatgaattgcatataaaagtaaactgttttattactcagcaaactgaaaacttataggtcaaatgtctgacattatccctagttcaataagtttacagttattgaagacttaatgtgctactgttctaaaccctggctgtataaaggagaaaaaggcatgaatcctgtcctctgagaaggaagggcaaaggcctgctggcaaagggagcatgccgcattggaag

SEQ ID NO: 110657 - DNA, 187 bp, Homo sapiens
aaaacaaaacaaaaaaagttactgagaaacagacaaatttcactgggtccatggcatcccccttgctgtttggtgtgtttaagcataagtgagggaccctgatcctgactatgggctgcctctgtcctgggtctcactgctttgatgtggagctttggacaggtggcagcagttcccgaagcttttc

SEQ ID NO: 110658 - DNA, 245 bp, Homo sapiens
tggctgggcctccagcccatgcccctgagggccgtgctcctcaccccttagtcagaatctcagggcccacccttgccctctcatgtcatctgtacaatggctgagaggagttctcctgtcccgttaccagtggggacacagaagcccagagacaaggccaggaggtcagcagactcagggcatgccctggcacccccccaggcctgatgaggtgtgacttctctagggggacagtttctgaggga

SEQ ID NO: 110659 - DNA, 101 bp, Homo sapiens
gtggaacttctcaatttagtagtgaaagtctgattatggaatggataaagcataaaactaaaaattccacagccatagatggctctgtgacagcacatcca

SEQ ID NO: 110660 - DNA, 762 bp, Homo sapiens
atctcatcccatcagttgaagaccttaagagaaaagagactgacctgctctgagcaaggaggaattctgctggccaactgcttgtgaactccaacttgtaatatcagtctccagcctaccggcttactctgcagattttggatttgccaagcctccacaaccgcagaagccaattccttaaaataaatcccttacaacagttccctaaaataaattcttcaaaattccttaaaataaatgtgtgtgcatgtgtgtctgtgtatatatatagcctatgtaatgtctaatatagatctataatatatattagataaatatacacatacttatcatatatatatgtgtgtgtgtgtgtgtttctcctattggttctgttctctggagaacctaatacagaaacaaatctgtttattcttctagcctctgtatcatcaggcctctttgttagagcaggtgagctttaccctaactaattcagaggttgattcgttttcatgcatgtagatacttgtcatttagcttctattatctgcctgtattttaaggttctttgtcttaaaatgttatgactccaggaatgttatatattaagtatattaaccttttgactattatatatcttgcaaacatcttgtaatcagtcacttgtctctttattttatttggagcggctttcaacctagagcagtggtccccaaacccggggctgcagactattccctgtctgtggtttgttaagaaccaggctacatagcagaagat

SEQ ID NO: 110661 - DNA, 330 bp, Homo sapiens
tttttctttttgctgagacactggcgaacatttccaacacttacctgcaacggcatctttcaccagctcaactgtatgaaggttaaaaactcttcctaattttgattctaataaatgacttgaagaaaagtgtgtccctgtttgtttacgtctataaatttagaagcactgtgaaatctcaaacaaaattagcctggggatgcggagaatcaggtaacctaattaacaaaggctgagccacttacattctcaggactctggatcaatgctggccagcctaactgaagggagagcagacaagccctggatgggagaaccaacagctcagag

SEQ ID NO: 110662 - DNA, 213 bp, Homo sapiens
gatgttccatgcaggaggcagctctttcctgttgatgggccagatcagtggctccctcctgggacagcgcgggaaggaggagatgggctactttcccatggggaagccgaggcaggacccttcacactcctgcatctgtactcatgcagcacagacgtggggaagtgctagccctgcacagagggggtggcatctgggcaggagtccatctag

SEQ ID NO: 110663 - DNA, 354 bp, Homo sapiens
gatgctcctgaaccattatcacagaaggagaggaaaactgcattaatgactgaactaactttaggtcttttcaaaacaaatatagtcatcaagctaaatattcccaagtctccagaacacacatgggtatgcacaaacatgtgtgcacaaacacacacacacacacacacacacacacctctttgctggcaacaagataagcaagtattagccagcattattgggacaggttttagccctaatttacagagcttttgagatcatgccccagtaaatttttttaagctaatgtgttcatacaggagcatcacaagtaagtttatccaagtcactgttaaacccacaccctgtctt

SEQ ID NO: 110664 - DNA, 252 bp, Homo sapiens
attgggttctatgactccgtttctccatctgtaaaatgaagattgtaaagtatataactgaaaagtgttattgtatgtattacagtttcaattgtaaagtattagaaagtattattgtagaggttaagtgagataatacatgtcatttatcttaagataatttctggagcatagtaagtgctcagtaaatattagtggtatcattgcaataattattaccgtagtattctcttaggtcagtgcctaaggaaa

SEQ ID NO: 110665 - DNA, 459 bp, Homo sapiens
tatatgtgcgtgtgcatgtgtgtgcatgagtgagcacagagctgccagctggggcacagcctcagctgagagattcctgaggcaccaggtcacctgattctagggcctgctggtctccactgggcaggtggggaggggcagcaaggcctccagttacaagggcacctgcttcctcattgcctaagagggccccaggctctgcacacaaccctgcctcctgctggttaacaggactggcttgttgctgctccagcaaacaatctgaggaaaccccagagcccacaaaccatctgtgacccagactggttcttactgaatcctgtgggttctcagaacactgtactccaccacagaaaaaccaatctgacggcaaagccaggccacctcctcctaacccctccctccccatgtttgttttagctgggtaaaagtaactctgattaacatcatttacatgaa

SEQ ID NO: 110666 - DNA, 171 bp, Homo sapiens
cacttagccttccatataaaatataaaccaagcttaagtctaatgtttgtggtagcagagaagagtgacaagatgacagccatgttttaggaaaccaacaggcaaccagaatgtcagagcgtggcatgagggagagataaaagaatgagcaggaatcaatggtgggatgat

SEQ ID NO: 110667 - DNA, 258 bp, Homo sapiens
ctgaaaccttgatagaagactccttgctacaaagcagagctacttaaaaagattgtttcttcttggctgctacgaaaaggagcattagcaactaaacattgcactcatctcatgagccccaagacctaattatactaaggctccaaagtacaaaacccttagtcacatggcttctaaattactcatgacagtatcatttactcaagtcacagctggccacttcttatgcttatggtctattcttaaatctggactccg

SEQ ID NO: 110668 - DNA, 560 bp, Homo sapiens
tctcaaaattataaaagttgaaaacaaaactatctttttaatttatttctctctttgcaacctcactgtcagactgcattttcaaaaatacatagaaaatgtttcatatgttcctatgatatgctataattttaattgtattacttgtaccaattttagaaattccattatatgaaaagtaacattttcataataagaggatgccaatattactattttaatgatgcattaccaaaaatacttcagtataacaatttttttgcaaaaggttacatacctattccaaattaactatacctttgacgcaatgaatactaaaaacaaaaaaaatcaagtagagtgaaatgcttgtgcactactagcatgtaatgctgttagacaccaaaggcaatcaatcatttagtatataatagaattttaaatttgcatagccattggcccaatagagtcaagtccgagagtttttacaagtgaaactataagaacccagagataaaaatataagcagagaccatttacatgtttaacaatgagtacaataaagggcctgatcaatcagg

SEQ ID NO: 110669 - DNA, 252 bp, Homo sapiens
cctctttcagcctcccaagtagctgggactacaggtgcgcaccaccatgcctggctaatctatgtatttttgttagagacggaggtctcactatgttacccaggctggtcttgaactcctgggctcaagccatcctttcaccccggcctcccaaagtgctgggattataggtgtgagtcaccatgcccagctaagactactgtgattttaagctctgtgtgcgcaggcattcgttcaacctccgtgactgcc

SEQ ID NO: 110670 - DNA, 391 bp, Homo sapiens
ggggttacaggcgtgagccaccgcgccaggcttaagcagtttttaatgccccttatgctaggtactaaaggccaggcctcaaggagctcagtaaacaagtttttttcctgctttgatggcatatcatcagccagccagttcatttacttttagattctatagcagggagacagaaactcaggccgttaacatgacccatgtagatactcttttggctcccatctctctagttacagtatggtttcatcgctgttcagcattggtgagttataagtttttcctatgtatgtaagtttcgtgtctctagattgtaatttatttggatagaggatttttgttcttaccttttaaaatttatcttccctcccctcttccccaccacatgttttca

SEQ ID NO: 110671 - DNA, 131 bp, Homo sapiens
cttctcccaacagtgataattaacagtaatgatacctgccattactgcaggccaagtactttaaatagagcacaacatttacgctatgaagtagatattaaaatcaaccccattttatagctaagaaaact

SEQ ID NO: 110672 - DNA, 338 bp, Homo sapiens
gtctcaaaagaaacacaaccgatatttggttaaagaattgtattatgtgcaatttgtattttagatggaggtgcaagctacccagcatatgaagaaacaaatagagaacactggcaacttatcaacttatttagaaaaaaattattttgaatattaatataataatttttaaaatttaatatattgaagtatctgagaccattattataccttaagagtaccaggataaggagaggttaaaaagttcccatgctcagaaacactaactaaagatggattaaaaagcagacacatttagtgcctaaggatatatgtgtgtgtgtatatatatatatata

SEQ ID NO: 110673 - DNA, 297 bp, Homo sapiens
cctgccaagatcaccccaagcagaaaccagtaggcataataattagtatgtttgtatatatatatgtgtgtgtgtgtgtgtgtgtatgtactttgctgattagatattttatcagatatcttatctatataaggaaacaacaacaaaagtgaagctgacagtgcgttgagagccgggctttagcacaccacagctctatgtcttaggatccctcctctctgccagtgtggcgcccgcctcctactcccatcctctgcctccagtctcctctgccagcctgtcctccatccaagctcc

SEQ ID NO: 110674 - DNA, 336 bp, Homo sapiens
tggcttgacaacattccagatgaactgtcacttttgcttcataattaaaaaatgaaatagagctctttttagctattcttctccagcctgtcattaggtatgaacacaagtcagtgccgacatatggatttatatttcctagaaagagcaggtgttgatgggaaagaagatataaaccaacttaaattaaactgcttctgcatatgaaatggctggctgcttttgggcagactttatttcacctgtaaatatttaatagtaattggtgtctgtgggttttgctagagggaatggttcttactcctactgactttgagggcccaggtggctctgggg

SEQ ID NO: 110675 - DNA, 225 bp, Homo sapiens
cttaaattcctcatcttcacagtagcctaaacatattcttctgcatagttacctccatcaactgcagcaattttctctcatctgcactcatttttcctgtgtcttgaattatgtaggattgtctcatgggaacagacttacaactgggcctttgtttaaaaacttctctaagctcccaaacttcagcgactgaaaattaaagtttcattttctttcctttttgct

SEQ ID NO: 110676 - DNA, 715 bp, Homo sapiens
aaggaactgaagattagagtggtaaaggtcagttcagagttagggctgggattttcctgaccaccagcattatctctcttctctcatgaggagaggagaaggtaactctgcgatggctctatttaccatcttgagattttttcctgagctttttttgagaaccttactatcacactcctcaggaaagcattacagtccactctcttcagggatatgttttccagtttgtagatcatttaggcccattttcttttctttcattcctttggaatttttctttttcctttcaactggacccttacctttaagaagacagaagctgaaagaggtaaactttatgcataagacttagctcttgttccaaatagttaaaacacatgaaggaaaagagggaaatgaaatattttcttatgggttttatttttattacttccctgaattttggtatgcctcttatttcatagtaactgagttggctgtgcatctggctatgtctcacacccacaatgtttgttgactgtagtgtcggtggtgtgccccagctgttctgtaaatagctgcagcttactgggcaaggtttttggatgagaatgtccaaatttatcccaggcatgtgaccaccaaccaaaaacattggccttctcaatgccatcagcctcttttaaaagtatctagtcaatgtagatgcttaaaccaatcggtgattgacttgatg

SEQ ID NO: 110677 - DNA, 678 bp, Homo sapiens
tatttacattccgtgcctagatcctgccaatttttgagcttgcagctcctggtgtagaggaaagaggcctggaccttaagtcgtggtccctgctctgctgtggtaacccaccctgtgatgccaagcatagctaatagcctctttggatctcagagttaagagactaaattggatgttcttttaagagttctgatatcctggccgggcgcggtggctcacacctgtaatcccagcactttgggaggccgaggcgggtggatcacaaggtcaagagattgagaccatcctggctaacacggtgaaaccccgtctctactaaatatacaaaaaattagctgagcgtggtggcaggcgcctgtggtcccagctactcgggaggctgaggcaggagaatggcgtgaacctaggaagcacagcttgcagtgagccgagactgcggcactgcactccagcctgggtaacagagcaagactccgtctcaaaaaaaaaaaaaaaaaagagttctgatatcctagagggcttgggattttgcagtaggccaataccctgcccctcacctttcccaaccagccaggggccccagcctggtgtgtatgtcagagaaagaagacactggaatgagtaaggtgcttatatcaataatgtataacttgagcccatagccaaggagaggaatgc

SEQ ID NO: 110678 - DNA, 290 bp, Homo sapiens
taataactgttttttgaattggttgcattgtgtgaaaatcacaagatttgacataataatcctaaattggcacaacactgaaataataacagattatttcttttttttttgtagcagtcctctgcagctggcttctggctgccccccagctccccaccccaactcttgcagatgggacatttttcattctctatgtcaccctcaggcctgtctctgtcatttacattgaccccttgaaactgcaagtgaatttgagaactttgactcagatattccagaatgaagaaaaa

SEQ ID NO: 110679 - DNA, 925 bp, Homo sapiens
cccatgcctacccctttttggttgagagctgctcctctgggcatccactcctgggtctttttgtcctttcttgtgtgctggccaagcatgctgtctcaggcagagaggggagattagcagtcttgcaacaagaagctgctgacatgtatgtgacaagtgctaaggggctatggcagggcactggcaccctctgcaatgcccttctggaaatctcctgcaactgctaagggtgctctggttgcctgacttctctggccctccagcacctcagtcccagtcctcattatgttatgttgaaatctttcactcatacaacacatttgttgaaatccttgctatgcaaagagattacatttgtgaataaagatagatatgatcacttctcttgttggggaaaaagggtgcaaaagcaaggaagcaaacacataaatattaatacataagaataaaaattttggcaagtgctatgagggtaacaaatggggtgtataacaataataaatgaatcttgggattgggatagggaattcatttagacatggtgattaagaaacaccaagctaaagagaagctatttatgccaaattctgaaggatgagagaagactgtcatgcaaagagcagggggaagagtgttaggtaggagggacagtgggaagatgggaattgtcttgcttgaaaaactcagtcaccaaggctagaactggggcaagagggcgtgtaccagatgaaggtggaaaagtaggcaagggctggctcaggcaaggctctgtctcttccgctagattgtaagttcttcatgacctatgaggatcatgtcacttatctttattttttcaccaatattgctcctttccttcctccccaacttgtgtagcccaacactgaaggttttcagaaaacttttatggtctatatgcaaaaca

SEQ ID NO: 110680 - DNA, 326 bp, Homo sapiens
ctagtggatattttcataattgtttatgcacaggcagtttggaacctatccactgttgattaagaatagagggggaggtttaacatagaaaatgacaaactggatgattagtagaatactatagtggatttgcctctgtttttctttggctcttattcaggtaaatttacatttatctagcatatattagcatgtattaattagaactgggttcagctgccagagattagagcatcaaaatcatgggttggtaaggaggagaaaaagtatcaggtgggatgagccaggagaaagtgtcctggttctagtggtggccctcaaaaggt

SEQ ID NO: 110681 - DNA, 156 bp, Homo sapiens
ccccacctcagtgctgggattacaggcatgagctaggattacaggcatgattacagtgctgggattacaggcatgagccactgtgccgggccttattttttttatttcttaaacttgataaactgaagggggaaaagtaattgtaaagctcacatt

SEQ ID NO: 110682 - DNA, 762 bp, Homo sapiens
agaaatggaacagaataacaaaaaatatgagattaaaccggcttttttttaaaaaaaaagccaagttcactttttaacttttaaaaaacacaatttccttaagtaggaaatgccaggagtgataagtgaccagattgcttgtcacttaagttttactgcaaactaattcccacgagagaaaggggatgtgaggtgcttccccacaagggtacgcttttccatctgtacccttgtgggtcgagaaccacggagaccctgggaaaagttgggaggcagggatttaggagttgcacagtcccctcattggatgagtcacctgagacacacagtgggatgcttctctactcagggtcccttcctcggaggtgaagaggaaggccggcaggcagggtcacaagagcacagctctgcacttgtgaaaaagaccttttttgacataggaacgaagaacatttatgcatgaagagtgtggagtgcgaagtagtgggtgacttttgttctctttctggcagaactttgcctacacattcctactacccctggaattctaactcagatgtgggtagcagcttcctcaaagagaaactttttcccagctgggtgctgtggctcacacctgtaatcccagccctttgggaggctggagtgggcagatcgcttgagcccaggagtttgagatcagcctgggcaacatggtgaaactccatctctgtgaaaaatacaaaaattagccaggtgtggtggtgcgcgcctgtaatccca

SEQ ID NO: 110683 - DNA, 231 bp, Homo sapiens
ccctttctcgtgcagctttaggcaggaaaattgttcagatctgccaaaggtcagaatgcattggcaggctttccagccaaggatggaagagtgctgctttcctatgacaacttctgacctaccagaagctacatgaatttctgagaccctttcaagtaaagtatttcctgtttccctccccaccatgtccccctaaaataaacattggaacaaaattgacagcctgggaag

SEQ ID NO: 110684 - DNA, 223 bp, Homo sapiens
caaaataccttctcagtatatatttattcaaagcatttctagttatagaatttctgagctgggagacttttggccaggtgtatcgtaccatgaaaggatgccccaaaatgtcaaatcacagggttactccaatgcctagccatttttctgctaacacttcttagaacagtaagaccagcccagtcctactggggccacccacatcatactaactccccatcag

SEQ ID NO: 110685 - DNA, 483 bp, Homo sapiens
aagcctggcttcaacatcctaaggagtgaattccttaggcagagcaacaaagtaaaacaatagcagcaatgatatacaactttggtgctaggctgccaagttgtgactatatactccaaattgctaaaggaaaatcttaggtagactgagaaaaactaagtgttaaaattctgctattaccatttcctcttacttccagcttcttctctctctgcccccatgtggttcttttattaaaggatgcaacgcagagggccctttcctgttttttctcctctctatccaagttacaggaaattcaacaaagccgatctccctgtgtgacatagttacaaaacatgtagatgtgccaggggggagccataatcaaacactcaaaataagagaagagctgatggtgcaattgatggcctgagtcctggctaaaatggtcacagagctccttccctctgcagctacctggcatcctggacttctccaaaa

SEQ ID NO: 110686 - DNA, 273 bp, Homo sapiens
gtggtcttgattttcatttctctgataattagtgatgttgaacatttttttcatgtttgttagctgcttgtatgtcttttaagaagtgtgtgtgttcatgtcttttgcatctgtatttttctgtttttgttgggcctttttaaaatgagattatttgtttttggcttgttcaattgtttagctttctcatagattccagatattagacctttggtggatgcataagttgtgaatattttctccctttctgtaggttgtctgtttactctgttg

SEQ ID NO: 110687 - DNA, 394 bp, Homo sapiens
tttagaagagacagggttttgccatattgcccaagctagactcgaacctctgaactcaaatgagccacccgccttggcctcccaagtgctgggattacaggcatgagccaaagagcctggccgattttttttttttttcttaaccagaagctgatactagcgtctgaatttttgttgaagaaatctatgaacaaatttgctctcgttacagttactagactgcataatttttttttagaaagcatccatgctagcctgtagtcccagctacttgggaggctgaggcaggagaatggcgtgaacctgggaggcggagctttcagtgagccgagatcgcgccactgcactccagcctgggtgacagagcaagactccgtctcaaaaaaaaaaaaaa

SEQ ID NO: 110688 - DNA, 407 bp, Homo sapiens
ttataaccctgagggatcatcaaagatactatcctgattcctggtaaggaaaaatatattatttccttataacaaggcaaggagaaatgctattttattcctgataatttatataactagaataatttttttcctttcttttatggacctaaatctgccaattgggaattttgtgcatgaaatatgaagttactttttatagataatcagtgcttttaagtccctaaaaggctcctgctgaagtaatgatgatgttaataataaaagcctttgaaaggctgaaaacctacatagtggtaccatagtatttggagcttctataggagtggagaggggcagctcattgttgagagttgcatgctgcaacctaatggtcagcaatgaaagaaatacttgtagaatgttca

SEQ ID NO: 110689 - DNA, 416 bp, Homo sapiens
gtactggttcgtcattttctaatttacttgcagaatttatttacattttgtgtattcatcctttgagccattataggttgaacatcatttcttctggtcagtcatttgtccttcttattccttaaataataacatttcttctataatagttgaaaacttttttgtagtcaaatcaatcttttctgtatggtgcatgctacctttcttctgcttaagaaggcctttcatatcccaagattatgaagatattctctaagatttttaatagttatcttaaagatttgtttttacacatttgaaattgtaatccaactgtaatctgtatgtggagcatggcagtagtctaatctcacctgattttattttttcatgtagtccaccaagtccctagatcacttattcaatagtctgtcctt

SEQ ID NO: 110690 - DNA, 394 bp, Homo sapiens
ttcaatagatgatgctgggagaagtggtcattcacatgcaggagaatgaaattagacccttacgtcatacacatacttgaactgagtggattaaagacttaaaacatacgacctgaaactgtaaaactactagaagaaaacacagggaaagctctgtggcattgatctgggcaatgattttttgttgtgactttaaaagagcaggcaaccaaccaaccacaaaaaatagacaaatgggactgtatcaaactaaatagtttctgtacaagaaaagaaactaagtgaagagacaacccatagaggtaaaaaaacaaaatgtgtaaaccatatatctgacaagggctaatatccaaaatatataaggaattcaactaagtagcaacaacaacaacaa

SEQ ID NO: 110691 - DNA, 359 bp, Homo sapiens
ctagaaaaaaaaacattaattaatgatggaacaattaactactatttcatagataaggagagaatttaatcattttacaaccaaaataaaaagtgaatatccaactcgaaatgggttggggatcaaatctgtcaccaaaaaaggtaacaggaacttctctttggttcatggtagctggtgtctttctgatgctagtagtaagtaagtttcagtaataagtttctagtatttctgcattctgtataggaacatgtgtaacaatttcataatttagctatatagttgctaaaaatactgaaatgcaaagaacccaggagaaaaaaaaaagagttctgagcaatcagagcggggttcacaag

SEQ ID NO: 110692 - DNA, 378 bp, Homo sapiens
gtccacgtaagatatgatcccattcctatgaaacaggcagaaaggcacatccctagagacagagctaggggagggagaacggggagtgactgcttaatgggtatagggtttacttttggggtggtaaaaatgttctggaactagacagaggggtggttgtgcaacattgtgaatgcgccaaaggctgaactgttcactttaaaatgggtcattttatgttatgtgaatttcaacttaattttttttacagacacaaaagaatactgatgcatctgtaaaaatcccctcagcaaaaacaaaaacagacaaaaccaatctatactattagaattcaaggtggtggttactctagtgtgggatctgggggcactgataatg

SEQ ID NO: 110693 - DNA, 520 bp, Homo sapiens
tcttgtaagatctcttggcccccgttcctcactcctcttgtgacctgtagccccaggaccttttggttgtcagctgctggttacagcaagtggttgggaggccctagtattagctctgcatgtggtgatcttgccatgggactggaagcctgagggaggatggctggagtggggtgggctgtggtgaaggggatgggatggagattaatctgtggaccaccatttaggccctagtggcctctggtgatccacaggctcaatttgagaaccactaatttcatgacaaaacagatatgtaagacctaaaatcaagggagagaatggacgcctcgtgctacgaagatgtaggtgcatctggtttcagattctgcagtgagacctgtgaactccacctacggctgcctcatcattgggggagtcttaggtggctaagaagggcattctgaagaaacgcgttgtggtgaagggacaaagcttggttggatgggtgatgggaaatttgttacaggagtactggcag

SEQ ID NO: 110694 - DNA, 627 bp, Homo sapiens
tatggtcatgtcattcaggctgtactcacctttcttgagaggacttcttggataagtgccattctgcagccccggtgcctgccttagccttcttccaagcacttaccgcctgccctgttctgggtttgtgtgttcgctgcctctcttccgtcataaggacggaagccccagcagagcaggacgttcttctgtgatggctcccctggtgcctggcggtgagtgatgttaggggatttggactcatctttgtagtgaatgatgggaggatcactgaaggtctaaatcaggggagtcacatgagtgcatttgggtgtttgaagagcagtgtggatggcaggagagctgatgacaagtatttagggagagcctccatgcacattgattgggagtccattagcagtcctgctcttcaggctaccttgggtgggcccaagctttgctggcctagttaattaccaatagctagtatcaatgtcattccatcagtgacattttgaaactactagaaattacagagaagcagccagacaccgtggctcacttctgtaatcccagcactttgggaggctgaggcaggtggatcatctgaggtcaggagttcgagaccagcctgaccaatatggtgaa

SEQ ID NO: 110695 - DNA, 350 bp, Homo sapiens
cttgcctgaacccaccagctcaggcagcccaccgccaaagacagcgcgaagctgcaaccacctagctgctcctcatgcaggggctggagagaggggctagggcttgaaactgagggggagaaagagctgcacattgtaaatgggaagcagagagccaatgagtctgcctgggatgtgtgtgaatcccaaaagacgcaatcccaaatgccatagtcccaagtgttgagaatccaaaatattaaaattactatactctaaaatccgaaaatcacaatcccaaaagatctaaatcctggaaatataattctgggaaaatttttttttaattttttaaaagatacttacatttt

SEQ ID NO: 110696 - DNA, 364 bp, Homo sapiens
  misc_feature (258)..(258): n is a, c, g, or t
  misc_feature (344)..(344): n is a, c, g, or t
cacacacaaatatatgttcacaactacatgtgataaatttgcctgtgcagttaagggagccatgtttcagagtggaggtgtgtacacattgaaataagaaactacttcagaagcaccctcagttttcttttgaataaaacagacgcaataaattggccatcataaaccaaggaaataagggtcaggtggtgagacactgaccttctaaaactgtgctaaacatttcaagtcacttaaaaaggccaggtaaccttttanaatgaccttggcctttactaaagggtggagacatggccttctcatcaagtgacacacgcagaataagaaataagattggcaggttncatcttcccagtctaaataa

SEQ ID NO: 110697 - DNA, 400 bp, Homo sapiens
cttccctaagaaaggaattgtatctgccattcatcaacaaaacactcagtagcatttgaacaagtaaatggaccagagttaagaaaactcccttgactcttctcaccagaagcaaggaccaaagctggtgggggaagcagggttggtaggcagggagaacaggggcagagaatctattgaaaattgaatatgcatacattgaaaactttttgttcttattaaatacagaaatgtaatctgtctactttctaaaaataaaagcttattttctctgattatgacagaactatttgccttatgaatcaagaacagaaaatagaaaaatttacttgattaatagccccttctttcccatagatcatcagttcttaaattcttttggtttaaggatccctttata

SEQ ID NO: 110698 - DNA, 565 bp, Homo sapiens
gagtggtcaaattcataaagatggaaagtagaatggcagttgccaggggctaggggtgaagggggttatcatttaatgcgtagtttcggtttgggaagatgaacaaattttgaagatggttggtagtgatagttgcacaataatgtgagtatacttaatgccactgaactacactaaaaatggttaaaatgataaattatttgttatgcatattttaccataattaagaaaaaaggttacactaattagtgacaactagactggaatgcaaatcccttgaataccagtctaacaatagaatggaaagatgtttggtctgggagtcagcaggcatggaatttagttcctttgtattagtcgaaggtcttcaacaaatcatgttagccctttgagccttgttttccatttataagagagggttgaacaacattccagctctgccagtcttacatacccagagcccttcctcagcccggggagtctcctagtggacattgtcctgaagccagcctggattttgctctctttatttttttttctttgtcacaggtcattcaggcaatga

SEQ ID NO: 110699 - DNA, 236 bp, Homo sapiens
gggtgtctcctgaggcctctctttggcttgcagatggctgtcttttcactgtgtccacacatggccttccctctgtgtgtgcgcatcctggtgtctctgtccaaatttcctcttcttacagggactctagcccagttggcttagggcccaccctaatagcctaattctaacttaattacctctttaaaggccctaccttcaaatccagtcatattctgaggtccttggcactagga

SEQ ID NO: 110700 - DNA, 400 bp, Homo sapiens
cttgccttgaggggggcccaagggctcagatcttcccataccttcaggcattggcattctgatctgcacttggacagcaattacacttcttggctccacatcagtgcctgccttgctatttcaaagattgcctgtaactcaaattttagggctctgcactaaaaagtaataaattgaccaaaacagagtatataggctgggagttgtctagagggcatcttgcaatttctgtcaaacactgcatgtttccagtcaccatgtgtttctcatcttcctttgcatatgccgccacgggatattcagaatcgacggtttctgaaatcactgctttcgttttcacatctggtgatgatctcatagtcccaaagagaggttatcgaaggaacgcaataaactatgt

SEQ ID NO: 110701 - DNA, 830 bp, Homo sapiens
tcaaaggtagaggagagctttggagagctgtctgcaaaaatgaaagaagaatttaaggattaggcataggacaagtcagttgtatgtagtccaattttggttcctctcattgcttagggttgttttgacccagtgatttagttgcacagttttaggtttctgtacatttggatgtcatagataccaccaccttatacaccttatttcataacctgtgtgtttattaaatggctagtgacatggaaaatggggagattgatgtgttgctttggcacaaaaaaatacatacaatattattgtcactggttccaattaaagaatgaggacaggctgggcacagtggcccatgcctgtaatcccagcatttagggaggctgaggcggatggatcacctgaggtcaggagtatgagatcagcctgaacaacatggtgaaaccccgtctctactgaaaaaatataaaattagtcgggcatggtggcacaagcctataatcccagctacttgggagactgaggcaggagaattgcttcaacccaggaggcggaggttgcaatgagccaagatcgtgccatcgcactccagcctgggcaacagagcaaaactccatctcaaaaaaaaaaaaaagaatgaggacagaaagatccttaatttcctggaatgccttgccttgtgcttcctctatgtttaaggtttttaaaaatgtgtaaattaaaatgatgtcctctgccttttttatatagcattgtgctactgttgtatgtttgtgtgtgtgttaaaaatgatcagactctttttgctgttttaattttctattttattttattgtcta

SEQ ID NO: 110702 - DNA, 1121 bp, Homo sapiens
gatggacatttgagttgctgccaccttttggctattgtgaatggtgttgctgtgaactttggcttacaagtatctgagtccctgctttcagttcttttgagtggaatttgctggatcatatggtaattccgtgtttaacttttggaggaactgccaaactgttttctaccgtggctgtaccattttatattcccaccaaccattgatttagtttgacttctgttgtttaaagaagtatatctgaattttacacatactccaaaactgtaattatttgaattaattggagtagaaattaatttgaaataatgaaatgtctgattactggacatcaaaagctgctttgcattaggccatggttctcagaattcacaatcctcctttccattttttcctccctccctcccttcctcctctcgctaccatggtcactctcagcttcacaataagcacgtgtatcttagggcatttgaacttcaaatactacagcacctcacacgtaagaactctgtaacagtagacctctatttccctttcctgtcctatgtgctacttttttgttttgtttttttgagacagggtcttgctttgttgcccaggcaggagggcagtggcgtaatcacagctcactgcagcctcaacctcctgtttaagcgatcctcccacttctacctgccaagtagctaggactacagatgcagaccaccatgcccggctaatttttgtatttgtagagacagggtctctccacggtgccctggctggtcttaaattcctgagtttgtgcgatctgtccacctcggcctccaaaatgctggggttacaggcatgagccactgtgcctggcctttgtatttttgtcatacattttatttcccagtattatagactccagaatattgttgttgtttcataggtgactaactgggtaggggaatgtctggttcccttactatccggtgaagtagcagaaccaccttttgtaggaatcagttatcaggccctttactttcccttgaactctaggctagttccagaacctttggtggactggaaagaggaaatagttatgccacaatttttagtacatgcaaatgtacatgtaatgtttaaaaaaaaaa

SEQ ID NO: 110703 - DNA, 1778 bp, Homo sapiens
gatggacatttgagttgctgccaccttttggctattgtgaatggtgttgctgtgaactttggcttacaagtatctgagtccctgctttcagttcttttgagtggaatttgctggatcatatggtaattccgtgtttaacttttggaggaactgccaaactgttttctaccgtggctgtaccattttatattcccaccaaccattgatttagtttgacttctgttgtttaaagaagtatatctgaattttacacatactccaaaactgtaattatttgaattaattggagtagaaattaatttgaaataatgaaatgtctgattactggacatcaaaagctgctttgcattaggccatggttctcagaattcacaatcctcctttccattttttcctccctccctcccttcctcctctcgctaccatggtcactctcagcttcacaataagcacgtgtatcttagggcatttgaacttcaaatactacagcacctcacacgtaagaactctgtaacagtagacctctatttccctttcctgtcctatgtgctacttttttgttttgtttttttgagacagggtcttgctttgttgcccaggcaggagggcagtggcgtaatcacagctcactgcagcctcaacctcctgtttaagcgatcctcccacttctacctgccaagtagctaggactacagatgcagaccaccatgcccggctaatttttgtatttgtagagacagggtctctccacggtgccctggctggtcttaaattcctgagtttgtgcgatctgtccacctcggcctccaaaatgctggggttacaggcatgagccactgtgcctggcctttgtatttttgtcatacattttatttcccagtattatagactccagaatatgttgttgttattgttttaaaagtcagttatcttcttagttttctttcagaaaaattaaatggtgagtttttttgtttgtttgtttgtttgttttgcatggcccatgtatttaccattcctggtgctcttccttcttttgtgtggattcagttttccatctagtatcattttcgttctggtaaaagcatgtttgacatttcctgtagtattgctttgctggtgacacattcttcctcagcttttgtctgaaatgcctttatttcaccatcatttttgaaggatgtttttgctgggtatagaattctaggttggtagtttttgttatttttcagcatttttaaggtgacatttggcttgtacatgttgttcttgagaattctgcagttattctttgttccactgtatgtaataatatatgtttttctcctttctctgattttaacggtttttctctttgttgctgatattctgaaacttgactatgatgtgtctttgtgtggttttctttgtggtttttttcctgtggaatttattcaacttctgggatctgtaggttatagttttcacaaattggaaatttttgacattacttcttcagacactttttctgtcttcccctccatcattctgggatttgaattacatgtatacagtaactgttgttgtttcataggtgactaactgggtaggggaatgtctggttcccttactatccggtgaagtagcagaaccaccttttgtaggaatcagttatcaggccctttactttcccttgaactctaggctagttccagaacctttggtggactggaaagaggaaatagttatgccacaatttttagtacatgcaaatgtacatgtaatgtttaaaaaaaaaa

SEQ ID NO: 110704 - DNA, 861 bp, Homo sapiens
tgattcttctctcttttcttctttattagtcttgctggtggtctatcaattttgttgatcttttcgaaaaaccagctcctgaattcactgattttttgaaggggtttttgtgtctttgtctccttcagttatgctctgatcttaactccagcttggcattagaagtagttgtttatatccccatgtgcagcaaagtctttttcctgagatcatatcacatgtgccaagttatatgccaagccatggttctcaagctgaaggtacagtaccctgggcccttacttgttctgaaaggggtgggggtggtggttttggacatactgttagactttctgagccacaactgaggtagctatggcttatcgtattttgacttcacaggtgaatctccgctgtcagccaggaatagccaggaatagctaaaatagctccttaagctgtaacatttctcttttccaaccccagcaaaggattggtctagtggtaacaacaaacctcatagaagtagtacacctattattctggagatacttgcttctatagatttattacaatatgttttataaaagtattttagagtatataatttgtgtttatgttccacagaaacatattttataggagttaatcttgactatctaaaggtattgtgaactagttccagctttctccaatacccttgtccacgagaagtaaactaaatcatgtatctatttcctctattatctttattaaataataagttaatgtggcctgaatatatacggatttctgatactatggtctattactgagggaaaaaacaccactaaactatcctctaatctgtgtaatagattagctacactttcttcactagca

SEQ ID NO: 110705 - DNA, 269 bp, Homo sapiens
tgatcctgtgtgtactccacttgtactctttctgctcctctctactgactggcatggcatgttacttttcaggtgacatgcctccacactccaaatacaaaagtacatatttatgggtagaaaaaaatagtggaaatacatatacaaatatgtgcaaatgtgtatattaatacattttctgtttttttaaataagattctaaaattttaatgtatcacagataataacttggtcagcagtacaattgggcattaagcatagcattaatg

SEQ ID NO: 110706 - DNA, 523 bp, Homo sapiens
atctttgtgattttggattagacattttttaagtaggcacaaacaaccgaaaaatagataaatggacttcattaaaataaaaaacttgtatgcttcaaaggacactgtcaaggaagtgaaaagataatccacataatgggagaactatttccaaattgtatgtttgacacagctctagtacctagagtatataaggaattcatataactgagcaataaacgacaaccacatttaacaatggggaaaaaaagctgtgagtagaggtttctctaaaggaaacacacaaatggccaagaagcacatgcaaagatgttcaatgtttttcgtcattaggaaaatgtaaatttaaaccaaaatgagataccacttcacacccagcagtatgacttaagaaaaaaataaagacaacacatgtttcaaaagtgatggagaatatggaattctcatatattactattgggaatctaaaatgatgtagctactgaagttagtaaacagtgtgtgagttcctcaaaaagtgaaa

SEQ ID NO: 110707 - DNA, 653 bp, Homo sapiens
caccaacgtgtacctcaataagccagcaagcactacagcattactgggcttggggtacttcctaatgcagatattaccgcaatgaccaaagaccaaagatcataacaccatttgaatacttggaaagccttcccaagaatgatgagtacaaacaagtctagactgtgaagactacaataaatgcttaattcttcaatgcccaggcagcagcgaatatccataagcatgaaaaccatccaggaatacatgatctcaccaaacaaactaaataaagcaccagtgaccagtactggagaggcagagatatgtaacctttcagagaattcaaaataactgtattgagaaaacccaaagacatgatgtaatcctattcctattccagagaaggaattcagtattctatgagataattttaacaaagagatacaaataattaaaaagatcaagcagggcaggtgcagtagctcatgcctataatcccagcactttgggaggctaagacaggtggattgcttgaggtcagaagttcgagaccatcctgggcaacatggtaaaaccctgtctctactaaaaatacaaaaaattagctgggtgcagtggcacatgcccatagtcccagctactcagaaggctgaggtgggtggatcacttga

SEQ ID NO: 110708 - DNA, 336 bp, Homo sapiens
ataaagtacaatgtaaaagaaaaaggcagttaaaaatgcaagctccattttttattattagagttaacagacacaaaattacacaatcacatatatgggcaaggtttaaaaggcttactctcagtttctgtacttctcttgccccagaccaacaatgaccaatttgaggaccggcagcagttcgtggagcacactttgaatagtgtggagtttacgttattcccatctgcactggcacagttactcaggtactgtctaattcagtgaacccaacctcccacacctggcaggaggcttatacacagggttgctcgataaattagttgaattgaatga

SEQ ID NO: 110709 - DNA, 790 bp, Homo sapiens
acacaacagaaagttcagcggattatggaggactgatttcctcatcaacctgtggttattgataaaagcttcttcagggtgggtcctgatcaccccagctgtttccatacaactgtggttcacttaggtgtcatgggcatgcacacattttgtccaagggaaataaagtaggtgaaaagcagtttagatactttaatggatacattgggcagggcttgcccaaaactgcttttctccttgatcttgagtgaagctacaacacagtgtcggggaagttcagaaggcaggcattttttacttaggctttctaagggctttaaattcgtaacattcttaaataaaggatataaagtgcagtgtatttatgaaaatgtctgctatgaaaaatgtcttatttcagtcaagccaggcagccccgcttggctcctccctttctctgacactagatgatccctccccaaggagcagaggaaaggggaggggggaagacctcctgttgacaggctgctgtttgtctgtcacatgtcttactccaccatttattttgcctggattactccagtagtctcttaactggaattctaatctattctcacagcagccaggatgacctcaaatgctgcggtggcttccatctcacctagaataaattcagagtccttgctttggctgacgaggttccatctgatcttgtcctctgacacttctctgatctcatccccctggctcactcgctccagcatagccttctggctgctgttccaacatgcgagcacagccatgcctctgg

SEQ ID NO: 110710 - DNA, 302 bp, Homo sapiens
cattcacacacacacaacgcacccacatccgtacaacacacacacagaacgcgcacacgtccgtacgacgcacacacagaatgcacgtgcgtacgtacaatgcacacaaagaatacacacatccatacaacacacaggcacacaacacacatgtgcatgcacatggcgcaacatacagatacacaaagacacgtgtacacacacatgcagagtccccagggcagcgctggcgtcatggggggctgcctccacaccgcctccaggagtgtttacagctgtggattacatgataccgccccctt

SEQ ID NO: 110711 - DNA, 208 bp, Homo sapiens
tttccaaggacacaggagctgtgccccgagggccatcgttaggggctgaggaaacaaggtgaatctagacaggggcagcgagcttcctgccacgggtcagataggaggcacctgacctcagtctgtgggccacacggtctctgccaggaccacgtgatgctgcccttgtggtgcccaagacaggacagacagtgcatcggcgtgcgag

SEQ ID NO: 110712 - DNA, 497 bp, Homo sapiens
gcagtacctatattgttttattctgtttaacttttggttataatttcttcattattttttcctgctttttctcttttcggattctaataacacatacattggagagcttgatactgtctcatgggtcattaaggttcatttttcttcagtcttctctctgttcttcaggttgggtgatttctgttgaactcttcaaggtcgctgtgatttctaatatgctgtggaacctttctagtgaattgtttaattgtgctttcagctctagaatttccattgggtttttatagtttctgtttttctgttgagattctttattttacattcattaagtctatattttcctttaattgtttgaatgtatttatgtttgattctttaaaaatatttagctgctttaaaatgtttatctgcaatatgtaacacttggacccatttggagtcagtttctattgactgggttcctctcccccacacacactccccccaactcagtaggg

SEQ ID NO: 110713 - DNA, 354 bp, Homo sapiens
atagcctctcctctacttccacacttcaggaagtatgtgaagaacctattaacatataggctatatgaaaatatagtcccagttttactaatctgaaattctctaaaatagcagtactattcgtcattttcactttcacacttagttgtcaatatcatgtaagatctctgttacacatagtaggtatttgatgctgtttcagagttcttcctgatttaagattcagcgctataagatcaattccaaaagttcatgctaaagatgtagaggggccactagatgtttcgctaatttaggactctgacccatttagatacagtgagggcatacataatgctggagtggacaaattaa

SEQ ID NO: 110714 - DNA, 490 bp, Homo sapiens
  misc_feature (321)..(321): n is a, c, g, or t
aatggagatggggtttcaccatgttggccaggctggtcttgaactcctgacctcaggtgatctgcccaacttggcctcccaaagtgctgggattgcaggtgtaagctaccactgcacctggccaacaacactgacttcttgcttgttccttgcctttccatccccaaaatcgttcccagggcctagtgtaatgcagggcaactagcaacacctctcaggcagagctgaagctgtggagaccaagcatcaaccaccttggctaatgcggctggcctgcctggggctggaggttgggaggggaggaatatgtacccattttanacatcctgaattccattctttggattttttatttgggggagcaccctttttaagggggtccttcttttttgtggcaggggaatggtttggcccttaaaaccttccaccccttttggacaccctttttttatttccatgcagtttttattttaaagtctcccttgtttct

SEQ ID NO: 110715 - DNA, 538 bp, Homo sapiens
  misc_feature (308)..(308): n is a, c, g, or t
  misc_feature (316)..(316): n is a, c, g, or t
aatggagatggggtttcaccatgttggccaggctggtcttgaactcctgacctcaggtgatctgcccaacttggcctcccaaagtgctgggattgcaggtgtaagctaccactgcacctggccaacaacactgacttcttgcttgttccttgcctttccatccccaaaatcgttcccagggcctagtgtaatgcagggcaactagcaacacctctcaggcagagctgaagctgtggagaccaagcatcaaccaccttggctaatgcggctggcctgcctggggctggaggttgggaggggaggaaaanctacttgnacatcaatatcaccatgttcgggtttcgcatttaaggagaagggcctcctttgagaacggaatcctttttaaatgcccctccttggtttaaccacaacaacataggtaatttccggtttcaggaaggattttttttctggaaaggagacttttcaaggtaggcctggactattaggaaaagtggaaaacccccgttttgggggcctccccgggaactctttt

SEQ ID NO: 110716 - DNA, 367 bp, Homo sapiens
aatggagatggggtttcaccatgttggccaggctggtcttgaactcctgacctcaggtgatctgcccaacttggcctcccaaagtgctgggattgcaggtgtaagctaccactgcacctggccaacaacactgacttcttgcttgttccttgcctttccatccccaaaatcgttcccagggcctagtgtaatgcagggcaactagcaacacctctcaggcagagctgaagctgtggagaccaagcatcaaccaccttggctaatgcggctggcctgcctggggctggaggttgggaggggaggaagaggtggcagtaagtataagatcaccttcctccctgtgtgaccttcaaggggcaaccaccct

SEQ ID NO: 110717 - DNA, 433 bp, Homo sapiens
tgaaaatagttggaatgggggaggctgtcaaagtagattatagcgactcttcacgctggtatagttaagattgcgtcagctcttgaattgtggacccagtgagttctttagttttcttacctggcaatcactgtaggctgaactttggtaggggaataatctgaggcccatgtataaactagctttctagaggctctgaagaaaacatgaacagtgatctttgacaagtttggagtttaatcactgggagttgtgtttttaactcttgacaatttaagatctaaggctagttttgtttgtttgtttgtttgtttgtttgttttgttttgttttggagatgaagacttgcttcgttgcccaggctggagtgtagtgaaccgagatcgcaccactgcactccagcctgggcgacagagtgaaactccgactcaaa

SEQ ID NO: 110718 - DNA, 320 bp, Homo sapiens
agtagttgggactaataggtgtgcgtcaccatgcccaactgtttttttaatgttttaaaaacattaaaacacagccagacatggtggctcacacctgtaatcccagcactttgggaggccgaggcaggtggatcacgaggtcaggagatcgagaccatcctggctaacacggtgaaaccccgtctctactaaaaaatacaaaaaattagccgggtgtggtgacgggcacctgtagtcccagctacttgggaggctgaggcaggagaatggcgtgaacctgggaggtggagctggcagtgagccgagatcccgccactgca

SEQ ID NO: 110719 - DNA, 1785 bp, Homo sapiens
ggacgagtggccgactctggagcccaggctgttgcttcccagactggtggtgaatcctccatagtctgggacaaatatggccctgaaggctccatgagcagacgagaaggctggacttcgcaactgggtcaccttagatccggaactagagaatgacaccgttgtttccgggaggaaaaagaaaaagcgcttgacccggaagctgcgtgtcccatccccgcgcctgcttctctgactggggtgaggccgcagcggactgccctttcccaagatggcgtcgaagataggttcgagacggtggatgttgcagctgatcatgcagttgggttcggtgctgctcacacgctgccccttttggggctgcttcagccagctcatgctgtacgctgagagggctgaggcacgccggaagcccgacatcccagtgccttacctgtatttcgacatgggggcagccgtgctgtgcgctagtttcatgtcctttggcgtgaagcggcgctggttcgcgctgggggccgcactccaattggccattagcacctacgccgcctacatcgggggctacgtccactacggggactggctgaaggtccgtatgtactcgcgcacagttgccatcatcggcggctttcttgtgttggccagcggtgctggggagctgtaccgccggaaacctcgcagccgctccctgcagtccaccggccaggtgttcctgggtatctacctcatctgtgtggcctactcactgcagcacagcaaggaggaccggctggcgtatctgaaccatctcccaggaggggagctgatgatccagctgttcttcgtgctgtatggcatcctggccctggcctttctgtcaggctactacgtgaccctcgctgcccagatcctggctgtactgctgccccctgtcatgctgctcattgatggcaatgttgcttactggcacaacacgcggcgtgttgagttctggaaccagatgaagctccttggagagagtgtgggcatcttcggaactgctgtcatcctggccactgatggctgagttttatggcaagaggctgagatgggcacagggagccactgagggtcaccctgccttcctccttgctggcccagctgctgtttatttatgctttttggtctgtttgtttgatcttttgcttttttaaaattgttttttgcagttaagaggcagctcatttgtccaaatttctgggctcagcgcttgggagggcaggagccctggcactaatgctgtacaggtttttttcctgttaggagagctgaggccagctgcccactgagtctcctgtccctgagaagggagtatggcagggctgggatgcggctactgagagtgggagagtgggagacagaggaaggaagatggagattggaagtgagcaaatgtgaaaaattcctctttgaacctggcagatgcagctaggctctgcagtgctgtttggagactgtgagagggagtgtgtgtgttgacacatgtggatcaggcccaggaagggcacaggggctgagcactacagaagtcacatgggttctcagggtatgccaggggcagaaacagtaccggctctctgtcactcaccttgagagtagagcagaccctgttctgctctgggctgtgaaggggtggagcaggcagtggccagctttgcccttcctgctgtctctgtttctagctccatggttggcctggtgggggtggagttccctcccaaacaccagaccacacagtcctccaaaaataaacattttatatagaca

SEQ ID NO: 110720 - DNA, 2405 bp, Homo sapiens
ggacgagtggccgactctggagcccaggctgttgcttcccagactggtggtgaatcctccatagtctgggacaaatatggccctgaaggctccatgagcagacgagaaggctggacttcgcaactgggtcaccttagatccggaactagagaatgacaccgttgtttccgggaggaaaaagaaaaagcgcttgacccggaagctgcgtgtcccatccccgcgcctgcttctctgactggggtgaggccgcagcggactgccctttcccaagatggcgtcgaagataggttcgagacggtggatgttgcagctgatcatgcagttgggttcggtgctgctcacacgctgccccttttggggctgcttcagccagctcatgctgtacgctgagagggctgaggcacgccggaagcccgacatcccagtgccttacctgtatttcgacatgggggcagccgtgctgtgcgctagtttcatgtcctttggcgtgaagcggcgctggttcgcgctgggggccgcactccaattggccattagcacctacgccgcctacatcgggggctacgtccactacggggactggctgaaggtccgtatgtactcgcgcacagttgccatcatcggcggctttcttgtgttggccagcggtgctggggagctgtaccgccggaaacctcgcagccgctccctgcagtccaccggccaggtgttcctgggtatctacctcatctgtgtggcctactcactgcagcacagcaaggaggaccggctggcgtatctgaaccatctcccaggaggggagctgatgatccagctgttcttcgtgctgtatggcatcctggccctggcctttctgtcaggctactacgtgaccctcgctgcccagatcctggctgtactgctgccccctgtcatgctgctcattgatggcaatgttgcttactggcacaacacgcggcgtgttgagttctggaaccagatgaagctccttggagagagtgtgggcatcttcggaactgctgtcatcctggccactgatggctgagttttatggcaagaggctgagatgggcacagggagccactgagggtcaccctgccttcctccttgctggcccagctgctgtttatttatgctttttggtctgtttgtttgatcttttgcttttttaaaattgttttttgcagttaagaggcagctcatttgtccaaatttctgggctcagcgcttgggagggcaggagccctggcactaatgctgtacaggtttttttcctgttaggagagctgaggccagctgcccactgagtctcctgtccctgagaagggagtatggcagggctgggatgcggctactgagagtgggagagtgggagacagaggaaggaagatggagattggaagtgagcaaatgtgaaaaattcctctttgaacctggcagatgcagctaggctctgcagtgctgtttggagactgtgagagggagtgtgtgtgttgacacatgtggatcaggcccaggaagggcacaggggctgagcactacagaagtcacatgggttctcagggtatgccaggggcagaaacagtaccggctctctgtcactcaccttgagagtagagcagaccctgttctgctctgggctgtgaaggggtggagcaggcagtggccagctttgcccttcctgctgtctctgtttctagctccatggttggcctggtgggggtggagttccctcccaaacaccagaccacacagtcctccaaaaataaacattttatatagacaaaaaaaaaaaaaaaaaaaaaaaacaaaaaaaaaaaaaaaacaaaaaaaagaaacaccagaataacgagatgcaaagagaggagcacgcacagccacgaacagcaacgctaatcccatcagcaggagagaccagacctatacgtacacaccaacgcgagggacctgagcactgaaggacagcaccgaggggtgcaactccaggcgggtgccctgctttgactgaacagcgcgatgctgacacggccgtccgcactctcatacgatacttgcttgtggcgctgcagcggtcatcaacgcggagcctacatctgcggaggagtagatacatcatctatatccacctcatcactccacatcaataaactacttaacaaaaccaactccctcctaactacacacacaccaatacaacaaaattaatctcaaacacatatcacatacatccaattgcaattaaacctcaataacctcataatatacccatcgtattagatcatatacacaataacaacaccaaaaccaaactaaacaccacacgacaactacgaatgatcttaccaacaaacaagctaaagcaaacaccaaaacagctaataaacaaaacaataaagtcgacaaac

SEQ ID NO: 110721 - DNA, 2637 bp, Homo sapiens
ggacgagtggccgactctggagcccaggctgttgcttcccagactggtggtgaatcctccatagtctgggacaaatatggccctgaaggctccatgagcagacgagaaggctggacttcgcaactgggtcaccttagatccggaactagagaatgacaccgttgtttccgggaggaaaaagaaaaagcgcttgacccggaagctgcgtgtcccatccccgcgcctgcttctctgactggggtgaggccgcagcggactgccctttcccaagatggcgtcgaagataggttcgagacggtggatgttgcagctgatcatgcagttgggttcggtgctgctcacacgctgccccttttggggctgcttcagccagctcatgctgtacgctgagagggctgaggcacgccggaagcccgacatcccagtgccttacctgtatttcgacatgggggcagccgtgctgtgcgctagtttcatgtcctttggcgtgaagcggcgctggttcgcgctgggggccgcactccaattggccattagcacctacgccgcctacatcgggggctacgtccactacggggactggctgaaggtccgtatgtactcgcgcacagttgccatcatcggcggctttcttgtgttggccagcggtgctggggagctgtaccgccggaaacctcgcagccgctccctgcagtccaccggccaggtgttcctgggtatctacctcatctgtgtggcctactcactgcagcacagcaaggaggaccggctggcgtatctgaaccatctcccaggaggggagctgatgatccagctgttcttcgtgctgtatggcatcctggccctggcctttctgtcaggctactacgtgaccctcgctgcccagatcctggctgtactgctgccccctgtcatgctgctcattgatggcaatgttgcttactggcacaacacgcggcgtgttgagttctggaaccagatgaagctccttggagagagtgtgggcatcttcggaactgctgtcatcctggccactgatggctgagttttatggcaagaggctgagatgggcacagggagccactgagggtcaccctgccttcctccttgctggcccagctgctgtttatttatgctttttggtctgtttgtttgatcttttgcttttttaaaattgttttttgcagttaagaggcagctcatttgtccaaatttctgggctcagcgcttgggagggcaggagccctggcactaatgctgtacaggtttttttcctgttaggagagctgaggccagctgcccactgagtctcctgtccctgagaagggagtatggcagggctgggatgcggctactgagagtgggagagtgggagacagaggaaggaagatggagattggaagtgagcaaatgtgaaaaattcctctttgaacctggcagatgcagctaggctctgcagtgctgtttggagactgtgagagggagtgtgtgtgttgacacatgtggatcaggcccaggaagggcacaggggctgagcactacagaagtcacatgggttctcagggtatgccaggggcagaaacagtaccggctctctgtcactcaccttgagagtagagcagaccctgttctgctctgggctgtgaaggggtggagcaggcagtggccagctttgcccttcctgctgtctctgtttctagctccatggttggcctggtgggggtggagttccctcccaaacaccagaccacacagtcctccaaaaataaacattttatatagacatttggttttgcttttctgttctccccaacagggaactctgccattggctgggattgatcttgggtttcttgaaacactagatctggtcaagccccaccttgggcctcccgtgatctttcccctgttccaagatttcccacagttctttggctctctctcttttttttttttaatttttcacttctttattttttagagacaaggtctcactttgttgtccaggctggtttcagactccttggctcaagtgattctccagcctcagcctcagcctcccaaagtgctgggactacaggcatgagccactgtgcccagtggctctctttttcaagaatctcaaaatcctcattgtactatatgctttcaatccctcacctcagtccctcttgttgtaggttgtctttttctccccatttggagctggttcttatgaagacatctttggtgagagcagctagagggagagaactgtgaagtgtccactgtgaagtggaatattttacactttatacatgaaggaaatggaggctcagagaggataagcagtttcggtcaagccacagagcaaatccagcccacagagctggattccaggtcaggtctgtctaatggtgaagtccagatatgtactcactgtgacccatctcctgaggggagacagaggctgctctattccagcccctactgtgccatgatggtctccctgttgaccttctccctttttttttgagacggagtcttgctctgtcacctaggctggagtgctgtggcgtgatctctgctcactgcaagctccgcttcccgggttcatgccattctcctgcctcagcctcccgagtagctgggactacg

SEQ ID NO: 110722 - DNA, 1734 bp, Homo sapiens
ggacgagtggccgactctggagcccaggctgttgcttcccagactggtggtgaatcctccatagtctgggacaaatatggccctgaaggctccatgagcagacgagaaggctggacttcgcaactgggtcaccttagatccggaactagagaatgacaccgttgtttccgggaggaaaaagaaaaagcgcttgacccggaagctgcgtgtcccatccccgcgcctgcttctctgactggggtgaggccgcagcggactgccctttcccaagatggcgtcgaagataggttcgagacggtggatgttgcagctgatcatgcagttgggttcggtgctgctcacacgctgccccttttggggctgcttcagccagctcatgctgtacgctgagagggctgaggcacgccggaagcccgacatcccagtgccttacctgtatttcgacatgggggcagccgtgctgtgcgctagtttcatgtcctttggcgtgaagcggcgctggttcgcgctgggggccgcactccaattggccattagcacctacgccgcctacatcgggggctacgtccactacggggactggctgaaggtccgtatgtactcgcgcacagttgccatcatcggcggctttcttgtgttggccagcggtgctggggagctgtaccgccggaaacctcgcagccgctccctgcagtccaccggccaggtgttcctgggtatctacctcatctgtgtggcctactcactgcagcacagcaaggaggaccggctggcgtatctgaaccatctcccaggaggggagctgatgatccagctgttcttcgtgctgtatggcatcctggccctggcctttctgtcaggctactacgtgaccctcgctgcccagatcctggctgtactgctgccccctgtcatgctgctcattgatggcaatgttgcttactggcacaacacgcggcgtgttgagttctggaaccagatgaagctccttggagagagtgtgggcatcttcggaactgctgtcatcctggccactgatggctgagttttatggcaagaggctgagatgggcacagggagccactgagggtcaccctgccttcctccttgctggcccagctgctgtttatttatgctttttggtctgtttgtttgatcttttgcttttttaaaattgttttttgcagttaagaggcagctcatttgtccaaatttctgggctcagcgcttgggagggcaggagccctggcactaatgctgtacaggtttttttcctgttaggagagctgaggccagctgcccactgagtctcctgtccctgagaagggagtatggcagggctgggatgcggctactgagagtgggagagtgggagacagaggaaggaagatggagattggaagtgagcaaatgtgaaaaattcctctttgaacctggcagatgcagctaggctctgcagtgctgtttggagactgtgagagggagtgtgtgtgttgacacatgggttctcagggtatgccaggggcagaaacagtaccggctctctgtcactcaccttgagagtagagcagaccctgttctgctctgggctgtgaaggggtggagcaggcagtggccagctttgcccttcctgctgtctctgtttctagctccatggttggcctggtgggggtggagttccctcccaaacaccagaccacacagtcctccaaaaataaacattttatatagaca

SEQ ID NO: 110723 - DNA, 1664 bp, Homo sapiens
ggacgagtggccgactctggagcccaggctgttgcttcccagactggtggtgaatcctccatagtctgggacaaatatggccctgaaggctccatgagcagacgagaaggctggacttcgcaactgggtcaccttagatccggaactagagaatgacaccgttgtttccgggaggaaaaagaaaaagcgcttgacccggaagctgcgtgtcccatccccgcgcctgcttctctgactggggtgaggccgcagcggactgccctttcccaagatggcgtcgaagataggaagcccgacatcccagtgccttacctgtatttcgacatgggggcagccgtgctgtgcgctagtttcatgtcctttggcgtgaagcggcgctggttcgcgctgggggccgcactccaattggccattagcacctacgccgcctacatcgggggctacgtccactacggggactggctgaaggtccgtatgtactcgcgcacagttgccatcatcggcggctttcttgtgttggccagcggtgctggggagctgtaccgccggaaacctcgcagccgctccctgcagtccaccggccaggtgttcctgggtatctacctcatctgtgtggcctactcactgcagcacagcaaggaggaccggctggcgtatctgaaccatctcccaggaggggagctgatgatccagctgttcttcgtgctgtatggcatcctggccctggcctttctgtcaggctactacgtgaccctcgctgcccagatcctggctgtactgctgccccctgtcatgctgctcattgatggcaatgttgcttactggcacaacacgcggcgtgttgagttctggaaccagatgaagctccttggagagagtgtgggcatcttcggaactgctgtcatcctggccactgatggctgagttttatggcaagaggctgagatgggcacagggagccactgagggtcaccctgccttcctccttgctggcccagctgctgtttatttatgctttttggtctgtttgtttgatcttttgcttttttaaaattgttttttgcagttaagaggcagctcatttgtccaaatttctgggctcagcgcttgggagggcaggagccctggcactaatgctgtacaggtttttttcctgttaggagagctgaggccagctgcccactgagtctcctgtccctgagaagggagtatggcagggctgggatgcggctactgagagtgggagagtgggagacagaggaaggaagatggagattggaagtgagcaaatgtgaaaaattcctctttgaacctggcagatgcagctaggctctgcagtgctgtttggagactgtgagagggagtgtgtgtgttgacacatgtggatcaggcccaggaagggcacaggggctgagcactacagaagtcacatgggttctcagggtatgccaggggcagaaacagtaccggctctctgtcactcaccttgagagtagagcagaccctgttctgctctgggctgtgaaggggtggagcaggcagtggccagctttgcccttcctgctgtctctgtttctagctccatggttggcctggtgggggtggagttccctcccaaacaccagaccacacagtcctccaaaaataaacattttatatagaca

SEQ ID NO: 110724 - DNA, 1617 bp, Homo sapiens
ggacgagtggccgactctggagcccaggctgttgcttcccagactggtggtgaatcctccatagtctgggacaaatatggccctgaaggctccatgagcagacgagaaggctggacttcgcaactgggtcaccttagatccggaactagagaatgacaccgttgtttccgggaggaaaaagaaaaagcgcttgacccggaagctgcgtgtcccatccccgcgcctgcttctctgactggggaagcccgacatcccagtgccttacctgtatttcgacatgggggcagccgtgctgtgcgctagtttcatgtcctttggcgtgaagcggcgctggttcgcgctgggggccgcactccaattggccattagcacctacgccgcctacatcgggggctacgtccactacggggactggctgaaggtccgtatgtactcgcgcacagttgccatcatcggcggctttcttgtgttggccagcggtgctggggagctgtaccgccggaaacctcgcagccgctccctgcagtccaccggccaggtgttcctgggtatctacctcatctgtgtggcctactcactgcagcacagcaaggaggaccggctggcgtatctgaaccatctcccaggaggggagctgatgatccagctgttcttcgtgctgtatggcatcctggccctggcctttctgtcaggctactacgtgaccctcgctgcccagatcctggctgtactgctgccccctgtcatgctgctcattgatggcaatgttgcttactggcacaacacgcggcgtgttgagttctggaaccagatgaagctccttggagagagtgtgggcatcttcggaactgctgtcatcctggccactgatggctgagttttatggcaagaggctgagatgggcacagggagccactgagggtcaccctgccttcctccttgctggcccagctgctgtttatttatgctttttggtctgtttgtttgatcttttgcttttttaaaattgttttttgcagttaagaggcagctcatttgtccaaatttctgggctcagcgcttgggagggcaggagccctggcactaatgctgtacaggtttttttcctgttaggagagctgaggccagctgcccactgagtctcctgtccctgagaagggagtatggcagggctgggatgcggctactgagagtgggagagtgggagacagaggaaggaagatggagattggaagtgagcaaatgtgaaaaattcctctttgaacctggcagatgcagctaggctctgcagtgctgtttggagactgtgagagggagtgtgtgtgttgacacatgtggatcaggcccaggaagggcacaggggctgagcactacagaagtcacatgggttctcagggtatgccaggggcagaaacagtaccggctctctgtcactcaccttgagagtagagcagaccctgttctgctctgggctgtgaaggggtggagcaggcagtggccagctttgcccttcctgctgtctctgtttctagctccatggttggcctggtgggggtggagttccctcccaaacaccagaccacacagtcctccaaaaataaacattttatatagaca

SEQ ID NO: 110725 - DNA, 927 bp, Homo sapiens
tcagggcacaggcaaaaggcaaacccaaagaggtgactttgagccaggaggaccccttactttgatcttaacagaaacgggggtttcctctggtgcgttatgtgtatcatttattgaaccaatgaagctccttggagagagtgtgggcatcttcggaactgctgtcatcctggccactgatggctgagttttatggcaagaggctgagatgggcacagggagccactgagggtcaccctgccttcctccttgctggcccagctgctgtttatttatgctttttggtctgtttgtttgatcttttgcttttttaaaattgttttttgcagttaagaggcagctcatttgtccaaatttctgggctcagcgcttgggagggcaggagccctggcactaatgctgtacaggtttttttcctgttaggagagctgaggccagctgcccactgagtctcctgtccctgagaagggagtatggcagggctgggatgcggctactgagagtgggagagtgggagacagaggaaggaagatggagattggaagtgagcaaatgtgaaaaattcctctttgaacctggcagatgcagctaggctctgcagtgctgtttggagactgtgagagggagtgtgtgtgttgacacatgtggatcaggcccaggaagggcacaggggctgagcactacagaagtcacatgggttctcagggtatgccaggggcagaaacagtaccggctctctgtcactcaccttgagagtagagcagaccctgttctgctctgggctgtgaaggggtggagcaggcagtggccagctttgcccttcctgctgtctctgtttctagctccatggttggcctggtgggggtggagttccctcccaaacaccagaccacacagtcctccaaaaataaacattttatatagaca

SEQ ID NO: 110726 - DNA, 1243 bp, Homo sapiens
ggacgagtggccgactctggagcccaggctgttgcttcccagactggtggtgaatcctccatagtctgggacaaatatggccctgaaggctccatgagcagacgagaaggctggacttcgcaactgggtcaccttagatccggaactagagaatgacaccgttgtttccgggaggaaaaagaaaaagcgcttgacccggaagctgcgtgtcccatccccgcgcctgcttctctgactggggtgaggccgcagcggactgccctttcccaagatggcgtcgaagataggttcgagacggtggatgttgcagctgatcatgcagttgggttcggtgctgctcacacgctgccccttttggggctgcttcagccagctcatgctgtacgctgagagggctgaggcacgccggaagcccgacatcccagtgccttacctgtatttcgacatgggggcagccgtgctgtgcgctagtttcatgtcctttggcgtgaagcggcgctggttcgcgctgggggccgcactccaattggccattagcacctacgccgcctacatcgggggctacgtccactacggggactggctgaaggtccgtatgtactcgcgcacagttgccatcatcggcggctttcttgtgttggccagcggtgctggggagctgtaccgccggaaacctcgcagccgctccctgcagtccaccggccaggtgttcctgggtatctacctcatctgtgtggtatgttgggggactgttggttggaggtgcctggctgggagtgaactgtgagtctaggcatggcagaaccccaggaaggtagacacagaacgaggccctgagtgcagttcctgatggcccagttccctgggaattgccctggccagcttctaggcctcaggggccctccaaatgcctgttgagaggcccttcctccaacagtgttgccacgaggtagactggccattaaatttcaaccctgagagccaggagaacaagatggggtgattctctcatggctccagcccccaaaggactagaaggggataaaggagaggtttggtgggggtcaggccccagctgggactctgccccctagagctgatgagagctctagggtagccacttatggttctccctggtgctaggggaggccagggtgactggagacatggacaggcgccaggccattaggtcttatcttaattaccgagtatatctctgtacagctctctgtgtgggctccca

SEQ ID NO: 110727 - DNA, 1802 bp, Homo sapiens
ggacgagtggccgactctggagcccaggctgttgcttcccagactggtggtgaatcctccatagtctgggacaaatatggccctgaaggctccatgagcagacgagaaggctggacttcgcaactgggtcaccttagatccggaactagagaatgacaccgttgtttccgggaggaaaaagaaaaagcgcttgacccggaagctgcgtgtcccatccccgcgcctgcttctctgactggggtgaggccgcagcggactgccctttcccaagatggcgtcgaagataggttcgagacggtggatgttgcagctgatcatgcagttgggttcggtgctgctcacacgctgccccttttggggctgcttcagccagctcatgctgtacgctgagagggctgaggcacgccggaagcccgacatcccagtgccttacctgtatttcgacatgggggcagccgtgctgtgcgctagtttcatgtcctttggcgtgaagcggcgctggttcgcgctgggggccgcactccaattggccattagcacctacgccgcctacatcgggggctacgtccactacggggactggctgaaggtccgtatgtactcgcgcacagttgccatcatcggcggctttcttgtgttggccagcggtgctggggagctgtaccgccggaaacctcgcagccgctccctgcagtccaccggccaggtgttcctgggtatctacctcatctgtgtggcctactcactgcagcacagcaaggaggaccggctggcgtatctgaaccatctcccaggaggggagctgatgatccagctgttcttcgtgctgtatggcatcctggccctggcctttctgtcaggctactacgtgaccctcgctgcccagatcctggctgtactgctgccccctgtcatgctgctcattgatggcaatgttgcttactggcacaacacgcggcgtgttgagttctggaaccagatgaagctccttggagagagtgtgggcatcttcggaactgctgtcatcctggccactgatggctgagttttatggcaagaggctgagatgggcacagggagccactgagggtcaccctgccttcctccttgctggcccagctgctgtttatttatgctttttggtctgtttgtttgatcttttgcttttttaaaattgtttttaaaaaaaaaaaaaaaaaaaaaaacaaaaaaaaaaaaaaaacaaaaaaaagaaacaccagaataacgagatgcaaagagaggagcacgcacagccacgaacagcaacgctaatcccatcagcaggagagaccagacctatacgtacacaccaacgcgagggacctgagcactgaaggacagcaccgaggggtgcaactccaggcgggtgccctgctttgactgaacagcgcgatgctgacacggccgtccgcactctcatacgatacttgcttgtggcgctgcagcggtcatcaacgcggagcctacatctgcggaggagtagatacatcatctatatccacctcatcactccacatcaataaactacttaacaaaaccaactccctcctaactacacacacaccaatacaacaaaattaatctcaaacacatatcacatacatccaattgcaattaaacctcaataacctcataatatacccatcgtattagatcatatacacaataacaacaccaaaaccaaactaaacaccacacgacaactacgaatgatcttaccaacaaacaagctaaagcaaacaccaaaacagctaataaacaaaacaataaagtcgacaaac

SEQ ID NO: 110728 - DNA, 976 bp, Homo sapiens
ggacgagtggccgactctggagcccaggctgttgcttcccagactggtggtgaatcctccatagtctgggacaaatatggccctgaaggctccatgagcagacgagaaggctggacttcgcaactgggtcaccttagatccggaactagagaatgacaccgttgtttccgggaggaaaaagaaaaagcgcttgacccggaagctgcgtgtcccatccccgcgcctgcttctctgactggggtgaggccgcagcggactgccctttcccaagatggcgtcgaagataggttcgagacggtggatgttgcagctgctgtttatttatgctttttggtctgtttgtttgatcttttgcttttttaaaattgttttttgcagttaagaggcagctcatttgtccaaatttctgggctcagcgcttgggagggcaggagccctggcactaatgctgtacaggtttttttcctgttaggagagctgaggccagctgcccactgagtctcctgtccctgagaagggagtatggcagggctgggatgcggctactgagagtgggagagtgggagacagaggaaggaagatggagattggaagtgagcaaatgtgaaaaattcctctttgaacctggcagatgcagctaggctctgcagtgctgtttggagactgtgagagggagtgtgtgtgttgacacatgtggatcaggcccaggaagggcacaggggctgagcactacagaagtcacatgggttctcagggtatgccaggggcagaaacagtaccggctctctgtcactcaccttgagagtagagcagaccctgttctgctctgggctgtgaaggggtggagcaggcagtggccagctttgcccttcctgctgtctctgtttctagctccatggttggcctggtgggggtggagttccctcccaaacaccagaccacacagtcctccaaaaataaacattttatatagaca

SEQ ID NO: 110729 - DNA, 1034 bp, Homo sapiens
gtctggactgctggccagttagcgggcacagaggcctgtgttcatccacgacccacttcccgggtttcccattcatgtgggcgctgtgattcccagtgacttctcttggcagagagagagtgagttgaaatgtcgagctctgaggtgagttggggcccagcatatgtagaacctgcgttgtgtcattcccacagagttgacacactcattttattagtgtcagtccccagcttttgctgttcagtttgggattttttgactttacaatgatgcaaaagcaatgcacattcaggagaaatcacactttgaatacccaaacaaccattctgtttttcactttcagtacagcattcagcaaattcatgagagagtcaccatttattacaaaacaggctttgatcctttgatcccagcacttctggaggccaaggcgggaggattgtttgaggctgggagtttgaaaccagcctggggaacaaaatagggaccccatctctccaaaaatttaaaaattagacaggtgtggtgacatgtgcctgtagtcctagctactcggttggctgaggagggacggtcgcttgagcccaagaggagaggctgcagtgagctatgacaccactacactccaacctcggtgacagaatgagaccctgtctcttaaaaaaaaattaaataaaataggctttgcattagatgattttgcccaactataggctaatgtagtaacacttaaggcagaataggctaagctgcaatgttcggtgccttagctgtagttgatgcgtttttgacttcacgatattttcaacctgacgatgggtttatcaggacataaccccatcgtaagtcaaggagcatctgtagtagtgttgttaccattaaaaaaaaaaaagccaaaacatacaaaaagtcacctaatagtgaaaccaaaacaaccctcttgcacagggaatgaaaaggatgggaactctctagaacataggcagccccccgcaccccccgacatcttatagtgggctagcacttgcccagca

SEQ ID NO: 110730 - DNA, 5397 bp, Homo sapiens
  misc_feature (2)..(2): n is a, c, g, or t
gncgcggaggcggatgggcgcggctccctcccccactcaggcctcttcacggggcggggggccgggtcccccagcccccacccgcgccgtgtccagctcctcgcgtgctcgcggcggagccctgagcgcactgggtccgagtcctgcgcgccccctcaccacctcccccgcacctgctcctcctcctcggtcccgcccagcgcgccagcagcccgatccccagtgctgggagaagagagggggcgcaggcggcgacacaaagggtggagcggcgggaccgggacccgggaggctgcgcggcatggacgccgagtaccctgcctttgagcccccgctctgcagcgagctcaagcacctgtgccggcggctgcgggaagcgtaccgcgagctcaaggaggacctcacgcccttcaaggatgaccgctactacaggctggcgcccatgcggctctacacgctctccaagcgccactttgtcctcgtgtttgtcgtcttcttcatctgctttggcctgaccatcttcgttgggatcagaggacctaaagtgatccagacttctgcggctaatttttcactaaataatagcaaaaagctaaagccaattcaaatactttcaaatccactgtctacatacaatcagcaactatggctgacatgtgttgttgagttggatcaatcaaaagaaacttctattaagacaagctttcccatgactgttaaagtcgatggtgtagctcaagatggaaccacgatgtacattcataacaaagttcacaaccggacaaggaccctcacatgtgcagggaaatgtgcggagattattgtggctcaccttggctacctgaactacactcagtatacagtgatagtgggatttgaacacctgaagctccccatcaagggaatgaacttcacatggaagacttataaccctgccttctcccggttggaaatctggttccggtttttctttgtggtgctcaccttcatcgtcacttgcctgtttgcgcattccctccggaaattttccatgagagactggggcatcgagcagaagtggatgtctgttctcctgcctctgctgctactttacaatgatccgttcttccccctctccttcctggtcaacagctggctcccagggatgctggatgacctctttcagtccatgttcctgtgcgccctgctgctcttctggctgtgcgtgtaccacgggattcgtgtccagggagaaagaaagtgtttaactttctatttgcctaaattcttcattgttggactattgtggttggcttctgttacgctaggaatatggcaaacagttaacgaattacatgatccaatgtaccagtatcgagttgataccggaaattttcagggaatgaaggtcttcttcatggtggtggcagcggtgtacattctgtacctcttgttcttgatagtgcgggcgtgttccgagctacgtcacatgccttatgtggatctcaggttgaaatttttgactgcattgactttcgtagtacttgtcattagcatcgccatcctttatttgagatttggggcgcaagtactacaagacaattttgtagcagagctgtcaactcactaccagaattcagccgagttcttatctttctatggcctgttgaacttctatctctacaccttggcctttgtatattctccatcgaagaatgccctctatgagtcccagctgaaagacaatcctgccttctccatgctgaatgactcggatgatgatgtgatttatgggagtgactatgaggaaatgccgctgcagaacggccaggccatccgggccaagtacaaggaggagtcagatagtgactgagccccggccagcccagcgaggcgacaagatgcctggatgctttccccggtgaccgtctgctgaccttcccctgttatattcagatttttcttacaagcagagatttcctgttcatttgtttacatatttttttaaaggaaaaccaaaactgagggtaaatttaaatgtttagccaaatttattgtcatggtggctacgagaagaggcattgataacaagtttcaacagccaaatccttttttacagagatttcagatgagcgtgttttcagtgatgaggaaatttcacgtttttagtacagtgaattatgtacttttttttcctgtaatcattcactgattccaagttcacgggcagcctgtgactaggtcctcagcgtgacagcatcaccctctttcttcccttttccatggtactgttttgtgaccctttaaactcaaagggaagccttatctgtggctgcttcagggcagtccttcctcgttgagtggccagtgccctgggtaaccaggtggctgaagtgattggtcagttatgtggactgcgttttgtgcagtgtgtgagttatgactcatcgggaatgggagatgctggggttccaacccttcacgtcaccaaaggggaagtaatagtgtggagttctgaggagggtttgataagttgaataaggaaaggctaagataatttacaggttaccaactcatgtggggaaggtcttactgccatggtgcttttcaggggcctgtgtgtacacacatgattaaatggatttgcctgtgggaggtatgggcaggagaggaacccttaccattccagtaaatagcagtttctgcaattctgttgaatatgaaatgccatagagctttatttatttatgtaagtaaaagctaaatgaggggccaggtgcagtggctcacatctgtaatctcaacactttgggaggccaaggtgggaggatcacttgagcccaggagtttgagaccagcctgggcaacacagggagaccccgtctctataaaacatttagaaagttggctgggcatgctggggcatgcccatagtcccagctactcaggaggctgaggtgggaggattgcttgagccctggaggtcaaggctgcagtgagccatgattgcaccactgcactccagcctgggtgtcagagcgagaacccgtgtcataaataaataaagctacatgaaagattgatagaatattttagattatttattggccaaaagtttttaaaactcatatttggaagcaaaatgaaaagcaagtaaaatgttttaaatggttcatggaaaacgtatttgggtagaaggcaactcgtgcttccggaaggggttccctgtcctccatgtgtccacatggcggtcaggtagggacgacctgttctgtaaagtccttggcactgctgaatctgtggcatcatagaaggccctggagcttccccgttcctttcagtcagggactccatatagagtctcatgtggacgtctcccgtgctttcctcttgacctctacagtcacacttctgttaacatctggtaactgtgggcaacctgactgatgccgtcttggcaattgaggtccagaagatgatagttccgcaacgcaagcagtacctactttttttcttcatctatgcattgactctcagattaccatgcagagcttcacgttatcatccacgttaagtagtgctaggtaggaccttagagatgttcatgagaaactatttgttatgactttcctttgtatctttccttttaatttaaactttaatgataatgtacttttaatatggattctattcacatttgttttaaaaaccttgtaaatatgaatgtttaagacaacttactgcaagggtaattcaagtttacatgatttttaaatttgcaatgatgttttttttattctgtgtattgaaaaaaattttctgttaccaaattttacaacttctaataagactactataactttatgtaaactgatgaagatgtgctgattaacatattctgtgatatggtttacaacttttaatcataattgtccatgattttggaatgctgttatttatcagtaaatgtaaaatatttgaggcatttagccatacacacactagaactttttaaaactttgtcctatagtgtaattataaactgatgactattatcttcatacattgagtcttcatgcatcaatgaaatgaaaaatataggattatttatttactttttgtaactaagtgggaaataagaaaaaaagttagaaagtacttaaggggaaaatcgttcttactaagtcatgtattttcaacttgtcttccctggtatatcataaataccgacatattacataccccatgtaaaattttgcttaaactctctagcacttggcatgtagaatatgtaccataggtatcaggttaaaacactaaagtctgccagaaacttttgacagtagcaagaaaattgttgaagaaaaaataaattatttactgagggtagttatgttaaagttttgcgaacttaaagggctgactttagttccttcatggtaatggcttgagtaacatcatctttgggattttttaaatactggtccagtctaggagaacctggaagatgaccagaggtatttcagtttccctagggagagcttcgttatccatgtggatgataagtctgcttgatttattattaaatcattatagcagtgaagtggtgccattttctctctcttaagccccatttgaaaggctagagaaggggatatatatactatgttcaaggtttgtaaggttgttaatgtacataattgcagattgcaataaaagcttagatacattttgtaaacccaacccactaaatgagcaggttacaagacaaatgtcaccagcctcaagtattttatgaactatttactgagggtagttatgttaaatagattataatgtggtaaattatttcctgaatcctttatcacaggaaaaacacagaccctcataaaagggataattaaaacggatgtgtctgaacatttagtgaagatgagacttaaaacatgaaagtgtatttgtgtattttgagggttttagaaaccggttgccttagaggttagacttttgaagaaaaaaaaaaaaagatacagatcttttcccctggccaaagggaagttgtattagtctgtgacatcttgtgatgctgtttatcttggtttgacattggagatacgctagtaactgtgataccatactataaaacagaagaattttctgctactaaaaactgcctttttacaaaatgactgtaaatatttgtaaaataaaataacactaaactttaagcccaaaaggagagatagagccatgtgttcagttgtggacctgtccgtggggcacagtgccaccccatcacagtgttgctgtcatcaggcaaaagtgaatgtttgtttatggcaaattcgtcttttgcgaatggcttaattctgacactacctttctgggaaatgttaataaatttttaatattcaaatc

SEQ ID NO: 110731 - DNA, 416 bp, Homo sapiens
tcgtgttgcacagcagagtggatattctgtgtctgtgtttgtgtgtttatatcttctacttacacattgtataatctctaaagaaaaaccaggtgaattaaggtcatctccgtgtaatgtgtgagtctttcttggaatttggaaaaaaatactaaattatcaatattgctataatctgcttttgtccttttctgttacactttaggacctaaagtgatccagacttctgcggctaatttttcactaaataatagcaaaaaggtaagactgggtctgagtggcagctgggtggtggggtgcattataaacctcaggtcactgagaaatggttccgcttagagtctttaaggtagccttcccttgccttgcggcttctcaggcaacacgaatgagtgcaacacgaataagggtaccga

SEQ ID NO: 110732 - DNA, 455 bp, Homo sapiens
aagagacctttgagaccgtctaacttctgacagctctttattttcctcttccacactgacacaccattccagcgggaattaaatcatagcttcgctctttcaattttctatcaccaactgcttctgctcaccccgtcctcctctccctgacccccagttcccagggcccatcagtccagaaagcacagttcttcccgtggccttcctgcccttttcatgtaacttgatctcttctggccctgccctcggtgctggtgacaggagcgccaccagatggctcagtgggtccaggtttccactgatgtgagaggccatagttcacctgttatttactgtgacctcgaagagtgcttgtgacccctggctgtgggcttgaactgtggagtcctgacgtctgggtaatggacccccgggcactggcgggtgcttggcactagaaggggctgctgatggcg

SEQ ID NO: 110733 - DNA, 2317 bp, Homo sapiens
ttcatttcgcttccaaatatgaaaagcaagtaaaatgttttccatgaaccatttaaaatgttttaaatggttcatggaaaacgtatttgggtagaaggcaactcgtgcttccggaaggggttccctgtcctccatgtgtccacatggcggtcaggtagggacgacctgttctgtaaagtccttggcactgctgaatctgtggcatcatagaaggccctggagcttccccgttcctttcagtcagggactccatatagagtctcatgtggacgtctcccgtgctttcctcttgacctctacagtcacacttctgttaacatctggtaactgtgggcaacctgactgatgccgtcttggcaattgaggtccagaagatgatagttccgcaacgcaagcagtacctactttttttcttcatctatgcattgactctcagattaccatgcagagcttcacgttatcatccacgttaagtagtgctaggtaggaccttagagatgttcatgagaaactatttgttatgactttcctttgtatctttccttttaatttaaactttaatgataatgtacttttaatatggattctattcacatttgttttaaaaaccttgtaaatatgaatgtttaagacaacttactgcaagggtaattcaagtttacatgatttttaaatttgcaatgatgttttttttattctgtgtattgaaaaaaattttctgttaccaaattttacaacttctaataagactactataactttatgtaaactgatgaagatgtgctgattaacatattctgtgatatggtttacaacttttaatcataattgtccatgattttggaatgctgttatttatcagtaaatgtaaaatatttgaggcatttagccatacacacactagaactttttaaaactttgtcctatagtgtaattataaactgatgactattatcttcatacattgagtcttcatgcatcaatgaaatgaaaaatataggattatttatttactttttgtaactaagtgggaaataagaaaaaaagttagaaagtacttaaggggaaaatcgttcttactaagtcatgtattttcaacttgtcttccctggtatatcataaataccgacatattacataccccatgtaaaattttgcttaaactctctagcacttggcatgtagaatatgtaccataggtatcaggttaaaacactaaagtctgccagaaacttttgacagtagcaagaaaattgttgaagaaaaaataaattatttactgagggtagttatgttaaagttttgcgaacttaaagggctgactttagttccttcatggtaatggcttgagtaacatcatctttgggattttttaaatactggtccagtctaggagaacctggaagatgaccagaggtatttcagtttccctagggagagcttcgttatccatgtggatgataagtctgcttgatttattattaaatcattatagcagtgaagtggtgccattttctctctcttaagccccatttgaaaggctagagaaggggatatatatactatgttcaaggtttgtaaggttgttaatgtacataattgcagattgcaataaaagcttagatacattttgtaaacccaacccactaaatgagcaggttacaagacaaatgtcaccagcctcaagtattttatgaactatttactgagggtagttatgttaaatagattataatgtggtaaattatttcctgaatcctttatcacaggaaaaacacagaccctcataaaagggataattaaaacggatgtgtctgaacatttagtgaagatgagacttaaaacatgaaagtgtatttgtgtattttgagggttttagaaaccggttgccttagaggttagacttttgaagaaaaaaaaaaaaagatacagatcttttcccctggccaaagggaagttgtattagtctgtgacatcttgtgatgctgtttatcttggtttgacattggagatacgctagtaactgtgataccatactataaaacagaagaattttctgctactaaaaactgcctttttacaaaatgactgtaaatatttgtaaaataaaataacactaaactttaagcccaaaaggagagatagagccatgtgttcagttgtggacctgtccgtggggcacagtgccaccccatcacagtgttgctgtcatcaggcaaaagtgaatgtttgtttatggcaaattcgtcttttgcgaatggcttaattctgacactacctttctgggaaatgttaataaatttttaatattcaaatc

SEQ ID NO: 110734 - DNA, 810 bp, Homo sapiens
caaaagtctaacctctaaggtaaccggtttctaaaaccctcaaaatacacaaatactatgttcaaggtttgtaaggttgttaatgtacataattgcagattgcaataaaagcttagatacattttgtaaacccaacccactaaatgagcaggttacaagacaaatgtcaccagcctcaagtattttatgaactatttactgagggtagttatgttaaatagattataatgtggtaaattatttcctgaatcctttatcacaggaaaaacacagaccctcataaaagggataattaaaacggatgtgtctgaacatttagtgaagatgagacttaaaacatgaaagtgtatttgtgtattttgagggttttagaaaccggttgccttagaggttagacttttgaagaaaaaaaaaaaaagatacagatcttttcccctggccaaagggaagttgtattagtctgtgacatcttgtgatgctgtttatcttggtttgacattggagatacgctagtaactgtgataccatactataaaacagaagaattttctgctactaaaaactgcctttttacaaaatgactgtaaatatttgtaaaataaaataacactaaactttaagcccaaaaggagagatagagccatgtgttcagttgtggacctgtccgtggggcacagtgccaccccatcacagtgttgctgtcatcaggcaaaagtgaatgtttgtttatggcaaattcgtcttttgcgaatggcttaattctgacactacctttctgggaaatgttaataaatttttaatattcaaatc

SEQ ID NO: 110735 - DNA, 5798 bp, Homo sapiens
  misc_feature (2)..(2): n is a, c, g, or t
  misc_feature (5538)..(5538): n is a, c, g, or t
gncgcggaggcggatgggcgcggctccctcccccactcaggcctcttcacggggcggggggccgggtcccccagcccccacccgcgccgtgtccagctcctcgcgtgctcgcggcggagccctgagcgcactgggtccgagtcctgcgcgccccctcaccacctcccccgcacctgctcctcctcctcggtcccgcccagcgcgccagcagcccgatccccagtgctgggagaagagagggggcgcaggcggcgacacaaagggtggagcggcgggaccgggacccgggaggctgcgcggcatggacgccgagtaccctgcctttgagcccccgctctgcagcgagctcaagcacctgtgccggcggctgcgggaagcgtaccgcgagctcaaggaggacctcacgcccttcaaggatgaccgctactacaggctggcgcccatgcggctctacacgctctccaagcgccactttgtcctcgtgtttgtcgtcttcttcatctgctttggcctgaccatcttcgttgggatcagaggacctaaagtgatccagacttctgcggctaatttttcactaaataatagcaaaaagctaaagccaattcaaatactttcaaatccactgtctacatacaatcagcaactatggctgacatgtgttgttgagttggatcaatcaaaagaaacttctattaagacaagctttcccatgactgttaaagtcgatggtgtagctcaagatggaaccacgatgtacattcataacaaagttcacaaccggacaaggaccctcacatgtgcagggaaatgtgcggagattattgtggctcaccttggctacctgaactacactcagtatacagtgatagtgggatttgaacacctgaagctccccatcaagggaatgaacttcacatggaagacttataaccctgccttctcccggttggaaatctggttccggtttttctttgtggtgctcaccttcatcgtcacttgcctgtttgcgcattccctccggaaattttccatgagagactggggcatcgagcagaagtggatgtctgttctcctgcctctgctgctactttacaatgatccgttcttccccctctccttcctggtcaacagctggctcccagggatgctggatgacctctttcagtccatgttcctgtgcgccctgctgctcttctggctgtgcgtgtaccacgggattcgtgtccagggagaaagaaagtgtttaactttctatttgcctaaattcttcattgttggactattgtggttggcttctgttacgctaggaatatggcaaacagttaacgaattacatgatccaatgtaccagtatcgagttgataccggaaattttcagggaatgaaggtcttcttcatggtggtggcagcggtgtacattctgtacctcttgttcttgatagtgcgggcgtgttccgagctacgtcacatgccttatgtggatctcaggttgaaatttttgactgcattgactttcgtagtacttgtcattagcatcgccatcctttatttgagatttggggcgcaagtactacaagacaattttgtagcagagctgtcaactcactaccagaattcagccgagttcttatctttctatggcctgttgaacttctatctctacaccttggcctttgtatattctccatcgaagaatgccctctatgagtcccagctgaaagacaatcctgccttctccatgctgaatgactcggatgatgatgtgatttatgggagtgactatgaggaaatgccgctgcagaacggccaggccatccgggccaagtacaaggaggagtcagatagtgactgagccccggccagcccagcgaggcgacaagatgcctggatgctttccccggtgaccgtctgctgaccttcccctgttatattcagatttttcttacaagcagagatttcctgttcatttgtttacatatttttttaaaggaaaaccaaaactgagggtaaatttaaatgtttagccaaatttattgtcatggtggctacgagaagaggcattgataacaagtttcaacagccaaatccttttttacagagatttcagatgagcgtgttttcagtgatgaggaaatttcacgtttttagtacagtgaattatgtacttttttttcctgtaatcattcactgattccaagttcacgggcagcctgtgactaggtcctcagcgtgacagcatcaccctctttcttcccttttccatggtactgttttgtgaccctttaaactcaaagggaagccttatctgtggctgcttcagggcagtccttcctcgttgagtggccagtgccctgggtaaccaggtggctgaagtgattggtcagttatgtggactgcgttttgtgcagtgtgtgagttatgactcatcgggaatgggagatgctggggttccaacccttcacgtcaccaaaggggaagtaatagtgtggagttctgaggagggtttgataagttgaataaggaaaggctaagataatttacaggttaccaactcatgtggggaaggtcttactgccatggtgcttttcaggggcctgtgtgtacacacatgattaaatggatttgcctgtgggaggtatgggcaggagaggaacccttaccattccagtaaatagcagtttctgcaattctgttgaatatgaaatgccatagagctttatttatttatgtaagtaaaagctaaatgaggggccaggtgcagtggctcacatctgtaatctcaacactttgggaggccaaggtgggaggatcacttgagcccaggagtttgagaccagcctgggcaacacagggagaccccgtctctataaaacatttagaaagttggctgggcatgctggggcatgcccatagtcccagctactcaggaggctgaggtgggaggattgcttgagccctggaggtcaaggctgcagtgagccatgattgcaccactgcactccagcctgggtgtcagagcgagaacccgtgtcataaataaataaagctacatgaaagattgatagaatattttagattatttattggccaaaagtttttaaaactcatatttggaagcaaaatgaaaagcaagtaaaatgttttaaatggttcatggaaaacgtatttgggtagaaggcaactcgtgcttccggaaggggttccctgtcctccatgtgtccacatggcggtcaggtagggacgacctgttctgtaaagtccttggcactgctgaatctgtggcatcatagaaggccctggagcttccccgttcctttcagtcagggactccatatagagtctcatgtggacgtctcccgtgctttcctcttgacctctacagtcacacttctgttaacatctggtaactgtgggcaacctgactgatgccgtcttggcaattgaggtccagaagatgatagttccgcaacgcaagcagtacctactttttttcttcatctatgcattgactctcagattaccatgcagagcttcacgttatcatccacgttaagtagtgctaggtaggaccttagagatgttcatgagaaactatttgttatgactttcctttgtatctttccttttaatttaaactttaatgataatgtacttttaatatggattctattcacatttgttttaaaaaccttgtaaatatgaatgtttaagacaacttactgcaagggtaattcaagtttacatgatttttaaatttgcaatgatgttttttttattctgtgtattgaaaaaaattttctgttaccaaattttacaacttctaataagactactataactttatgtaaactgatgaagatgtgctgattaacatattctgtgatatggtttacaacttttaatcataattgtccatgattttggaatgctgttatttatcagtaaatgtaaaatatttgaggcatttagccatacacacactagaactttttaaaactttgtcctatagtgtaattataaactgatgactattatcttcatacattgagtcttcatgcatcaatgaaatgaaaaatataggattatttatttactttttgtaactaagtgggaaataagaaaaaaagttagaaagtacttaaggggaaaatcgttcttactaagtcatgtattttcaacttgtcttccctggtatatcataaataccgacatattacataccccatgtaaaattttgcttaaactctctagcacttggcatgtagaatatgtaccataggtatcaggttaaaacactaaagtctgccagaaacttttgacagtagcaagaaaattgttgaagaaaaaataaattatttactgagggtagttatgttaaagttttgcgaacttaaagggctgactttagttccttcatggtaatggcttgagtaacatcatctttgggattttttaaatactggtccagtctaggagaacctggaagatgaccagaggtatttcagtttccctagggagagcttcgttatccatgtggatgataagtctgcttgatttattattaaatcattatagcagtgaagtggtgccattttctctctcttaagccccatttgaaaggctagagaaggggatatatatactatgttcaaggtttgtaaggttgttaatgtacataattgcagattgcaataaaagcttagatacattttgtaaacccaacccactaaatgagcaggttacaagacaaatgtcaccagcctcaagtattttatgaactatttactgagggtagttatgttaaatagattataatgtggtaaattatttcctgaatcctttatcacaggaaaaacacagaccctcataaaagggataattaaaacggatgtgtctgaacatttagtgaagatgagacttaaaacatgaaagtgtatttgtgtattttgagggttttagaaaccggttgccttagaggttagacttttgaagaaaaaaaaaaaaagatacagatcttttcccctggccaaagggaagttgtattagtctgtgacatcttgtgatgctgtttatcttggtttgacattggagatacgctagtaactgtgataccatactataaaacagaagaattttctgctactaaaaactgcctttttacaaaatgactgtaaatatttgtaaaataaaataacactaaactttaagcccaaaaggagagatagagccatgtgttcagttgtggacctgtccgtggggcacagtgccaccccatcacagtgttgctgtcatcaggcaaaagtgaatgtttgtttatggcaaattcgtcttttgcgaatggcttaattctgacactacctttctgggaaatgttaataaatttttaatattcaaatcaaaaaaaaaaaaaaaaaaaaaaaaaaaaaaaaaaaaaaaaaaaaaataaccccttttacaacatttataaccctcaaaacactccctttacccaacttaataaccccttaacacattcccctctttacaattaataacttncaaaaaaccccctctcactccccttccatcattacacaccctaatacccatttcaaaatttaccctcaatttttctctaaaatcctttaaatattcttatatcattaactattaaccattaatccaaatctcaaaatccctattaacctaacaaataaccgtaataatccttatgatcttcatcttgtccaaaatcccctattacccattttccaccttactcctccactattctcttcacccctcctttaccctcatct

SEQ ID NO: 110736 - DNA, 889 bp, Homo sapiens
  misc_feature (2)..(2): n is a, c, g, or t
gncgcggaggcggatgggcgcggctccctcccccactcaggcctcttcacggggcggggggccgggtcccccagcccccacccgcgccgtgtccagctcctcgcgtgctcgcggcggagccctgagcgcactgggtccgagtcctgcgcgccccctcaccacctcccccgcacctgctcctcctcctcggtcccgcccagcgcgccagcagcccgatccccagtgctgggagaagagagggggcgcaggcggcgacacaaagggtggagcggcgggaccgggacccgggaggctgcgcggcatggacgccgagtaccctgcctttgagcccccgctctgcagcgagctcaagcacctgtgccggcggctgcgggaagcgtaccgcgagctcaaggaggacctcacgcccttcaaggatgaccgctactacaggctggcgcccatgcggctctacacgctctccaagcgccactttgtcctcgtgtttgtcgtcttcttcatctgctttggcctgaccatcttcgttgggatcagaggtaaggttcggtttttactcattgaatcttttgccatgcgcggtggccctggcgtattgctttcggtcagcccagctgtgcccctatcttccactgctaagggccccagcgtggagggagaagtgtccacagggtggatggggtcccagccctgcgcttctagctgctctgtctcttgtgggggaggtgtgcagtaagtagccccgagtgaccctggccatgccctgtgcagcagccaggggcagccttgaccacatgccttcattggccaagcaaacgtttctaatctgctgtgcacgagacccagctgggcgctggtgtgtccagaacatgctgcctggttggggagacag

SEQ ID NO: 110737 - DNA, 325 bp, Homo sapiens
ttggtttgagagtttgtttccaattctttatttcattattgtgtctagagaccttgattcaccgtatgcccgtggccttcctgcccttttcatgtaacttgatctcttctggccctgccctcggtgctggtgacaggagcgccaccagatggctcagtgggtccaggtttccactgatgtgagaggccatagttcacctgttatttactgtgacctcgaagagtgcttgtgacccctggctgtgggcttgaactgtggagtcctgacgtctgggtaatggacccccgggcactggcgggtgcttggcactagaaggggctgctga

SEQ ID NO: 110738 - DNA, 395 bp, Homo sapiens
gcttaatttttgttttttatttttcaaaataaaatgcaagtggaatttacttccagagttgttaatgagtttctttctttttcagatctcaggttgaaatttttgactgcattgactttcgtagtacttgtcattaggtaagaagaccttatttcttgaaaacagcaaaacggaatttttcttttactgtcaggaatatctgttgcctccttttgtggagtggatttcagggtacttctagcccagtagactcatgaggttagagggcctcccaccaaggctgggcagccgagagcagccgtcagcctggagagcatgtttttgttgtaagcggccgaggactggagcacgttcacttgcacactcggcccgcgctgggcatgttctgtccttgc

SEQ ID NO: 110739 - DNA, 561 bp, Homo sapiens
gtgacctcgaagagtgcttgtgacccctggctgtgggcttgaactgtggagtcctgacgtctgggtaatggacccccgggcactggcgggtgcttggcactagaaggggctgctgatggcgggaggagtggtcgggctgtaggcagagcctctgactgatgtgtccagatgccgcgttccttcccttgacagcaccaccagccgagttcttatctttctatggcctgttgaacttctatctctacaccttggcctttgtatattctccatcgaagaatgccctctatggtaagccaccctggggtctggactgctggccagttagcgggcacagaggcctgtgttcatccacgacccacttcccgggtttcccattcatgtgggcgctgtgattcccagtgacttctcttggcagagagagagtgagttgaaatgtcgagctctgaggtgagttggggcccagcatatgtagaacctgcgttgtgtcattcccacagagttgacacactcattttattagtgtcagtccccagcttttgctgttcagtttgggattttttg

SEQ ID NO: 110740 - DNA, 317 bp, Homo sapiens
aatgtgagtgagggtactggctgagaaggatatagcaaggtatgaaaaataaagggtttaggctgggggccaagggccagtgttctctgtgcacagagaacacagagaatttttcctgcacaaaattccaaggaatttgaaaattatatatttaagctaagtataaagtttattaccaggtgtttttatgaatgtagaatgatacaacatattatttaatggattattaacttcattattactttttttttttttgacacaaagttgcactctgttacccactgcatccagcctggtctacagagcaagactgtcac

SEQ ID NO: 110741 - DNA, 156 bp, Homo sapiens
  misc_feature (3)..(3): n is a, c, g, or t
  misc_feature (5)..(6): n is a, c, g, or t
  misc_feature (156)..(156): n is a, c, g, or t
agngnnactctgtagctatcatggcacttagctatctgtattgtaattatccatctccttcactaggctgtaactctgtgaggacaaggaccacgtctgtctttctcactgagatatattcagtgcctgacacaaaataaaggatcatcattcttn

SEQ ID NO: 110742 - DNA, 272 bp, Homo sapiens
aaatctctttcgtcaatactgagggacagattttttaagtgaacataaaatccaagaggggaacgagaacgtgttcttctgggagattttgaatgagaccgttttcgaaaatgtctatcattaattcctcttggtggagaatgttcttcagatctcctaagaacgtcaccctccttaactgcattaccaccaaactcaatccactgttgttctgatccttgcattacttctataaatcttgaacccataaaacttctatgacatttaagacc

SEQ ID NO: 110743 - DNA, 308 bp, Homo sapiens
agacggggcacacagcagttttgtttaggtataaggaagatgacttagggctagaaaatggatataaatgctcacacctgttcaagatggtagcacccagcatgttcttcctgacgttacattgtcccctgtcctttctcctgagtgtcttactttatcattgtcctgtctccttgttctttgtctttccatccttttccctcctattttacaactgctggtctcaatgccttaggaagttctttatataaatgtctggccctggactacatggcactgctgcataagttagtaaaaagtatacccct

SEQ ID NO: 110744 - DNA, 476 bp, Homo sapiens
aggaaaaaacaagtgaatatgaagacagatcagtggaaattatccaatgaggactaaagaaaaaagattgaagtaaaaattaacagatactcaggaatcttttagctaatactgtacatataatcagagtcctagaaggggagaaaagggagaatagggcagtagaactatttgagaaaataaacgctgagtatttcccaaatttggtgaaagacatccattaatagattcaagatactcaaccaacaccaagcaggataaatacaaagaaggtcagccaaggtgcctcacagccaaactgttgaaaaccaaaaataaaaagcaaatctgaaacatctaccaaagaaaaggacaataggatgatccaattggcagctgacctctcagcagaaactatggaggccagaagacagtgaagcatctttcatgtgctgaaagaaaaaaatgattagcctggaattcccctgtgaaaaaca

SEQ ID NO: 110745 - DNA, 313 bp, Homo sapiens
aatcaagatgctgggtttctagttagaagtttcaatagcatctaatacagaatctggtatgcaatagtttttaaagaaagtgatgcttcaccctttcttctctctgcattccctaaaacggctagcacagagcctgacatgtggtaggtacaaacaaatacttggactggataattatgcatgaaatcccagacctcagggtgatcagggcttaagggggcagtggtaatggtagacacaggactgcggctatagtcacagaacaggcctcccaggcagcattcatcctgctattgaaacttctaaaagtagg

SEQ ID NO: 110746 - DNA, 564 bp, Homo sapiens
ttgttttaaattgaaatctaatttccttttatatctggactgaggacccatggctatttgtaaaatggattaaatttaggtgttttaatcaagtgtaggaatgataaacttgaatccagggcaggcccgaacttttttttttttcatattccctttgttactccacaaacaaccagagctgtcacgtgtaaaaatggtgatcctataataattcttatatttaccacactcttagttgcataatcagctcgcttacataatctagaaaaatataatagaaagttcacttcaagcaaaacaatggaattgactgtaaatgggtatgcaaaaacttgagttagataaaatatctttatgacaaagaatggtgagattgactctaataaaatatgttcttttaaaaaatcagtattttataaagtaaaaaaaaaatgtttcatgttaagtctttgaaaagtctttgtgatatctgcctttgtcctgtctcacacatcacctatcctgcttgaggcacaaaaccagttgatgccatggagtgagtggtgttcatgaaagttcactggt

SEQ ID NO: 110747 - DNA, 472 bp, Homo sapiens
ttatctcgtacttctggtgacaagggagaaaaaaataggacatattttttgccgcttttctctaaaatacatttaacatcaaaattaaactacccacagtacactttactactgtttatttagagaaaatgaagaccaatccaacatttctagaacagggatttcaataaagggcggagatgtaagaggctggaaataaaaataaatggaaatgactgcaaacgcaaaacgcttcatctgggcttcacgctgaagggactcgccaccatcgtgagcggcagcggaggattctggcaactgaaaggttctaacctgcccggctggcggtggggtgagggccgcggagagagaacaacgggaaagagacgacgggcttctcatcagctctgatttcccacagctctgtgctctgccttgcactgcctaagcagtatgagatttttgtattaaacgtgcatgtgaattctaaaag

SEQ ID NO: 110748 - DNA, 559 bp, Homo sapiens
gaaataaaactatcatttttaacacttttctggggggaaatattattcgaatttcataacaattagcttgatgaccttttagaatatatatgtagaccattgtgatgttggggctgcctgttgtaaataggatttttgtgagcttgattgtacaaaattgaaatttgcaaacatcttactgagtttactgtttccttctgggtgttaggcctactgtagaaatcagaaaaatcggaaatattttgttgcttgctttgtgaaactcatgatgtgacatggattaaatttctaaaaagtttatttaattgcctttaaaattagtatgtcaaaaagtttatttatttatttatttatttattttaatttgaaacagtctctctctgtcacccagactggagtttagtggcatgatctcagctcactgcagctaccacccccgggtttaaacgattcttatacctcagcctcctgagtagctaggattacaggggcccgccaccacacccaactaatttttgtatttttagtagtgatgggtttttgccatgttggccaggct

SEQ ID NO: 110749 - DNA, 419 bp, Homo sapiens
cagatcttgtgattggcgggtatgttggctcccatctgtatcccaacattttgggaggccaaagaggaaggattgcttgaggccaagagctagagatcagcctggggaaaataggaagatcctgcctttacaaaattaaaatcagctggacatggtgatgcatgcccgtagttccagccactggagaggctaaggtgggaggattgctttagcctaggaggtcaaggctgcagtgagctatgatcacatcactgcactccagcctcagtggcagagtgggactctgtctccgatataagaaaaggaagaaacaccagggatgcacatgcacagagaaaaggccatgtgagcacaaagcaagaagaaggccacctgtaagccgaggagacaggcctcaggagaaaccaaatctgccaata

SEQ ID NO: 110750 - DNA, 247 bp, Homo sapiens
tttcaattgaatttagtcagcacatttataagcttagttaagttggttaatttcaactcagaatggccagtatacatggccttttacctcccattctggacacattttattcagtcagtctttcaacaaataattattgcatatgttctatgtgccagatactgtgctaatccctggatattctactgcaaatgaggcagttacaattcttgccctctatagagctgacagtccatgggggtgataa

SEQ ID NO: 110751 - DNA, 451 bp, Homo sapiens
agaggagccccatgttccagcagaaagcaggggaagggggaaccctctgaggaggacaagcccacccaggctgtagacagcttgtgtgcagcagcagaagcaggccacacatttttaagggaggaaggcggtttcccaggtccagaccccaagcatgacaggtctgcgaaacaggacagcaaactgcctgaaccaagaagctgacaatgtcctggtttctcagagatgcccaccctccacccctgccaaagcccctgggaccctggagctctgctagagacagagctggtcagagatgctctccacaccctggctgagtcaccaatgggccttgggacctgagcgagccactgacctctggggtagagttcccctcagtaatcagggggccagaccctaggatcccgaaccccgagagagcatgagggtcaaatggaaggatgggaaaatg

SEQ ID NO: 110752 - DNA, 144 bp, Homo sapiens
ttacttttcctgatttatacactattattctccaacatttcacattccttcttcttaatatcacaaataaaattattattttatacagatgatttttggattggctttagctacacttaactattttttaaatttatttatttt

SEQ ID NO: 110753 - DNA, 400 bp, Homo sapiens
cttgaattttagatctgaaactatgaaactactagaagaaaacactggggaaccaccccgtgacattggtctgagcaaatatttcttgtgtaagttctcaaaagcacaggcaaccagagcaaaaatagacaattggaattacataatgctaaaaagcttctgcaccacacaggaaacaacaaactgaatagacaaaccacagatagagagaaaatctttgcaatctaactgacaagggactaataacctgaatatataaagaactcaaacaactaaatagcaaagaaacaaataatttcatttttaaaaatgggcaaaaaattgggacaaacatttttcaaaaagaagacatacaaatggcctacagttatattttttaaatgtttgacattgctaatca

SEQ ID NO: 110754 - DNA, 445 bp, Homo sapiens
gccgtagggcgcgtgtgtggtgggtggcaggggagatgagggcagggtggaaatgactcctttttggacttgatagatttgaaatctgttcccatgaggcatccaaatgaaggtgtcaaaaataagttagacataggtaattggagctctgagatacatacacatttgtaaaggagaccttaccaaacagaggctcttgggtgtcttgggaatgcctttctctctcctagaaaggaaaggcatcatgagaagagtgcccaggatgaagactcaggcatctggcatttagaagtgtacactaggaaaagccagcaaaggagacagaaggaaaatcaagagagtgtggtattagaaagcagtgagtggaaagttttgaggtagagtgatcaagtgggaaatggtgctgtgcagtagaaaaagatgaagaccagcaagtaaccactag

SEQ ID NO: 110755 - DNA, 444 bp, Homo sapiens
ggcagggcagcctcccgccctgaatgctggtgcaggggacctgggggctgctggcagcccacccagtgacaggaggcccaaggtgggaggggcagggtgtcagtggccaagtttggggatcagggcctggtcagcctggaagtgtgggaaagaggctctgcagctgccggggcctcaccaaccttccctccctgggtgtgtgaggggtgctccctgaggctctgccgagactcagataccccgagaagtcatgtgtgtgtggtggccatgaggagtttgtggatcctgagtccagtgaaaggaagttggggcccagtgggcgcaggaaggccaggaagctgtcttctggaggtctctttggggctggccttagatactctcacagatcctgcgggtggggagtcagcccagtagcctttcccaagccaaaccaggaatccttta

SEQ ID NO: 110756 - DNA, 332 bp, Homo sapiens
cagagatgatgtagcccagcttctgagagtaagcaaagcaataaatatgaaacaggaaacgctggtaaataacttcctggggactactctggaggatgggggctgcaaagctaatactttcttgatattttaagggaagctcctctccaaaccacctgggctgtgacaagaaggaaagaaacctggaccctcaaccagtatccaagggctggcttcattttttccccaattagcttgcaacgagttaatagtagctctgtagtgctggattcagggatttgtgtgacatagataaggtttggcattaaaaatgctaaatcattacaactctg

SEQ ID NO: 110757 - DNA, 350 bp, Homo sapiens
cccattgaatatttccaacactaatataaggaaggcagttttattatcttcattttcagatgaagagactgaggcccagagaggttaataaaactgcccaaggtaatagggctgctcagtggtggagttagatataaacctaggtggtctggctctagggtccacatgtccacacccctggtaactgcttctgttgtgccagggtacagcatactttgtgttatagttttcattttaatcttattggcacaatttggatttcttttgattctttttagggtgtcggtattaacttttgtgcatgaaagggagagagggagagaggagagagagaaagagaggaggggagg

SEQ ID NO: 110758 - DNA, 666 bp, Homo sapiens
gtagactgtcctagcactggtgggagtgtagcagtgaggatgaccggaggtgactctcagcgccatcttggttttggtgggttttagctggcgtttttactgcaagctgttttgtcagcaaggtctgtatgacctgtatcttgtgctgattttctgtctcatcctgtgacttagaatgcctaaccatctgggaatgcagcccagtacgcctcaggctccttttacccagccactactcaagatggagttgctctggttcaaacgtctctgacacaacaatactataagaaagagattacaggaattccccaaaatttgacttttaagtaaacaggctaaaagaaagggatgaatttattcaagttcatacacatcatgtaaaagctgagacaaaattctgttaaatttcattgaaaaaatgaaatgctgccagttttgtaaactgactaacagaacctccccagatgaaagaaaaatgttttcaagggcccgagaaataatggttaataaaaacaaaaaatcaaatcaaaataaagttagcaactctaaaaggtactttcccttactaaagacaaacacttattattttggtctttaaaaagtgtactgtaaatccagtagtaaatttctaaaattagcttttcaaaaaaaatttttttttggtcc

SEQ ID NO: 110759 - DNA, 761 bp, Homo sapiens
ccactttcctggaaatccacccagaacctccaccctctgacaccatggtcaactcctgttgtggctctgtgtgctctgaccagggctgtggcctagagaactgctgccgtcccagctgctgccagaccacctgctgcaggaccacctgctgccgccccagctgctgtgtgtccagctgctgcagaccgcagtgctgccagtctgtgtgctgccagcccacctgctgcagccccagctgctgccagaccacttgctgcaggaccacctgctgccgtcccagctgctgtgtgtccagctgcttcagaccccagtgctgccagtctgtgtgctgccagcccacctgctgccgccccagctgtggccagaccacctgctgcaggaccacctgctaccgccccagctgctgtgtgtccacctgctgccgcccaacctgctctagtggctcttgctgctgatgccctcacctatactcacctgcctttattaaccagcattcttgatatggtccacctgtgaactgaatcatgcaaggccaattggacaacctcagttccaaccaattcttggattgagtttggcctccaaatatgctcaccaaacactatgttgctaccctctaccaaatgaatacaagtttgaattttctctgaaatatgtcaaccccatgttccctgaattgaaatatttgctctctaccataatttatcacatggagctattcctctatcttaaataaattttaatttttgaggcatgcaaat

SEQ ID NO: 110760 - DNA, 713 bp, Homo sapiens
atggctgagctgtggaatagggtcattagagctgaactggtgctataaagattgtattactttattatatatctctctttttgtttttgtttttttgagacggagttttgcccttgttgcccaggctggagtgcagtggcacgatctcagctcactgccacctctgcctccttggttcaagcgattcttctgcctcagccccctgagtagctgggattacaagcgcacaccaccacacccagctaatttttttctctttttagtagagacggggtttcatcatgttggccaggggggtctcgatctcccgacctccggtgatccacctgcctcggcctcccaaaatacagggattacaggtgtgagccaccacactggccatatctctttcttattacctgcaagagcctatcaaactcagaaattcactaaactgtttagattcttaatacactcttgcaaatatatgagattgtcatatctgttgaccccttcaaactctttggcaataagcaatatttattctcttagaagttgagaaaaatactcatagtttatgaataagagaagtgaaatatctgaattttcttcttatgttaagaaggtttgtacaacacacatcatctattttagattgtagcattctaaggggcacacatgttttgaatagtttaatccttaaagggagacaaatattgtgcttatttttgtta

SEQ ID NO: 110761 - DNA, 305 bp, Homo sapiens
aatagaataaacagggtgttgtgataaaggaggtagggatcaatttcaactgcagtggttggagatctctctgaggatgtggtactgggacctaaacatgacaaggctcagttatgagagaagaggggtattggggtgggggcagagagagaattccaagaagaatacgtggcttgcagaaggcccggagagcttttccagcatggcttaccccagaaaacaccaatgttactaagaccaatacagtaggccgaaggggcaggaagagagaccccaagcattccctcttctaaattattttacct

SEQ ID NO: 110762 - DNA, 373 bp, Homo sapiens
aaaagacattcttctttttttattgctttaagttcttacctccatataatgtgattccagcctgtcttgctaaactacataactaagagacaggggaaaaaaaactcctttctgaaatcctgttatcacatatcatagaagccagagcactagaccccttgatactgcagtgacctccccaagacccacaggaagctgctgactgatcatttctacaacttacgaaattttcattatgttctaagttaacatgggaaagttaacttatttcatttcaacttatttttcccctttggattaagtatctggatgagctaagaaacttgattggggtgggggcatgggatagtttttttttttattatttaatgtt

SEQ ID NO: 110763 - DNA, 399 bp, Homo sapiens
cacatccttcttcacatggtggcaggaaggagaagtgccaagcaaggcggggaaaagccccttataaaaccatcagatcttgtgagaactcactcattatcaagagaacagcatgggggtaacatcttcctgtacccactctccagagtgtatatatttgtatgctttttgagccagcaactcatttccagcaatttattccaaataaattttcagagctatatattaaagtttatttacaataatcttggggttgtttataatagggataatttggaagcaatctaaagcagttctatctaacagaactttctgtaatgaggaaaagatcctattatctgtattatccaatacagtagtcactagccacatgtgaccatggagcacttgaaatgttgc

SEQ ID NO: 110764 - DNA, 162 bp, Homo sapiens
attttttgaaggcacagaccctttattaactttgttaacaaaggctagagaattgcacctaccacaggcaggagatctttttagatcaatcctcatttaacagcagtcactaataggcaaatggtgtccgatgccttggctaagagattttaatctgagcat

SEQ ID NO: 110765 - DNA, 329 bp, Homo sapiens
ggcatctgtaatcccagctacttcggatattgaagcaggagaatcacttgaacccaggaggcagaggttacagtgagccgagattgtgccactgcactccagcctgggcaacaagagtgaaactccatctcaaaaaaaaaaaaaggctgtttaatgttacggttttttaattttggaaacctaatggccaaaagtaagagtggcacagggcactaagatttgtttccagagcccatattcactcacctctcagttactaaacacatgtacacctctacacctggaccaccccctgcccttccacccagctttttttcctaataagccac

SEQ ID NO: 110766 - DNA, 242 bp, Homo sapiens
tgccaaagtattactatttcaaactagctgtctcactgaatctctgaagatcctacaaggccctcattctgttcctttgtgatttctcctacccacaatatgctcctaccccatctccctatgtctaaagctaaactattctgtaagttacctcaaataccatctcacctgtttaacaaataggcttatttgagaatagagagaccagtcaaagttagatactcagatactgcagtcatatt

SEQ ID NO: 110767 - DNA, 320 bp, Homo sapiens
ctgaaatttgtatcaattgttggttccctgaagattgtgctggacagagtatgccataaattggtatgtttggggtgatcttttttagttttgaaaagcatttgactggacctaaagttataattattttcaagagtattgactgtcattcagttgtctattaatggaattcccagataaattttgcataatattaaaatacggcaaaataaagttagtcaggtcctgaatgtgagaaaatacaacatactttccagaagatcgggcttcttttcctcaagatggtgacctgcttctgttacacattcttgtctttcact

SEQ ID NO: 110768 - DNA, 607 bp, Homo sapiens
tttaaggaacaaagaacgtgatgactagtgtggtcatttcaggcataaaaataggactaaaacaggaatcagtcagaaattgaagactatagcccatgagtgatcatacatttatcagtgggtattaacacactcaggtgggttcatgagtagattctggaatttccataatagtctacatatttaaacatagttgaacctaggtttcatgcagttatgctataggccttaggggaagctcttggttattttacatttttaattgagttctgaagttaagcagtaatactaacaattaaatgttttgagaaatttttataatgcccatgtgttacatagtattggacattatctactagtaatagtgtagagatagacatgttacagtaataggataaaatttaaaagaataacagtaatcaatcactaatagttgcatacttggcagttgtaactcgtggccctcaccacattttgagaatcactgatgcaagtttcaaaattcatggttggccaaacacagtggcttacacctgtaattcagcactttggaggctgaggtgggaggatcacttgagaacagcctgggcaacctgggcaactcacc

SEQ ID NO: 110769 - DNA, 248 bp, Homo sapiens
agacaataggccttccttattcaagacttcactgtcctcagtttcagttactcatagttcaaaaatatcaaatggaaaatttcagaagtaaacactttgtaagttttaaatgctgcaccattctgagaagcatggggaagtatgtcctgcttgcaagataaatcatcccatggtccagtgtgtacacactgtagactctaccagcccattagtcacatagtagatactgcagttaccagatggactgt

SEQ ID NO: 110770 - DNA, 359 bp, Homo sapiens
gttctactgcaacttacattctcacccaggctggaatgcagcagcgcgatctcggctcaccgcaacctccacctcccaggttcaagcgatacttctgcctcagcctcctgagtagctgggactacaggcatgtgccaccacgcccagctaattttcgtattttcagtagagacaggtttcaccatgttggccaggctggtctcgaactcctggtctctcctcagcccactctactctggtttctgccctgttataccactgagactgttcctgtaaaggtcaacagggacacccatgctgctaaatccagggtcacttacttatctgacctccaccccatcaccatatgacttaattaa

SEQ ID NO: 110771 - DNA, 276 bp, Homo sapiens
tttgcgtttttgtaattattttaatcattgaatagtggaaaatagaattggggcgcacatccacttgtttgggatatcccatccaatagcagtgataaaagaaagcagaacaaataacctctgtttctggttactctcaaaacgcgttctgggacttgggctatgtcttattaaatggaatgatttaccgtttatatatttaaagctcagaatatgataaaggtcctgtctccaccacttcaaacgcacagggtttcaaatgacacagttaagatc

SEQ ID NO: 110772 - DNA, 137 bp, Homo sapiens
ccatggagttggccatattaacaaaaaggactgaattgtaaatatcagtaaataaagaatatctattgatacaagtcattttactaactcattcctcaagaatttccttgagcagatatacatatacttttttgttt

SEQ ID NO: 110773 - DNA, 344 bp, Homo sapiens
actacctaagtgaaaatgaggccatttgagaaggagttgaatctcgggtggagattcttaaaaagcacattacagctggtcattgtgaggccaaatgagacaaggaaggttgagtgtctctcaggcagttgtatacgagaagttagtggtctcttttataagaagtatttctgttcagatttatgtgtaatactgattctagaaatagctgatatgtgaactggaagtacaattcactcatataagttctccctcatttgggtcttggttttggagaaagaaaaggtggtccacattctgttccttttgtaggaagcacttggtctcttctaatgggaaacttc

SEQ ID NO: 110774 - DNA, 613 bp, Homo sapiens
tggggccctttgcgccaaggctggagccaaagtggctgggatgcagggaacaatgtcctgaggctgcacgaggcagcagggcccttgacctggccctcgaaaaagtgaaagagtgatgttgcctctgtgtatcaaatgcaggcatggcggtcctcacatctgcccaaggttacagtcagggatagactaagaacagaactcaaagtggacacattcctgctttagtaataaattgcctaccagttttgtaaagcttggtatatcttatttttcttttgacttttgtcaaacacagaagtaatataagtccctcgtatccaactagcagctcctcagttatcaattcgtggcccatctcatttcacctgctcttattttttagtttttcattttgtaatgcttgtattcaacacagtgacgtttagtaagtactatcacgtgccggagattgtattcaatgagtatgtaaaaatggataagaaagtttccttcctcagcttctcatgatccaatagcaaaggcacatgtatccaaagattatataatgtaagcaataactggcataagccaaaggttatgggaacacaggaaagagagcaattagtgcttccct

SEQ ID NO: 110775 - DNA, 381 bp, Homo sapiens
taaagtacaaccaatctcatttgtcatagtaactgataaggaagaagcttaagttttttgtgcacattctatttgttgggtactgtgatcggaacatagatgttctcattgaagactcaacatttataccagtggttcccaaatcttgctatacattggaatcacttagagacctttaaaaaaactgatgcctagctgcagcttcagatattttgatgtaattggtacaggacgtgacatgggcattggatttttataaactcccaggtgattttgatgtgcagccaagtttgggaaccattagtctaagtggtatttaccacttttttccctgttgctctcttcagtgaggttaaataatttacttgtgataacaccact

SEQ ID NO: 110776 - DNA, 474 bp, Homo sapiens
gacaaaagaaatcaaagaggagctaaataaacgaagagaaaccccatgttcatagacaggaagattgccaacttgatctgtgaaaccagcacaatctcaatcaaaattccagcaagttatttgttgatataaatatcaacaaactaattctaaggtttatatggaaaagtaaaagacccagaacatcatattcaatattaaaggagaagacaaaagtcctaagactgacattacccaactttaagacatactgtaaggctatagtaatcaagactgtgatattgacaaaagaataaacaaacagatccatgcaatgaaatagagaactcagaattagacccatgcaaatatagtcacctatcctttaacaaaggagcaaaaacaatatgatggagaaaaacattgtctttttgacaaatgatgccagacaaactggatgtccacacaaataaaaaaataacaataattaaaaaa

SEQ ID NO: 110777 - DNA, 531 bp, Homo sapiens
aagtaccgctcaaagatcaagggaaaatagctcaaagaagtatccaatggatttggtataatggagtttactggtgacctcgacaagagcagttctaggggaagatcagggaagaagccagagtgttaagagttgagttatgaatggggaatgagggattgaagaggagataagatgagcagataattcctttgtctatttgctgataaagtggagcagagaaatggtctggcagctagagggggatgtgggctcaatagaaaatattggagcacatttatatggtaatgaatgagccagtagtcctggagagagagcacagaagagagaaagtataaggaaagttgcaaagctcttgcaaaacaggaggggccggcatagagagtggtctttggtaacaggaaaaacacatcctacattttaacaggcaaatgagaacttgggtacaaatataggtagttgtgtatgtttgttggtgagaagatcaagtggatcggatatgatcacttctgttttctcagtcaaatctga

SEQ ID NO: 110778 - DNA, 858 bp, Homo sapiens
gggcttcggatgtctcagtgcctcttggtgtctctgctttcacacttcttgaccaagggcatagatacactaaaaattatctgcagacaatgaaggtcatccatggtagaaagagaaaataacctgtttatgggagatatctgttcacagtggatgaaatccacactgaggaaggttcagcagaacatggagctgacctatgactgcccccgctcctagttggctgctcttctttggagtctgtcatgcaatcagctgcttaaacacatctattctctatgtgttccttttgtagcctagagataattccatcttttccttgagtcctgactggtgattccaggcctccttgatcaaattgactgtccccaaatgttacacacatttcagcattaaagttactacacttttcccagtaaattacatttttttgttttattttatgttttaaaacttagagtcaatcagtgaagatctacagtggaaatacatatgtataaaattagtgaatttggtataatgatacggtgctgtgataatttaataaaagcattgagaaattaatgtggttttaatactagtagttccccaattttttaatatggccattttcacactttccaaaaatttgataaaaataatactggagacccatgttaccatttatattcaaaattactaacattttgcaatgttatatggagtatatctgcataaatacatataatgtttctagaacctcttcaaggtaaattgtaaagatgacaattgacccctagagacctctcaaagcatgtcacaggaatgaagatattctcccagttccagtgtcattactgtatctaagaacatcatcta

SEQ ID NO: 110779 - DNA, 201 bp, Homo sapiens
acgcgggggactgggcgatgtctagggacatctgtggttgtcacgacttggggcactcctggcatggagtgggtggaggccagggatactgctcattaccctgcagggcccaggatgctcccccaaccagagaaggatcccgcctgtgtccacaagccccttgtctgggagacagagccagtccactgtgtctcccgatcc

SEQ ID NO: 110780 - DNA, 263 bp, Homo sapiens
atgagtggctgccactctaggccttgcagaccccaatgacagggaggtcatcacctccacaggctgcccattggaacaggtggtggctgggaagtcctttatgctgagttgacctctgggtcttggtggctatagcccttggtcagcatgaggactgtccagagcctgtgctgggcggtcatggagcatcatgggtggtttgctgagtgcccttcccatctttgatctcatggaccgggggacccacaggagggggctccaca

SEQ ID NO: 110781 - DNA, 251 bp, Homo sapiens
aatcaccgcgccacatctggcgacctaactcattgtcaagcttcactttcgctcattgtgcccttggcacatcgttttccagtagacaactccatgaacagttttatttatttgcgtatttatctatttgcaaattattcttctcacatttgactgctatcttccccttgtggaaatttttatcttggaagtttggggagcatcagtggagtacatgtggatgctcccaactcacatctgatgaggaagct

SEQ ID NO: 110782 - DNA, 846 bp, Homo sapiens
tgtgtctcctcttttcttctgggatgttatgtgtttagaacttgcaaacctttatttctgtacttctgatgtacctgcctaatgtgtttcttcccaactaccttccccccttcccccctcctttcttatgattgataaggaactctgtaaaatccttcctcctgtgtaccagaaccttctctccattccctccttccaggcttcttatatgtcatgaccaaatcttaccattaatgtatgatgggcagtattcagatgttctgtgacatatcaacatgggaaagtgtggatccccaggattatccgtggggatggggctgggtcttgggatgtcagtgaagaaggggatcatgtaccgtttagatttcatccacatgctccatcatctctatgcagaacagaattaagaaaagagacatttaaagaggatggcattcattgcctggaataacttaaagttctgaaaagagaataattagaagacatttgctgtctaggatgctaaagaaacactattgaaataccctattgcagattaaagaaccagggaaacagctatagcttgaactttgcataaaactgatgtttctggccaggcactgtggctcacacctgtaatcccagcactttgggaggctgaggcgggcagatcacttgaggtcaggagttcaagaccagcctggctaacatgatgaaaccccatctctactaaaaatacaaaaattaactgggcatggtggtgcacgcctgtaatcccagctatttgggaggctgaggtgggagaatcactggaacctgggaagcagaggctgcagtgagccaagattgcaccattgcactccagcc

SEQ ID NO: 110783 - DNA, 668 bp, Homo sapiens
gaggtcaggagttcgagaacagcctggccaatatggtgaaacccctgtctctactaaaaatacaaaaattagctgggcatggtggcggacgcctgtaatcccagtcgctcaggaggctgaggcaggagaatcgcttggacccaggaggcagaggttgcaatgagctgagattgtgccattgcactgcttcttgggtgtcacagcgacactccatctcaaaacaaacaaacaaaaaatccctgtacaaagaaaaataaataatgcttgtaaatggatacgtgcaggcccatattttcccctgaagtgttggtagttggtaagtgtaagatacagaggaacttttcaccctccatggcacattgccagatcaaacctttctcagccagaagtggctttggaagctctaacagaagtttcctgcatgcaagtgaggtacccaaagctctcatccttggagtcacatctctagtcagagtgtctgccacaggacaagaccctggcgcgatgggacatgctgtgccttatttcatcagaggtgtccagctttccccagcacatgcgttctccctgaggaaggctgccggcacagatatcaggggctggatgttcttggaggtgcaccttggggaaccgctgggctctctagcttgctgtttccttgaatccag

SEQ ID NO: 110784 - DNA, 142 bp, Homo sapiens
tgctgggattacaggtgtgagccaccgtgcccagtctcctgatgcattcaaacacatttcagatttctccagaagagaatccctttgtctttgtcaaacccatctcaacttctcatttctgccctatttctttctctctctc

SEQ ID NO: 110785 - DNA, 288 bp, Homo sapiens
ggcagcaggcgagtaatattcagtgcctggcatgtgtgggctcataaagttaacacactgaagatgcacagttatatgggttgtgatggggtgatatgtagagttgggtgaaaccgcactactaggtctggttttccttgtcattcaaagcttgaaagccaccttagagacaaagcttcttatgaatacctcatagctaggaacaggtctgtcatagctctttgagcatgaaagggctatgttgatcattcctcatctcatctctaggtcctcatggcatcctatatc

SEQ ID NO: 110786 - DNA, 365 bp, Homo sapiens
aagaatttggggttttcttatttagttggaatgccttattaggtattaaagtcagtgacgttaagttttctgctgctatcttttgaataaaatttattgaagaaaaatgtcaccaacaaaacatgattttaaaactaacacataaggccaggcgcggtggctcacgcctgtaataccagcactttgggaggccaaggtgggcggatcacaaggtcaggagattgagaccatcctggctaacacggtgaaaccccatctctacaaaaatacaaaaacaaagaaaaattagccaggcgtggtggcaggtgcctgtagtcccagctactcgggaggctgaggcaggagaatggcgggaacctgggaag

SEQ ID NO: 110787 - DNA, 238 bp, Homo sapiens
agcatgtgtaagcaagtataagcaggtgtgattatgagacctggtgtgaggtgtatgagcaggtgtgtgaacatgagtgtgtgaacctggtgtgaggtgtgtgtgagcaggtgtgagtgggcatatgagtgtgagaaggtgcattgggtgtgaccgtgtgtgggggcagtaagtgggtctgagtgtgtgtgcatgtgtgtgagtgggtgcattgggtgggtgtgagtgtgcatgtgag

SEQ ID NO: 110788 - DNA, 373 bp, Homo sapiens
acatggtgtcatgcacctgtagtcctagctactccagagactgatgttggggaattacttgagcccaggaatttgaggctccagtgagctataccatgatcccgccattgcactccaacctgggtgacagagcaagattccatttctgaaaacaaaaacaaaaagccaaatgctacaggaagcaaattccaggcaggatcattagagaagacttaatagaagaagtaacctttacatgtagacatgtagaagaaacgtttttcgaggtggagagaatatcatgaggtcagagacacaagacaaaggagggattgtggcaaggatggagttgcagaaggattgaatgggggtcagcttgcccaggcacagaatg

SEQ ID NO: 110789 - DNA, 160 bp, Homo sapiens
tggccacagaacagtgaaccttttactggggattcaagtttaaaatcacacagcttaacagtaatgttagttttaccactaggtggcaatgacacagctgcattgggctgacatgattaattttaaaaactgtgcaaatccagacagaaattccaagatc

SEQ ID NO: 110790 - DNA, 105 bp, Homo sapiens
ctaatatctacatgccttggtttgctctaggtgattgtctcccccgctagactgagagctcttacaagactgggactgtgtttcattttccttttgtcttccctc

SEQ ID NO: 110791 - DNA, 444 bp, Homo sapiens
cagcacttatctaatgccgagctacaaactctttgtgctaccttaagcagccttggaaacataaaagacaacaccttattttcagagattgcattaactttcaaagaaagctttatggctagactaactcattcatctggcttcatcaaggaattatgtatgctaacaatatgcaaactttataaataacttggaatgccaaaacttttgcctgcttttgatagacttcctatttttgatggtaataccaaaatgtacttcacactttcttgctttctcggagaacactgaacagaatgtacctttcctcagacacgatacactgtcttcaccaatgagctttgcgctttcacatagtaatgtattcaggaacaagacaggtgtgcaggacccctcagccccctcactaattggccccaagctggcttcggtgctgcagtccac

SEQ ID NO: 110792 - DNA, 878 bp, Homo sapiens
ggactggaactgtaccattggctctgctaggtctccagcttgcccattgcagaaagtgggacttcttggcctctctctctccgtagctgtaggctaacccaagaagaataaagcatcggcttccctgacctgctgctccccccaaaacagagtgccaatatgattccaaggttcttagcacactgtatattacctcactcctcctacagtggtctggaactgaacttgcaatttctccaagatatgtcggtatctctctccatgctgtgctgcgtgggctttgggagcggtgatgtggaccatttgaaattgtccttgctacctctttaatgcatatttttatatttctatgctccacccaagtgctgtagtctctcaactgccttctttttgttcttcagcttttatgaagctattttcaagtgtgagtagttgtccaaattcatgtttcttgagggaacaagtgacttgtttgtaagttgacttgtatatctttttatagctgagattttatcctgtgatcttactaactcaggaattttttggagattctttgcagttttctaagtagaataaccatattatatttattattattttccttcttactttggttttaatttgctctttttttacatgttttctgagttagaaacttaggttattgatttgatacccttattcctttataacatatgcatttgattgtgtaagtttttctctaagcactgctttagtgcatcccacaaattttgatctgttgtatattttttatttactttaatatatcttctaattttcttttgactttatctttgaccaatgaaatattcagaaatgtgtaatttctaaatatttgggagattttctaaatattt

SEQ ID NO: 110793 - DNA, 1545 bp, Homo sapiens
ggcagggcgccagtgaccgctggggccagagccctgccgggaaaggagggcttccgccttgcagcgcagctcggatcagcagcagcccaggaggcctcccgcccgtactttcccgcgtccatccctctgtcccacggtcggtgagtcagcggagcctgatggaggccttgggctctgggcactatgtgggaggcagcatcaggtccatggcggcggcggccctgtctggcctggcggtgcggctgtcgcgcccgcaggggacccgcggctcttacggcgccttctgcaagacgctcacgcgcacgctgctcaccttcttcgacctggcctggcggctgcgcaagaacttcttttacttctatattctggcctcggtgattctcaacgtccacctgcaggtatatatttagagccactaactttgtggcatttgggggctcctcgtcaggatggctgacttccacccacctgctcacccaccctagagcaaagcgaccaactccgctcctgcatgcagacttgccactcattctttccattgcctcatcttttagtataaatgggtggcaaaaaaagaaaaaaacagcatttgtggaaagcctgaaatataacccaaatcgtctaagatagaatgaaaaattgactctcaaggaaatatttgaaggaacagaatacagcttaaaaatttgaaaatccttaaaaatatctgagaagtttttgcatccgtaaaacagaaaacagcacgaactttaggaaatgacaatgggcacagaatgcaataaaaaaaaaaaaacggggaaaggtaactaaaaacttaaggaaagataaactgaacaagaatggctcagacagcaggcaaatctccccaattagaaacgaagtgaatagacccaattgaatgagatgaattctaagcaatagatggattgaataataagctggaggacattaataacatgttctggaaggcatacatttcttcaacccaaaggaaaaaaaatgacagaaagaaactacagggaagaacattaaaaactgtgcaagaaacttatgtttcacatatgaagcaacctcagatgtggcatggttttgaacagttgccgaaagtgtgagaaagggaatctgtttgaatattggcacatggatcaagactctggagtcggtgatgagaaaatccaatcagagcattccactttgctattcattgaaccaggtagccaacagaagagttaaaaattagtgatatgactatattcagggggaaggagagctgaggggggcggcaggaagtcagcagaaaatgcctcatgtcattaagtcaagaaatagtaataaaggcatgttattgaaaaagggggtgtaatctctaaacaagcacgtgtagaagtttgtgtttctgatttggggaagcaagagttgagaaggagggacagttctattacttttcattatatgtcctttttctactgtttgatttttaaaaactatacacatgtattgcttttgcttcgattaaaaatcaagacattaaaatgaaaaaaaaaa

SEQ ID NO: 110794 - DNA, 968 bp, Homo sapiens
ggcagggcgccagtgaccgctggggccagagccctgccgggaaaggagggcttccgccttgcagcgcagctcggatcagcagcagcccaggaggcctcccgcccgtactttcccgcgtccatccctctgtcccacggtcggtgagtcagcggagcctgatggaggccttgggctctgggcactatgtgggaggcagcatcaggtccatggcggcggcggccctgtctggcctggcggtgcggctgtcgcgcccgcaggggacccgcggctcttacggcgccttctgcaagacgctcacgcgcacgctgctcaccttcttcgacctggcctggcggctgcgcaagaacttcttttacttctatattctggcctcggtgattctcaacgtccacctgcaggtatatatttagagccactaactttgtggcatttgggggctcctcgtcaggatggctgacttccacccacctgctcacccaccctagagcaaagcgaccaactccgctcctgcatgcagacttgccactcattctttccattgcctcatcttttagtataaatgggtggcaaaaaaagaaaaaaacagcatttgtggaaagcctgaaatataacccaaatcgtctaagatagaatgaaaaattgactctcaaggaaatatttgaaggaacagaatacagcttaaaaatttgaaaatccttaaaaatatctgagaagtttttgcatccgtaaaacagaaaacagcacgaactttaggaaatgacaatgggcacagaatgcaataaaaaaaaaaaaacggggaaaggtaactaaaaaaaaggggggggtataaatcgggagggaagttcgctaccgtttggaaagggcctgagggtaaaagggagggcggtaaacgacggaacggtggcttgggactctcggggagatgcggcgcgaaggggaataggtgagacgctgggttgtataaggaa

SEQ ID NO: 110795 - DNA, 199 bp, Homo sapiens
cctagttttagaagttcatagcaaaggcttgaggtggcagtatgtttgatgggtagccaacagaagagttaaaaattagtgatatgactatattcagggggaaggagagctgaggggggcggcaggaagtcagcagaaaatgcccattgctgcctgggaaaaagaaatgaatcactgactagttttagaagtttcaata

SEQ ID NO: 110796 - DNA, 620 bp, Homo sapiens
cctagttttagaagtttccatagcaattctataccattaccactctgaagaaactgaatcatttaaaccctagttttagaagtttcaatagccgggaagaacattaaaaactgtgcaagaaacttatgtttcacatatgaagcaacctcagatgtggcatggttttgaacagttgccgaaagtgtgagaaagggaatctgtttgaatattggcacatggatcaagactctggagtcggtgatgagaaaatccaatcagagcattccactttgctattcattgaaccaggtagccaacagaagagttaaaaattagtgatatgactatattcagggggaaggagagctgaggggggcggcaggaagtcagcagaaaatgcctcatgtcattaagtcaagaaatagtaataaaggcatgttattgaaaaagggggtgtaatctctaaacaagcacgtgtagaagtttgtgtttctgatttggggaagcaagagttgagaaggagggacagttctattacttttcattatatgtcctttttctactgtttgatttttaaaaactatacacatgtattgcttttgcttcgattaaaaatcaagacattaaaatgaaaaaaaaaa

SEQ ID NO: 110797 - DNA, 822 bp, Homo sapiens
gctatctagaggatccattctcgctcatatctctcccttcgccatattctctccataaaaaaaaaaaaaacggggaaaggtaactaaaaacttaaggaaagataaactgaacaagaatggctcagacagcaggcaaatctccccaattagaaacgaagtgaatagacccaattgaatgagatgaattctaagcaatagatggattgaataataagctggaggacattaataacatgttctggaaggcatacatttcttcaacccaaaggaaaaaaaatgacagaaagaaactacagggaagaacattaaaaactgtgcaagaaacttatgtttcacatatgaagcaacctcagatgtggcatggttttgaacagttgccgaaagtgtgagaaagggaatctgtttgaatattggcacatggatcaagactctggagtcggtgatgagaaaatccaatcagagcattccactttgctattcattgaaccaggtagccaacagaagagttaaaaattagtgatatgactatattcagggggaaggagagctgaggggggcggcaggaagtcagcagaaaatgcctcatgtcattaagtcaagaaatagtaataaaggcatgttattgaaaaagggggtgtaatctctaaacaagcacgtgtagaagtttgtgtttctgatttggggaagcaagagttgagaaggagggacagttctattacttttcattatatgtcctttttctactgtttgatttttaaaaactatacacatgtattgcttttgcttcgattaaaaatcaagacattaaaatgaaaaaaaaaa

SEQ ID NO: 110798 - DNA, 561 bp, Homo sapiens
ctctcactcccctccctagtctgcaaatggccaaaaatagtttccattgtcattgacttaaatttccattttgattatggaaataaatatttttactgccctttcctgaaacaggaataaatttttccattcaagttctcctaatcagactctgagaaccaaaccctgaccacaaagtgcagaggacacccaaacagacaagacaaggtgtgtctgcctcctgcgctcaggaccaaagaagttggcctcagctccctgcttcatggctaccacatactgggtccattccctgattcagctaccacattctcctgagctctggtctcagtactgtggggacagctataaacatgacacaccctgcccctaccctcatggagcttaaaatttaaacccaaggcctgggcgcggtggctcacacctgtaatcccagcactttgggaggccaaggtgggtggatcacctgaggtcaggagttcgagactagcctggccaacatgggaaaacctcgtcactattgaaaatacaaaaactagccgggcatggtggtgggagcctgta

SEQ ID NO: 110799 - DNA, 1568 bp, Homo sapiens
ttgttggcctactggaaaaaaaaaaaaaaaaaaaaaaaaaaaaacacattcgaggtggtaatatgatacttttaaaccggaacctgcatctgatatcctggaatttgtttctctacttcctgtatttctcctatcatgaatgactgctctgacaaagaatatgtcatgggacacaccttcagctaactttgctttttcatgcttgttttcaattcactagaagaaaatctaacttgtcaggaagcaagtacataataggaagtgtctgtcttagtttgtcttcaacagttaagaaaatgaatgtttccactcttactacattcttagtcacctgtccactgaccaagagccttgtggccctgagtaatcatttagaacttggaatcagcaggggcgctctctctagttgcagtttagggaatgggttattagctttctaggatatttatcatgctttgaaataatttaatgaattttattccataagatccaattcaggttaggcttgtttgattttttttttcagaaaatgtattccataaagtttgtacttagaccagacgggtgtactaagaatcattcatgagtaaatgtgtgttgaatatctacccttgacctttttttgagaaatagagtaaacacagtccctgtagtctgacagctaatggggagagagggtagacttttcatcgaattaaatttctacatgcacctttcccccagaaatcttactcatggctggtctcaagtaagtctttattgaaaaatattgacatatcttcttcctcttccttctcctcactgtcttccttttagtagttaggcagagttaataggtaagaaaaattatctgcatttatgtgtagtttgtaatctactaaaggggttctagaataaatgttgacattttgtaacttacattgttgttgctactgattaaacacataacccaagtgtggatgaactctagcattacaaagcttaagcacctcaggctcctatgatgttgtaatggactctttttacaattagagtagggtggggtaacagagggtctcaaagaaaatgcatatttaaatttcaggcttctcagataacctctggagccctactgtctggaaacagccagtttccatgctgttacaataatttggcaatggcaattggttaatctccagtttctttgccacctgaaattttgagttgttcagccagtagatattggattaaatagaacaactttgttaagctggtttaataatgattatgaaaaaccaaatagagaaaaggtgaaaataaggcagaattgaggagcatgacctttggcatatcatcagagtaatagcagtaaaaaggattaaaatatttctaatttaagaataatggcaataataatagtgatgttgatggcaaaagtggcttgtcagaactttaaactcttagccaggcttggtggcacatgcctgtaatcctagctacaagtaagactgagatgagaggatcccctgagggaaggagtctgaggccagcctgggcaacatagcaagaccctgtcttaaaaaaaaaaa

SEQ ID NO: 110800 - DNA, 307 bp, Homo sapiens
agtagctgttatagtgtgacttcatctacatgagcagagatgattttgttttctttcaaaactgtatatattttacttctgctgattatagtgactaggtatttcagaatgttattaaaataaagtgaaaaggggagccatccttgttttttctctgacttcaatggaaatagtttttttaaaacatagattaccctacttacacatgttcaattcaaaatgagaaaattaggacgctatcagtattttaaaactattattttaaagttttagttcattaaaacaacagatgaagtggtaacattct

SEQ ID NO: 110801 - DNA, 338 bp, Homo sapiens
ccagtgttaaggagattctttcttcctcacttcagagacagcttaatgtgttgtatttggatgtagggatgtgtcagttacctattgctacatgacaaccgaattcaaatttaatggctgaaaacaacagtcatttattggttcacagttctgtatgttggcaatttggtcagggctcagctgttgagttcttctgctggtttctcctttcttgtgcagttacaattcattggcaacttgatggagttttgtggcctaatagtgtctccctcagatgcctcgtggttggtttcagctgtcagcttggcctttctctacatgtggtctcttatccccaa

SEQ ID NO: 110802 - DNA, 309 bp, Homo sapiens
attgtacatgaatgttcacagcaggtttatttgtaatagctaaaaactggaaataacccaaatgaccatcaatagatgaacaggtaaacaaattgtggtatacccagaacaataaactactactctgcaataaaaaaggaataaactattgatacatgcataatctggatgagtatcaaattaattatgctgagtgaaaaaagccacacacacttccttccaccccaagaagagtactcactatatgtttccatttatttaaaaatttctagaaaatgcaaaccaatctataattacagaaagcagatc

SEQ ID NO: 110803 - DNA, 377 bp, Homo sapiens
tactcaatattactgaataacctaagaatgctttcagttgttgagaaatgtaacttttaaatgtattcaagaaacatttgtagtgtacatattatatatagggtattgcaccaggcagtggagttggatacaagcagagcaggtattggtccctgacttgaaggattctagcaaaagaaacagacaaactggtgcttataagggttataaggaaagtacaaggtcctatgggactgcataaccaaagcacttacgaacttaaagagacaaaaatttctgagaggaggtcaattaagatgtgaacctgagtccagtatggtggcacccagtggcagtgtgaactgtgaggagttcgccgagttccaggaattactcaa

SEQ ID NO: 110804 - DNA, 650 bp, Homo sapiens
ggtcttcatcattgtcgttttcatattgaataggctgaagaggaggaggaagaagaggaggggttggtcttgctatctcaggggtggcagaggaagaaaaaaaattagagtgtaagtgaacccgcacagttcaaacccctgttgttcaagggtaaactgtagtttaaatctgagtgtcaactccaataaattggtagaggcttcctggaatgatgtattaatatgattctaagattgcatctcagtgcagaagaaagcgtactgtgatagattaacaatgtctgctgaggcaaagataggaatttggagtcaacatgccatgaatttatttgttatttcatgaactgaaataaagccaaaatcttatagatacccctgtagctataagactaccaggcaatcatcacgtagtgcatcgaatcatgaaaccaacaggaaaaataagacatccagctgtctggaagatagaacaaaggaaatggtccattttttcgtcgactctgcaaggcacaacagtgtttaagttatccatcatatgagcctttccacacagacataatacacaggagatgaagaacgagaaatgctttagtgtaggttactgcttggatctggactgagagacaagctaattgagcaattgcctatga

SEQ ID NO: 110805 - DNA, 266 bp, Homo sapiens
gggcactactcagatcccattcatgagggctccaccctcatgacctcatgtaatcctaattacctccccaagactacacctcctaataccctcaggggaatagtttcaacataggaattttagggagacacagacacaagcattccgtccgtaacagccaccaccttcccagataccttggttttagaaaattttattgatttatttttttgagttggagtctctctctgtcacccaggctggagtgcagtggcgcaatctcgcaa

SEQ ID NO: 110806 - DNA, 149 bp, Homo sapiens
tgctgggattacaggcgtgagccaccatgcccagccagttctgtcactttaataagggtgtaacaacctggggtacgtctggaggaggaagatttggacagtgagtaattctgaaatctttactaaaatacagtgggaagagtcattgg

SEQ ID NO: 110807 - DNA, 106 bp, Homo sapiens
tgaaggatggattgatggtgccagaagattcatgaccacgtactttctgttttattcttacttaagtttttaaagggcattttagtgtcctttatgttgctattgg

SEQ ID NO: 110808 - DNA, 587 bp, Homo sapiens
tgaaactgagcatggaaaatttcaccttaccagacaggcctttttggaaaccatacacagtgggacggggggttaaatttatatttaacttcaaaagattttttcttccacaaatgatataatatggggtactgagcaatcattttttggtataattgagctagcttgttggtctgttcaattatttatgagccacttacagatttatttaggtatttcagcatactctgacctccatctctcagaactgaacatcgacagtttttcttttttcctttttgggtgcataaataagagaatttcatgtcagtaaaaaatatttccatgttgcaaaacaataaggtgattatgtattatgtgaagttgttggaacccctaaaacataaagaatgagaaaaaaatgacatagatctcactgatactccatattgatatgatctgaaactgaattaaggaaaaggtggggacaatgttgggagggcaaggaatttgcttctctattttctcatttaaagttttatggttttaaaaaatggacaaactagggatttgagcatttggaaatattaaatcaaaagtaccaaact

SEQ ID NO: 110809 - DNA, 428 bp, Homo sapiens
gtagatcgtatttgaattttaccagttttcccattaacttcctttttctgtcccaagatctaatgttgggtcccaccttacatttagtttcatgtccccttagtttcctccaatctgtgacagtttcttaattttttcttgtcttctgtgaccttgacacttctgaagaaaacatttccttgatatttctgatgaaaatgattattatgtagaatgtccttcaacttgaattggtctttttctcatgattagaatgaggttctgggtttttggcaagcagagaacagaagcgatactatatttttctcagtgcgtcatatcggggtcatgatgtcagtgtgtcttatactggtacactaacccatgtctgctaggtttctttccaatacagtcactgtttttctcattacaactaataaacatcctat

SEQ ID NO: 110810 - DNA, 707 bp, Homo sapiens
tcaagcacaggtgaccatcaggatgtacggatgagacggcccagttggtgggagctcaccagactgacattaaaaggaaaggccaccccaaacctccatagcagtagctgggaaggcctgaatggctgtgtctggcctggaggaactgctcccttcaggaaccgtagcccttcaggggcctgaagcatttcagagacgaagagggagcccctgagacgcccacatgtagacactccaggaaacagcagtacctgactacactcaacaaacccgaagtcctcacggcctggcaggctcttcacctctggcgcctgccacactccagcctcacggctttccctcccctccctgctcttcccactccctgtgacactcttccctgcgacagcttcatggcttactactggtctctgcatcaatgtcacctcctcctgaaagccttccctgatcacccttggtgtgtgtctcctgtctgtcacagggcagggaacttgtgtctggctgccagtggcatccccagcagccagatccctgcctggcaatagtagctgctctgtcaatatctgtccatggttgagtccagctcctattcctcgcagctctgtgaggtccccaaggacttggttacaaggtgctctcagctgagtggccttaactaagattatcatgggtgatgctggtaggtttcccccaaatcgacatgactg

SEQ ID NO: 110811 - DNA, 242 bp, Homo sapiens
tttctcagttattgaacacacctcactctcctgtcagtctcatgcatttcaaggctttaaataccattcataggtcagtgactccaaaatacctatgtccagctcagacctctctcctgaactccacacttgaacatccagctgcctactcctgatctctatgtggatacctaaaaagtgcctcaaatttaacattgccctggtagcaccctcagtgataccaacaaagctggtacatctgc

SEQ ID NO: 110812 - DNA, 298 bp, Homo sapiens
aatttttaaaataggaaaaaaggatcttgtagttacccatgtagttactgattccagggctcttcattctctcatgtagagtcagattcccttttgctaccattgctcttctgtgggaaggacttcctttcacttttcatgatgtgcagctctgcaggggatgcatattctcacttttgtatgtctagaaaagtttcagccaggcatggtggctcatgcccgtaatgccagcatttagggaagccgaggctgtcagatcacctgaggtcaggagttcgagaccagtctggccaacagg

SEQ ID NO: 110813 - DNA, 646 bp, Homo sapiens
ggcaggattgttagagttagccgcatttccagtaatggccttagttgtaatcacctgttgaatgtttgtatctttgtttttctacttagtatttttgaaagactatatctagcaaacatggtgcgttactaagaatgtaagaatgaatacaatggttcagacctggtaactgtcagggtgagaaacaaaaggattttggtctgttaggaatatgcccatacatctcttaataaattttagtaaatctattttctctgatctaatctgaatatagttttaaacttttattatggaaaattataaaagtaaagggaacaaattaatacacctacacctaaaattaatacacctaaaagtaaagagaacagattaattttttttttaattttattttactttaagttccgggatacaagtgcagaatgtgcagatttgttacataggtatacgtgtgccatggtggtttgctgtacctatcaatctgttatctaggttttaagccccacgtgtattagctatttgtcctaatgctctccctcccttgcacccaaccccctgactgtccccagtctgtgttgttccctcactgtgcccatatattctcattagagaacagattaattaacttgcattgtcatttttgtgt

SEQ ID NO: 110814 - DNA, 386 bp, Homo sapiens
ttgtgatctgcccacctcggcctcccaaagtgctgggattacaagtatgagccaccgtgtccagcccctcctttgattgtttacagaagagagataactagcataccttcaactcaatgatggattgagcctttgtaggctcaggtttaccaacttttcaaggttttcttcaatggcaatatgttctgatgttcccttttcccagaatctgtcattattgataccatagtgctttaatatatcgttataatattatcaacaaaaatgatgtttaccaagggaaaagtaggttagtcaagtactagagggcgatgaagcagtagaggatggagtaggaatcatcccacagtgtaattgaagactctgaggtctttattacactactg

SEQ ID NO: 110815 - DNA, 148 bp, Homo sapiens
tctgccttgcatagtactttaaataggttgcttttctaaatgcataggtaagtaggcagtttaatactactagaattatttatttcactgttacttttcctactgtatacacctcttgtttatccctattcctctccccctttttttt

SEQ ID NO: 110816 - DNA, 436 bp, Homo sapiens
tgagtagctgggattacaggcatgcgccaccatgcctagctaatgtttgtatttttagtagagatggggtttcgccatgttggccaggctggtctcgaactcctaacttcaggtgatccacctgctccggcctcccaaagtgctaggattataggcgtgagccactgtgcccggccgctttgctcaatttttagtttgcttggctgagagatgtcccttagaagcaattttacccctaagatttagacatcactggaaatttttgcttcagtgaggggaaaaaaagatggaaggacctgatttctacacttacaagattacagaaattaataaggataaagtggctgcattctctctttggcaagagaaataatatgtcaaaaggcacttaaggattcaaagcttccaatctgagattttaatttctcacacatct

SEQ ID NO: 110817 - DNA, 373 bp, Homo sapiens
ctgaaaggaggaccagctttatcaagaatctttttgtcctctttgatggaatgttcctgtggggatttttcagtttatactaatttatactgggatgatttcagctaattctgatttctttagaatgtttttaaatttaaagctaaatttaactttatactttcatatatatatatatatatttttttagatggagtctcactctgtcacccaggctgcagtacagtggcacaatcttggcctactgcaacctctgcctcctggattcaagcgattctcctgcctcagcctcctgagtagctgggatatttattacaggcaccgccaccatgtctggctaatttttgtatttttagtagagacggggtttcac

SEQ ID NO: 110818 - DNA, 414 bp, Homo sapiens
cctgtagtcccaaccacttgggaggctgaggtgggaggattgcctgaggccaggagtttgagacctgggcagcatatgaagaccctgtctctaaaaaactaaaaataaaaaatagccaggtgtggttggtgtgcttgtggtcccagctactcaagaggctgaggcaagagggttgcttgagcccagaagttggaggctgccgtgaactgtgattgcaccactgcacttcagcctgggtgacatagcaagaccctgtctctgtggtggtggtgggtgggggtgggggaaggatttaagaagggtttgtgaggtatgtattatttataaatgggcttttaactttacccttcacatcttgggttgaaattaattgtatccattctcagtttttctgtcttgctatatatttaaact

SEQ ID NO: 110819 - DNA, 368 bp, Homo sapiens
gacctcgtgatccacctgcctcggcctcccaaagtgctgggattacagcggtgagccactgcgcccagcctcctttaacatttcttgtaatgcaggtctactgacaataaattttcttggttttcttttatttgaaaatatctttattttaccttaactcttggagaatatttttactggatgtaaaattctggtttaattttttaaattcccatagaactttaaagatgtttcattgtcttctggcttttattgtttctgataaaaatctgaagacattttgaatcatccattcttccccgtatgttagagagagagagcgtgtgtgtgtgtgtgtgtgtgtgtgtgtgtgtgtgtgtgtgtgtgtg

SEQ ID NO: 110820 - DNA, 870 bp, Homo sapiens
atggtaattgtcaagaatcatatttgtaaccacaaagaacaataatctcacactatcttctgggtaaactgctcctacgtttgaattgattttgtaaagaggtaactgtggtttgtggatgaaaacatttgtttatttgcattttttgttgttgttgtttgttttcttgagacggagttttgctcttgtcgcccaggctggagtgcagtggtgctatcttggctcactacaacctccgcctcctgggttcaagcgattctcctgcctcagcctcctgagtagctgggattacaggcacacgccaccacaccagggtaatttttgtattgttggtagagatggagtttcaccacattggccaggctggttttgaattcctgacctcaggtgatccgcctgccttggcctcccaaagtgctgggattacaggtgtgaaccaccgcacctggcctatttatttgtgttttatgatactatttaccttctcactgccaccattctcagggctttatcagtaccccacaaaaaacacaccttttgatttcctccctttttacctgtggtagtaactcatttaatgccatgttccccccttcatgaagcatcttctagttgcttagtctagaggttgaatttttctttatgctgtcactgtttttagcttgcgtttcttctgggcattccttggcaatgcataatttcgtaattattaagtgtacatatctcatttttaaactgcagaattcctcaaaggttaaactacctttatgacctttatgtctccatggcgttttataataccttagcattccttaaatattcaaatgtataatatgaagtgtgtttgacattctcatagtaatagaataa

SEQ ID NO: 110821 - DNA, 325 bp, Homo sapiens
tttgaattttttgtagaaatggggtttcaccatgtcggtcaggctggtcttgaactcctgacctcaagtagtccacctgcctcggcctcccaaagtgctgggattacaggcatgagccactgcgcctggcctattggttggaattatgttgtaaagaagtgcttttgtttctcccccatttgcttattatcactgtggatatttgggtttgcattttattcagtgagttataatctgttactgtccttatggattccggtgctctagtgctcttgtcccagatttggctactgagagctccttcaggctgattccatcatctttt

SEQ ID NO: 110822 - DNA, 469 bp, Homo sapiens
catatagagcaactagcctcattgtttttgaattgcaagatctctgattggttcttatgcgggggtgatttctgggctttcttgctctataattcactataatttgattgccattgagaatgaaatattttctaggctatggtgcagtggaacctcaggtgaaggattttaaaattaggggagtaggcttgacgcagtggctcatgcctgtaatcccaggattttaggaggccaaggcaggaggatcacttgagcccaggagtttgagaccagcctgggcaatatagtgagaccccatctctattattttattattgttattattattttatactttaatttctagggtacatgtgcacaatgtgcaggtttgttacataggtgtgcaggtttgttacataggtgtacatgtgccatgttggtttgctgcacccattaactcgtcatttacattaggtatttctcctaa

SEQ ID NO: 110823 - DNA, 350 bp, Homo sapiens
ttgttcttctatagtcctcaaccattcccacctgcccacctctactcatgctatcacttctttgctggcctggatggtggtctgagccagtctcctcctcagagactcaaatagaacatccaaaagtcttttgtagcaggcaagtttctgatgcctaatcttagccccatttcttcagctttatgctatatattctgtgctgaattatcacattcttatttttatgttgatttatagccattctatgattgtttcaagagagtttttttttcctcttttctgtgaaagtggatgtaccataaagataagtaccacatcttttaatttattgcatcttaactaaataaatt

SEQ ID NO: 110824 - DNA, 288 bp, Homo sapiens
tggatgaaatttctccttcaaagcttcatgccttggtctttccacattttgaaaattaaaacacccacgggagaataataagctagctgtttcaggtattcactattatcaggagctgggaactggcttgaaaggccttggaggaccaaagaattagggaaaattatgaggagaaaaattacttctgaaaataagaattgactatagaattttaggacgagtgctaaatttgaaggtaggcagaactgtgttcaaattcaagccagaccacaactagctgtatgccct

SEQ ID NO: 110825 - DNA, 285 bp, Homo sapiens
agctggaagtatacttatgatatatctacaagttgctacttcaaaagcaaccttcctacttttccaaataatttataggagtgtgataagctggaaaatggtccaccaaaagatatctacatcctacactgtgaaacctataaatgttttatgatttgggggaaaaacaggtctttgcaggtgtgattaagttgagaatcttgagatgaggggattatccttcatcatcaaggtgggccctaaatgccatcacaaatgttgagagagggagggggcaatctgaca

SEQ ID NO: 110826 - DNA, 409 bp, Homo sapiens
cgcaaccatcttttttatcctcagttggaaaagtgtctgttttcttctaattataaagatgctgcatgctcattacaggaagttctaagagtatcaaaaagtgtgaagaattaaagattaaccaaaattctgggaaaagattgttataacaatgttgacaggcatttacaacaaagcataacattattctttgacattatgctttgttgttgtttttaacaagctatatctagcttcctattattttcattttgaagtgcgacattcacccatcagaatatacactgaactcataaaaatattccatgtttcaaaagatgaaatacaacctttaaataaacacctagaaaaatggcctccctgggcacaggggtgcatgcctgtagtcccagctcctcgggaggctgag

SEQ ID NO: 110827 - DNA, 380 bp, Homo sapiens
aattcttgtgaagattaataatatatgtaaaagtgaattgtaagatactgagctatatagatgttaggtagagtagtttgtaattttatgactatgattgtgtgtagcagtggttttaatttcggctatgcacttgaattacttgtgaagatgtaaagagttgccttggcatctctattttgaaaggtttataggtgattctgatatgcaaagttgagaagcactgccttatattaacaatgttttgcataaatgtcttatgtaagtattatatgaaaagtaatattttattgccatttaaagttcattcatttgctaaatacatattatgcatcaggcattgtcataggttctgaataaacagatgaatcatagcctct

SEQ ID NO: 110828 - DNA, 119 bp, Homo sapiens
gctgaccaatctctgtgcttctgtcccatcacccttcttctgaaatggggatgctgatgtatccacctcctaaggttgatgcgaggatgaagttatttcacctataaagtgctgagact

SEQ ID NO: 110829 - DNA, 393 bp, Homo sapiens
tctgtgcttcagtttgaatattttctactgatctttttttcaagttcactaattctgtcttctcactagttcactaattcagtgttcagcctgctgtgaagcacagagaaaaaaatggaaaaaacaaaaaagacaaaacaatggcttctagaagaaaacataggtaatagcttcttgtcctgggagtaggcaaagatgtcttaaacagaatgccaaagcaccatatatagaaagaaatttgatagacctcattaaaactaagaactcttgttcatcaaaagactcgagtgtgcttctagaagaaaacataggataatcttatctatgtggccttgggtgggcaaaatttcttaggacacacaaaagactaaacataaaaatgtataagataaa

SEQ ID NO: 110830 - DNA, 583 bp, Homo sapiens
ggtaataggagcaaactcagatgatccacatgttgcagttagtagtcaaggattttaacataagtattataaatgtcttgaaaaaaagaaaaatgaacagatagaaaattttgacagagaattggagtctataattaaaaggaatcaaatagatattctagaactgaaaaatatatttgaaattaacattggatgggcttaacagcaggctgaacactgaattagtgaactagtgagaagacagaattagtgaacttgaaaaaagatcagtagaaaatattcaaactgaagcacagagaaaaaaatggaaaaaacaaaaaagacaaaacaatggcttctagaagaaaacataggtaatagcttcttgtcctgggagtaggcaaagatgtcttaaacagaatgccaaagcaccatatatagaaagaaatttgatagacctcattaaaactaagaactcttgttcatcaaaagactcgagtgtgcttctagaagaaaacataggataatcttatctatgtggccttgggtgggcaaaatttcttaggacacacaaaagactaaacataaaaatgtataagataaa

SEQ ID NO: 110831 - DNA, 361 bp, Homo sapiens
ctttgttacctaaacttttcacaacctttataggttacctgtttgttaagatcacttttataagctagtattacaggttgcaaagatctggagatgagtggagagaagagagtgtgtctgtatgtgtgtgtactcagtgatagcagaatagattagaaagagtatgtgtttaaaataacacacaactttattaatttatacaactttgggtaaaatacatcatttctgagtctgtttttccctctataatgggaatacagcaaggttattgtattaaatgagaatgtacagcacatagcatatcacagatgttcaaaagtaactattatgtttattattgtttattaataaaaatgctagt

SEQ ID NO: 110832 - DNA, 407 bp, Homo sapiens
cctaagcccccaggtgaccacactgccctggatgctggatgaggctctgacattgtggccttgagcaagtcccttctctccatgctgacctctaataagtccagtacaaagtgtgaacctgggtcaggcgcggtggtcacgcctgtaatcccagcactttgggaggccgagtagggaggatcacttgagctcaggagttcgagaccagtctgggcaacgtggcaaaaccttgtctctggaaaatatacaaaaattagctgggtatggtggcatgtgcctgtagtcccagctactcaggaggctgaggagggaggattggttgagtccaggaggctgaggctgcagtgagccgtgattgtgccactgcactccagcctgggcaacagagtgagaccctgtctaaaaaa

SEQ ID NO: 110833 - DNA, 450 bp, Homo sapiens
tagaggatcccctcctgcttgtccctaattcctgtttccctaactgaccacctgctttcagttggccacctttccttccttaccctttctaattcctgttttcccacacatagtcacactccttccttgctgtataaactttcgattttagtcagttagagatacagatttgagactgatctctcatctccttggctgcagcaccccaataaagccttcttccctggcaatactcatagtctcagtgactggctttctgtgaggtgaggaacaagccctagaccaaacccctggtgtttcagtaatacctggactcccttctgtggattttcctagagggcagcctttccttgtacaactccatgttccaaacattgctgaccctggggccagaggaactgatataaatagaataggatggaaaacacatcacagggagcaggagaacca

SEQ ID NO: 110834 - DNA, 170 bp, Homo sapiens
tgggcgacaagagtgaaactccatctcaaaaaacaaacaaacaaaaataaatcaatttccaaagcacccttaatgacatatcttgagataatctggcagactagaaagaaaaaaatagtaaactattcccaaacccacggttcaaagatttagtaccctaaatttaggct

SEQ ID NO: 110835 - DNA, 356 bp, Homo sapiens
ttactagttgtccctcaatattccttccattttctttcatataaaaaaactatctgggtatgtaactgcccaacctcctctgaaactaggtttgatgcatgagatgttaagaaggacctgtgtgcctactttatgaaatacctggtgcactcccttttgctgttttcctctcttccttccatcttgtagtctggaatctagatgctaccttggaccatgaggatgcagatcacaccctagaaattagagagttctgaagtggatgtggttgatctgtgggaactttatttaagcactgcaacttgggttttcttcttactcattgctaaatccagtcttaatgcataaatctggat

SEQ ID NO: 110836 - DNA, 614 bp, Homo sapiens
cctcgtctgtgtggacatttcctctccctccctatccctgcacactagggattaacaatctgcacttgttggggagggaaagaagtcacgtttgtcatgttttgtctggcattgttttttctgaaatgattccgttttaggatgtgagctccttcaaataggagtttcaattccttatatataatatacagtactcagcacacagtagtttcctatatataatttttaaaaatcattaagcatttcatctctgtatttcatattttagcttgagttaatagctgtttggggaaaaaaaagatgactagcaccataaatcatattttggtgaccaaaattagtcaaaaagaatatattatactgattttgatattttggattagggagacaacttgatgttaacttacatttaacagaggttccattttagcaacaatatatgcatatcagataaagaacaaaggaaatcagatactgttgtgatgaaatccatcaaattttcaggtaaggcttaaaaagatgaagatagggagaaaaaaccttccatggccatatcaaatgatggaaattaactcagcctcaagggaaaatatcatagaaaatgatgaattgaa

SEQ ID NO: 110837 - DNA, 306 bp, Homo sapiens
ggggttcagcataattatttgcttggttggcaagtttttggactctatccttgagtttttttatgttgtcatataccaggccagattgatttaggtaaaaacaacactcttcatttaaaaatatacagagtcgtcctttttcagcaatgagtaaattgaggccttggcgattttggaggaaagagaattgcaaagccagcaattgtttctttttttatttatttatttacttatttttttaaattatactttaagttatagggtacatgtacacaatgtgcaggtttgttacatatgtatacatgt

SEQ ID NO: 110838 - DNA, 686 bp, Homo sapiens
cagtttccaaaggaaccatttaaaaattattgtctgtattttgggcccattaaactctactaaaaaatcattgactatctgggaaaattgtctacatactcccatctccccctcacctatgaagagggtgcatttaaacctcagctctctggcccttctttgagtctcatagtttttatggttcctgggctcatgtacattaatatatgtgtatgccttttttgcctgttaatgtttctattgtcagtttctttcaacagagttgaactttcagagggaaaggaaaatttctcttcactcctatgaaaggaaaatttctcttcactcctataccaatcagctatatattttgttgatacagtaaaaatagtaaatagtaaataataaactttcatattttcaggaatttgtttaggaagaatatttgaataaactggatattttgcttaattagcaattatcacactataaatattatatgcatcacacagatgattattttccagataaatagggtacaatggaattaatgtatcactaaaattctgttaaaaatcattgacaacctgattaaaaattcgaagacctttcaaagctttaggttcaccattctaaatatatatttaattaccaagaatcttagatagaagcagggattatgtggtggtagaattttatttgcaaat

SEQ ID NO: 110839 - DNA, 664 bp, Homo sapiens
gaaacttaaacctaattagcttcatggtaagttcacctcttttccccaggacaaacaacttaatgtctgtttggagtttttcccttcataaacatgtttttttttctcatgcaccagcaatcctttactttctacaaccactaccacaaactctccctccctgccattttccctgccccaaaattaaggtaaaaaacaaaccaaaagggggcgttagagaaataaaactatattaaggatatatccttcttggaggatcatttagctggcatagggcaaaaatatgacaaattaggattgggatgaatcactgattatgtagtgtatgttgagtatagaattagcagctgattgggaaattcatccaaagctgtataatatgtgacctctggcaaataaattgagctcacctataaaatgaggggattgtattatatgcttgataaaatatatggtgaagtggtattaagtgctatttggctctagcattcaggaatacccacatcccaccagcaactgcagtaactacttttcaccctctcatcccaaactgttcccacagaagagtagtagcaaagttaaaaaacaaaaatctctctttctctcccccttccttcctgcctccctctttctctctccctctctctttacctctctctccctc

SEQ ID NO: 110840 - DNA, 308 bp, Homo sapiens
aggtaggaggatcatttgagaccaggagtttgaaaccagcctggacagcatagtgaggctttgtctttacaaaaaaaattagattaaaaagaaaaaggagttggaggatatctgctgataggagtagagtctcccagtttagtagctatcaatgggcattagggaatgaatgaatgaatgtggaaccaatatgcacgtgtcaactcaatgagattgacatgtggaaattgagattcccaaatgggtgtttttgtttgttgtttatttgttccttttaatctctaccatttgtgtcttttgccacttct

SEQ ID NO: 110841 - DNA, 731 bp, Homo sapiens
atcattatcaccatgaactaaaaactttctagacaataaaattagtattatgtgatgaatccaatatgtgtaattgaagtttttcagagaactctaattagtgcaagttctcctgtgctttttggtcctttcaccctttcatctcttttaaactttagaagcagaatgatactctcaatatattgattgtattccctccattttattggagagactagatcatagttaataaaatatgttattggactgttaggattatgtatatatttagaaaataagacttttaaaatactttgtgaacactagcaaattttacaggtggtaatagctatccagattgctaagttatttttaagaatatctgtcttgagaatggatccacataagtaagttgataaatgccactagttgataataatagcaggttatcagcatgcactgatttaattttcatactttaaaattttcaaggctactctgaagtttgatggtatttttgtaattttgctgaagcataaaatcttaaaaaaaaaaaagttttatgaagctcctggataggctaagtcgtaaagaagcctactagccacaacaactttttcatttcaaatgaccttttgatttctaataaaattcctctttatcatgaagttttcctctaatagaatttgagaaattaagtattagtgtggaaaatgctaagtgctagttgaatgaatataaattgtgtggtg

SEQ ID NO: 110842 - DNA, 845 bp, Homo sapiens
cacagtggctctcgtctgtaatcctggcgctttgggaggccaaggcgggtgatcatctgaggtcaggagttcaagaccagccttgccaacatggtgaaaccacgactctacaaactacaaaaatgagccaggcatgatggcaggtgcctgtaatcccagctacttgggaagctgaggtgggagaatcacttgaacgggaggcggaggttgcagtgagccgagattgcgccatagcactccagcctgggtgacagagcgagactccatctcgcggggtggggaagtgaaatccagtacattttactaacagtggaaatacaactagaagttgttgggtgaaggagaaaaggagtaagggaattaatattcagtgagggcttactataattgaacttcttttccattctgtgttcttttattttatgcttattattttaattgactgttaggattaagcaatccaaataagccggaacctatgaaaataacttctaattaccaataagctttcattcaaaacttcactcaaaggccgggtgcggtggctcatgcctgtaatcccagcactttgggaggccgaggcaggcagatcacgaggtcaagagattgagaccatcctggccaacatggtgaagccccgtctctactaaaaatacaaaaaattagctgggcgtggtggtgggcatctgtagtcccagctacttgggaggctgaggcaggagaatcgcttgaacctgggaggtggaggttgcagtgagctgagatcgcaccactgcactccagcctgggtgacagagtgggactccatctcaaaaacacaaaaacaaaaacaacttcactcttca

SEQ ID NO: 110843 - DNA, 264 bp, Homo sapiens
aaatgaaggaggcagtaatcagggtgcaacaccaggtaattcagaaggctccatgtgacaatctcagaaggagccccagcagcctgtagagccctaggagacttcctgaggatgtgagcccgtgtgtcaccttgggctcgcttcgacttggatcatgagtaaggcaacctcactgtataaagcaattggtgagtaaatccacaacttcaatgagaaagccaaggaatcaggtgggcacagtggctcacacctataatcctggca

SEQ ID NO: 110844 - DNA, 137 bp, Homo sapiens
ctgcagagggtgggggcagctacttttctttcccatttccgctgcgacagttgtggtcttgcctcacgggagcttccacggttggctagaggttccctgagaagcaagtctttgtctcaaaaaaaaaaagtaaataa

SEQ ID NO: 110845 - DNA, 296 bp, Homo sapiens
cctgtgcctggctaatttttgtatttttagtagagatggggttttgccatgttggccaggctggtctcgaactcctgacctcaggtgatccacctgcctcagcctcctgaagtgttggggattacaggcgtgagccactgtgcctggccaaaatatttttttaatttagaaaaaaaaaaaaaaaaaagcactctggctcctgtgtggaaaagtaagtgtgagagatgcagaatcgaagtaagagaaatcattggtaggctaggactctgctgggagctgtcggtagcttatactaa

SEQ ID NO: 110846 - DNA, 361 bp, Homo sapiens
ttgcgccccttcctgcgagttcggatgcacccctcctagaagcgcactgtctgctatacccatcctagaagcgctttctctttcatcacgggtgctgcaaaatcgaaacgtagctacagagaaggtaagagcgaatatcgccctttcctcctctgaaagggaaaatgctggttatcctagagctgcatgtgaattttacaaacatttactagaacaaccaactcttcaagccttcaggctctatctgtttaaaccagtgaatggataattaatagcagcctccttttggggttttgactagattgccagattctgcacagctagggtcttcttgcctccaacttgccttcctgagccgtgc

SEQ ID NO: 110847 - DNA, 605 bp, Homo sapiens
caaacaaaaaaagattgaagtaatgaattttatttcagtggtatggggaaccttgtttctgacagtaggggaagctatcatgttcctggtaggaggttgcatcttatttcaagcggtgggaaaacaggacctggctttgcattagtaactgaagccaggtggtgaactctcagcatgtgtaaggagccggctgagaaggagctttgctcccatgatattaaattatctgattattgaaaacttttgtaaatggtcattagtgagcaaattgtctttttaaaaattctattatgaaagagttttaaacttaacagaaaataggcaagaacagtgccaagaactcctgtacactcctttgcccagagactattcctttagagcaaaggctacagcccagaatcacgcgcttcaccccattcatcacagctctcctttctgtccatctggtgccactcctcagttttcctgaacttccgcgattttggcgtttgtggaggttataggctgatcattttgtagaatgtctttcaatgtggattcgttgatgtttctgcatgattagaccccacctgtgtgtacttgaagcctgaatgtcacagactctg

SEQ ID NO: 110848 - DNA, 720 bp, Homo sapiens
gggcactatctaaaggctcacaagtatataatcatcacaagtatgtctcattgcctcccccttttaaggaaaatgcataaatgctaaatctcctgagaacctcttagggaaaaagcagccacaaaggtagctgtgacttgggtttttcccaggcatgctctcaagctggaataatagaccttgatgacggagccttctgcctcagtcactcatttcggttgtcagtactaatgaaagtaagaattttatgtttttgtgctttacaaatatacttctatatagtaagagactgataactctttcatttacctttttaataataattcaagtgctctaatgccacaaagctaactttttgaccttaagagaataccacaatttctttggcctttggtttccgtgtaaaatccaggattttaagtaggtcatctccaaggctctgactggttctaaggactgcaggagggaggaataagacttcttcatagcttataaattgattgagacagttgcaaaaatacttgtatttagttctgtctgttgacaaatgcagaaatcaaagatgaagtctgcaatgatgcgcctaccaaatcacatatatgttgtaacatgtaggccgatgtataagagacatgtgtgactcatggccagattttaggtttacagtttaattcaggtacatgatttgtgtcctttgagtttacatttgacataaaatat

SEQ ID NO: 110849 - DNA, 369 bp, Homo sapiens
cctcgcccggctaattttttgtatttttattagagacggggtttcactgtgttagccaggatggtctcgatctcctgatgacaaattatttttctaatatcataatgaactcatggatttaagtgtatttgatggatttcaagctactataattattacacaatcatgcatcattcaatgacgggcatatgttctgagaaatgtgtcattaggtgatttagtcactttgcaaacatcacagggtgtacttacacaaacctagcttactacacacctaggctatatgttatagcctgttgcttctgggctacaaacctgtacagtatggtactatattgaatactgtaggcaattgtaacacaatggtag

SEQ ID NO: 110850 - DNA, 733 bp, Homo sapiens
aggttgtccaattactagcagggctgagttttatcactgggttaaagcagtgtctgttgtaaaaacacattttccatttgtaattaatcagtaatgtatggaggtagtaactggaggctgtgaacatcatgttccccaacatttcactcagaggattttgtgtccattgatgattcttcctaattagttattacattgttggctacaaagtgatgatttctaatttaattatgattcctttttatatattagcagatattcttcagtataagtcagctatattccccttttaaaatatctggacttccggcctcatgaactcatggattctcttttagatacagtattataatccattaacactgatattctttttgaagctcaaattgtccaaactttggccaataacagctcctttagtgccacgttggtggtataatggtgagcgtagctgccttccaataaaagctccttcgagctgactgctgtgtccttttgaaacgtcctcattagtctttcaacaattctttgctttttagcagaataagatattccaggctctgcttctacttttactaccctagatctgaaatgagcaatttctccaaggaaaacctggttcctttttgtgggaaatcatatttattaatagtaaccaaggtctgggtggcagttatgctcattgctactgggtactattgcttctaggccttgtctggaaagagctaatgtg

SEQ ID NO: 110851 - DNA, 309 bp, Homo sapiens
agaagggtgattttcctgcaaggaaggcagacactgctgtgagcaaggggcatgtggccacacagaggtgagccaggcatgctattgctccccattgagctcacaattggagaacacccagccagtccttgccagccaaagtcacatggcatctcaaggacgctcacctgttcaggctttcaccacagcaacgaaacatatacaactctctgccaagaagtccctgcctaatatggtttggctgtgtccttgcccaaatctcaccttgaattgtaataatccccatgtgtcaagggtggggccaggtgg

SEQ ID NO: 110852 - DNA, 416 bp, Homo sapiens
gagaaatctgacatagttgactccttcttgcttctagctttcaagctgtccttggtcattcctaggcattggccaagctaattttgggaggatttagtttatagtttaaccttaaagcaaggatgataatagcccttcccaaaactaaactgcttttgtaaaattaatgagaggccaaaagattaggattatgctgggggcttgaattctgctaagacataggcatagttaaataacaaccagccattgttccagaggtcacaagatttgtaacttctccaattactcctatagatggcatcactattgtagaacctaagattgctcttttgagatatttttcagactttgcattttggcaactgactgactccacctggactcatgactcaactggtcttgtggcccccaaccaa

SEQ ID NO: 110853 - DNA, 349 bp, Homo sapiens
aaaaatgcttgaagaatttgtaatcatggacttttatacaccatttaaatgaaaactcagtatttgaatctggtggtgatttaaatatttatgtaaaagaggacattatcagattattttcctgtcattcttattcctctataattttccccaaatttttgatattggccacttttgtacctcctgcagatgtcaacaatacaagggtcctcatgtattgaaatacccacttacgggtatttcagagactgagccgctggaagcccttggcagtgttttcataagggctgatgcattctcttatgggtagaggccatggctcttacagaaaagattattaggcttaaaa

SEQ ID NO: 110854 - DNA, 248 bp, Homo sapiens
gctctgacttggctgtctgtatacaatatggtggaagagagtttggcaccctgcaagaactcaagaaagcctagatgaacaagaacataaacatggtaattctgctacgggtaagtatcatgacagaaatacacagagtgatgtgatgacaaggagtggcaggaagagggataacttcagtggttagaccttttttttttttttttgagacagtctcgctctgtcacccaggctggagtgcagtggtg

SEQ ID NO: 110855 - DNA, 397 bp, Homo sapiens
taaaaggccagtattacttgccataaatagaaggttactgtaaaaacagtgaacaaactcatgttttcaaattatagctagatactgtttgcagaaggctttggtgctcccgcttcactctctgttgcaaagggaattcataattaatggaagtgttagaagcacactagcaccagactgagtctttttactgggaagaatcagaattaaagaagaattgagaaatgaacaactttcttatgatgtgatttctgagtcccacatgtctagaactactcaagttatacaagaaatacgtgccccagagctttggagttcctcatcaacccagagcctaccaatgagtgggccacagcacatgacagtcctatgaatgggttggaatttgctcaatatt

SEQ ID NO: 110856 - DNA, 533 bp, Homo sapiens
tgctgaatgaagtgagtgtgctctgtaggccggacaccgtggctcatgcctgtaatcccggcactttgggagactgaggtgagtagatggcttgaggtcaggagttcgagaccagcctgggcaacatagtgagaccttgtctctactaaaaatacaaaaattagctgggtgtggtggcatgcacctgtaatcccagctactcaggaggctgaggcacgagaatcatttgaacccaggaggcggaggttgcagtgaacagagatcgagctgctgcactccagcttgggtagcacagcaaggctctatctcaaaacaaaaaacaaaaaaaaaagtgtgctctgtccataatatggaatgctatttagcaacaaaaaggaatgaagtacagatacacacaacgacatggattaacttcagaaaccttatgctaagttaaagaagccagatgcaagagactacagactttataccgtataattccatttttatgaaatgtctagaaaaggcagatagaaacagacagatgagtgttt

SEQ ID NO: 110857 - DNA, 248 bp, Homo sapiens
ctctgcctttacacctacgatctccagagcactggcgagcctccagacaaactcaggaggaaagaaagatgagccacatttaaaaggcacttgttttctggagaggggtgggggtgtaaatgatgactagaaaaccattcacagatttatgcttcgaccctcactttacacccttgtagtatctgaccattactcacagtgggtatcttatcaggagccttactatattttatttacaagggagcttg

SEQ ID NO: 110858 - DNA, 295 bp, Homo sapiens
tttttgaggcagagtttcactcttgtcacccaagctggagtgcagcggcatgatctcggctcactgcaacatccgcctgcccatttatggtgataacaacttcttcctctcttacttcctccctctctgtcttcgccctgcccccagctatccgtctatactagttttctatttctgctgtagtaagttatcacaaatgtagtggttcatacaacacaagtttattatcttacagctctttaggttagaagtacaatatggcttggctctgtgtccccgcttaaatctcctgtca

SEQ ID NO: 110859 - DNA, 398 bp, Homo sapiens
tttcagtacacactgtcctttgaatgtattttccccagtagagctaaacatatttctctcttaaaaacttctaatgccttccgttagaatggagacctttgtgtggcctttagcatacctgcctctctgcctcgcccacactgatggccatttagtttctccaacttgacattttgtctcctgcctagggcttttgcatattcctcttgtcccaacttgttcttcacatgcattcttcagctctcagctcattcattccttcagaaaagcctttctgaatcccagattagctcaggttcttctgttatacctgcaccccatgtgtttccttcaaggcatttatagtagttggaatggtacactgtatgactatgcgatcatgactgtcttccctgtta

SEQ ID NO: 110860 - DNA, 160 bp, Homo sapiens
ggagcagcagcctttccttctgcaggacgggggcacaggccatgtctggtgcccgggagaagcgtgtcagcaagcgcctgagcccctgcccagggcccgactcccaccaggcaggggacagaaggtctactgcacgatggggcaaggaaggacgaagcag

SEQ ID NO: 110861 - DNA, 469 bp, Homo sapiens
atggtagaaatatttttatgaaaaactttgaaacaaacaagccttctacgtccattaagataattttgcgttgcttacagcactacaaatcttccaaatacaggcagtccccaacgtacagacatacaggacacctcccaaatgtaaacgacagccacacagcagggcttgcatgtgcaggaactcttcttctcccagtgagcagactaagcactctgaatcccaccccactgcctcgcagagggaaagaaggcaggacagatgcaagaagagtaatgtcaggggctccatcacagctgcccaggggcttctgctgtagttcatattttcctcattcccatctctggtttctcccataacccagaagtccctgccaggggcggtgggtcacgcctgtaatcccagcactttgggagaccgaggcaggtgggtcacctgaggtcgggagttcgagatcagcctggccaat

SEQ ID NO: 110862 - DNA, 524 bp, Homo sapiens
ggtaaacatttgttaagttaatgaataaattgttccctctttgcataaaattcaaacacttaatttggtctagaaaatctttcacgatctggcccctgccaacaccactttctcatgtactcatggcaatcttgtcacactggctctttgcatggctgtttccttctcattctttatgtctaagaggtcttccatggtcatctcatctaaagtaggtgcttcttgtcctctctctgagtactttgttttactttaggcaaatcatgattaattgttaaatacatggtataggcttgctattccctgggaatttgtaagagatgcagaatcttggttgtcaccccagatttactgaatcggaatctgtatttttacaagatcgtctaataagttgtgatgacatcagagtttgagaagctgggatagaaactgaaaggacagctgggcacggtgcctcagcctcccgagttgctgggactacaggcacacgccaccatgcccggcaaatttttgtattttttttt

SEQ ID NO: 110863 - DNA, 548 bp, Homo sapiens
atccttcattatgccaataaaccaccgtaggctttcctcaaaatgtagatgagacatcaccatgttcagatacctcagcttcttcatatataaaatgggaatgacagtaatatccacctctaaaggctattatgaatagcacaatgtaaatgaagcacagtgacaggcttatagcaagagcacaagaagttagagtttgagctgggtacagtggctctcgcctatagcccgagctacttggtaggactgtttgagctcaggaattcaagtccatcctgggcaacatagtggaacctcatctcaaattgtagtttgagtctattcattggacttacatgttttttgttcttgttgcctctgctgctctgtatgcagctgactaaatcaagtcactgttcagtgtcatatggatgtatcccaacacagctaaaccaggaggtttgataatgtcatatcatggaaattttaacatgaatctctatgttgtcctgtattttagttatattgaatattatgttaattttaagtaaatttctgttgcctttaca

SEQ ID NO: 110864 - DNA, 332 bp, Homo sapiens
tatatatgcaaccaacaacactggagtacccaggtatattaaacaaatattattagtgctaaagagatagaccccaatacaataatagttagggatggcaacatttcatactcagcattggacaattcatttggatggaaaaatatcaacaaggaaatattagatttgaactgctgcttcgttagcacacagcacattctccaggatataccatatgttaggacacaaaacgggtctcaataaatttttaaaagtcaaaatcttatcaagtatcttctcagaccacaatggaataaaactggaaatcaataacaagaggaacttctgaaatt

SEQ ID NO: 110865 - DNA, 344 bp, Homo sapiens
aaacctttccaaggcttggtttacttatctgtcaaatgaagatggtggtgcagttttcaggctgcaagtgagtgtgtaaggtcacttagctcataatatggtgacacatttcacaggtctcatgatcagatgaggaagcacatagtatcattcggccttttatacaggtccactggttacctgttcttggtaacagggtgaaggctggggtaacaagtcctgccgggagactgtaagaggttgcatggcactgtgggtcagagtagcatggatccagaccgcctgcatgtacattctggctctgccacttattagctgtgtgccattgggcaaattatttaacc

SEQ ID NO: 110866 - DNA, 225 bp, Homo sapiens
gctagaattataggcttgagccactgcacctggctggctgtgttccctgttgtgtgttaattatagtcagaattggttcaagacaacttggacactgtgtatgtggggacagcccatgagaaagaaccaccaactactttaggtttctaaggtttcatattgaagctcaacaggaactccaaccaaacctactgtaagaaggaactgacttacgaggcacagtga

SEQ ID NO: 110867 - DNA, 695 bp, Homo sapiens
gcttttattaggatcttgttatgtgcaagcaaaggtatgcatgccatatcacatttaatctccaaaacaggcctacaagataagttctctttccatgctcatcttaaagatgaggaaaacaaggctgatagatattccttaaaattactggagttaggccaggcgcggtggctcactcttgtaatcccagcactttgggagactgaagcgggcggatcacctaggtcaggagttcgagaccagcctggccaacatggtgaaaccccgtctctactaaaaatacaaaaattagccaggcatgatggcgcatgcctgtaatcccagctactcaggaggctgagacaggagaatcacttgaacctgggaggtggaggttgcagtgagccgatgtcatgccattgcactccagcctgggcaacagagcgagactccatctcaaaaaaaattactggagttatagagaagcccagatcccatagagaccctgacttgcacacaggtctctggcatctacatttctgaccttcgttacatcagtttgcactctccttgcctcttccaaatcagcacaaaatattaatgctcttcctagttgctctcaaggaacttacctcttagagtaccaggctgcatgctggccaggctatacttggcaagagcagagtttctagaatcatctcttgtgcactttgatg

SEQ ID NO: 110868 - DNA, 764 bp, Homo sapiens
tattgataaattttattctattaaaactcagaattgatatttattaaaagattccataaagaaagcaaaaatcaagctacaaacattttaacatacataatcaaaaaattatttgcatacaaaatatgttctaattctttaaaccatttatgtgtgttatatacactattctgaaaacaaaaaccagcacccaagacagacaaagcgtgtggagctagtgtggctaagttgaggcgggaaattaatgctgcaacaaagttactgactgtctccaacctgttttgtggtgttacacatgggcataataatagctccttcctcataaggctctcggagctataaaccacagtgtgtctaaaataccttgcccagggtctggcgcatggcaagagctcaaccaatggtgaatggttggaactataaataaataatcgtgtcagagccgagtgggaatcaaactcagctccttaagtcctccatgacctagacaggattattccagaccatgtggcagaagttaaggggccttggcgatgaaggcaagaatgcccacactgtttctcctgttcctccctctttctgtccctgaggcagtagctgtttactccaaactgagtctcccacacatatccagcagggctcagcctcagggaatccataggattctgggggtggacctttgggaggagaaaccatctcaactaagacactttcctctctcgtcagcaaagatattcagagatggatagccgacttacattttt

SEQ ID NO: 110869 - DNA, 317 bp, Homo sapiens
gtgacataaacgtgcatagctagaggttgtctagcaatatgaatgtgtcctatggcatctggcacccaaagtgtgtggttagtagaggaaaaacaaggtttgatgtcaaaagccagtctggggaaaattctttaagattttgtagctttaatgaaagagacttgttaagaattttcccaggtttgaccatagtcctaaaagttgatataacattatttattgatgatgttcctgtgctaaaagaaaacttttctaagccatcaataacaacaggctgagcgtggtggcttacgcctgtaatcccagcactttgggag

SEQ ID NO: 110870 - DNA, 248 bp, Homo sapiens
catatggctgagtctagctccagtgaaagccaagaaatacagtattacaagtggccatgttccagctaaaaatcagcattccattattaagaagggaaagaatcattatttgatagaaaacttgcagtgtcagacacaaattccatgccagggagtctgggctttatggagcaggtaacctttgaagaattctcagcaggtcttatgacatgagtggatttatattttacttttacgtgcgggtgggg

SEQ ID NO: 110871 - DNA, 409 bp, Homo sapiens
ttttttttttaaagacggagtctcgctctgttgcccaggctggagtgcgatggcacaatcttggctcactgcaacctccacctcctgggtgcaagctgattctcctgcctcagcctcccgagtagctgggattacaggtgcgtgccaccacgcccagatgatttttgtatttttagtagagatggggtttcaccatgttcgtcaggctggtctcaaactcctgacctcaggtgatcagcccaccttggcctcccaaagtactgggattacaggcgtgagccactgcgcccagccccaccttgctctttctcttctaccacacactacagaatcttctcccactctgcaccctcaactgatgaccttgcttcccatttcaccaagaaaagagaatcaccgggaagtgagc

SEQ ID NO: 110872 - DNA, 513 bp, Homo sapiens
tgaatagtcaactgttgtgactatttcgatcactttttgtgcacagacaattgtaattgggccttttgagggtaacgtttgggaaacgagcattctgagaatttggggtggcttaaggaacgtatatcacgttactcatacccaccaaacatgtatctcctttaaaaaacaaaaatggtaaatgaaaggaaagaaaaaaaatgcatacctcagaatgcactgctttacattctctggatttctgaattctcatttgtagtggccagtaggactgcttacatatcttctggttctcctgttctggtcttatggtaggattgtatttcctttcactctttagtgttaggcatggatatatcactaattttggccagtcatatgtgagctaagtgctagtgtgttagttcccatgtcccctcagctctgcttccttgggccccttagtgacgacagtgagctgcccctccctaacccccaattctatattaacaataaggtaggagtgagatagaa

SEQ ID NO: 110873 - DNA, 268 bp, Homo sapiens
ttgacagtgcaggccgggtatggaggtaacataaagccttccaagactcaagctcctcctactgcattgttcagttaaaccccattgtaaggtttgtccttagaattcaagatgattgctagaactccagccattacatctgcattcgtggcaacagaatggaaacagggaagaagggccttgccttttaaggagactccatgaaagtctcacacaagactttcatatacatcttattggccagaacttagaacatggttccaccagg

SEQ ID NO: 110874 - DNA, 344 bp, Homo sapiens
cacacacgcccacacgtgcttacacacacaccttaactttttttgcacagaagttgtgttgttcctggtcagtgtataacattttttgcaactttttgagtcactctggaagacatattcacattcatgtggcttaaacttactccttgaaagtcttggaggaaaatgcttaaaataaaacaaatttgagtttgcgacatgggccccttatttaactgcggaacaaatggttgttattttaattaccttttgtttcattgtattttaactcatgaaatgcaagtgttactgctactggtaggctttttccagatggaactaagcctatttattcttaaaaacat

SEQ ID NO: 110875 - DNA, 502 bp, Homo sapiens
ttgttgatcttttttgttgatctttttacttacatgattaattaggtgggatggctgggtaaaatccttgccatttttttgttacccctttaattttgtcatattcctacaatactttcattgtttcaggaaattatattcgaaatttaggatttctgtgttggtttattaaccttaaaatgagtttgaatttgtgaagtagtaaaatgtaggtagttggcatttatttgatcagattacattgtctcaaattggtttctgagttttattgattttgcagctcagcctttcagtttttctctaaaattattctgcaaagtgtactttttcttttagatatctcaaactaatgattattttggcaaatcgactctttcattcattcaaaacatatttatggtatgcatgccatgtgccagaatctctgctaggctctggggaggtgatggccagtggaaacatccctgcccttgtgaaactttgcagtgaactggggaaagga

SEQ ID NO: 110876 - DNA, 504 bp, Homo sapiens
cgctccccaatgacgtaactgccctgcagcttctagtagcttttcgcagtgtctcctaccgccgggcgcggtggcgcgtgcctgtagtcccagctactcgggaggctgaggtgggaggatcgcttgagcccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgagcaacatagcgagaccccgtctctactaaaaatacaaaatattagccgggcgtggtggcgggcgcctgtagtcctagctactcgggaggctgaggcaggagaatggcgtgaacccaggaggcggagcttgtagcgagccgagatcgtgccactgtactgcagcctgggc

SEQ ID NO: 110877 - DNA, 343 bp, Homo sapiens
cgctccccaatgacgtaactgccctgcagcttctagtagcttttcgcagtgtctcctaccgccgggcgcggtggcgcgtgcctgtagtcccagctactcgggaggctgaggtgggaggatcgcttgagcccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcccacaacccacgcgcccacaacccacaacccatgacg

SEQ ID NO: 110878 - DNA, 497 bp, Homo sapiens
gaaaagagacttgatcatttctggtgccttagaaagctgctagcgcgtgcctgtagtcccagctactcgggaggctgaggtgggaggatcgcttgagcccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgagcaacatagcgagaccccctctactaaaaatacaaaaattagcctggtgtggtggtgcgtgcctgtagtcccagctactcgggaggctgaggcaggagaatcacttgaacctgggaggcagtggttgcagtgagctgagatcatgccattgtactccagctcaggtgacagagtgagattcagtctcaaaaag

SEQ ID NO: 110879 - DNA, 364 bp, Homo sapiens
caggcggatcacgaggtcaggagtttgagaccagcctgaccaacatggcgaaaccctgtctctactaaaaatacaaaaattagctgggtgtggtggtgtacgcctgctgaggctggaggatcccttgagttcaggagttctgggctgtagtgcgctatgccgatcgggtgtccgcactgagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgggcaacatagtgagaccctgcctcttttg

SEQ ID NO: 110880 - DNA, 246 bp, Homo sapiens
cctggctctgaacttaggggacaagagtattattaaaacatccgcgcgtgcctgtagtcccagctactcgggaggctgaggtgggaggatcgcttgagcccaggagttctgggctgtagtgcgctatgccgatcgggtgtccgcactaagttcggcatcaatatggtgacctcccgggagcgggggaccaccaggttgcctaagttcagaccagtgaatcctctagagtcacctcagcatagcact

SEQ ID NO: 110881 - DNA, 391 bp, Homo sapiens
  misc_feature (383)..(383): n is a, c, g, or t
cgctccccaatgacgtaactgccctgcagcttctagtagcttttcgcagtgtctcctaccgccgggcgcggtggcgcgtgcctgtagtcccagctactcgggaggctgaggtgggaggatcgcttgagcccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgagcaacatagcgagaccccgacagacctgcctgccgggatcctctaagntagctcac

SEQ ID NO: 110882 - DNA, 467 bp, Homo sapiens
  misc_feature (18)..(18): n is a, c, g, or t
gacaattccagctcggtnccccttttggggtctttggcgcgtgcctgtagtcccagctactcgggaggctgaggtgggaggatcgcttgagcccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgagcaacatagcgagaccccgtctctactaaaaatacaaaatattagccgggcgtggtggcgggcgcctgtagtcctagctactcgggaggctgaggcaggagaatggcgtgaacccaggaggcggagcttgtagcgagccgagatcgtgccactgtactgcagcctgggc

SEQ ID NO: 110883 - DNA, 459 bp, Homo sapiens
tagaggatccccagttcccacactgcacgcgcgtgcctgtagtcccagctactcgggaggctgaggtgggaggatcgcttgagcccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgagcaacatagcgagaccccgtctctactaaaaatacaaaatattagccgggcgtggtggcgggcgcctgtagtcctagctactcgggaggctgaggcaggagaatggcgtgaacccaggaggcggagcttgtagcgagccgagatcgtgccactgtactgcagcctgggc

SEQ ID NO: 110884 - DNA, 621 bp, Homo sapiens
atcccccgaacatgccgtggctgggcatggtggctcatgtctgtaatcccagcacttagggaaactgaggcaggaggcacgcttaaatccaggggttcaagatgcctggacaacacagcgagaaccccatcactaccaaaaaaaaaaaaaaaaaaagcaaaagcaatccaggtggcatggtggtacatgtgcgcgtgcctgtagtcccagctactcgggaggctgaggtgggaggatcgcttgagcccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgagcaacatagcgagaccccgtctctactaaaaatacaaaatattagccgggcgtggtggcgggcgcctgtagtcctagctactcgggaggctgaggcaggagaatggcgtgaacccaggaggcggagcttgtagcgagccgagatcgtgccactgtactgcagcctgggc

SEQ ID NO: 110885 - DNA, 489 bp, Homo sapiens
cagtcggtaccatgttgaaacccgtctctactaaaaatacaaaaaattagccaggtgtgcgcgtgcctgtagtcccagctactcgggaggctgaggtgggaggatcgcttgagcccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgagcaacatagcgagaccccgtctctactaaaaatacaaaatattagccgggcgtggtggcgggcgcctgtagtcctagctactcgggaggctgaggcaggagaatggcgtgaacccaggaggcggagcttgtagcgagccgagatcgtgccactgtactgcagcctgggc

SEQ ID NO: 110886 - DNA, 459 bp, Homo sapiens
ttggctgggcatcgatcagaatgaatttgcgcgtgcctgtagtcccagctactcgggaggctgaggtgggaggatcgcttgagcccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgagcaacatagcgagaccccgtctctactaaaaatacaaaatattagccgggcgtggtggcgggcgcctgtagtcctagctactcgggaggctgaggcaggagaatggcgtgaacccaggaggcggagcttgtagcgagccgagatcgtgccactgtactgcagcctgggc

SEQ ID NO: 110887 - DNA, 519 bp, Homo sapiens
gatgggatgagaatattcacatttcattctcataaaaatgctgccaaggtcaggcacagtggcacatgctacctgtaatcctggcactgcgcgtgcctgtagtcccagctactcgggaggctgaggtgggaggatcgcttgagcccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgagcaacatagcgagaccccgtctctactaaaaatacaaaatattagccgggcgtggtggcgggcgcctgtagtcctagctactcgggaggctgaggcaggagaatggcgtgaacccaggaggcggagcttgtagcgagccgagatcgtgccactgtactgcagcctgggc

SEQ ID NO: 110888 - DNA, 617 bp, Homo sapiens
cgctccccaatgacgtaactgccctgcagcttctagtagcttttcgcagtgtctcctaccgccgggcgcggtggcgcgtgcctgtagtcccagctactcgggaggctgaggtgggaggatcgcttgagcccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggggcttgctacaacccccacctcccagccgcctgccttggcctcccaaagtgctgagatcgcagcctctgcccggccgccaccccgtctaggaagtgaggagtgcctcttcctggctgccaccccatctaggaagtgaggagcgtctctgcctggcagcccatcctctgggatgtgaggagcccctctgcccggctgcccagtctgggaagtgagaagcgcctcttcccggccctcatcctgtctaggaagtgaggagcgtctctgcctggccgcccatcgtctgggatgtgggaagcgcctctgcccggccgccccgtctgggaggtgaggagcatctctacccggc

SEQ ID NO: 110889 - DNA, 334 bp, Homo sapiens
cgctccccaatgacgtaactgccctgcagcttctagtagcttttcgcagtgtctcctaccgccgggcgcggtggcgcgtgcctgtagtcccagctactcgggaggctgaggtgggaggatcgcttgagcccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcagggccaagatcacgccactgcactccagcctgggcgaaagagcgaaactccgactcaaaaaaaaaa

SEQ ID NO: 110890 - DNA, 1980 bp, Homo sapiens
agcagctattttttccggtcctgtgatatcagaattgaccaaggaatacgtatattgtaattgacacgtggtggtatcttccaggtacaaattctctaaattttgtggttagcagaatgggacttgtgataagaatagcttggttttagcataactagggtttaaaataattgtttaattatagagactgaccaggctttggccatctaaactggaaagtgttagtaccctaccttcttttgaaaatggctatggtaaggaaaatgtgttagtaaattatgtattttcttgaaaaatacataattatggttggatgggaatcactaagttgggtgttaactgatgtctcaattagtaacattaggattttcattaataaacctaaaaagctttccctaagaacaggcctggcacagtggctcatgcctgtaatcccaacactttgggagaccagggtgggtggatcccttgaggtcaggagttgaagagcagcctggccaacatggcaaaaccccatctctacaaaaaatatgaaaatcagccgggcttggtggcataccatagtcccagctacttgggaggctgaggtgagaggatcgcctgagcccaggagacggaggttgcagtgggctgagattgtgccactgtactccagtctgggtgacagagccagaccctgtctcaaaaataaagaggattctgagtttgtatagtgagggcttgcagaaattttgaaacttattttgtaagtttacaatgaatttgtacatgatgtgctcatgtcttgggttgagtatcctagacatgattttttcatttgctgcatattaaacatttgttggttgtagtcggtatttcttaaatagaagtttgtcaatattagattagtttcaagaaggacttagctcaggaaaaggatagttatttctgtggttctcagctttgatgcctacagagattctgatttaaattgctggaggagggcccaggcatacattttttaagtttcccaagtgattctaatttacatctagggttaaaaacagccaggcgcggtggctcatgcctgtaatcccagcacttggggaggccggggtgggtggatcacctgaggtcaggagatcgagaccagcctggccagcgtggtgaaaccccatctctattaaaaatacaaaactgaccggtgtggtggcaggagcctgtaatcccagctacttgggaggctgaggcaggagaatcacttgaactcaggaggaggaggttacagtgagccgagatcgtgccattgcactccagcctgggcaaaaagagcaaaactccatctcaaaaaacaaaaacacctcactgctgtttcctaagtacatacttaagaaaattgggatacatggtggtggttcatggatgttgataaggaattaaaatgtaccgtgcgactctctgtttcagtggtgacttttacctgtttagtataaatattcctttgcttccaaccataaatgtgttcttagaaatgggcctatagtttagtaacctatagtttggtaataggcttgtttgttttcagatggattttggttctgtgagctaaagctattttgcattaaagccttcgtcctcacacattgttttgacatatttctagtcttcataaacttttttaatttagatttttttcccttcacaagtatacatctgttttagcaaatagccttatgaaggttgtagatgtattattttgggcatgcctggtgatttctatattttttccaattacatttaaagctttatgttttaggaatataagtacattttatttctactttttattatatatatttaattgcacaagtactactgtctagaaaaaaatgggatgttgctaacacagcattgttggcttgtaggcagtgctgtcctgtaaatagattgaaatgtatttttatcagctggtatataaatttgaggaaagaaaaaaaagga

SEQ ID NO: 110891 - DNA, 1926 bp, Homo sapiens
agcagctattttttccggtcctgtgatatcagaattgaccaaggaatacgtatattgtaattgacacgtggtggtatcttccaggtacaaattctctaaattttgtggttagcagaatgggacttgtgataagaatagcttggttttagcataactagggtttaaaataattgtttaattatagagactgaccaggctttggccatctaaactggaaagtgttagtaccctaccttcttttgaaaatggctatggtaaggaaaatgtgttagtaaattatgtattttcttgaaaaatacataattatggttggatgggaatcactaagttgggtgttaactgatgtctcaattagtaacattaggattttcattaataaacctaaaaagctttccctaagaacaggcctggcacagtggctcatgcctgtaatcccaacactttgggagaccagggtgggtggatcccttgaggtcaggagttgaagagcagcctggccaacatggcaaaaccccatctctacaaaaaatatgaaaatcagccgggcttggtggcataccatagtcccagctacttgggaggctgaggtgagaggatcgcctgagcccaggagacggaggttgcagtgggctgagattgtgccactgtactccagtctgggtgacagagccagaccctgtctcaaaaataaagaggattctgagtttgtatagtgagggcttgcagaaattttgaaacttattttgtaagtttacaatgaatttgtacatgatgtgctcatgtcttgggttgagtatcctagacatgattttttcatttgctgcatattaaacatttgttggttgtagtcggtatttcttaaatagaagtttgtcaatattagattagtttcaagaaggacttagctcaggaaaaggatagttatttctgtggttctcagctttgatgcctacagagattctgatttaaattgctggaggagggcccaggcatacattttttaagtttcccaagtgattctaatttacatctagggttaaaaacagccaggcgcggtggctcatgcctgtaatcccagcacttggggaggccggggtgggtggatcacctgaggtcaggagatcgagaccagcctggccagcgtggtgaaaccccatctctattaaaaatacaaaactgaccggtgtggtggcaggagcctgtaatcccagctacttgggaggctgaggcaggagaatcacttgaactcaggaggaggaggttacagtgagccgagatcgtgccattgcactccagcctgggcaaaaagagcaaaactccatctcaaaaaacaaaaacacctcactgctgtttcctaagtacatacttaagaaaattgggatacatggtggtggttcatggatgttgataaggaattaaaattcctttgcttccaaccataaatgtgttcttagaaatgggcctatagtttagtaacctatagtttggtaataggcttgtttgttttcagatggattttggttctgtgagctaaagctattttgcattaaagccttcgtcctcacacattgttttgacatatttctagtcttcataaacttttttaatttagatttttttcccttcacaagtatacatctgttttagcaaatagccttatgaaggttgtagatgtattattttgggcatgcctggtgatttctatattttttccaattacatttaaagctttatgttttaggaatataagtacattttatttctactttttattatatatatttaattgcacaagtactactgtctagaaaaaaatgggatgttgctaacacagcattgttggcttgtaggcagtgctgtcctgtaaatagattgaaatgtatttttatcagctggtatataaatttgaggaaagaaaaaaaagga

SEQ ID NO: 110892 - DNA, 833 bp, Homo sapiens
tggagacggagtcttgctctgttgcccatgctggagggcaatggtgcaatcttggctcactgcaacgtctgcctcctgggtgcaggagaatcacttgaactcaggaggaggaggttacagtgagccgagatcgtgccattgcactccagcctgggcaaaaagagcaaaactccatctcaaaaaacaaaaacacctcactgctgtttcctaagtacatacttaagaaaattgggatacatggtggtggttcatggatgttgataaggaattaaaatgtaccgtgcgactctctgtttcagtggtgacttttacctgtttagtataaatattcctttgcttccaaccataaatgtgttcttagaaatgggcctatagtttagtaacctatagtttggtaataggcttgtttgttttcagatggattttggttctgtgagctaaagctattttgcattaaagccttcgtcctcacacattgttttgacatatttctagtcttcataaacttttttaatttagatttttttcccttcacaagtatacatctgttttagcaaatagccttatgaaggttgtagatgtattattttgggcatgcctggtgatttctatattttttccaattacatttaaagctttatgttttaggaatataagtacattttatttctactttttattatatatatttaattgcacaagtactactgtctagaaaaaaatgggatgttgctaacacagcattgttggcttgtaggcagtgctgtcctgtaaatagattgaaatgtatttttatcagctggtatataaatttgaggaaagaaaaaaaagga

SEQ ID NO: 110893 - DNA, 896 bp, Homo sapiens
ttttttttttgaagatataattcaaaataaagtagatgctttacaaatgataatcgagctgccaaaattcagaaacaataattactttgaccattcattacaccacagctttgtattctcacctttcagttacatcatatatatatttccttaggaaccactaactctctgacatatcagcttcccagctgaaaatgcatttacctctgcagcatttagaattaaaaattatgttttcgatgtatattttcagtctgaaaatgtctcctccactccctgaaaacaaccccagccagtaaatgcaattctttgaataaataaggtgggcttttttgtttgttttttcatatattctggcagggtcttgctctgttgcccaggctggagtgcagtggcaggatcacagctcactacagactccacctcctgggctcaagcagtcctcccacctcagcctcccgagtagctgggactacaggtacacactatcatgcgcagctaattttaaaatttttggtggagacggaacctcactctgttgctcaggctgatctctaactcctagactcaggcaatcctcccgcctcagcctcttgaagtgctgggattacaggtgtgagccactgtgcctagcaaacaaggtgtgttgaattaattaattttagttaatttccaaataatttttctacagcagtttttaaagatattatgtacatacaataaaatgcccagatcttaattatcctaccagatgacaatgttattaacccatgtaatccccatgtcaatcaagatataggacattcccatcactccagaaagttccaaggaaatgttttttcagtattccccagctgtacctgccacacagaggcggacacttctactgtgggttt

SEQ ID NO: 110894 - DNA, 664 bp, Homo sapiens
ttttttgagaaaagccagaaatatgaatttttacataaaatttcccaattttaaaatgtacccagtgaatttaatttttttcaaaatattttgtaaatgtaacgaaacatatcaataggtccgagacgggctcaggaaccattcagtttttttgccttcggctctagagtatgtataatatggcattttaatcttatacattgagaagaaattaagttgtaaataagaaaggagctgggactacaggtacacactatcatgcgcagctaattttaaaatttttggtggagacggaacctcactctgttgctcaggctgatctctaactcctagactcaggcaatcctcccgcctcagcctcttgaagtgctgggattacaggtgtgagccactgtgcctagcaaacaaggtgtgttgaattaattaattttagttaatttccaaataatttttctacagcagtttttaaagatattatgtacatacaataaaatgcccagatcttaattatcctaccagatgacaatgttattaacccatgtaatccccatgtcaatcaagatataggacattcccatcactccagaaagttccaaggaaatgttttttcagtattccccagctgtacctgccacacagaggcggacacttctactgtgggttt

SEQ ID NO: 110895 - DNA, 290 bp, Homo sapiens
ttcatagggaaaaatatacagctttgatataatagtagacatatatagaatatagtgaattacaaccttaagtgcgagctgtgctaaaaatcatctttagtaaatgtgttctttgaaactgttggtccttgtaagtctgaagcactatgtaatacctaatacgatactaaaaccagccaggcccagtagctcacccctataatcccagcattttgggaggctgaggtgggaggatctcttaagcccaggagttaaagaatagcctgggcaacaaagtgagaccacgcctc

SEQ ID NO: 110896 - DNA, 506 bp, Homo sapiens
aagaggatccggtctcatatcagtccataatctcttcttttagattgttagccctttagtgtatattcccccaaagggttgaagttacccagctaataacgggcaaagacatttcgggacctcagaaataactgaaacaggaactagaaaatccagaaaccactcttcttccttctcatctatctatgcttttcaccatgtgttagtgttattctcacagattaactctacaaagttggacaatagctgccaacatcttccagtctcatatcttcttaactttgccattcaaagaataaggttctcttcttcccttaattccaatttggaaaacctcagagaaggtctctgattggcccaggtctcattgtaaaactgtatgtgtggctgggaggagttggtcctatgataggcaatccttattttaatcacgtagttggagtaagcagaaaataggttcctcaaataaggcacgtatttttttttcacctcaaagctaatgatga

SEQ ID NO: 110897 - DNA, 245 bp, Homo sapiens
ggtcatactgggaagggagggctttaatttataggtgagtggaaattgttttgaggaggaaatgagagaatttactgtgtgtcttctccactagatggtaaacatctagaatgcagagacattataatacaattttattccctgtacgtggcacatagtagatgctcagtaaatgtctctcaagctcaaagctgttcttcaggaagatggccctgatagcagcaggaagaactgagtagagggag

SEQ ID NO: 110898 - DNA, 399 bp, Homo sapiens
cattcaattgctcctattctaccttcccaccttttaaaacaagattcccaagcaatttaggattaacctgtgcttatttctgaactgaagaatatctgaaccaaggacttagaaacttttcccaactactcaatatgcagatgagaatactgaggcccagaaaatttaagctaactgtgcagacacagagctggtcagtggggactcacactagaatccatgtctcctgacttcaagctaagtgctttcactataacccatgtgcaaaaagtcagatttcagatccaagactggacatagggagttcaagaccagcctgaccaacatggagaaaccccgtctctactaaaaatacaaaatcagccagacatggtggcacatgcctgtaatcctagctac

SEQ ID NO: 110899 - DNA, 271 bp, Homo sapiens
acgactgtaattccagcactttgggaggccgaggtgggcagattgtttgaacctaggagtttgagaccagcccgagtaacatggtgaaactctgtttctacaaaaaatacaaaaaactagctgggcatggtggcgtatgcctgcagtacagctacttggaaggctgagacaggaggatcgatttagcccaggaggttgaggctgcagtgagccatgtgagtgctattgcattccagccccagctcaggcgacagaacaagaccctatctca

SEQ ID NO: 110900 - DNA, 265 bp, Homo sapiens
gaagcatttgtgccggttgacatctttgcattatggctttgctcctggattcctccgaagttttggttggctcctaggaaaatgtctctcctgatatatagatcgtgtagtctctctaaattatggaaatcagcatgtgaaactgtatcaggtgggataactctgtgcctttctgcttagtggcttgaagtacttgaagaaaatatgctgttttctttccttggagcctttcagaaatgttttccaaaagtgatacatgcttgtt

SEQ ID NO: 110901 - DNA, 334 bp, Homo sapiens
caggtcctgtatactctgccgttgatcttagttcttggtccctggctgtgactctctcagtctgtctctaaaagccacccattcacttggcgggaacaggatggaggaagctttgtccacccaagctcttagccactgaggaaccagggactccccccaccccacccacagcagaggaggagactgtcaccccagagcctgagtgctgcctcccctacatcccgttgtgctgtggggggaggcaggaccgggcagatgggggcaaggtacaggccagggagtagtctcatcttcccagcatctcaggccaggaatcccagcctaggagttgagc

SEQ ID NO: 110902 - DNA, 298 bp, Homo sapiens
ctcaaacagtaacaattttaacattttccccaatgaggaactctagattacaaaagtataatagatgtttataacttaaatatcaatctgtagtgtgaaaattaaaggaagaccagatcccatcatgatcttagttctgcctagatgttagtatcacatagtgttcttgtttcttctgcatttacatgtccttctcagtttttcttccacactacttgatattactgtctaccattaaaagtttaaacggctcatcaaactagctacccctcccttactgcttttagatcagtgttca

SEQ ID NO: 110903 - DNA, 418 bp, Homo sapiens
actgtacgcacagatctaccccgtctactgtgaggcaacaggtaaggagagcataggctttggggtttcatcaggctttggtgtgagacctgtctcaccatttaatagctttgtacattttggtaaataccttaagcagccagagactcatttttcctgtatgtaaaatggccacacagctgccccacagagttactgaggcatggcggattgcttgaacccagaaattcaagaccagtgtgtctctacaaaaaattaaaaattagacaggtatggtggcatgtgtctgtagtgccagttactcaggagactgaggtgggaggatggcttgagcccaggagttggaggctgctgtgagccatgattgcaccactgcactccagcctgtgtgacagagcaagtccccatctctcttatt

SEQ ID NO: 110904 - DNA, 527 bp, Homo sapiens
gaagaatccatcaaaatgagtgccaaaacattgtgatgccaaaaagctaggaaatacagaataaaagacaaatgtccagtgctccaccactttaaagtgactcaggagatttggtcacctttagcttaactcctccaaccatccctgcgtgtattatgtgccagaaattgggctaggctttcagttagagctatatataaaaacaacatcagcaagaatgaccacgcacagatgatttaaaaagctctgccatcaaatatagaccatgttttatcttttgctattagcttctcctcacaccttaaaaactaaaatttagcctttgcttttccctgctcctttccaataaagagctctaccaggtacctttggcaaaaaatgaaccttctttctaggagcacaaagcattttttaagtaaccctctgtcagagtcttcaagaagcttaacatgatctgatcaaaggaaaagactgagattgaggcaaaactggtgcagggccaccactgccaatcatcacccttcacg

SEQ ID NO: 110905 - DNA, 270 bp, Homo sapiens
ctttagcacatattgagaagctttatatggttctagtctttcaaagtaaaaataggcaagcagatatctagcactgaaggtggacttagttttataagcttcagatcctcatttagaaaagctgtgcatgaatcttatcgtcaccttcaaaagggcctggcaaaattctgcatgcctcgcaaaagttgagagatgaaactggacaccaagacgagtcggctgtgtcccatttttcatttccaatctgaaatgtggcttgcacttggtgaa

SEQ ID NO: 110906 - DNA, 415 bp, Homo sapiens
aaagctttggctgaccttagtaagactttatttactgtgccttacatgtctccacccacattttagccttgaacttacacttacggaaattccccacttcttccttcactaaccacttcaatgaacttgtgtgtgcattcacacctgttattacacgggttcattcactgcaactagatctcaacagttaattggcacaggaaacaaaacagaaatgtaagtggggtagagcacaatgctctctgaagactttagacctgactctggcattaagtgagccatttcttcctcctaaactgtaaagtcagagtcccttctgtctataaaattgagtgattctatgaagtgtcattacttaccttagttgagttggatgtcagcctagcctagcagtagaggtcaatgttccccaagg

SEQ ID NO: 110907 - DNA, 733 bp, Homo sapiens
cctggacacagctatagccagtaacaaattttactctgcttctctagactgggcactacagctaaataatacacagtttctacccttcgtgcactgaaagtgtactgaggggaaatggactgagaagcaaggacaataatgtttcctagattaaatgatacatctgaatttctatattttagtatagatactctaaataaaatacatcttttatgtcttcttaattttcaaatatatctaactaaaattgggatctctatgttctttccactttaagctttcctctatttgattttttttctgctatcattaattaaaaactaagcagaaaatgggtaagggatataaaatataaagtatgttgtatattatttttagtaaaatgaagattttattttatatgacctgtggaaaccttttacttgaaatgtgtctggctatactaagtatagattagttcatttcttgcttttgttttatttttgttctcaagttgagtgacaactgagagtagtatcaatacctgtacctcccatggatcaacaggtacactctgttctccctaatctgaattcagccaataatttgtcatgttatttgtgttttgttcttttgtttaaaggttactgaagaggttctcattgtacagagtataactacatgatgtattctagagctagattgaaaagcaatctgtaattagccaacagataattagcactttcaggatacc

SEQ ID NO: 110908 - DNA, 477 bp, Homo sapiens
aggagtactctatcaatatcctgtggtatacaccttttccaaaataacatatctttgttcctggttgtagaagtaatgaggttcagtgttaagagcaatcagtgcttagtggtaatagaaaatcaggtaatacagaaaggtataaagaagagagcagtgaaaatgactagtagttctaccacccagaggttaacattttgatgtatagtttcgctgactttttggtgtatagacacatacacatgtttttaaaatacaaatagatttataataggcatgttgtttttaattctaatttcatttattatattttggccattattctatgtcattatacatttatatcttcattcaaaaaaaaattaaaaaaataaaataggacattgaggcaggatatgatggaattacccaagatcgtgcagaaagtaaatgattaagccaggattttaatctaagtctgattaaatcctgtgcttt

SEQ ID NO: 110909 - DNA, 241 bp, Homo sapiens
tggaagtatactctacctcttaacggaagagtgaaaagaatgcattttagaatagtatgtggaatggaagatacagctgcaaacaactctggaaaaataaaatctatgtgacacaaggacactcccaacaaatgttttcagaatatacactagtccccgttatctatggttttgctttacatggtttcagttacttgtggtcaaccacattccaaaaatattacatgcaataaaatatttg

SEQ ID NO: 110910 - DNA, 591 bp, Homo sapiens
aaagaaaagaaaggaaaaaacaaagaaagaaaaagaaaaggaaggaaggaaagaaagaaagaaaatggggcatgagagtaagagtatagctgtatgaatggagttatcactttatggaatagaaaatactagagtagaactagttttgttggggtaaggggaattacaagtttggtttgagtcatattaatttgagatcactgttaagccttccactggagaagtaaagaaaatagctggatataaagcaatttttaaaaatgtttgacatttgagaaatatgtctggtgaccaccaacatggaaatgtagtcagttctctggaagtacatggtgttacctaagaaaggaatgcaaaaagaaaagagaagaggttcttagaggcagacctgaggcatttagcattcagaaacaagaaagatgagaaagattcaatttaaaacctgaagagatcaataactgaaataaatcagaaagttgacaattacctccccaaaggctttgaattataatgattttatggataattctttccatatttttgagaagcaaaggaagtattcaacttccaaatacgcagaaacaaatatta

SEQ ID NO: 110911 - DNA, 351 bp, Homo sapiens
aggagaggggaaagggaggaagagggcttggacttgacctaagccacacacgagctccgtggaggaggactggcctgcacaggagactgaaggagtctccagagagcagaaagggcacatggcccagaggtgcccgggaaccagcatttcaaggaggcaggcacgaacagtcacagctgccgaggggtcagggaagctaaacatgttcctgggattcggtggcacagaagtcacatgcagccagggaggaggaagaaccatgatctcaaggtctgagtcaggtgtctcccagccagacttaagtgttaagggaagtgggggggatgagcaaaccggtttccatacgttttt

SEQ ID NO: 110912 - DNA, 600 bp, Homo sapiens
  misc_feature (577)..(577): n is a, c, g, or t
cagacctgcgtgatgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatgacaggaatggcctcctcccttagctccctgttcttgggtaaggaaatggaatactgaagggcccttcactgcctttgctcctcccatgttatgcccagcgtttgatgggtagcagagagaacaaaaaacaccacaaggctatttttccccctgcattctttctgtattgagtatcctttcagtgttattagtgtatgctttgaatgtaaaaattggtcaccctaaggaaaggaattggcatgtgtatgttcccagttcaactcatggagatggcagctgtttaaatgtttttctatgtagtttataaattnaaactgaattgaggactatgaaa

SEQ ID NO: 110913 - DNA, 594 bp, Homo sapiens
ggaaatgcacagactcactaacagggtcccctggacaagcagacggacacaatgacagggccacacacagttgcagaaacacccacactgatgatcacacctgggcccacaaactgtgttcacaaacaaccctaccgaacaggcacccacaccacacacacggtggtgcaaccacacagacataggcggagtgcttatcaggaaacacaaacttgctgataggcacaggggacacacacatacacacagacacctgttacagggatacctggatacacggccaaatccaaatcacactcccacagggacatacacaaatgcactcacacaatttcacagctaacacattaaaactatcagaaagtgacattcgcccgacacggtggctcatgcctgtaatcccagcactttgggaggccaaggtgcgtggactgcctgaggtcaggaattcgagaccagtgttttctgtgggtgcgctaagtgtgtgtgctgctgggctgtgtgggattagagttagctgtagggtgtgtgtgtgtgtgtgttgctgacagttggtgatgatgtttgagggttgcgtgaggagggtgggttggt

SEQ ID NO: 110914 - DNA, 658 bp, Homo sapiens
atgtaattttataattatttttaaagaacttttcattttcttagtgaatttttgcctataatattgggtacaggatgagaatttatatgtaatatttgaattatagatactttggataaaatgacttcttaattccttaaaaaactaattattgcttttttttaaaactaggtaattaggtagttgaaagacagaatgtcattaagttaactaaattaccactgtattacagtaaatacaaacaacatacttacagtgtaaactatggtaaataaaaactaaaaaaacacttccttgaaagtattttttaaccaaacttcacaaggatggatagaattaacactataaattctgcacagaaaaaaaatagtgcatactaaattgagaacagatgcacagaagtgctatttttagaaattaaaaaatggtaaagatgataataggcagatcagaagtcccacatatttatcagggttgtaaataaaaacccagttcaaaaacatgcattactaactggctgtgtgatttttaggcaagttacttaacctttctgtgactgtttgttcttgtaaaataggaataatagacttatagaactgtaacgaggaatggatgagttaatatttctaaagcatttggaatagtgcttgacacatag

SEQ ID NO: 110915 - DNA, 141 bp, Homo sapiens
taaacaagaaaaaaattaagaaagatccatagaaattattttaatattcaaattctatttctctctacagcttatcatgcaaactaaaggaaaaggaggctaaggatataagcacccctgaaaaatcccaaaattttcttg

SEQ ID NO: 110916 - DNA, 561 bp, Homo sapiens
cccgactctggctttccctccgctcccgccaggccagagcttgatgcgcatgcgcgggaggcagtgggctccgttcgtttcgttttccacgtgactcggcgctagcggaacacgtgtctcctcccctttctggcgtggagggggcgggagctgtggaatgtctttgtctgcgcgcgggcccgcggagtgtggggcgggagacctgttactcgcggggccacgccctctccaacggctgagcagtggagggaggctgtggggagtggggtggggggcggtcaccgaagtaaggaagtaaaagactgccgagagggtcacggaaaggggagggagagagaattgagaccgcctggggaggaagacaggagtgagacagactgcacagggagaaaggaaggctgagggagagtctgatgcagggggaaagttggggaagggaaacctggagggagaaattgaggaaggacggcttggtggaaacactgaaggcgattggagtacttgaactaagagggatggttcagatcagagatctgaagtctagcaaagaaaagggtccca

SEQ ID NO: 110917 - DNA, 215 bp, Homo sapiens
acaaaaaaaggaagagaaagaaaaaaagaaaccacctgagatctgcgggtggacttttgaagtgcttcttgagtgaataaaagagcaattcctattttcatccaaggaagatgaattggcccaaattccagctagagttttagtgtcccactcccatgcacaggtcaaggaaggaggggccagcaagggaggacatgacatatggctgcattcgg

SEQ ID NO: 110918 - DNA, 729 bp, Homo sapiens
ctcgtgcaatttcggcagagggtgttttgtatgatgattattagtgagtgaatcaggccactggggttttgggatagagactctgggatattcaagaaccttgggggcaggatggtgaataggcctttagacccttcacctgcccacttgggaattggccctcccacccattgtaggagcttggccaggaggagctcttcgtggctgtggagatgctctcagctgtggtcctgattaaccgggccctggaggcccgggatgccagtggcttctggagcagcctggtgaaccctgccacaggcctggctgaggtggaaggagaaaatgcccagcggtgagaaaggcttagccacacattgggagtgagggatgggggaatgcagccaagactcagcactcttctgttggagacttgccttgtgtacgatgtcccattcttgggcccaggcccaccctctgggtctgttcacagttccttggcctgtgtttcttcctgggagtggatgggatcacagtcattccttttttcttcattgattcattctttcctagcagatgtttgagtactgacccatgtgccagatattactctaggtgctgggaaacagcagtgaacaaaacactttctgctcttgtcaaacttacatgctagtaaagggagacagatgatgagaaaagaagatgaggtggctgggtgcagtggctcacgcctgtaatcccagcactttg

SEQ ID NO: 110919 - DNA, 415 bp, Homo sapiens
ggaacaactgaatagccacatgtaaaagaaggaaactggacccctacctcacaccatacacaaaaaggaactaagaatgaatcaatgacccaaacgtaagaggtaaaaacgtaaaattcctggaagaaaataaaggcgtaaatcttcttgaccttggattaggcaatgtttacttggatatggcatcaaaagcacaagcaatcaaaggaaaaatagataacgtggacttttgtccttcaaaggacactatcaagaaagtgaaaagacaacctacagaatggaagaaaatatttgtatatcatatatctgaagacagttgtatccaaaatatatttttaaaaaaactcttataactactcaataattaaaaacaacacagccaggcacaggtggctcacatccataatcctagcac

SEQ ID NO: 110920 - DNA, 314 bp, Homo sapiens
taaagatgaacatttacagctcctttttcttttattataggcctatttccttggtagtaaaagtagcatggcagttcatagtctgtttaagtctcctagtaagacatacatccaactaaaaacaagagatgaaaatataaaggtaatgcttacaattcacttgagaattacaatataattggactatcttgcttttgatatgtacatattaattaaggtttttttctaggtgggatcgccttttgagttggtggttagtggcaacaaacgattgaaggagttaagctatatggtaatctcttatagaatctaaa

SEQ ID NO: 110921 - DNA, 694 bp, Homo sapiens
ggacaattaatctgctagtgttgtttagaatggattgaagaacagaggggaagaaggtagggagaccaaattgtttcattaaattatataaaaaattttcaaaaaaagtcagcttctattgtggaggaaaactattgtacagaccccagtcagaacagtgaagatacttgtactgtcctcaagtgtcattgtacttgttgattaacatatattaaaaacaagcaggtgtggtggctcacactggtaatctttgcactttgggtggccaaggcaggaggattgcttgagcccaggagtttgagaccagcctgggcaacttagtaagactcctgtctgtacaaaaaataaacaaaattagtcaagcctggtggtgtgccctgtagttccactacttaggaggctgaggtcagggattgcttgagctcgggaagtcaaggctacagtgagtcgagatggggccactgcactccagctttggtgacagtgtgagacactgtttcagacacacacacatacacacacacatacacacatacacacacacacacacaaccaaaaaaggaagccatatattaaaaatgttgccataaaaaatattggggacagggtatataggagccacaaagacgtggctgcatccgggggctagtaatagccaagctcctcccactcctaggcctgaggggtgagggag

SEQ ID NO: 110922 - DNA, 384 bp, Homo sapiens
cggcacgaggggcctcgcttgggagggctgtggccaggccttgagtccttggctcagtgggaccttctgaaacagcctccaagctgcacccctgcttcctttgcttttggatgaccccctccagcagctttggtgctgatgggaataagtcgacctgcagcggaagttcagcccaagtctcagcccagcagcctccccaaacctggccagggtctggtcatgctgccgtctctgcggtactctgtggagttgtggtttctgtaccttgaagagaacttccccttctgggacccagaaacccagtgaaccctcaggaaaaaagggaatgaaattactgaagacaactctgtggcagggagagggaaaagaggctctttgtttttg

SEQ ID NO: 110923 - DNA, 570 bp, Homo sapiens
agataacattccagtgccccagaagtctcctttgtgtcacctgctagccaaaaatgccgtccttgaggttatcactgttctgaccttgatcaccataaatttttgcctggggacatgtttctttttctccaccgtacacccatgttcatgcagaacagtggagtgggagcagggcagggtctgtatgtgccaaatactacactagacacattcccagacttaaataaattctcccgtaaaacacagacctgggcttatataacttgtctaaactcaatcccatgtcattgatgccaaagtcagtgttttttccattgcgccatgctctatgtcttcaactgacatttgccataatcattatcattatcattaatgaaaagtcatctgacacttgccagtagtttatatgatcaaagaacatcagttaacacccagttctcatttctaagtgcgtttaaatggtcaagagcttttaacataactctcttgggaagcagaatgaattaagttaatttagaaccaaaagataatggcaatttcttcatttaatgagtgccttgtttgtgcaag

SEQ ID NO: 110924 - DNA, 264 bp, Homo sapiens
gatgggttctacggcccccagggaccgaacgtccagcatcagagccacattggagccccgcctgcaggcatagcccaccactgcctagtgagcacccaatcatatttgcttttcttttctttttatcttttcttttagagatagggtctctctctgttgcccaggtctggagtgtgatggcactattatggctcacagcagcctcaaactcctgggctgaagcaatcctcccacctcagcctccagagtaactgggaccacagg

SEQ ID NO: 110925 - DNA, 308 bp, Homo sapiens
aagtgttccatattaaatttttcattttgcctacaacatacatacataattaagtgcttcattggaagatgcttatttttcatttcttttgtaattctccttctgctttccactcagactttagggctgtattgtattctataaagagtatatacttaataaatcaatatttactaacgtaaaaccataaacctgtcaataaccggtggggaacttatcatgaattttaaaaaatgtttactttcccatcagtcttaactgctatatttgaaatatagcgtgtttttctagctatgtcatgttaacct

SEQ ID NO: 110926 - DNA, 570 bp, Homo sapiens
gtagctgggattacaggcgcccgccaccacacccagctaatttttgtatttttagtagaaacggagtttcaccatgttggccaggctggtctcgaacgacctcaagtgatccacccgcctcgaccacccaaagtgctgggatgcgtgagccactgcacctggtcgggaacttccttttttcttacaaacatggggtaaagatgaaacccagacagtatgtcaaccaaaagggtcgatgatatcttttcttgaaaggcattttatattgaacctaaagtgaggagagacattttaaagggtaaatcctctattcaaacattttactttaagagtttcttctaaacatttgagcattttacttttctttcttgaatttaactcaaaatctatatctttggcttaataaagctccttcctggtgtttaggagctggaaattcaacaaagccagccatcgccctctttgagtgggagggaggtggtgaggcctccatgagggaggaggccagtgcagttccccctgcacattgcacatggccccagaacggccttcctgcccagggccctgagg

SEQ ID NO: 110927 - DNA, 1138 bp, Homo sapiens
agagatttctttttaagattttagattcacttaatgtaatgttgaattgccatgaatgtaacctggagtttgatttgagacattctgtgggataaggaatagttttctattgaactgtggtggcttttgccactaatcaggatttagggctgtgcacctccatctgttaagtgaaatggaacttggcttcctaaacactatattagaccaacttgagtcaatacttttattaagtttaatcagggattctcaaaatatttaggattcaaattagcccaattagaaagcagtgcattaaatgttaccaaaatatctgaagatactttagaactattttacacaaagcttatgtctttcctatggaaagtatcatacataaaattttacattcttttaaaaaacagaatctaatgtcttcagatacctagagcttggaaattataatagagttgggctttgacccgaagtcagcagttcttttcattttagattttcaggcaagtttcagtagtttggagacttcttcagtagtgaccccagcttaacctacatataatcactttgcacacattttaagttaatcagatgcttccagagtcttggatttggttacccctttgttagataaggagacagattctaggttgggacaaacatcttaatttattctctaataataaagtactgattaaagagcaagttctcagagaattcacaaaatttctagaatccatgaaagatctagagaacataacaaatgaaactctagaaatttgaaagaaaaaaaaacacttagctgtaagtgctttgacctattttttttaaaaaaaaaaaacctgtcttaattctgtgactgcattgcacccttcaccagcactaagagaagtcggaatggaagaaattaccgtatgtaattcttattcacttaaaatctttgtgcgcataggccttagcactttgacaaataaactctgccttttagctcctcactattgtcttctttcctgtcacttttaggctgtttcattggtcgtataaaaacaaccttcttcgaagttgaatgtatgtttctgcacatagacaaaccatattttactgactcattctatgttgaataaaggcatacagttttacccta

SEQ ID NO: 110928 - DNA, 1080 bp, Homo sapiens
agagatttctttttaagattttagattcacttaatgtaatgttgaattgccatgaatgtaacctggagtttgatttgagacattctgtgggataaggaatagttttctattgaactgtggtggcttttgccactaatcaggatttagggctgtgcacctccatctgttaagtgaaatggaacttggcttcctaaacactatattagaccaacttgagtcaatacttttattaagtttaatcagggattctcaaaatatttaggattcaaattagcccaattagaaagcagtgcattaaatgttaccaaaatatctgaagatactttagaactattttacacaaagcttatgtctttcctatggaaagtatcatacataaaattttacattcttttaaaaaacagaatctaatgtcttcagatacctagagcttggaaattataatagagttgggctttgacccgaagtcagcagttcttttcattttagattttcaggcaagtttcagtagtttggagacttcttcagtagtgaccccagcttaacctacatataatcactttgcacacattttaagttaatcagatgcttccagagtcttggatttggttacccctttgttagataaggagacagattctaggttgggacaaacatcttaatttattctctaataataaagtactgattaaagagcaagttctcagagaattcacaaaatttctagaatccatgaaagatctagagaacataacaaatgaaactaaaaaaaaaaaacctgtcttaattctgtgactgcattgcacccttcaccagcactaagagaagtcggaatggaagaaattaccgtatgtaattcttattcacttaaaatctttgtgcgcataggccttagcactttgacaaataaactctgccttttagctcctcactattgtcttctttcctgtcacttttaggctgtttcattggtcgtataaaaacaaccttcttcgaagttgaatgtatgtttctgcacatagacaaaccatattttactgactcattctatgttgaataaaggcatacagttttacccta

SEQ ID NO: 110929 - DNA, 797 bp, Homo sapiens
ggatatgataggagcaaaatggtgcctacatcgtctttataaagaaaagtatatagcccattttttaacaaatgaataatatatcgaatcattgatgacctaaaagaaaaattgttaaggtcagattttcgagagtgtatcttgatgacccataaaactgactttttattgtagttcactagttcccataattgcccagctgtggttactttcactgaaaagaaaaaatatattttggaagttaatgtaaggatacattggctttttttttttttctttacattggctttttaaaagacagtttttatttttcagatactggaatgtcaagtatctgggttgtcccaagacgttggagataattcagccttccaagagaacagcagtctagatcttagctgaaaatgtgctgtttctaaaggaagcttcttaagtctcaggggacattagcatcttcataatttccatatataataagaatgaaggtaaaatatttaaatgtgtataaactaatccataatgaccatttacaaagattgactccccatttctggtacatatttatcattatttagatgggtctcctatcttgtgggaagataaatttatattcaggtgatgacatgggtgcctgcaagtagagttggtctgcagctgagggagaaggcaacataccagaagacaaggcagcttcaacctggatccccagctaccctttatttacttcactgagtcagaaacccgtgttcattgcttctgagactacttgacctcagctggtctttagaagtctggta

SEQ ID NO: 110930 - DNA, 608 bp, Homo sapiens
ggatatgataggagcaaaatggtgcctacatcgtctttataaagaaaagtatatagcccattttttaacaaatgaataatatatcgaatcattgatgacctaaaagaaaaattgttaaggtcagattttcgagagtgtatcttgatgacccataaaactgactttttattgtagttcactagttcccataattgcccagctgtggttactttcactgaaaagaaaaaatatattttggaagttaatgtaaggatacattggctttttttttttttctttacattggctttttaaaagacagtttttatttttcagatactggaatgtcaagtatctgggttgtcccaagacgttggagataattcagccttccaagagaacagcagtctagatcttagctgaaaatgtgctgtttctaaaggaagcttcttaagtctcaggggacattagcatcttcataatttccatatataataagaatgaaggtaaaatatttaaatgtgtataaaaacaaccttcttcgaagttgaatgtatgtttctgcacatagacaaaccatattttactgactcattctatgttgaataaaggcatacagttttacccta

SEQ ID NO: 110931 - DNA, 302 bp, Homo sapiens
cctgggctccaggctcctcccacctcagcctcctgagtagctgaaactccaggaggatgccaccatatgttcttatgtggcagtggaacaagatactacagaattttagttagaaggagaaggataattttctttgggtaggtggttaggaaacatgtggcctgaaacttgagtggtggtaatgagccgtgggaagatctgcatgaggaataatccagagagacctacaggtgcacagagcctgagctgaaacaggaggccattgtactcagagcagagtgagcagggggttgtagattagg

SEQ ID NO: 110932 - DNA, 471 bp, Homo sapiens
gaatggatcgtgcacagggttgtaatacaaatggtaaggggtaaggctagagacgtgagctggggccgtggtacaaaggccttatgaaccgtgtgaaggacgtttaccctagtacagacaatgaggatacactgaattaaagagggaataccatgattctaactgcagtttagaatgacgaatctaggctgggcgcggtggctcatgcttataatctttgcaatttgggaggccgaggcagacgattgcttgagcccaggagtttgagaccagccaggacaatatggcaaaaccccgtctctaccaaaaatacaaaaatcagctgggtatggtggcatgtgcctatagtcccagctactcaggaggctgatgtgggaggatcacttgagcccaggagttcgaggctgcagtgagccgtgattgtgccagtgcactccagcctaggtgagagagcaagaccctgtctcaaag

SEQ ID NO: 110933 - DNA, 418 bp, Homo sapiens
aaaaacaagattaagtatcatcattgatttaaagagtacaaagtttgaagaaaatgcttccccgagacatttggcaaggatacagctttcctctattatgcccaggcagccacctctgaaagctccctagaatataactcaagaatggcacccaaaatccctgagcatcttgttcctctccagccatacaaagggatgacaacaacatggatccagcaaccggaaggtatgtttgccactgtgtgtcagccagacttcaaaatggtccccagtgattcttgcctcctggtattcatgacccatgtagtcaggtaggtctgacctacataaccaacaggatgctgcagaaatgacagtatgggacttccaaggctagggctctgggggaaaccagtccacatgttgtgaggacattcaa

SEQ ID NO: 110934 - DNA, 403 bp, Homo sapiens
tcgcactgccccgcctcccacctcaccccagatggggtcagcagcctgctgggggtcagcagggtagggcatcctaaccccctctggcaggtgaaaaaccctgaggctcagagaggggaagtgacttccccagtgtcacacacctcttggagggcagggggaaggtcaacacctgacctcctgactctgagattgaagcaagaaagtataatgttaataatccaaaatcttccaggtttgtttctgcttctacaaacacagagggctaagctcacgctcccacagttatgctcacgcttccacagtttgacttttaatctcatgattgtcaagctgggatcatgtggcagacaccattctgcaacatgccgttctcactgcccctgtctgggccatctttccc

SEQ ID NO: 110935 - DNA, 322 bp, Homo sapiens
ccgtggcacgcagtcctctccttccagtctgcacaggctttcctcctctggacactttacacacatggactcaggccatgtggctttccgtgtctggcttctgtctccaagcatgttttcccggctcctccaggctgttgcttgtgttggtgacgcattctttttcgtggctgaatcatattccgtcacatgtgtacaccacgtttattcatccaggcatccattgaaggactttggggctgtttccacattctggctcctggaaatggtgctgctgtgaacatccctctgtgtgtgcatctgggtgaggaaacgcgctttc

SEQ ID NO: 110936 - DNA, 464 bp, Homo sapiens
tccacaacttgaatgccatattcaatgaaaaaaaattttatttgtccagccaaatgtattttttgtctattattcctcaagcatgctgccactgaagtaaaagaatgtatggctcagttcatcctaatacaaaatattacataacctgcttttaataaactatgtatgcttacattctccctctgcatttaaaaagattggctattagaacaaatcctagaaccatgcttcttcgtttcaaatcctgtctgtcacttatcattacacagtggagtaaaataagtgtcccctgttattactggtacttgaattaaaaagttttagaagcagagaatggcagaaaagctcacacgaggagggttgaatttgaattctgggtctgatgctcacgagttgtgtgagttggttgagtttgcctgataagtttatctagaatccatactgatgggacaggcaaatcatta

SEQ ID NO: 110937 - DNA, 451 bp, Homo sapiens
aggattagcaacagccatgcacttctcacttccaggcctgcgggaggggcagaggagagggctgccttggaggaagggagggttggaggacctggcccagctgcagccgcacctcagcgaggcaacccggggaacactccccatctccgctgtcccttttcatcttcctcctactgttgatcctcattgctgaatccaaccagaacctgagggtgagtgtccgggtgaagggttggtataggtcagccaggtggctgctggggcacagagcaggatagacagtggttttcaagaacaggtggaagattccagcactgtactagtcctgtggctgctgtaacatgaccacaaactgggcagcttgcaacaacagaaacttaattctgtcacagctctggaggccagaagtctgaaatcagggtaccctgttccctctggaggctctagggga

SEQ ID NO: 110938 - DNA, 198 bp, Homo sapiens
ctgatttctcttgatacactattgtgtgccagtgatatgaaatgatatgcggcacctcaaagctacaacattaatgcaagttactgatagagaatgctatcagagtgaaaaggaaaaacttgaagattattttggcttttttaaaaatagcaaagattacattattttattatattttgcttttgagagtaaagttgg

SEQ ID NO: 110939 - DNA, 245 bp, Homo sapiens
ccagccagctgtgctggaggctgggaatttcaccaaaattcatgtgtatgcttctgccctttgggaggttcaaagtctggtgggaagcagacaaaacgtgaagagtgtacattacagcctgtgctgttttgtctatgaaagcgacaaacacactaatgggagactgaaaatgagaaggtggtgaggaacagacctctttgaagtgatgctatggtggctgagagcaaagctggaaggtgctggcc

SEQ ID NO: 110940 - DNA, 435 bp, Homo sapiens
  misc_feature (380)..(380): n is a, c, g, or t
gacagggcaggctgcacactgtacgtagctgcccctgagaaagctccctagggaaaggtggccagaagaagcagagagctgaaggagataaagactgaagccatgctgcccatctgggaaggatgttcctaagcgtatgcttggtgtgtgggggccacttggctggagcagcatgaaggtatgggacagtgacctgtacttgtggggaggtgggatcacccaggaacctcaaagaccagagtaaagactttgcttttgccttgcattctcagcgagagaaccagccacgaggggattcccgctgaaagagtaacacaacctgccttttgttttagcacagtgctgtgcagaacttcctgcaacgccgacacgttctacgntctgtgctgtctgcacagtgactatgaaccagacgtggctatttaagttaattaa

SEQ ID NO: 110941 - DNA, 300 bp, Homo sapiens
gggattacaggcgtgagcaaccgcgcccggcctgcgtgagtcacttttcagctgaaaacgctgcagagctgcatgactttccagagacggtccacacccaccacccatcccaggtccacccctccttcttcctctcctgtagcctgaggagacctctgcacctttgcgtgtgctgttgcttctccccagattgctcttccctgcctctgcctgcctggtgaactgccagttcctcctagaagcccagctcaagcctcatcttctgaatccttccctgatgctcttcctttgcccttcagc

SEQ ID NO: 110942 - DNA, 319 bp, Homo sapiens
agtctgagggcagagacataacccagtcaacaaacagacctaatagagagtaaaacaaggacaacagatgcagggcagacacaaacactgtgtgttctttaaaggcaattcctttttaccccaagccctgtgacttgcctccaaacttccttacctatactgcccctagtgtgcacttctcaggtccccaaagggctgcacaattttttgcccaggcatgttgaagaggtctcaggctgtggagtgaaatggatctggccctgaaccctgactctgcccgaccaggagcaaacagccgcttttcccctctgagccataa

SEQ ID NO: 110943 - DNA, 620 bp, Homo sapiens
atggtgtggaagacagttagatggtgaatacctcagggaacaccatagtctcctcggttttcaccagagtttgcctgggagccgggacatccctatcattttatgggctatttctgttttcttcatcatttgtcccctgtccattagacaacaatggattgatctttttctaatctgaattaggccaggcacaaacaggtaagttaccttccggtttccataattacgggaacaggcaagtacttcttccaaactcaggccttcagagaaaaataactgtggtgggaggggtgcaatccctggggaaacagcgttcttggtgaggacaatgctgaggtcacccatcggtctccgaagaatagcagttctacttctcaagggaagagagccccaactctaagaatttcaggtacatgaaaaaaaagtgccacaatccattgtccaagtttgccttatgttctatttatagtcagagtgcgtgctctgaatctgttttagaatcatgttcttcaggacaacttgaaataaaaatcagagaagtttagtttcaaaaaaggcagagaggtgactatccacccaggagacttcacccattcccgccacgccagtgtccccagtca

SEQ ID NO: 110944 - DNA, 830 bp, Homo sapiens
tccttgactgtaatttaatatagtcacagaattcagatcagattttccttaactagaaaggcagtataccatagtgtttaagtacagaggcataaaacagactgcctggattagaaatatgactttaccacttgctagctgaacaactttagctaagttactaaacctctctgttttctctatttgtaaaatggggacaataatagcttctatctcataaggtaattgtgagaactgaatgaattcatgcctgggaagttgttagaatgtctatctagtacacagtgttagctgtttctagaactttgaaaattgtcagagaattagtatattttctgtttatttctgtcaaagcgattgacagaaatgaacaggtgagaaaaattaggataaagtagtaaaaatgaaaaaacataaaaatagatgataaaattgggggggaaactgcataccatgcagttgagagagtgggtaagtgtgtgggcccacagtgctgctccccagtcctcagaaaagagaagctgtggcccagggaccacagcagcactgtaagtgtgatggctgtttttatagatctgtcaattaaagctctcaatacaagcttcttgtattaatgtcaaagtgcagatctaaacttgagacccctgctggtcaggaacatccaaactggtagaggccttaagtattagatgacgatctgtcagtcccgtatatctatcttaaaatttcatgacgttctgcaacacaacatgctgtaataaatgtcctaatttgaggaaattgggactgtacagtggctgattaatctaaaaaaaaggaagaaaaattga

SEQ ID NO: 110945 - DNA, 334 bp, Homo sapiens
cagaacagagtatttggttggaaggaagtttgagattccaggttgtaatcatgggattctgaggttctaaagttgaatgattttaagctgcacagatgctgcaacatcttgtcctgtacaactttttaagttttgtgggaagtggcacatagtaagtgatcagtaaatatttctgaatgagtaaatgaatgtgtgaagatcattaaagtcaacatgatcaagaaaatgtgagaccagagtgttatgaattaaattattccaatatgtcaatagaagttgagatgaaaaggaatcagatacccaacactcaggcattacttagatatcccaaatc

SEQ ID NO: 110946 - DNA, 405 bp, Homo sapiens
acaatgctggaagtctctgcaggaagctgttagctggagactggttgaccgctgtcctcactgggttagaggcctgctcagagatcgagccatgaggacctgagcttgcctgtcctttcaagagtgcagcaaactccttcagcagagcctgtgcagaagaaaatgtaggcacccttttccgaaagccagcactttgggatattccacaagtcttcacaataacaagctaaaattttccagaagctcggctgcccccaagtccaactgctgctcagtccccatggttgctggacctcacagggtcaagagacacaagagcaaaagcaggggcaggaggcgttgcttgctggcgttgctctctgcttctcctcactgccattgctcaccgggcacctgagtctctgc

SEQ ID NO: 110947 - DNA, 490 bp, Homo sapiens
tactcagatgttgtaggatgtcacttatgctgaattctactgtctaaagcaagtcacaaaactggcctagacttaaagtgtgagctaattccacctcctgataggaagacttatacaggtgcattgcagagggtatagataaagggaagagtagggaagtgtggctggttttgtaatctaccatactgactgcagtatagtttggtaagtgtggtgaggaaggcaacatctagattctaaaaagcattaaacaaatttcaacttagttaattcaatttcagcttagttttcctataacagggatgctactaaaggaaaaaagaaaaactgggttgtttatcttatattaggatcctactgtgtgttttctaaaatcattaagttatcaccagatgatgctgttttgcctacttaatacattactcagtttcatcctgagcccataaggaagttgtttactagtgtcgtcttatggcataggaagttgacg

SEQ ID NO: 110948 - DNA, 415 bp, Homo sapiens
cttcctgtgtcgctgggcagcaggccgcctccaggctgtgcgcgtcttcgactttttgactcatgggaaagaagctgtgatggactcgaggtggccatgtgtgttgggcagtggctcccaggtgttgggccagcagggaagggcgttgcagatggaaaggggttcagagacacacggatatgatacatccctacatcctttgcccctgccctcttcccacgtcagggctttttctacaccacagggatccttacgtccctccctggggcctccaccccgaccctgtattccagctgttttgcacagaggtctgataaggactctgctgcttctgcaggccttaccctggctttgcccctttccatggctgaccaggccttgaacacagctgcagtgttagaactgcgcccactgt

SEQ ID NO: 110949 - DNA, 819 bp, Homo sapiens
  misc_feature (79)..(79): n is a, c, g, or t
  misc_feature (214)..(214): n is a, c, g, or t
  misc_feature (227)..(227): n is a, c, g, or t
  misc_feature (230)..(230): n is a, c, g, or t
  misc_feature (275)..(275): n is a, c, g, or t
  misc_feature (376)..(376): n is a, c, g, or t
  misc_feature (421)..(421): n is a, c, g, or t
aaaattaaccatttcaattttctcaaatagttttaagtacagcagattaaactaaatgtctttaactaaagcactaacnggtataatgataacaatttggtaagtcacagtaaagtctcttaactatccttcagatattaataaagtgaataactctaataaccagtaacagattctttcacaaatcaggtgggttccagttctttgctttcancaaaactgaaggnggncctaactgagttattaagtcaataaaaataattactgatgagagngcaatataatttttggcatataacttgtaaacatttcaaaaaaactgagtggcaatgctgtttttaaaaattaattccatccaaatggaattaacatttgnttttgttgtagaaaagcatcctggagtgattaataaaagactttncaagcataaaaatgggttatattagtatattgttctatggggaagaatggaaatatgagttcaaaaatataaaataacgatgtgaaattttgactattaaaaaagagtctcatataacttttaatggataatggcaggcatcaaataggtatggcatttaaattcattggataaattttagaaagacatgagactctttgaacgtcaatatttgtcatatgttaaaaatcacatcctacaattaagcttttgatgagaactgttagatgtcagcttaaacacgtgtaaggggatttacagattttcaaaattattttaggggtacacaactaagaacactgaacaatcactgctataatggcaccctattactctaccacaggaacaaaagctcccgg

SEQ ID NO: 110950 - DNA, 635 bp, Homo sapiens
catgatctcttccttgccctaaaatgtctttgtaactcacatcattaatctgctcccctcctaatccagttttctactgacctaaaggtctctcctctcagtctttaaacattttagccctgtctctctccagcgcaaactcttacataactcataattatcttttcctcccacggtctcccagtttctggatctcccttcagataatcttacctgaaacctcctttccttaccataagcaaggccttgccatgacagataacggtgccccataaccactgttaagcgtctctccctaccttctctctttctagctcatcccctccagtattctgactccaaaaatcttccaaacccaatgagtcctccagtgcattgaccttagaagttgttctgaccctcaccaaacttatgtccccttttccttagtgagcttagagtaaatatggcagcataatcacttctttgcatatccttttaaaactcagacttcactgaaatatctcatctctgttaaaccaacctttttcaaaccgtgcttgttgtggcctaagcagtcaatgatagttgaggaaaaacacaaccatgatgactttgaatttgtaactactggcctgaggtggctccttagtgcc

SEQ ID NO: 110951 - DNA, 900 bp, Homo sapiens
tctcaaagtccagcctttcgacttgctgagttacttgggtaaattattcaacctttccatgcctcagcttccttatctaaggattgggataacaatggtagtcactgtttaaggttcatatgaggattaaatatgaattcatgtaaactacctagaaagtgctagaaacatttgctgttgtcattatttaaaccaataaacggatttagtttctcacattaaaaaaaaaatcagaggtaggcagtccaggtggtgcagccacatcacaaagccaggaaggaactaggctccttctgtctccctgcttggacatttcctgcatgtcagtttcattctctgggatgtaaaatgtaagtacctccttcggcattccagacagaagaaagaggaaaggcaaggaacaaaaatgacttattccagtggcctttggcttttattccagaagggaaggcctcccaaagggtttttcctacagctcattagccacaatgatgtcctatggtcatgcttgcttcagtggaggggggaagtttagtccttcattttcctctccagtggaggaaggcaggggagaatgggactgggaatgggggttgagtgaactgaccttcagtaccgcccagcaggcccagctcaaaccccacctacttgtctttcccaattatcaacattacctagccatttctttggcactaatttttcattctttctgcctaggaacaatacttttgcatagttggtttcttctcaaccttcagattccagttaatgtcttctcagaaagggattctctagccacccattgaatatatgttcctcctcttactctcttaattagcactctgtttatttcctttataatgcttaattcaattttcagagtgagagagagaatatctg

SEQ ID NO: 110952 - DNA, 325 bp, Homo sapiens
tattaaaaattcaaaaaaataagaaaaaagaaaattatatgttgatgcactaaacaaaagctttgtattcaccaaatatttattgagtgtcccccaagggataggcacagtaccagtagatggggctttggtaataatcaagatcaacatagcctctgtcctcaaggaagttacggtctaattgtacaggtaaataaacaattataatctaaggtaaaaggtgctaggatgggggcagtgccccagggccccttagcaagggcatctgatctagctttgggatcaggtttctcaaacacagtgacgtctagtttgatgtcagtcc

SEQ ID NO: 110953 - DNA, 611 bp, Homo sapiens
tagggtttgcatttttcaattaaaattcattcaaagaactcctgcccagaggcatttgattatgcctacacctgctatctagttgcagtgttgaaaggcatgggctctggagttagatcgggcgatatccatatgttttctcaacctgaattcccttgtttgcataacagagataataaaggtccctagctcataagcttgctctgaggagtaagtgacatgatgcttgcaaagcacttagcacggtgccaggcgcaatactttttaatgctgatcactgtcatcagcatttcaaccagagacacacagtccacagtaattgagccacataatgggttcttgagaagtgactagaaggttaatgctttggtaaaagattaggaaagttgattctacctatgatctagaattaatttctctagagatgcatgggatgtgtaaagattcttttaatcaattactgttgaattacattgcagcagcaaggaattttaattcttaaaaactacctggctatgtagattcctctaacagtaatttttgggggataaggagtagtgagatgcttggccacagtttttaactttcccccaaattacacccactacata

SEQ ID NO: 110954 - DNA, 444 bp, Homo sapiens
gccctgataatgaggatttctccgcattatgaaaggaatgatggagtggtctggggaggggaccatacattccaggttaagggacagcatgagcaaaggtaggtgtacagatgcttataagagcaaggggcagcagggcgtggtggctcacgcctgtaatcccagcactttgggaggccgaggcgggtggatcgcctgaggtcaggtgttccagcttggccaacatagtgaaaccctgcctctactaaaaatacaaaaacttagccgggcatggtggtgggagcctgtaatcccagctacttgggaggctgaggcaggagaatcacttgaacctaggagacggaggttgcagtgagccgagattgtgccattgcactccagcctgagcaacaagagcgaaactctatctcaaaagaaaaaaaaaagagagcaagttacctggaa

SEQ ID NO: 110955 - DNA, 320 bp, Homo sapiens
aattctgccacccacagcccaagtgtacctgcctctttctatctcgctgttacgattttggttaagccaccaccttctctcaccttgactgctgcattgcctttccccgtctccttgcttttgctcttcattcgaccattcatttctttcacaactgtcagctattcatactgttttgctgtgtctccacccaaatctcattttgaattgtaactcccacaattcccgcgtattgtgggaggaacccggtgggaggtgactgaattatgagggcgggtctttcctgcgctgttctcgtgatagtaaatgagtctcacgtg

SEQ ID NO: 110956 - DNA, 330 bp, Homo sapiens
gatggcagagtggaaagatgggaagacctgggtcccaattaatgtaataaagtttctgagttagccatttctttttcttctttgaatcagtgatttggtttttctgtcacttgaggttaaaatgatcctaactaatggaggaagggggagtccctgaattggtaaacaaagaaggctcacttgatctgtaatgttttatttattttaactaaaaaataatatctgttgtcaactctgcgtagtgagtatgtaggtcattattctctaattttaaaatgaagtgggtagtattatttaaactgttctttaattttttttaaaaaaaggaag

SEQ ID NO: 110957 - DNA, 325 bp, Homo sapiens
aaatgatgatcaagtaaatagtctattaaaaacaaaaacaccaaactaatttctgtagcagacctttgtatatatgaccagagaggagcgacttatacactactctaatgcctttatagactaaaatatttgaaaccttgaaaagcgtacaaaggatcccctgaattaggggaagaatcaaggttcaaatttaagtgtgcaataatatgattaattcctttgtgagagattgtaatctctgtggataagaatgttttttgaaaaaaatatatcatctagaatttcagaatatcagggtgtcattttcacagcaaagttttaattg

SEQ ID NO: 110958 - DNA, 573 bp, Homo sapiens
  misc_feature (339)..(339): n is a, c, g, or t
  misc_feature (454)..(454): n is a, c, g, or t
aaaaggttttgctctttttttcccaaataccgtttcaacagaaagaacccaaagagaccctcaaaatgcctgtaaaattattgcttttctttctctaagtcaggcaggcgaggcaacggaaaggaagagatttggtaagtaaattacagttttgtgattgctcccactaccgtgactgcatgtctgtgggtgccagccgacgagacaatcgtctctcacactctggtagcattcactcaacctacaacactgaggaagaaagccacactgaagacacaaggaaaacaagtcaatccagtctagagaacaacattcagggaaacagagtaccaacacctncttagaacatggaaataaaaaataactccatcagagctacctcgccaaggagcatgttgaaagtccaaaatagcaccattcatcagtgtctcaggtcctgtggcagcatctcggncagttaccacaaggaaacaatgagtttcaaactacttctatacatcaaaagagtacatggataaaatatagagatatacagacattgcataaactactaggtttgttacattctaaatg

SEQ ID NO: 110959 - DNA, 272 bp, Homo sapiens
tttaggcattacctgttgacttgctactatgaaagaggaagattttcacttttgccccaccagcctgcccccaccatcttgagtccctcattctcattctccacatatagctacaccacaagttttggttacatagatattcagtggttacctaaatatcgatcaaagtgagccatgtgctgtgttatggattatatttcttttcttgcataacaagtgtcaaaaattatgaaaaactttcaaatgggaaaacaagaattaatggctcaccc

SEQ ID NO: 110960 - DNA, 549 bp, Homo sapiens
caccagatgctcccaccaagaacgaaaaagtgggccacatgggttattgctcaaggtctatgctgagagcaccatgaatcactaagacatctggcccgagaactttaatcagctgctctacctaaaatgcaatattctgttttcctcccaaactgggtggtcacctgggtgtcggggaggaaagcaaggaaggcttgcccttgtccgtgtgtctgttctgtctctggcacggcaggctgctgagttactggactgtgtccttcaatcactccactttgctttctgtccacttcaccagcccagagcagagccccgcagaagggactgctgaggccaggcagagcggtgatcaagttccaccttccaggaagagacagcacgcccggtgccccatggtggctgcgcatgacagcctggctgcagactactgtgtgcttccatctgtcaccttccaatgcaatgtgacagcagccctccggcgatccatctgcttccctggagctccatcccgactcccccaccccattctgtcggtgggagcatctggtg

SEQ ID NO: 110961 - DNA, 171 bp, Homo sapiens
tcccaggtgggaagggtcggagagcggaggtatctgagagggagggctctgagggggaaagatctgagagtggaaggctctgaggcggaaagatctgagagtggaaggctctgagggggaaagaaagatctggtcagccccagggaaggtaagtgtccggtctgcttatag

SEQ ID NO: 110962 - DNA, 144 bp, Homo sapiens
aggctggagtacagtggtttaatcatagctcactgcagccctggcatcctgggtttaagcgatccttccacgtcacctcagcctctggagtaggtggggactactacaggcatgtgtcaccctactgggctttttttttttttt

SEQ ID NO: 110963 - DNA, 267 bp, Homo sapiens
gtcaatagcagaggcaatggaatgagctgtaataagagtcagcaaatctgagtggacttggcttctcccgtttgccatggtgtaaatatccccaccatgattgttttcaggctaccaacatgatgtcactaaatgtggaattgagaagggatgtccaaaatatacatcaataaatcagccctcatttgattttcttctcagtgaactatgtggttaaatgacttttatctacctttatctcgccattagcaggagacattatggaaa

SEQ ID NO: 110964 - DNA, 258 bp, Homo sapiens
aaggtaggtgatttggggctgttaacagtaactttgtgatgttgtcaaagactcatgctctgtccagctttctattccttcctatataggatatcactcttatcttcatgttctcgtcctacacagaaggaagaggaaaggggaacagtgctaaaaatgcaaccgagtcttcctactatttttatttatttattttttagacagggtctcactgtgttgcccagccaagaatgtagtggtgcaatcacaggacaccac

SEQ ID NO: 110965 - DNA, 125 bp, Homo sapiens
ggagaagaaaaggtcaggaaaagaaagaacagtcaaataagtaaacgctaattgaattccatgttttttctgggtaatattcccatgggttggctgcctcaccctcagtatctctcttgactttg

SEQ ID NO: 110966 - DNA, 230 bp, Homo sapiens
tgttgtctgacaagacataatgttgagtgtgaacagctgtactctgttatcaaagggaggcagtatatatgagatcagacttgaggaggcccttaaggcacaaggaagttacatgagggatttgccagtatgtccatggtccctatttcccctacattaccttctctctttcaatccatacctaagtcttcctgcctaagacaagttgactgaggaagggaaaaaaaaaa

SEQ ID NO: 110967 - DNA, 521 bp, Homo sapiens
agtgatcagcggccccaaacacgtcagtctccccagcacagtggatacctgcgctccaggagacagaatcaagttgagactgatataagtaccccggagttaaagcacacagtccaggagttaggaacttagcaccggtcccttaaaaccttccagaacacagtcacttggctgaatccaccttattccacagttaaaccctcaaggtcatcaaatataggatacaagaaaaaaaaattggctgggcacagtggtccatgtctgtaattccagcactttgggaggcagaggcaggtggatcacttaaggtcaggagttcgagaccagtttggccaacatggtgaaaccccatctctactagaaatacaaaaatgagctgggtgttgtggcatgtgcctgtaatcccaactactcaggaagctgaggcaggacaatcacttgaacctggcaggtggacgctgcagtaagccaagatcatgccacggcactccagtctgggcaacatagcaagaccctatctc

SEQ ID NO: 110968 - DNA, 267 bp, Homo sapiens
agtgatcagcggccccaaacacgtcagtctccccagcacagtggatacctgcgctccaggagacagaatcaagttgagactgatataagtaccccggagttaaagcacacagtccaggagttaggaacttagcaccggtcccttaaaaccttccagaacacagtcacttggctgaatccaccttattccactgaaaaccaatgaaatgttccaatgagaaagttgttaatcaagagcagtcgtataatcaatggataaatttttata

SEQ ID NO: 110969 - DNA, 476 bp, Homo sapiens
ggctgaagtgcagtggcatgatctcagctcactgcaagctctgcctcccaggttcatgccattctcctgtctcagcctcccgagtagctgggactacgggcacctaccgccacacatggctaattttgtttttttgtatttttaatagagacagggtttcactgtgttggccaggatggtctgtatctcctgacctcgtgatccacctgccttggcctcccaaagtgctgggattacaggcgtgagccaccgcgcctggccctgatcactttttaaattcagagcatgagtcttcgattaggctggtttgtgtgactgtcactgtgctcagtcctgttattacagctgtgctgaggtacttagtgtggctgttttccagacttgacttgctcaaattaccatttctctatcttctccagttgcttgctgacccagccttttccactatacttagtggcagtgaccatctaaatatg

SEQ ID NO: 110970 - DNA, 548 bp, Homo sapiens
ttctactccagggcacttacacaatatgggtaagggttgtatctttcttttccaacatttaacagtttgagcacaccattatttttcttgtacgtactgtactcaaatgcataaatagaaaaaaatacacgtttcaccgtcagtcatattacactgaccttgctaatagattatcacacctggggaaaaggtgagttctggtctcaagggcttgtctccatcaaggctggcagagtagggaagacagagagaggttggggtgatcagagaatgagaagatgcaaggagaaaaaaagaacgcagaccagaagcatgtggaaaattgtgggtggcaaaccacccaggtgctgaggcaagagactgaggacacgagctgttccagtataataaaatataaaacaagaatagttataccagatatagatcttagatatgattatatatgaatatcattaatcattatttgtagcaattactctttattccaatattataataatcctcactctacaatcataacctaggaaaaaccaggccatacagagata

SEQ ID NO: 110971 - DNA, 429 bp, Homo sapiens
atcactcatcattggttaaagccgagctcacagcagaataagccaccatgaggctgtcggtgtgtctcctgctgctcacgctggccctttgctgctaccgggcaaatgcagtggtctgccaagctcttggttctgaaatcacaggcttcttattagctggaaaacctgtgttcaagttccaacttgccaaatttaaggcacctctggaagctgttgcagccaagatggaagtgaagaaatgcgtggatacgatggcctatgagaaaagagtgctaattacaaaaacattgggaaaaatagcagagaaatgtgatcgctgagatgtaaaaagtttttaatgctagtttccaccatctttcaatgataccctgatcttcactgcagaatgtaaaggtttcaacgtcttgctctaataaatcacttgccctg

SEQ ID NO: 110972 - DNA, 231 bp, Homo sapiens
atctcatacttttttcagaaaatcaaattttaggctgagggaagggagtgggtagggaaagggaagatgctgatcaaaagggacaaagtctcagtaagacaggaagaataagctttagtaatctaatgcacagaatggtgactttaataaataacaatacactgtatactcaaaattgctaaaagagattttaaatgtttttaccatgaaaaaagataagcacgtaagggg

SEQ ID NO: 110973 - DNA, 129 bp, Homo sapiens
cctcctgggttaaagcgtttctctagcctcagcccccccagtagctgggactataggcaggcatgagccgccatgcccagctgattttttttgtattccttgtagaaatggggtttcgccatgttgccc

SEQ ID NO: 110974 - DNA, 184 bp, Homo sapiens
tgtgcattgtgacacacttgtctagggatgcctggaaatgtataaaattggactgcatttcttagagtgttttactatagatcagtctcatgggccatctcttcctcagatgtaaatgatatctggttaagtgttatatggaataaagtggacattttaaaactagcaaagttaaaaacaaaaa

SEQ ID NO: 110975 - DNA, 494 bp, Homo sapiens
gccgcgattttcctaaaaccttaaacttaggacttttggcagaattgatggtccttaaccaacaattacaaggcagaccaggccctggggaaaactagctctgactatcctcacccagggaaggctcattggaaacactccgagagatggcttaattattaatatttaccatagagattgttctaggagcaacgcctccttgggaaaccaaagttatatcaagaggaggcttggtaagtgttgggggcagggaatgggccgctgccgctcagagactcttctgttgcctggtttaattttcctagtggcacctatctaatatttccttgcatgtttacttgcttatctattgtcagtctccatgagaacaaagatcttgccagtgctgttggttgcctgatttccagcccctggaatacagcctggtaggtggcaggccctcagtaactatttgttgaatgactaaataaatggagaggggtgggtgtgggctc

SEQ ID NO: 110976 - DNA, 202 bp, Homo sapiens
aaactataaatgctttttaaatccttggcaaatttgtattttctacctcattgcacagtaatattaataaagctaattgaaagttagttacatttaaattgtactttcattataaagtagttaagaattgtcctaaaattttaacgtgtttcatatgtctgtgctctctaaaattagaatgagtaaatgacactgatttaaa

SEQ ID NO: 110977 - DNA, 417 bp, Homo sapiens
ggattatagacatgagcaattgtgcttggctcaaatattcgttttaattgggctttttgtcagaagaatgtgccactctgaatttgtttttggtattaagtttgtttcttgcattacctgaacctattttacattgattttattttattttatttacatcgatttttattttattgatttttattttatttacattgatttgaatttgggatactgctattttaccgatattaaaagatgtttcagcaaagctagcagatttttccatgactttttttagtcattgttgaaagatcaaagcttcattcatctacagtttaacctttgcttctaaactaaaattttattcttaatagtttttttcttactctagtgatgagttgtttatccatgctaatcaagtatgctagtcacctg

SEQ ID NO: 110978 - DNA, 402 bp, Homo sapiens
caatacccaaaggatatgtatctacaaacctagtggataagcaatctttaatgaagtcatctttttaaaccttcaagtaaatagtgaatctgactgcaaactatcaaatctggcctcaccacaataaacatcaaaggcagcgaacatataatgaatcaacatgaaatataattcagcagccagccctgtaagtttttgcctgtaatcttgaattcactgaaacatagattccaaataatttcccaaaatccaagcttcagcatttcagtctgggctctgttaaagaatttatcctagatgcctggaataaaatggattagttcaaccaggttctgttgcctagctatggaatgatggagcacctccctggaagtggatagaatccaatgttcttcagtagac

SEQ ID NO: 110979 - DNA, 356 bp, Homo sapiens
aatatctgccacatatccacatttctgacccatttctgctggatttgaaggtaaaagaaaagagcaaaaggtgagtctaaggactggcttgactccagataaatatcttcctcagttatgcggtcagatctgtaggagaatgctgcgtcttagcagtatgggaaactaacttggcctagtctggtgatggcagtaaaacttttaacaattcatcagcccttttaatgccagttttttatataatacccttcacttatattcagccactcagcacttgccatgtgccaggttctatactaggtgctaaggacacaaccttcacaacaagtacagcccctgctcttgaaaagtaaagg

SEQ ID NO: 110980 - DNA, 225 bp, Homo sapiens
agggcaacatgtgaacccctgtagccagtcatatccttggactttgcaggtaaatgaggcagtaagttcccttttgtgcttaaaccagtttacatttctgtcacgtgcaaccaagggtccaagcctacatttcatccatcttcacctgcttctttgaatcctctcttcctgtacactgtgatgagagggccccctcccggacctgaggccagaccagctcatgtg

SEQ ID NO: 110981 - DNA, 410 bp, Homo sapiens
gagtgaaacattacgtacacatgaacacaaagatggcagcaatagacaccggggactactagaggaaggagagagggaggagggaggcaagagttgaaaaagttaactattgggtactatgctcagtacctaggtgacaggatcatccataacccaaaccttagcatcacacaatatactcatgtaacaaatcttgtggcacatgtaacccctgaatctaaaataaaagttgaaatgatttttaaaaatacaaagatgtacgtactaaatgcatcactctttactattagcaatactgtaaaaaaaatagaatctacaaaagtaatctggcagtctcattcattcattcaacaaaccattattgaaaacccactgcctaaaattacccagcactttggaggccaaggtgg

SEQ ID NO: 110982 - DNA, 251 bp, Homo sapiens
actttgtaaatcaagtgctgggcccggccctaggcctgctcaggcggaagctccagaggtgagtgacccatatgcgagaacccaggcagtgacagtggatgaagccatcctggaagcatagggtcctggagacattaaactctctctcccctaacatacacatacatatgtatgcgcacacatgcagggatgttcacacacacagacacacatcagccacatttaccaagagcttttttattttttatttt

SEQ ID NO: 110983 - DNA, 322 bp, Homo sapiens
tttaaataactaaaaatgcatataaaaattaaatgtttcatgatcaaggtaaaggaagaaaagataacatttattgaatgtaactagtgtgcttggcatgttacagaaatgatgttatttaagttttataaaaagttcatgaggaaagattttataaatgaaagaaactcaagattcaagggtgtttagagcctttctcctgaagttacctgatttattatacgggtgtgtttataaaggtttgataagtgcctattctttctgctctttcactgctgaagaatattttagacatgttacctcttcgtctgaattatgtttt

SEQ ID NO: 110984 - DNA, 326 bp, Homo sapiens
gagaaatggagctttgttagataaaaattttttcaacgcaaacagtcattttccagtgaaaggagagcgtatccgccgtaggatggacttagatcgtgtaaaagctgaggccaccgaggatataacctccggggtcctttgcctccttttccttagactccctccaaactcgtgtatctttccttcagcagtactgggctccacgcgaacctagtcctttgtctttaccctattacctttcataacatcctagttgaaaagtagttattcaaccgcgtttgaaaatgagaacaggttcacagaggctaggttacttgcgaaggtcg

SEQ ID NO: 110985 - DNA, 294 bp, Homo sapiens
aggagccccagcggctctggcacttcctcctgatgtttgcaaggggaaggtaatgattctaattgcacaggacttggtcctggccttggtgatggcaggagggcagagtcctcatggtatggccaaaaaatgtttacaacttgaccttgtcctcctctgatggtgttgaccttggacaaactatgcccctctgagcctagtgcctcagtttccccctcttgcaaatgcagcaggtagtagtgcttaatctcagagttgtggggattcaatgaaacagtactgaacggggcttaa

SEQ ID NO: 110986 - DNA, 587 bp, Homo sapiens
gggggccgggcacccagactccttccatcttgtgctccctccatccctgcgccgtggcctttgtccacctggtccaccatacccacatcccctccagtcagagggaaagcaaagaagggggaaatgaaagggagggaattcccttttctctttctttttatggcaccatctggaagtttcactatcgctgtcacacatggctgcgagggagcctggggaggtgtggccttcaactgaatcatggatcctgctggcagactcagccggacaggccctacaggcagggcaggacctggcccctgcagcctgtcctctccccgcattttctgacctgcagctgtcagagggtgtcctccttgctcttccttggatgccctgagctgaattccctggacagttctctggcttgttcattctcccacttaaggtgtccactcgcgaagaggtgagtgatccagctttctcctttcgcattcgaggctatgtacttggccggggcgcagggcgcagggccctctcttactatactattcagccgggcatcctgggaaccacagagtatatagggtatctacccaggctagaac

SEQ ID NO: 110987 - DNA, 2492 bp, Homo sapiens
agcgcccaggcccgcgccccccgcgcccccgcagcaggaatggcaggaacggatccgggccgagcccgacccgggacgaggaggggctgagccgcgggggatcctggaatcggcagggaggtggggattctgggaggaaaactccatttcctccttccctgccggtttctcccctctaccctggcaccccaaatttcgatgtgccgcctgccgggcgctaagcgccggtgttgagagaggcggcggccgccgcgcccgggaaaatgctgggcatgtacgtgccggacaggttctccctgaagtcctcccgggttcaggacggcatggggctctacacggcccgcagagtgcgaaagggtgaaaagttcggaccctttgctggagagaagagaatgcctgaagacttggatgaaaatatggattacaggttgatgtgggaggttcgtgggagtaagggagaagttttgtacattttggatgctaccaacccacggcactccaactggcttcgcttcgttcatgaggcaccatctcaggagcagaagaacttggctgccattcaagaaggagaaaacattttctatttggcagttgaagatatagaaacagacacggagcttctgattggctacctggatagtgacatggaggctgaggaggaagaacagcaaattatgacagtcatcaaagaaggggaagttgaaaattctagaagacaatcaacagcgggcagaaaagatcgccttggctgtaaagaggactatgcttgtcctcaatgtgaatcgagttttaccagtgaggatattcttgctgagcatctccagacattgcaccagaaacccacagaggagaaagaatttaagtgcaagaactgtgggaagaaattcccagttaagcaggctttgcaaagacatgttcttcagtgcacagcgaaaagcagtctgaaggagtcttcgcgaagttttcagtgctctgtttgcaattcttccttcagttcagcatcgagttttgagcagcaccaggagacttgccggggggatgccaagtttgtgtgcaaggctgacagctgtggaaagaggctgaagagcaaggatgccctgaaaagacaccaggaaaatgtccacactggagatcctaagaaaaagcttatatgttcagtgtgcaataaaaagtgttcttcagcatcaagcctacaggaacatagaaagattcatgagatatttgattgtcaagaatgtatgaagaaatttatttcagctaatcagctaaaacgtcatatgatcacccactcagaaaaacgaccctataattgcgagatttgtaataagtctttcaagaggcttgatcaagtgggtgctcacaaagtaatacacagcgaagacaaaccttacaaatgcaaactttgtggaaagggatttgcccacagaaatgtttacaagaatcataagaagacccactctgaggagagaccgttccaatgtgaagaatgtaaagctttgttccggaccccattttctttacagagacacctgctaatacataacagtgagaggactttcaagtgccatcactgcgatgctacctttaagaggaaggatacattaaatgttcatgtccaggtggttcatgaaagacacaagaagtataggtgtgagctatgtaataaggcctttgttacaccttcagtgcttagaagtcataagaaaacacatacaggagaaaaggagaaaatctgtccatattgtggccagaaatttgccagcagtggtacactcagagttcatatccggagccacacaggtgagcgtccctatcaatgtccttactgtgaaaaaggattcagtaaaaatgatggactgaagatgcacattcgtactcacaccagggagaagccgtacaagtgctcagagtgcagcaaggccttcagccagaagcgaggcctggatgagcacaagaggacgcacactggagaaaagccttttcagtgtgatgtttgtgatttggcttttagcctgaagaaaatgctgattcgacacaagatgactcataatcccaatcgtcccctggcagaatgccagttttgccataagaagtttacaaggaatgactacctcaaagtgcacatggacaatatccatggtgtagctgacagctaataggggctgtaaaggaattaaactattcagaagggctcctaatatgaatcccagatttttatcacctgatcagcataacagaagtagccaaaagtgacttactggtctcatagttcttatttgcctacatttagagtctgtagatgcatatgcaaccaaaaaaaagtcttacttttaacaagaaatggtataaatggaaaaaaaatacaactccatagccttgcaaaatgcaacttgtgctctgtcttataaaaatggagaaaggagtcatggctctctttcttggccatccctctgtaatgaagtttataatatacttccctaataggccttttt

SEQ ID NO: 110988 - DNA, 931 bp, Homo sapiens
agcgcccaggcccgcgccccccgcgcccccgcagcaggaatggcaggaacggatccgggccgagcccgacccgggacgaggaggggctgagccgcgggggatcctggaatcggcagggaggtggggattctgggaggaaaactccatttcctccttccctgccggtttctcccctctaccctggcaccccaaatttcgatgtgccgcctgccgggcgctaagcgccggtgttgagagaggcggcggccgccgcgcccgggaaaatgctgggcatgtacgtgccggacaggttctccctgaagtcctcccgggttcaggacggcatggggctctacacggcccgcagagtgcgaaaggtgggtgacccggcggcggcctgcgcgcccctgcacctcgcgcgccctgtgcctcccggagtcgccctgccgcagggcccggggcgcggcgggcttcaccccggtcgcccctcgcccgggccgggccaggcgtccgtgggaaggccggggaccgcggggcacggcgggggtggcctttactcgctgcgccacccgagcaggcagcgccacgtaggtggcggcggggtgcgctccgctgccggccggtccaggggcggaactgccaccggcctccctgccgcaagatgtctttcctctctcccgcaggaagtgagcgcggcgggagcctccctcttcctcggttacgggtgtgagctgcgtctttgcgttggcgaaggcacgcgtgggcgggtgttttcccccgcgcgcacgctgctccgctgtcgcctcttttcctttaggatgaattaatgtggctagaaacgcctaactttccatgcggggatgggaggagcagcccagagcgccgctccacgcaggccgtagaatctcattcatacgcccaggatttccttccctccttctggaatgtatta

SEQ ID NO: 110989 - DNA, 668 bp, Homo sapiens
agcgcccaggcccgcgccccccgcgcccccgcagcaggaatggcaggaacggatccgggccgagcccgacccgggacgaggaggggctgagccgcgggggatcctggaatcggcagggaggtggggattctgggaggaaaactccatttcctccttccctgccggtttctcccctctaccctggcaccccaaatttcgatgtgccgcctgccgggcgctaagcgccggtgttgagagaggcggcggccgccgcgcccgggaaaatgctgggcatgtacgtgccggacaggttctccctgaagtcctcccgggttcaggacggcatggggctctacacggcccgcagagtgcgaaagggtgaaaagttcggaccctttgctggagagaagagaatgcctgaagacttggatgaaaatatggattacaggttgatgtgggaggttcgtgggagtaagggagaagttttgtacattttggatgctaccaacccacggcactccaactggcttcgcttcgttcatgaggcaccatctcaggagcagaagaacttggctgccattcaagacaagaatttgggacccgccgaatggcgaggctaaaagagctgtaacacagacaagactgagacctgctccttgcttgccacattgcgagtgaagagaaggaga

SEQ ID NO: 110990 - DNA, 2681 bp, Homo sapiens
agcgcccaggcccgcgccccccgcgcccccgcagcaggaatggcaggaacggatccgggccgagcccgacccgggacgaggaggggctgagccgcgggggatcctggaatcggcagggaggtggggattctgggaggaaaactccatttcctccttccctgccggtttctcccctctaccctggcaccccaaatttcgatgtgccgcctgccgggcgctaagcgccggtgttgagagaggcggcggccgccgcgcccgggaaaatgctgggcatgtacgtgccggacaggttctccctgaagtcctcccgggttcaggacggcatggggctctacacggcccgcagagtgcgaaagggtgaaaagttcggaccctttgctggagagaagagaatgcctgaagacttggatgaaaatatggattacaggttgatgtgggaggttcgtgggagtaagggagaagttttgtacattttggatgctaccaacccacggcactccaactggcttcgcttcgttcatgaggcaccatctcaggagcagaagaacttggctgccattcaagaaggagaaaacattttctatttggcagttgaagatatagaaacagacacggagcttctgattggctacctggatagtgacatggaggctgaggaggaagaacagcaaattatgacagtcatcaaagaaggggaagttgaaaattctagaagacaatcaacagcgggcagaaaagatcgccttggctgtaaagaggactatgcttgtcctcaatgtgaatcgagttttaccagtgaggatattcttgctgagcatctccagacattgcaccagaaacccacagaggagaaagaatttaagtgcaagaactgtgggaagaaattcccagttaagcaggctttgcaaagacatgttcttcagtgcacagcgaaaagcagtctgaaggagtcttcgcgaagttttcagtgctctgtttgcaattcttccttcagttcagcatcgagttttgagcagcaccaggagacttgccggggggatgccaagtttgtgtgcaaggctgacagctgtggaaagaggctgaagagcaaggatgccctgaaaagacaccaggaaaatgtccacactggagatcctaagaaaaagcttatatgttcagtgtgcaataaaaagtgttcttcagcatcaagcctacaggaacatagaaagattcatgagatatttgattgtcaagaatgtatgaagaaatttatttcagctaatcagctaaaacgtcatatgatcacccactcagaaaaacgaccctataattgcgagatttgtaataagtctttcaagaggcttgatcaagtgggtgctcacaaagtaatacacagcgaagacaaaccttacaaatgcaaactttgtggaaagggatttgcccacagaaatgtttacaagaatcataagaagacccactctgaggagagaccgttccaatgtgaagaatgtaaagctttgttccggaccccattttctttacagagacacctgctaatacataacagtgagaggactttcaagtgccatcactgcgatgctacctttaagaggaaggatacattaaatgttcatgtccaggtggttcatgaaagacacaagaagtataggtgtgagctatgtaataaggcctttgttacaccttcagtgcttagaagtcataagaaaacacatacaggagaaaaggagaaaatctgtccatattgtggccagaaatttgccagcagtggtacactcagagttcatatccggagccacacaggtgagcgtccctatcaatgtccttactgtgaaaaaggattcagtaaaaatgatggactgaagatgcacattcgtactcacaccagggagaagccgtacaagtgctcagagtgcagcaaggccttcagccagaagcgaggcctggatgagcacaagaggacgcacactggagaaaagccttttcagtgtgatgtttgtgatttggcttttagcctgaagaaaatgctgattcgacacaagatgactcataatcccaatcgtcccctggcagaatgccagttttgccataagaagtttacaaggaatgactacctcaaagtgcacatggacaatatccatggtgtagctgacagctaataggggctgtaaaggaattaaactattcagaagggctcctaatatgaatcccagatttttatcacctgatcagcataacagaagtagccaaaagtgacttactggtctcatagttcttatttgcctacatttagagtctgtagatgcatatgcaaccaaaaaaaagtcttacttttaacaagaaatggtataaatggaaaaaaaatacaactccatagccttgcaaaatgcaacttgtgctctgtcttataaaaatggagaaaggagtcatggctctctttcttggccatccctctgtaatgaagtttataatatacttccctaataggcctttttattttattgttattctttgtgtgtctgtgtgtctgtgtgtctgtatgtgtctgtgtgtgtgcactcacttgcaaatgccagttgttgcagctggttttaccaatttaaatagaaataaatcaagatatccaactatttctttgcagatgaggataagaataagttatcaaagtctcaagtttgatagga

SEQ ID NO: 110991 - DNA, 1273 bp, Homo sapiens
aggtcggtggggtttcatggctctttttgctgcggggaaaaaaagtatttcaattacagaaagatgccaagaatgaacttgagctactcctatttgtcagtgtagcatttcacttctctctatggtgtacttctaatttattagaaactccataaattgaagggattggaagggtgagattggaaaagtaattgggtggtgctttcacaattacatttttggtttaattttcacctagaatgattcagtttgctgttttgtaaccatttcctagtctacaaaagcaaaataagccagtcccctgatattcatggaaaaaaatgtaaagttcttctaaagaattcccatataatacatatattttaaagttcaaccatgtggaacgatatcaggtgagcgtccctatcaatgtccttactgtgaaaaaggattcagtaaaaatgatggactgaagatgcacattcgtactcacaccagggagaagccgtacaagtgctcagagtgcagcaaggccttcagccagaagcgaggcctggatgagcacaagaggacgcacactggagaaaagccttttcagtgtgatgtttgtgatttggcttttagcctgaagaaaatgctgattcgacacaagatgactcataatcccaatcgtcccctggcagaatgccagttttgccataagaagtttacaaggaatgactacctcaaagtgcacatggacaatatccatggtgtagctgacagctaataggggctgtaaaggaattaaactattcagaagggctcctaatatgaatcccagatttttatcacctgatcagcataacagaagtagccaaaagtgacttactggtctcatagttcttatttgcctacatttagagtctgtagatgcatatgcaaccaaaaaaaagtcttacttttaacaagaaatggtataaatggaaaaaaaatacaactccatagccttgcaaaatgcaacttgtgctctgtcttataaaaatggagaaaggagtcatggctctctttcttggccatccctctgtaatgaagtttataatatacttccctaataggcctttttattttattgttattctttgtgtgtctgtgtgtctgtgtgtctgtatgtgtctgtgtgtgtgcactcacttgcaaatgccagttgttgcagctggttttaccaatttaaatagaaataaatcaagatatccaactatttctttgcagatgaggataagaataagttatcaaagtctcaagtttgatagga

SEQ ID NO: 110992 - DNA, 253 bp, Homo sapiens
agggagtgcctcacatgaattggctgatgttccttgtgaatagattcaggtcctcacggttagcaatcaagggggtcaaaataaatttagaaataaattcagtcaaaaactcttttttctttttcttttttttaagagacaaattttcctgggattgggttttaatggaactgggttcagcaagtccaaattctaccctctactggctcattcagaaaaaccattttctgtttcagttttggcagttctgtaa

SEQ ID NO: 110993 - DNA, 462 bp, Homo sapiens
catactgcttccttagggaagcattttcttttctgtatgttccttatctccttttctactgttctcttgtcctcagctcaagacatctctggtcttaaagatacaagaaataaccttcctttagccccaccatatacctctctagctactgtcctgttttggacaatttgtctcccacactcctatactgtggcttctgtgcttggcttccacactcttacacttgctgcattttgccttctgctcttaccattgtactcaaattatcagtcaacaatgaactcaaaatgccatatccatagctcactacagtttcaaactcctgcgctctagtgatcctcctgactcagcctcatgaggagctaggactacagaaatgtgccaacatgcccatcttatttttaaaattatttttttagagacgagggtcttatatgttgcccaggctggaattgagcaccg

SEQ ID NO: 110994 - DNA, 259 bp, Homo sapiens
gcatctgttttcattctcatgacttctctgtgaggtagcaagtattgtacccagttttctgatagaggaaattgtggcccagagagattgttgtaccccaaagtaatgaagatgaatacagttgcagaaccaagttagaagccagatttttggagatccaaggtccagtgaacacagctgtacccccacagacacttccgaaagtgaccacagcctcttcagccagtcctgaagagtatgttcaccttcatctgtctta

SEQ ID NO: 110995 - DNA, 551 bp, Homo sapiens
actttgtgcccattaaactcagcctcggcctctggcattgcatgaatctgtactttagttagagagaggtttccttgtctcctccacagtgagcagcctcttttaggctcctcactttatgccacagcagtaatgatagaagttaatggaacaattttcatggttcattgggaagtattattgcctttattctgccaagcccagagacttcattctcattgacctctgagcctaagtgaaggctgctagcctcccctcctttaagtcccccacttgtttctggggcatgctttctgctccttgctcatcccagcccgcatcgtcattacatgcctatctgcctcctgctgcactccaagtgggggatgatctcaaagtccactcctcagccctgtgcgcttctccctcagtgtcccctcccctgctggctcagggagtcatgtcagtgcctaccactctcatgatgacacagtctctgtggtgaaaaatggctgccctctgagctctggcccttagcccccatcattccctgcactttgggcatctcccct

SEQ ID NO: 110996 - DNA, 385 bp, Homo sapiens
acaaataatagagattgcaactttgccgctaataaaacatgattcagttatttttgagactaatgaaatcttaagtagtaaataagagacaaaagtaatgatcatttaattttagtattgaaaacactgctgattctgccagtaagaaaataagctggtgtgagtaccaagaataggaaaacatttgccctggaattgtctttttgttcctttctaggaaattgtcttttattttatgaaaggaaagcagataggtcaatataattatgtctttcatggatctgggaatagatctcaatcttctttgactctttttatacttacttttcctgtttcctgaaattatttacatatgactcatttttctctttattttgaagaagat

SEQ ID NO: 110997 - DNA, 369 bp, Homo sapiens
cagttttgtcctttttgttgatttcactgtttataatgtctcccaagtgtagtgctgaagtgctgtctagctttcctaagtgcaagaaagctatgatgtgccttactgagaaaatatgtgttagataagcttaattaaggcatgagttatagtactgttggctgtgaatttaatgttaatgactcaacaatatatattaaataactgtctttaaacagaaacataaaaaacaaggttatgtaataagtggttgatgaaaatactgtcacagactctcagggactccctgtatttcccctagaagcagtggttcagtatttgataattcagtcttcataatcactttatagaacataactatgaataatg

SEQ ID NO: 110998 - DNA, 306 bp, Homo sapiens
aggccctcttccccacccactgagcatccaagtgcgggaggcctaatccatgcacctggcacttaggaagcccacagtcactgctgttactgtggttgctaccctcatctcactgggaaagaagccggctcagagagatgggatgagtcacccaaggccacatgatactgggggcagggctggcacaggaacactgggctctagggctcattctcctccctgtaccccaggatgcggccactgccctgccctcccccaacaccttttttcctccctcttacagaaaacaggcaggctctaccagtc

SEQ ID NO: 110999 - DNA, 694 bp, Homo sapiens
atgggagtctgggaggtcgaggctacagtgagccatgatcaagccactgcactccagcctgagtgacagagacactgtctcaaaaaataaaaataaaatttggtatttaaaggtaaagaattactttaccttatcttatagaaggataacagctaataaatttagaaagaatgaaggaattttaaaaatcaacactttgtgaatgccagtgacttcttcaggggagaatgatcagatggtgtaaacaccactaggtgaaaggctgatgagcaagagaccatctatggctacctaagcactccacagatcactgctaaatgcaaagggaaaaatgtacctttacagaaaagatcaaatttagcatcacaactagtgatgtttcccatgtgtgctgaggatgaagtactcacactaaaatgtttaaacggaatctattcagacacttaaaagattaaacatccggttcagaaaatcaaggcagggaacaagttaaacaataccatgagaaaacagtaagacagatgtggagtattctataactagcctgctctctttgaagaaatcagagttattaagaaaaaaacagcgtaaggactcttctagactgagattacagacataacaactgcgatgagtgaggctcaatggaactgtggttttaaaaaagagcaacactttggagacaactgggtag

SEQ ID NO: 111000 - DNA, 741 bp, Homo sapiens
gcatactcagccctcgattaggaagcctcctcactctacttccttcagaatgtctgtggagaatggggcactcttgagaacagggaggtctgcccctgcttccaaggacacaacagacccggaagcggccctcactgcccgtgatctctccactatcatggctaatggcacagctcccagggagctgaggaatcagatgggatgaaggagggtttctatttattctgcgaagagtactctagctgcagtgatccttacaggccattagaagatttttctgtaaactactgtgtctgtgcctgctggaagccaaaggagcctggcttggcttcagcctctccagccctttaaaggacagttgagacagaggccttggggacaggctgatcttctgagcattctctcactgttttgtccctctggagagacagcatctttatcagtgttgtttagataaaatcatagtaacaacacccagcagagtcctctaaagagctttatcatctgataagacttttctgtgaatgcaaaaggggttttgaatctaacggtaaataccatccacagcttagttttgtggttgttcttgttgccatttgtttcatccttatttcagaatgtattgtcttctatttatttcaaaatggaaagtctaattaatatatagtaaggtgcaaaattttatcaaacttaccagtctcttccttcatgtgttgtgaaaaagagaaggtataaatgtgg

SEQ ID NO: 111001 - DNA, 594 bp, Homo sapiens
caacaaaaaatcattttctgttgcatatcctgtgtggaggatgttgtcaacgaaagctgggtcttcatgggctcacacagaaaaaataacagactcctgtataaatatttttttcagtatcaacatagatataaacgtttagttttttccagtgattttggaaatgtaaacatcgcgtgtggagaacgcgttagcttttggaatgtgtggcaatctgtgatgcgcacagtgaagtgagtaccatgtggtcagggaactgcacgcctcccgctgggtggcagcgagtgttttcaggttttaggttgtgcctccagtggagggagagcttctgaccatgactatcaatctgaggtgtttcatcttgtcctcctccccagcccctcccccagtcccgtctatcagaatcttttacagcaggaggatgataggattcaccctacgccttcacctaaggacacagtgtgtgaaaggtgttctgcaaggcagaagctgtcggtacattgcagatagaaggaattacagctcaccgggcctctaaagttttctgcagaggcatagagctggactttattgattttccgattgtataggaaa

SEQ ID NO: 111002 - DNA, 334 bp, Homo sapiens
cctggatcgtctccagaactgctgtggctgccaagctcggtagagacgtggcgccccacccagtgtcatccgggggacttcaagctggaatgcagagcttagaaagggaggggataattatggggtgtgaggtgcattgccctctaaatctttaaacaagcaattggcagtaccccgtgaaacctttccttctcctactcggccacctcccaccaacctggcatcgttcctcccgggagctagccagcttcagaaagcacatacagcatccttgctgccaaaccacctatgtgcacacaggatttccttaatggcttaataaactgttataaag

SEQ ID NO: 111003 - DNA, 223 bp, Homo sapiens
cttagggattcaaaaaacagaacacaagtaagggagaacagaagacttagggactcatctgattttaactactggctccaccatttacttacctgtgtgatcctaggcaagtcacttactgtcggtgaaccacaatttcctcacctgtaaaatgggtgtatgatgccacgtgtgtgggcacgtgcctgtaatcccaagctactcaggaggctgagtcgggagg

SEQ ID NO: 111004 - DNA, 329 bp, Homo sapiens
cccaaatccaaaatgcttcaatgagcatttcctttgaatgtcatgttggctcagaaaattgggatttttggagcattttggctttgggatgctgaactcatctatattttatagatcttttactttagagttgagatcacctgtcagtattttagttttatattacagaggtgagtgggtaaaggattgagtgtgaagactattggtttctcttggtctccacatattgacacgtgcaagtaaagttcatggttgactttgaccgagaaatacagtccaacagatttttacaaaactaacagacaagagaaaacctatacacagatttt

SEQ ID NO: 111005 - DNA, 807 bp, Homo sapiens
cgaaacaaaaagcaagttcataccgctgcattctgttctcttgttctgacggttaattcactggacatcaaattttctttgccctagttttccccaaaagaaaacaaaagcaaaaatagttatattaatgttgaaagtgctttgaagtcacttgataaaaggtgctatgaatagcaacttactgtgttactacattgcctttttggcattggttgatttataattttggtaaaggatcctaaaaccctgtattctttttctgtgccccataatgaccaaaaaagataaagaaaatgagagtaagatcaaaagatcaaactaaaacataaacagtctccttcctgtctgctttcttacctatctgttcacactttatctctttccctttctctctctctctcacatgcgcgcgcgcgcgcgcgcacacacacacacacacacacttgccccaacactgagaaataatcttgccagaattctggtttttatagttgttgtagtccgtttctctaaaaatagtcctgttttcatatgaatctaagagaacattaccggagaaaataaagttactcatttatagttactaataataagttagtgattaacttaccacaattggataaaatataaaactattcttcagcacatttatacctaaattagtgaagtccatttgtgaagttcatttggcatctgcagttaagagttaaccatgtataaaatccctcccaaagaacataatcatcgttagaaccaaatcctcttataaagaacaaatataaaaaagttttctgtggtgaagctatt

SEQ ID NO: 111006 - DNA, 360 bp, Homo sapiens
actgcactccagcctgggagacagagtgagactccatctcaaaaacaaaaaacaataggatcattgtacccttaccagggctcctgcaagggtccccacatgccttgtccagtgaggtcctgaggtcagtagtcacagctgagcagggcacaggcacttctgagtaggaaggcacgatagtatgagagaagtttccagcattggaaactttctgcagtttacgtgacacttcagatgaactaggtgtagtttcccagaggaagtccaaattcagttctgatagcttcatcttgctctatcattacttttcaggactccttcaactcttaaactccaagaagctaaggaggagaaaatgac

SEQ ID NO: 111007 - DNA, 831 bp, Homo sapiens
tacgaggggcggaggggaccgcgtcgcggaggagatggcgcggcacgtgcggtgacggcacccgagccctgagggtcccagccccgcgctccgcgtccccgggacagcatggagcgcccggagcccgagctgatccggcagagctggcgggcagtgagccgcagcccgctggagcacggcaccgtcctgtttgccaggctgtttgccctggagcctgacctgctgcccctcttccagtacaactgccgccagttctccagcccagaggactgtctctcctcgcctgagttcctggaccacatcaggaaggtgatgctcgtgattgatgctgcagtgaccaatgtggaagacctgtcctcactggaggagtaccttgccagcctgggcaggaagcaccgggcagtgggtgtgaagctcagctccttctcgacagtgggtgagtctctgctctacatgctggagaagtgtctgggccctgccttcacaccagccacacgggctgcctggagccaactctacggggccgtagtgcaggccatgagtcgaggctgggatggcgagtaagaggcgaccccgcccggcagcccccatccatctgtgtctgtctgttggcctgtatctgttgtagcccaggctccccaagcttccctgcatcttggtccttgtccccttggccacactggagaggtgatggggcagggctgggtctcagtatcctagagtccagctgcagaaggaggtggcttttcctccaggaaggggcttctgggtgtcccctcatccccagtagcctctttcttgcgtttctttttaccttttttggcactccct

SEQ ID NO: 111008 - DNA, 506 bp, Homo sapiens
gcactttcagtaccggtaattagagacaatgtggttttggctttcggctcacagtattgcaccaggtactgtgaatactgtgatcagtaagactagtgaaccccttgactccatgaagctcaagttttagtgggaaaaacattggtttgggtgtcggaagagctgagtttaatctccagctctgtgacttacagtgactaattgcgtgaccttggacaagtcacttatataaagactctaggccagaatctcttcatacatacagcaaggctagtttttttgagtgtttttgtgagactgaaatgagcgaactgaaatgggctcatttcagtttcctcataaaatgacctgaatttttatttacatctatctcatcaactagaatgtaaatttcgtgagagtctcggtgtggtctgttttttccacttctctaaccccactcagtacctagaactcagtagacctccacaaatacttatggttcttttgctttacattcttactca

SEQ ID NO: 111009 - DNA, 301 bp, Homo sapiens
gggtagaagtgacagcatcaaagggaagcccagaatctttgtttgatggctggaggagagacttctctcttctggataagaagcagaaagcatgtgatacaggatactccagcagccatttcactaccacaagctggatcaacgtaagggtgaaattaacaagatttcaaagaaggcaaaagacagagaaataacttgggcctatggttacatcactgagctgctgcaccaagccttgcctgaagctcgtcctacttctttcacttataaaaaccaataaattcccttgattatttaatcc

SEQ ID NO: 111010 - DNA, 458 bp, Homo sapiens
cagggctgccctcactcctccctccagtctgccaatgtgatacctgcagtttaagactatgagagaaaggcatagagaatcacagacaaactgaccctgagcagtgatattatttgagtcactaaactaatacccataatgaccttatatccagaaatattgtagtgtgtgtgggaggaaaaatccctatttgtaatcactttatttcttacactgttagtcagttttctgttatttgcaggcaaaaaaaaaaaaaattcctaattgattcagcagaggaggcagatcaaatgagtagccatcaactcttaaaaaggttgtttttttgttttgtttcgttttttgggggacagcgtagctttgaaaaacctgagtgaaactaaatattcttctgaaggtaaaaccaatatagcatatcatggagcctcataatttatttcaaattttatgcctgaaac

SEQ ID NO: 111011 - DNA, 153 bp, Homo sapiens
ccaaggtccaggggcccatatctggcaatgggcttcctgctgagtcactccatggtggaaggcagaagggcaaaggagcacaagagacagtgaaagagaggaataggctgaactcatccttcttatcaggatcccactcctaagataacccac

SEQ ID NO: 111012 - DNA, 744 bp, Homo sapiens
ccagtatatcaatttttctccttaaaggcttatgcttttttagttcttctgtatggagaaagatatggatcgaggttcttaattttgatgaatggatgccccatttttttctgcaccatttgttgaaagactctcttctccattgagttgattggcatatttgtaaaaatcctgattactattaatatatatgtgtgagtttatttctggactgtgttccattgactcttaagtgtctgactttttgccaataccacgctgtcttaaaaattgtaaataggtaaatcatgaaatcaggtagcatcagctcttcaatttggtactttttttccaaaattgttttgacttctaggtgttctctttttccatgtaaattttagagtcagcttgtcagtttctatgaaacttgctggaattttgacagcattgcattgaatgtgtagatcagtactcttcaataggattatctgtaatgatggaaatgttgtgtatttacactgtccagtgtgtggtagtcactagctgtctatggctattgactacataaaatgttgcttgtgtaattggagaaatgaattttaaagtttatttcattttaatttatttaaattcaaatgtagacacatgtcactagtggctattgtattggacaacataacatagattattttgggcacaattatatattattttgacttcttaaagtcagtattgagttttaaagcccacacatgtggtatatct

SEQ ID NO: 111013 - DNA, 288 bp, Homo sapiens
cttggggtactctttcctctcagttttaaactttttagtcaactctaagaatctaggaatctcagtattgaaagcgaccttaggtgccacccatgcccatctcaaaggcgagggggtagactaatcttatctacctttactgtggtattcccagcatgtaactgagtggagtgtggtaggaggtgcaaaaaatacttgcggaatgagtgagtccctgtaaatagcagcagcttcacaagaccactgtcattgcctcatttgttcatttttttgacgaatattagtaag

SEQ ID NO: 111014 - DNA, 732 bp, Homo sapiens
caagcttccagaggcagctaccacaaggcccccttcactgtggcttcacttctagctatagcaaaggtctgcctctgaagcttgaaacacaggctcccaggtgagcacttcctgctggcttccagcatctgcttttcatctgcctataagtaggtttcacgttgctgtttatagttcttgctacaaggacagttcctgggcaaggaagcagaagcctgcggtgcttgggagaaggcagaagtgtgatgatggaagaggaagaacaatagtaacagctcacactagtgcagcccttcctagtctgcatctcaagtctggtgatttgagtaatagcctggccataggatccacattttgttaaggaagtggaagtgaagaatgttcatgcggtttccttaatgttgcacagcagttagcaatagaggaagaattataatacacaaggtgtatgtgtgtgttatgtgtgtgtgtgacacagagagatacttttaagacctcttcaaaaatgttagtccaggccaggtgcaatggctcacgcctgtaatcccagcactctgggagactgatgcgggaggatcacctgaggtcaggagttcgagaccagcctggccaaaatggcgaaacccctgcctctacaaaaaatacaaaagttagttgggcgtgctggtgcatgcctataatcccagctacttgggaggccaaggcaggagaatctcttgaactgaggaggct

SEQ ID NO: 111015 - DNA, 170 bp, Homo sapiens
tccttgggaattcaaatttgaactgtccctggggacagcttatagggctgatgttgagggagcactggatgtccccaaggacatcacacctggggatggccatggcaccctgagtctgtggttagggaggagggctccttagaggcggaccaagatgcctgggggaatac

SEQ ID NO: 111016 - DNA, 353 bp, Homo sapiens
taggggcaggatctcactctgtcacccaggctggagtgcagtaatcgtagctcactgcagccttgacctcctgggctcaagtcatcctcctgcctcagcctcctgagtagctgggactatgggcatgtaccaccatgcctggctaattttctttaatttttttttttttttttttggtagaggtggggtcttgctatgtcacccaggctggtctcaaactcctggcctcaagtgatcctcgtgctttggcctgcctaaatgctgggttaaaggtgtgagtcatcatgcctggccctcaatgactttcctagacctaaagttactttattattaattgtaactttgtaatggat

SEQ ID NO: 111017 - DNA, 488 bp, Homo sapiens
ctgagccctccagagcgagagaggagaatcaaggcccacctgggaaagggagcccccctgtgtgactggaatgtatggacagccctggaaacatatctacaggtactgagcagaaattctgggagaaggggatgaccagacccctcagtcatgtagcgacctggatcccagtagctctccacctccttcgccactccaccagcctggacctccacctcccctggaaatgagagagactgggccgcagggtggtgcttcttgggttacacccctctaaggcagagagaatggcacctgtctcactcaccttctgattttgcaatgtaagaggaaatgaaaaatattatgaaaaaaatagaaatatagcatattattcaagggcagaaactctgttagacattcctgcagctgaatcacagctcttgccctcattggttttgttcttggtctcctaataagtgttccataaatggtcattgctttgttta

SEQ ID NO: 111018 - DNA, 1324 bp, Homo sapiens
  misc_feature (1250)..(1250): n is a, c, g, or t
  misc_feature (1270)..(1270): n is a, c, g, or t
gtccaagatggctattaaaaaataaggattattatgatgtctggaaagtatagtattggaggttcgcagcttttagaatctcaataggccagatatgtaggaagtgagggtttctcatctcagtcaggcccaaacctgtcctgatgctgaggaaaacacttgagatctgggaagacaattgtttaaagatactaatagtggacatttattgagtatttacctctattcagacattaggtttcccctgagcacccccactagattcagggggtgttgttttgtggccaagaggaggaatgagccaacaagattgcattattgtgcaggggcagagtggggagataggggcacatacccaggatgaaggtaacgattgaggggaggtgatcatgtgaatgaaatatatttaagaacgcacatgtcacgtcacttttgcaaacttgacacctcattctgttccttctttcccttttcagctccaagaggccttcgggtgggagccattcacccagctctttgctgagtaccagaccctctctcacctccccaaagacaacactggcaggatgaatctatgggtgaagaagttctctgaaaaagtgaagaagaatctggttcccttctttgaggcctggggctggcctatccagaaggaggtggctgacagcctggcctccctaccagagtggcaggaaaaccccatgcaagtgtacctccgtgccaggaagtaaaggatgccccacaaggcgggagagaaaaggcagggtcacgccatcaactccaccatggggctttggccgtgtgctcagtatctggagcctgaatcccgcttccaagcctgaccactagatggtggccacggtcataagaaaaaatggaacccctttctgtaaaaggtgccttgtgcttctttttattgtttttctgcctacgctattgctttccccaagagactcacttcacctcttagtcttccagagaggatctttcatcctgccatcctgaggcttctatttttgaccaatagctctaaagaccacgggttcccataacaacctgatatccctttctcatccctgccatccctgaataaggcttctaatttattatgctttaacaagttttcaaatagcaagcgagacacgctggaatagtggagagagccccaaaccagctttggttctatggaaaatcactccacctctctgtgtttctgtcttcacatccatgacatgaggatacaaatcttntcctcacaaagctgttgttngatttctcctggtcccatagtggactgttaacggtgtccagtctgcgtgcgatg

SEQ ID NO: 111019 - DNA, 1306 bp, Homo sapiens
gtccaagatggctattaaaaaataaggattattatgatgtctggaaagtatagtattggaggttcgcagcttttagaatctcaataggccagatatgtaggaagtgagggtttctcatctcagtcaggcccaaacctgtcctgatgctgaggaaaacacttgagatctgggaagacaattgtttaaagatactaatagtggacatttattgagtatttacctctattcagacattaggtttcccctgagcacccccactagattcagggggtgttgttttgtggccaagaggaggaatgagccaacaagattgcattattgtgcaggggcagagtggggagataggggcacatacccaggatgaaggtaacgattgaggggaggtgatcatgtgaatgaaatatatttaagaacgcacatgtcacgtcacttttgcaaacttgacacctcattctgttccttctttcccttttcagctccaagaggccttcgggtgggagccattcacccagctctttgctgagtaccagaccctctctcacctccccaaagacaacactggcaggatgaatctatgggtgaagaagttctctgaaaaagtgaagaagaatctggttcccttctttgaggcctggggctggcctatccagaaggaggtggctgacagcctggcctccctaccagagtggcaggaaaaccccatgcaagtgtacctccgtgccaggaagtaaaggatgccccacaaggcgggagagaaaaggcagggtcacgccatcaactccaccatggggctttggccgtgtgctcagtatctggagcctgaatcccgcttccaagcctgaccactagatggtggccacggtcataagaaaaaatggaacccctttctgtaaaaggtgccttgtgcttctttttattgtttttctgcctacgctattgctttccccaagagactcacttcacctcttagtcttccagagaggatctttcatcctgccatcctgaggcttctatttttgaccaatagctctaaagaccacgggttcccataacaacctgatatccctttctcatccctgccatccctgaataaggcttctaatttattatgctttaacaagttttcaaatagcaagcgagacacgctggaatagtggagagagccccaaaccagctttggttctatggaaaatcactccacctctctgtgtttctgtcttcacatccatgacatgaggatacaaatcttaaaatcaaacctcccgtatctgcatttaattgtatgtaaaagcttccctccacctac

SEQ ID NO: 111020 - DNA, 950 bp, Homo sapiens
  misc_feature (876)..(876): n is a, c, g, or t
  misc_feature (896)..(896): n is a, c, g, or t
ctgagccctccagagcgagagaggagaatcaaggcccacctgggaaagggagcccccctgtgtgactggaatgtatggacagccctggaaacatatctacagctccaagaggccttcgggtgggagccattcacccagctctttgctgagtaccagaccctctctcacctccccaaagacaacactggcaggatgaatctatgggtgaagaagttctctgaaaaagtgaagaagaatctggttcccttctttgaggcctggggctggcctatccagaaggaggtggctgacagcctggcctccctaccagagtggcaggaaaaccccatgcaagtgtacctccgtgccaggaagtaaaggatgccccacaaggcgggagagaaaaggcagggtcacgccatcaactccaccatggggctttggccgtgtgctcagtatctggagcctgaatcccgcttccaagcctgaccactagatggtggccacggtcataagaaaaaatggaacccctttctgtaaaaggtgccttgtgcttctttttattgtttttctgcctacgctattgctttccccaagagactcacttcacctcttagtcttccagagaggatctttcatcctgccatcctgaggcttctatttttgaccaatagctctaaagaccacgggttcccataacaacctgatatccctttctcatccctgccatccctgaataaggcttctaatttattatgctttaacaagttttcaaatagcaagcgagacacgctggaatagtggagagagccccaaaccagctttggttctatggaaaatcactccacctctctgtgtttctgtcttcacatccatgacatgaggatacaaatcttntcctcacaaagctgttgttngatttctcctggtcccatagtggactgttaacggtgtccagtctgcgtgcgatg

SEQ ID NO: 111021 - DNA, 455 bp, Homo sapiens
tgctccctaaatttatgacctcacatgcaaaatacatgcttaccatcctaacatcaccaaaagtcttgacttgtttcagcatactctgaagcttaatatcaaagtcgcttccaggtcaccagagataacatggccaaaaccattgcaagatgtgtttgatgattcaaagagaaagaaaaaacagcttttcctatgacaacgtttccaactaaagcatctgcaattatgaagactgaaacttcagcagggtgcggtggctcacgcctataatcccagcactttgggaggccaaggtgggcagatcatcagagatcaggagttcaagaccagcctggccaacatgatgaaaccctgtctctgctacaaatacaaaatttagctggggatggtggtgtgcgcctgtaatcccagctatttgggaggctgaggcaggagaatcgcttgaacctgggagg

SEQ ID NO: 111022 - DNA, 454 bp, Homo sapiens
cccagccatggcctcagggctgagtctgatgggtatcagggaaggctgctgcttgaacaagtgactgtgacctgagtgtgcaggaggcagacaggagcctgggtggggtgggaagccacctgctcttattcgtgcaggctcctctcacatctctctaaggatgcttatgagagcatttgagaaattctctcctgtttcctgcactggctctgtttccctgggtgccatttgtcgtggtgcccctctttcaggctgctgattttctttatccactgtgatcttcactgatctgcttatgagcaaagattcctatcagtggtttccaaacccagccaaatatcagaagcatgtggggagcctgttaaaaatacacagattcctagaatcttcttctggagactctagtttaataggtctggggtggagcctgagaatatgaacacttaagaagcca

SEQ ID NO: 111023 - DNA, 950 bp, Homo sapiens
tatgatgttttgtttttttaaatgttttaaaagcttaataggttggcatcagttgtagcccacaaacatggctagggctttggggatttggcatttttctggtggtttacaagacttactccgaatacaagaggaaaagctttaaaaacaagattgcatcataacccccaggagcaaagcaacctggaggctgcatatccatgggcgggcagcataagagaatgtgaagcccttcagtgagacgagacgagcaatgggaaaccttttctgttcttaagaagtgactttaattttattgacatatgtactgtatgttactgagattgaatgttaggggaagccttaaggtagaggtatttgggaaagtagccagtgggcacttgtgatatctaaaatctgttatcccaggactgtgtacagaggggcaacctacccattcaggaaggtcagggctttggaaccctaaaaagttggcccgatgacttaaagggaaaaataattcattcccagagatgagtcagaacagtctcctcaatcctgaaattcaacaaggcatcagaagggctggctgtggtcaagcccagctgctgtcatgtgaggagatgctcactgtggtcttgttgagctgatggccttggttgagctgatggacaagtgaaggaggccatggggctgtgctgtccttcctgccgtacgtgccattccactctcttcagctctcccctcaacagcatgcgagcccataccttctgcatttttccaggcctgtgagggatataggcctccccttggagcactgagtccggaggtcatccctgagctcatccacggctcatgctgtggctccgagtagtggtttgagtgggcaggaagggccatttgcaaacactgctgtgttctagacaaacaacccaagtcctatggcaggatttcttccttccttccttttt

SEQ ID NO: 111024 - DNA, 334 bp, Homo sapiens
agtgcagtggcgtgatctcagttcactgtaacttccgactccttggttcaagtaattctcctccctcagcctcctgagtagctgggattataggcatgcaccaccatgcgcagctaatttttatatttttggtagagacagggtttcaccatgttggccaggatggtcttgatctcctgacctcatgatccgcccacctcggcctcccaaagtgctgggattacaggcatgagccactatgcctggcctgatggtcatactttttaaaggcttcatgaggaatttccctaatttcttagaatactgctttggtcatctccacaattatggtagg

SEQ ID NO: 111025 - DNA, 207 bp, Homo sapiens
gggattacaggcttgagccaccatgcctggccatcataatgctttatttattctgtcctgtgcatcatggcatggttccctcagattccactcaaaaatcagggtaattcagcaaactcgtattagcatcttctttggcagtggttctcacacttgagtgtgtatcaaaagcatctggagagcgtgttaaaacacagattgctgccg

SEQ ID NO: 111026 - DNA, 410 bp, Homo sapiens
atcatgagtttcttaataacaaacattgagaagaaagttagaaaaataccatcgaaatgtttgatgggattctaaatatttgcaggccctgtttttatcaaagttcacatttttcaataaatcttttttttaattcagttttttttttctttcaactattgcttttgggacttaatagatttacctaattcttgcaaagcttgatcatgatatttcacttctttctatttaagacttcataaaaaattgagatgttgtagtggacaataattatcgtagataataaaacagagaccgtgttggctgttcaccaaactgggttcctcttcttcctggacacctacatggtttccaaggaacggttccaattagaagtggccatgagactgagtcctggtgcatggaatgtg

SEQ ID NO: 111027 - DNA, 502 bp, Homo sapiens
taacagagtgagactcatctcaaaaaaaaagattaatatatgaaagtagtacttgagataagaaaaaattttttaaataaaaaagacaaatatgattgctatatttcaaacagttcttagtatatagttcttgatatataattcttagtatatactaagtatagctcttagcagaatgcctggcacatggcaggtgtgcaagaaatgtcagatattgcaacaagtattatcagttgtagcaataaatatgactaacttcaatgtattttagaattttgagttatatatatattttttaatatgggttcttactctgttgtccaggccgtagtacagtggtgtgatcatggctcactacagcctcaacctccctgggctcaggtgatcttttcacctcagcttctccagaggctgaggcaagaggatgacttgagcccaacaaggttgaggctgcagtgagctctgatcacaccactgcactccagcctaggtgacagagtga

SEQ ID NO: 111028 - DNA, 759 bp, Homo sapiens
caacgagagacacctccacgggcctaggagcccagcccatgtgctcagtcaccccctttagctggcctttcgcccagcagagccttctcttcctgctactgaccaaccttggggattgggccatttgcttcgcagacagttcgcgccttcctattttgtctagttgctttcctattgtgtcgtgtagcttgttctctattttataggtcatttaaaataaaactcacctttgactttgtttagtctctgttacatgtttgctttttgtttcgtttatgtttgtacatttctcatgtttttcttctattcttttggttgtattctaacttttagagtctctttattgggatgtcttctagcgataaatataaatacatttccctctaacaaccactttacctggatctcccaccttgctgtatagcatctctgtcatttccaattttgaatattcgaaattcctactctggtttccctcctccctcatccttagaaatgcatttcttaattcccagattgaaggctgtgttttctggtcaccatcctcccatctgaactgcactgtcacttcagaaggtgactctcacagtttttaggcgtgtggtgtagttgtctgtgtgatcaagtttggatgactgttgttccctgggagcttgaaaaatggattgcgtgattattgtgttattttctatgtgattattggatgattttatatgtttagctccagcttggtcttgctttcagatcttctgtcttgta

SEQ ID NO: 111029 - DNA, 388 bp, Homo sapiens
acggactcaactttgccgttgtggagtgggagtagccatagacaaaacataagtgcatgggcctggctgtgttccagtaaaaattttatttacaaaaacaggacatttatgaaaacaggacatgggcttggatttgttttatcaggccatagtgtaccgacccctggtctgcacagaaggactctaatgtcagcaaccatagggacttgtacttcgtactgctgtgacacccatagggatacctcttgccttgtttctgaggaagttaataaaaaggtcaggctcgttcaccttaatttcagtctacccccacagttctaataaaaaatgttctgatcaaaatggctctttggacaacaaaacagcaaaacagtctccagcctctcct

SEQ ID NO: 111030 - DNA, 210 bp, Homo sapiens
atccagccacctcggcctcccaaagtgctgggattacaggtgtgagccaccgtgcccggccttccaagttctttatcaggtatatgatagcacatgtagctttttatcttccttacaccagtgcaagtttatagaaaggaaaagggatagttaatagtaatcataataatgtttaatatttgaatgttttttaggagctggtatactgct

SEQ ID NO: 111031 - DNA, 784 bp, Homo sapiens
atcccaaagcttccaaaaatagtgttagaactaataaattaattcagtaaagttgcaggatataaaaccaacatacaaaaatcagtagcatttttatacacaaataataacctagctgaaaaagaaatcaagaaaacaatatcatttatgatagcatcaaaaaatactctggaataaatttaaccaaagaggtgaaaaatttgtatactgaaaactataaaatcttgctgaaggaaattgaaaaagacacaaataaatggaacatataaataaatggaaagatatcctgtggatggaattaatattgttaaaatggccatactacccaaagcaatatacaaattcaacataattcctatcaaaattctaacggcattcttcacagaaatagaaaaaacaatcagtattgaaaagaaaaataaagttgaaggcatcacactttctgatttcaaatgatattacaaagctgcagtaatcaaaacggtatgatactggcataaaaacacaaatatagaccgatggaacataaaagagagccaagaaataaatccaaacatatagggtcaactaattttctacaagatcaccaagaggacacaatggggaaaggatagtcttcaataatgatgctgggaaaaatggattctcaaatgcaaaagagtgaaattggaccctgatcttacaccatacacaaaaatcaattccaaatggataagatacctaaatgtaaggcccaaaactgtaaaattcctagaagagaacatagaataaaagctccttgaca

SEQ ID NO: 111032 - DNA, 203 bp, Homo sapiens
gtaactgttcactaatggtcagggattgaaaagcatctttcatattttactgacaggtcaaaaaagagaaaattagctctgacttaatgcagaccaggtcaatttggtcaaagagaattttatagacgagctttggttccaccattgcaaaacaatattccgttaccagcagtattagtaggattcaggattacactgaaagc

SEQ ID NO: 111033 - DNA, 266 bp, Homo sapiens
agccagtaattaaatataaaagtggtacaagagtgacgatgccttaaaatgcctaagaatgcctaaaaagcagcaaatacaaagcttcttgggagaacccatcttgatcttaggatttagaaaattcctaaacataaagctgtaagaaatatgaactcacattcacaaaatgcagaaagaaataagatgcaatgaatgagaggaagcagaaacaataaagagcagaatcagaacctgcaaagagttcacatattggagttagcaga

SEQ ID NO: 111034 - DNA, 487 bp, Homo sapiens
aagagtgtacaataaaagtgtccctccttccccagaagcaaacacagttgccagttttttcgatccttcaagaaaatattctagacatatacagacaatcttcacctctcccctcactttacaccttgcttttccactttgtgatagaccttagagattaagaaaacatgcctgttgcatggcaagagtgatgccatcttgatgcaaaaccactatgaccaccaatatctgactcccgcatcccaaagtgttgggtagcataaataattccacacaaagatgtctaccaagcctccccaccagctagtgctcataagtttcacaagaaagtataatgtgtgaccagctgcatgtttaaccaaaaaagcctctatagaaagcatactttctggagggtaagtgcagggatccaccatcttgcagccacccaagacatcatttctgttcctaagtccctattaaatgtttacttctgagaaactgaatt

SEQ ID NO: 111035 - DNA, 748 bp, Homo sapiens
atttgggggccacagctaaggctgggtttactgtgagccgaggaaaagaagtgaatggcctgagatgtgtaaagggcttgaataggcaccgctgatccattcccaccttcagggacaaagaggctctggagggtttgtgagtcccataggttttggacatttgtagttcctcttccccttttgtgaaatgtagaatagtgctgtccttttgccccttctgctcatctgctcctagctgtactgtcaccctgtctttaggggagaagtctcatgtttatagtgcctgtgaggtcagggaaggcactgtcaatgctgttttgaaactttgtttccccactgttcagctcacaaaagtattttatcaccctcacgcccctgccctcacccagaagcacaaagtgaaatctgcccccggcagcttcccaagctgtgacccacagcaggttcctagttgttgttttggaccaggctgctggtcatggcccttgtccaactttctgagatctcaaaaagcagcagcccaagccagggcgagtggccgtgggagggttttttggtgtttccccttccctcaacttttagttttgaaaaagtgaaatctgcagtaaagttgctagaataatgcaacaaatacctgtacacctcacctggatcccacagttgttagttcttcagcacatttgcattctccctttctgtgtgggcatcacagatacaacaaagttagtatagcgggtgagtaggaaaa

SEQ ID NO: 111036 - DNA, 340 bp, Homo sapiens
acccagacaaaaatataatactaaagtccctttcaggctctgatattctgattctattaagcatagtagtaactggacactgagaattacaaaaacattagaaatgtagaacataaataggcactctgacttatgaatttctagctaaagtacaccaaacagggaaacaaaataccaaaaacacaatcaagaaagagtggacattcacctaagctacctgcattaatagcatggaccaggaaccaagagcttgcaacagaagatggatacctcaaaggaatactggtttctctcctgggttcctcagcggccaaacttactctgtgaccttggctggcaa

SEQ ID NO: 111037 - DNA, 306 bp, Homo sapiens
gtctcaacaggatcccgtgcaggctgggaacgcagtgtagagcaggtctcctgtttcttagtaccttgtgtacctctctgttagaccatcctgcctcttccccacctttcactttattctaacagttctgcttattctgttctcacccaagacatttgagtaaaatatggaacttgacccatattcactactgtaatcacagcactttagaaggccaaggagggtggatcacttgacatcgggagttcgagaccagcctggcgaatgtggtgaaaccccatctctactaaaaatacaagattagcc

SEQ ID NO: 111038 - DNA, 506 bp, Homo sapiens
gaatgaggaagttgaacactctgagtgatacaaaaaatagtaacatgtggtccctgccctttactaaacatagaaagttagaagtgcctatctttggaaatacccggttattataatatcagatctagagaaccatgaaaaagcttcctccagagaaagtctcttaaaattgaacaaaatctaaaaggtgaaatagcagttaattattcccaacattataccaaagcagagagtgattactgagtctgttccagaaatccccaggatgacttgagtttgggtaagctgggcctagcctaaggctagagagaaataacagaaagatggtaaattcattcttccagcacaatacagttgctcagtaagtaagtgatactgttgtttgatgaatggtagagttttctttttcctgtttctggaatgttttatagaatacatttcaaaacatagatgattccaattgctagctggataaagatagtaaatattgacccttgcaatcaagt

SEQ ID NO: 111039 - DNA, 386 bp, Homo sapiens
ttaagaattccaaaggatgggcaattacatgaggcctatagttatgaaatgattgactagaaaactaaatacagcctgccaaatgccgcttgtttaagaaatcattttccgtatgctgacatttcacaagcatcacatgaaaatgattttactaggcaaatatatacacacgtatgtatctgactccagagtagaaaaagaaaatctaaaccaccaaactctttttaaaagtctatttcattttgacatcactttccattttgagcagaaaaacaggacatgttgtcccttgataaatcaaaacctcaataggcaaagtcaggaagagagacttaaaaagcagctttagaaaaaatgtcactgtttatatttctatcaaaacaaca

SEQ ID NO: 111040 - DNA, 462 bp, Homo sapiens
gtattctttcctctgtcttcaatttttctgtttatacttctgtggaaatcctatccatccttaaaccttaaaatgtggagagtgtgtccttaagactgcatataatgactatagcagttcaagtctctttgatgttgactaactgatattgaggaaatatgtcaattctgtgggattcaggtactcctctgtaattgggagtaaagggagaagaggataatactttccctgcctctgtcatatctatcatagaataattaaaatgagcaaaaactttaaatgagatgaatatgtaaaagcaagagtaaaagctaacatgctatgcacagtagaaagccttactatgatcatcctctttactgttacatattcaccacatgcagatgaggcttcctcctgggattccacttattttcatcactattatggtcaatactatgacttatctttcagaattagtta

SEQ ID NO: 111041 - DNA, 365 bp, Homo sapiens
ccagtcctcaattctagaagtaactagtgcttttattgagtattctttgtaatttattaaatattgacttctattctctttttaatctaaattttattatctagacatataaagagtcaattcagtttcacaaagcttgttttgaaaaaacagtcgtcccctggtgctgtccctgtgccctgctgccaacaccatttgctgctcctcagaggagcggatttcaactcttaggtgttttggtttttatttccatgttgataacagttttatatttctacttcctgttttccattttaaacattatcttctgattttctacttcagagaacaaagaattagttttttaaaatccccttccctgcccc

SEQ ID NO: 111042 - DNA, 112 bp, Homo sapiens
catggaagtttctgcttgaaaatttttatttcctgggttgtatggtgagtccgttttcagtttcagaaggaactacaaaatgatcttccccattttatattcctactaacaa

SEQ ID NO: 111043 - DNA, 464 bp, Homo sapiens
gtatgtgatttctggctagtaagctacaccgaatcttggctagcacagttgaattccatgtcagatttgtaaacgcaaatttgctctctgcatttaaatatattagatatatttaggtaactacatttaaatgtattgagacatttaaataaatttgccgtctgtatctaaatatctgaagtggaccaggtgcggtggctcacacctataatcccatcactttgggaggccaaggcaagtggatcatgaggtcaggagttcacgaccagcctggccaacatggtgaaatcccatttctactaaaaatacaaaaattagctgggcgtggtggcaggcgcctgtaatcctagctacttgggaggctgaggcaggagaatcgctggaacccaggagacagaggttgcagtgagctgagattgcaccactgcagtctagcctgggtgacacagcaagactccatctca

SEQ ID NO: 111044 - DNA, 151 bp, Homo sapiens
ggtgtgggcttctaccaggggaagtgttttacagatcagagcatgctgttacacagaattagagcacttcttcacactgatgagatgggcatgacacaatggccatgattaactcaacttcatttacttttcatgatgttaattttcaata

SEQ ID NO: 111045 - DNA, 671 bp, Homo sapiens
gaaaaaaacaaacaaccccatcaaaaagtgggcgaaggacatgaacagacacttctcaaaagaagacatttatgcagccaaaagacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactggaaataccatttgacccagccatcccattactgggtatatacccaaaggactataaatcatgctgctataaaggaatttagtatcttctaatcccttctctgattacctaatttaaattttcaatatccctgaaactctccttcttctcattcttctttttctccgcaactctgatcatcatccaaaacactacagttggccctccaaatccatgtgttctgcatccgtggattcaatcaactacagctggaaaatatacaaaaccaaaatgtgtctgtaccccacatgcccagacttttatttcttggcattaatctctaaacagtacaacagctatttatagagcatttacattgt

SEQ ID NO: 111046 - DNA, 552 bp, Homo sapiens
ttctctgttgcttgaactagggtacatgaatctcaatgtaatatagggatgtagaaaagtataagagaagccccagaataatcaatagacctctagtaagatagtcacattgctcaatatgcaaaggtgacaaatactctaagatactcactacatgttaaaaataaatacagatatattgttcagagatgtattcatcaactacttaactatgtatctacccatgcatttaataactgtgagcatcataccaggcctccattctcatggagtttgtattctactggtagaggcagataataaagagatgagaaattcaaagtaatttaaaaaataacacaggaaaggtcatagacattttggtctggggaggagatggcactatgtaggctgattacctgtgagggtgcactcactcacctcttgtacttgtgaagaacatactgaaatgtacagggtgtttgggaggaaaataatgagatgcacagggcagtacttaatgtgaagacctcaccatagagacaggaattaagtcacctggagccaagagaa

SEQ ID NO: 111047 - DNA, 251 bp, Homo sapiens
attgcactccagcctgggcaacaagagcaaaaccccgtctcaggaaaaaaaaaaaaaaaaaaaaaaaaaaaagctggcacagtggcacacgcctgtattcccagctgctagggaggctgaggcaggaggatcacttcagcataggtgttccaggacacagtgcactacgatagtgtctgtgaacagccattgctctccagactgggaaacatagcaagatccccatctcaaaaaacaaacaaatatattgt

SEQ ID NO: 111048 - DNA, 321 bp, Homo sapiens
aaagctcggtaccctgtgctctgaacttagccctggctgaacttaggcctggctctaaagatgtttgctgttatttctacaactcgaatgccgtggtttgcaacaaggggcagatgttttattttgcaatgtctggaaactttatttttttgatggagtttcactctcgttccccaggctggagtgcaatggagcgatcttggctcactgcaacctctgcctcctgggttcaagcgattctcccgcctcagcctcccaaatagctgggattacaggcgtgcaccaccacgcccggctaatgttgtacttttagtagagaca

SEQ ID NO: 111049 - DNA, 641 bp, Homo sapiens
gtttgctatttctgtttccttcaaagatttatgtaaatatgttaagaaacaaagtagacagaggagcttataaatgaaaagcaggagtctcccatgcaatttttcacccttcattgaactgtttctgttttctgttctttaggtggttgctgaacatttgacttaaagaaattgctctttattttattatctcgttcctagcagttataagtggaacttcttatcctatagttgccatgagttttcgtttctacacatgattcatgtttgttgggcagtttttttggtgtgtgtttgataatgtttaagccttaaatgatttatatgtattagaagattagtacttttaaaagcaaaccttgaatgacttgaaaggccaccattgcattagttatttattgctgtgtaacaaattatcccaaattggccaggcatggtggctcatgcctgtaatcccagtactttgggaggccaacgtgggcggatcacctgaggtcgggagttcaagaccagtctgatcaacatggagaaaccttgtctccactaaaactacaaaattaaccatgcgtggtggcacgtgcctgtaatcccagctactcaggaggctgaggcaggagaattgcttgaacctgggagacaga

SEQ ID NO: 111050 - DNA, 300 bp, Homo sapiens
tccacattcaaagcaatgtgggtctgataatcagtgtatttaaacatttcaatagttttctttcacctgaaatttaatattgtagcaattactgaatttaggaaaattggtaggtagttgctatcagcaccgttactacgggaatacattagaatgattagcttttaggtgaaattgaattttttctttagtttccatagtgactgaaaacgatttaggtcagcttcacctgttgtgcccctcccccttttcaaaataagaggaacatttaatttagcacaatgatgttaattttttcct

SEQ ID NO: 111051 - DNA, 378 bp, Homo sapiens
tcttaaagttatatatgaaaactctttgaatttttctctgggacgcttattaaagaaactgcatcatattgctgttgtgtattgcggtgaagataggaaaatgcgggggataaacaggaagcatctttcaagatcatcaattactagaactttttgtggaaggaaggaccattattgatatatgaaaataaataaattatagaacatgagtaaaaatttgcattaaggtgaggtaataaatatgtgattgtgttcatttttgaatcttttgctcttgacttatacgtgtcttgaatactatgcagttctttttttttatactttaagttctagggtacatgtgcacagcatgcaggtttgttgcataggtatatatgt

SEQ ID NO: 111052 - DNA, 601 bp, Homo sapiens
ttttgccacatttaaagacaaatccagacaatttgtgtttcaggttatcaacagtaaaaaatccaagaggcctagcaaaaatcaagattcacttcacaaatagggcattcaacagatgaggtgccaggcacagtggctcatgcctgtaatcccagcactttgggaggctgaggcaggtggactgtttgagcccaagagtttgagaccagcctgggcaacatggcgaaactctgtgtctacaaaaaatacaaaaattagccaggtgtggtggcgggcatctgtagtcccaattactcgggaggctgcagcaggagaatggcatgaacccgggaggcggatcttgcattgagccaagatcacgccactgcactccagcctgggcgacagaatgagactccatctcaaaaaaaaagaagaaaccaaggatatagaataaaacaagagtgtagatttgggcattgaggccttcaaattggattgttctcaatgtccagaagaaaaaaaaaaatttagaagagacccaaatcagaaaacaaaagttgggctgaattcaatgcgaattaatttctagctcaatattaatactgcttatgtcagctga

SEQ ID NO: 111053 - DNA, 482 bp, Homo sapiens
gctatccctgctttgaatgttgatttattttataccacttaaaattattatataagcttcaagattgcaaagggcagtcttagttatttcagtaggagtttgaaacctgattgcagctgcaggtcccacacaactgaattcggtttcttgtgcacagcagtgttctctggaggtgcctggaggtctgaaggtgtgcccttttatagacaggaattccaccatgatgggtagagcttgttttttaaaaaggcttgggactagatacgattgcccaagaagacagtgtagacagcgaggagggctgagcatgaatgggatgagcctccagcacagaaagggcaggcaggaaggcagtaaagaaacaagcagggcacaaaccaggagagtatggcatgccatgatggagactgaacagaagcaaaaactacaggcaactgtagttttgttccctgttgaaggagagacactctattagagaagac

SEQ ID NO: 111054 - DNA, 299 bp, Homo sapiens
attcatccttccctgggaacctctttcctttcagaggttcagctatcgctctccccgtgacatctgtgatgacgtcttctgcccattccatcttctttaccaccaggaatcctaaggtaaacctcttgctttttttctcaccccagtaaaattcctttgcaaataaccttcatacctttctcgcttataaaaataattttcttagcaaaacttgccttcgtcaagaacacaaagttttgttatgaagttcggtctgtgccctgtttgtcagacactaaaaaaagggaggcccgtcggca

SEQ ID NO: 111055 - DNA, 287 bp, Homo sapiens
ttacaggtatgagccaccacgcccagccttctctctccatttttggcaaatcaaattcatctgtctcagactcctcatatacacccagattagagggaaatttaatctccctcctgtcttggtgggggctcaccccagctctcggtttgttgaagagtcttcagggggttcctgcaatccaatagaggaagagcctctggtctctagcctgacacacctccttggcactctttgtcatccaggtttacacagtgaatttgaagacaggcagccctactgctcacagg

SEQ ID NO: 111056 - DNA, 131 bp, Homo sapiens
gtctgctccctgggattacacatgagagacatcttggtgcctgcccaatttctgtgtctgtaaaatgagtttcctctcagaggccgactacaaacataagttttaaagaggaaccacagtgcactttgaag

SEQ ID NO: 111057 - DNA, 337 bp, Homo sapiens
gactgtaacttaaatagtgcatggtaatgtgcagcattgaatttgaaagaaacaaggggaataaaacttaatgactatgagataaatggaatgcaggagttttaaaaaattcttgttaaaaaatttgacgagaggattttctcttgtgaaacgtttagataaccctctagaaaaaaaccaggagaaaatctttgtgaccttgagctaggcagagttttaaaaaatagaacacaaaaaccacaaactatgaagaaaaaatttatgttggctttcatcaaagttagaaacttgtactctttaaaaagtgtattttctgttaagaaaatgaagaggcaag

SEQ ID NO: 111058 - DNA, 349 bp, Homo sapiens
taaaatgggaatttaaaaggggactacatcacaggattgttttgaggattaaataacagaataaacataaggagcttaaaacaatgcttaatgcatagaagccactcaaacaagtttgttctgattttttttcccctaagaaaatagtaactccaattcccacagaaagattccaaaacaaaagtaccaataagtctgaaaataaatgcaagacctgaggaggaatcattgctgttttctaaaaccagtgatagacaggctatcttagagaccggagttcttgctttacattcattttctgaggtcaggaagtaaaaaggacacatgggtgaacaggcactggtgagat

SEQ ID NO: 111059 - DNA, 340 bp, Homo sapiens
attcaaagaaaatagttagtcctttcctatattgaaatgaaatttttcttagaacaagaaaggcccatattaaggattaaaaaccatttgtattaacttccgaatataggaagtgtggcttaggagtatcacatgtgaacacttcagaaagctgacacagcattacaaaggaatatcattcctattaacaggatggcaagatttctgtcataatcaccaaggtagacaatatatgaaaaagtgtttatcttggaagtcacacttaaaagaaggcctctggccgagcacggtggctcatgcctataatcccagcactttcggaggtggaggagggtggatc

SEQ ID NO: 111060 - DNA, 414 bp, Homo sapiens
gcttcatgcacataatcacaaacactaaacttcttacaagatattagtaaattgaatccaacaaaatgtaaaatggataatgcatcatccccacaatactagtgtaggctaacattttaaaaattgatccatgttggccaggcgtggtggttcacgcctgtaatcccaaaactttgggaggtcaaggcaggcagatcacgaggtcaggatttcgagaccagtctgaccaacatggtgaaaccgtgtgtctactaaaaatacaaaaattagctgggcatgatggcacgtgcctgtaattccagctacacaagaggcggaggcaggagaattgcttgaacccgggaggcaaaggttgcagtgagccaagattgcaccactgcagtccagcctggacaacagagcgagactccatct

SEQ ID NO: 111061 - DNA, 571 bp, Homo sapiens
tgcgccgttatagaggatccctgttgctacgctggagtataatgtacaatcagctcactgcaactccacctcccgggtcaagcaattctcctgcctcagcctgccgagtagctgggattacaggcacctaccaccatgcctggctaatttttgtatttttagtagcagatggggtttcaccacgttggccaggctggtcttgaactcctgacctcaggtgatccacccacctcggcctcccagtgcttggattacaagcgtgagccactgtgcccagcctgtactgtatttttcttttgcctctaggactcttcaagattatctcctgtcagcagatttaataagctctatcttcttagcggtaatcaaaatatatttcaagtgtcctagtctctgatcaataaaatgctataattttatcaggttcaacatcacatacattcagatgaattagtcactttggccacacacaaccatcagcaaaacataaaacaaagatacaaaaaaaactctgaggatgacacatcccctcaaatggctcctaggggtctcctttgcctatattgcaaca

SEQ ID NO: 111062 - DNA, 273 bp, Homo sapiens
ccattcggaggagctgcatcagccagccattgccacaaacgtgctgcttaacaaaccacccgaaaacctaggggctgaaaaccatgctcatttcttcccacagaccggcaggtcggctgagtttagctgctagaggctcagctaggctttgtcactcctccgaggactggatagggatcaggctgtcgtggctgggtggctcggctctgtgccacagcctgccatgttccttctgggaccagcagctggcccgggcacgctttcctcctggca

SEQ ID NO: 111063 - DNA, 306 bp, Homo sapiens
ttactataatgttgctcaagctggtcttgaactcctggactcaaggtgatcctctcacctccgcctcccaaagtgctgggattacaggtgtgagccaccgtgcccagccttaaatcagcttatgactcgggcattctccttcaccctttgtgggtgaattcagcttgagacgctttaccatcccatcatcattaccatatttctgattcatcaggtcccctaacttcccaattcctcgttcttgactcataagctccttgtcctttgttaactcgtaaattaaggggttagaccggatgacctcaa

SEQ ID NO: 111064 - DNA, 706 bp, Homo sapiens
tatctatatctacatttatatatctatatctatatctacatatctatatctatatctacatatatatatataaatatgtataccatctgtgcttttttatttaattttttggctctttctagtttgactttgttgagctgtaatccagtattctcgtcatcagtttacaacttttaagtctatttagcaaagtcattctacctgtagcatggcagtgttatagagactaggaggcaaactggagacaatgtgtatgtttttcccattctcacagaatcaaagcactatttaattttggccagttggtgaaatgtctggcctaggctgtcttctcctttgccattagagctctcagaatctttccctagtttctcagtgtgagtcatctgctactgctttcttattagtgtttttggcttaaattttgtcttttgaatttgaatgcttgaccttaggaaagagagcagtagtgccagactcctagtctttacagtttacgaaaggctctgggccagtttgggaccataatagccaaattcttcctctctctgtcttttttcccaaagttttgtgttattcaggtttctggagacagtttcagataataatttaatttgtaaacattgtgcaaattttaatagcttaaattatatatatggcctgaaaaaaatttgcatgatcaattgatgaggctggtgtgatagga

SEQ ID NO: 111065 - DNA, 310 bp, Homo sapiens
  misc_feature (224)..(224): n is a, c, g, or t
cgagtttgggagtccccgtgaccacctttagggtaagagttctctagaagtactacaggactcagaaaaggctttctacagcagtacccccgagccaaaggccatgtgttccaaaacccccgggaggtgcctgaaaccggggacagtaccaaacccttcacttgctgtgttttttcctgtacatacatgcctgtgataatgtttataaatccagttgttagatntcttattgttgaatttcaaaagctctttgtgtattttggataacagtcctttatcagatgtgtcttttgcaaatattctcccgcag

SEQ ID NO: 111066 - DNA, 443 bp, Homo sapiens
tgagatggagtctcgatctgtcacccaggctggagtgcagtggcgtggtctcagctcactgcaacctccgcctcctgggttcaagcaattcccctgcctcagcctcccgagtagctgggattacaggtgcctgccaccacgccaggctaattttttgtgtttttagtagagatgggtttcaccatgttggctaggctggtcttgaacttctgaccttgtgatctgcccgcctcggcctcccaaagtgttgggattgcaggcgtgagccaccgcgctggcaaatacgtactacattttaacaccagttttattattacacacaccgataaaaaggcctgggtatacaatcacataatcatgggtgtggaacatattttcttgcttctaagaaaaagaatagaaaaggttaaaacctggggggaaaaaaatccaggtcacttatt

SEQ ID NO: 111067 - DNA, 441 bp, Homo sapiens
tcacaccgctggataaaaggagagcgggggctggagtctgaggttgctgtgttctgttaacacactcactgcctctctattcctcccagctaaaaaagtgtctacctcatcaaacttaagaacaacataaaatccaactaatttaaagggttttgaaaaaacgcatcaaaaacataaaagcaatatacatgcaaaagccaactgaacaatataatgaaagtctcaaattctagtcaataggccacttttcttaaaaatcaagagacatgataaagttccagtaccaccaaaaagtgcttaacacttatctttatccatctcttcattctcttcacctgttgtgaagtgcccacttggtacttctctccaaattttgctcacgcacctccagatgcaacctcttggggcctctgtttacacctcagtgggatagaaaaaaca

SEQ ID NO: 111068 - DNA, 257 bp, Homo sapiens
aacctcatgtcctggccctgaaagaaccatctggcaccaccccatctacagggcaaatacagcttccagcaaaccctctagagtccacctggcctttctggggggtccttcctgggttttcagcctcccctccttcagatgtcagaccctggggccgagaatagcgaggtgccgatgaatagcgaggtgccgatgaatagcgaggtgccgatgaatagcgaagtgccgatgaatagcgaggtgccgatgaatagcga

SEQ ID NO: 111069 - DNA, 1002 bp, Homo sapiens
tctgcctccgcatcctcgtgggccctgaccttctctctgagagccgggcagaggctccggagccatgcaggccgaaggccggggcacagggggttcgacgggcgatgctgatggcccaggaggccctggcattcctgatggcccagggggcaatgctggcggcccaggagaggcgggtgccacgggcggcagaggtccccggggcgcaggggcagcaagggcctcggggccgagaggaggcgccccgcggggtccgcatggcggtgccgcttctgcgcaggatggaaggtgcccctgcggggccaggaggccggacagccgcctgcttgagttgcacatcacgatgcctttctcgtcgcccatggaagcggagctggtccgcaggatcctgtcccgggatgccgcacctctcccccgaccaggggcggttctgaaggacttcaccgtgtccggcaacctactgtttatgtcagttcgggaccaggacagggaaggcgctgggcggatgagggtggtgggttgggggctgggatccgcctccccggaggggcagaaagctagagatctcagaacacccaaacacaaggtctcagaacagagacctggtacaccaggcccgccgccacccgagggagcccagggagatgggtgcagaggtgtcgcctttaatgtgatgttctctgcccctcacatttagccgactgactgctgcagaccaccgccaactgcagctctccatcagctcctgtctccagcagctttccctgttgatgtggatcacgcagtgctttctgcccgtgtttttggctcaggctccctcagggcagaggcgctaagcccagcctggcgccccttcctaggtcatgcctcctcccctagggaatggtcccagcacgagtggccagttcattgtgggggcctgattgtttgtcgctggaggaggacggcttacatgtttgtttctgtagaaaataaagctgagctacgattccgaaaaaaaaa

SEQ ID NO: 111070 - DNA, 773 bp, Homo sapiens
tctgcctccgcatcctcgtgggccctgaccttctctctgagagccgggcagaggctccggagccatgcaggccgaaggccggggcacagggggttcgacgggcgatgctgatggcccaggaggccctggcattcctgatggcccagggggcaatgctggcggcccaggagaggcgggtgccacgggcggcagaggtccccggggcgcaggggcagcaagggcctcggggccgagaggaggcgccccgcggggtccgcatggcggtgccgcttctgcgcaggatggaaggtgcccctgcggggccaggaggccggacagccgcctgcttgagttgcacatcacgatgcctttctcgtcgcccatggaagcggagctggtccgcaggatcctgtcccgggatgccgcacctctcccccgaccaggggcggttctgaaggacttcaccgtgtccggcaacctactgtttatccgactgactgctgcagaccaccgccaactgcagctctccatcagctcctgtctccagcagctttccctgttgatgtggatcacgcagtgctttctgcccgtgtttttggctcaggctccctcagggcagaggcgctaagcccagcctggcgccccttcctaggtcatgcctcctcccctagggaatggtcccagcacgagtggccagttcattgtgggggcctgattgtttgtcgctggaggaggacggcttacatgtttgtttctgtagaaaataaagctgagctacgattccgaaaaaaaaa

SEQ ID NO: 111071 - DNA, 112 bp, Homo sapiens
ggccattttgtgcttggtctcatatatgggaaacactgccctttaggatttatttaaaacagggtgcaactttcttctctgtgaggactcaagcagtttgagagtttagatg

SEQ ID NO: 111072 - DNA, 363 bp, Homo sapiens
ggtcgacatgacactgatgacacctaatgtgtcatgtgtaacaacagctcagagtatcacacacaggtcaatttttgtgtatgatgtgaggtaagggttgagacttattattattcttttttcataaggatatcccattcattctggctggatttcctattttccagtctagacaaggctatctttttttccccatcatcgaattgtcttggcacctttgaagaacatcagttgacatgggtctatatttggactttctattctgtctattgatgtttatgattgatttataaatatctgagtgtacagctcactgaattctcacaaactgaacacacgtatataattagcacccaggtcagg

SEQ ID NO: 111073 - DNA, 103 bp, Homo sapiens
cctttggaggcccatctgctggtcgcaagtctccatccagccttcagcactctaaattgaggcaggagggggctgatttgagggtgtcacgccttcatgggag

SEQ ID NO: 111074 - DNA, 235 bp, Homo sapiens
cccatgaacagacctatagccttgatctatttattactattgtgaaaaaaggaacaaaagaaagggaaataaattcataacaatccctgcacaccaaacttatgtatcatctacccatctacctctttctctcccacctgtctttatcttttccccctcccctctgcaattcacttccctctccccacgttgcactttcttctctcctccgaaattggaccaaagtcctccttct

SEQ ID NO: 111075 - DNA, 537 bp, Homo sapiens
tctcttgcttttctgtgtctgtgttagtagcactggtttgcatatagaagggaatttaattttatcagatgcatttacattcattttctctctgtattggtaccactgatagcagaaattggatttctttagagcgagcatatgttttcttttaaaaacaagcattaaaaatcttgaaatagtaagataaaaagaaaactggccattttcctactattctactatttatatataaccctgttaacattatggtgtatgtttttttaaatatttaatatattgatatgagaggccgaggttggtggatcacctgaggtcagtagttcaagaccagtctggccaatgtggtaaaaccctgtctttactaaaaatagaaaaattagccaggtgtaatggcatgcacctgtaatcccagctacttgggaggctgaggcacaagaattgcttgaacctgggaggcagaggttgcagtgagcttcgatcgcgccactgcactccagcctgggtgacagagcgagactccgtctttaataataa

SEQ ID NO: 111076 - DNA, 303 bp, Homo sapiens
gtattaattagaataggccaaactctgatataacagacccccaaaatatggtagcttaaagagtaccaagtttccttcatttttgtgcaacagtccagaataggtgttcaggttagtggctaggccgtcttccaggtcctgatctcctaccatcttgtggttccaccttgccctagggcctacttgtctactgtgtccagcaggcagaaggacttgggaggtattatcttgtgtgccaggctagcagtgacacaagctttcattcacattccattgacagcttagacatatggccatcagtaa

SEQ ID NO: 111077 - DNA, 436 bp, Homo sapiens
ccttccagtcctggtcttgcttttctccccgacctggtgtttcctccaccctgggaaagtgataaggcctagggtcctgtgtagtgcttctgtgaccgaattaaatttttctcctgccgagtcgcgggttagagattacaaagcacagcgtaagggcagaattaggagcagccgacatgatgcagcagtgatattcgcctttgtcttaaattcccggagtgggaagcagctatttccctcttcggagtaatccccacgacagggatccctgcttccggaagtacaaaggcactttggagtaagacaggtttggatggaaagttctaacaggttgaagcggtgacaacctggtcatgaagctccagcatgacacacatatttggaagtcctgtatactaggagttctctttgtgcaccagagtcacttgaaggggct

SEQ ID NO: 111078 - DNA, 798 bp, Homo sapiens
cattgtgaaccctgtctctactaaaaatacaaaacaattagctgggcatggtggtgcacacctgtaactccacctactcggtaggctgaggtaggagaatcacttgaacccagaaggcggaggaggtgatatcatgccactgcactccagcctgggtgacagagcaagattctgtcaaacaaacaagcaccatcaagtaaccaaccaggttgctggtggtttagtaggctttatgcctgatagccttcatctccagggctcaagatggttgcataagcctttttgctttccaccactaggcaaagagagagaagaaatggtgaggtctttattgagatcagtttgacttacggcaaatagaaaaaacatgtctgactttgccattaaataccttccaacttagcaatcctgagacaaacctgtttgcaaaatgtaactaggtacccaggttaggctggtggaatgttcattattccgttgctaaggatctaagcctattcatggtgtcctatttttagagtatacaagaatgaatcagagacctatgattaattattaatgattgtgaaataacactgttggatgacagaaagttgaaagttttaataacagctgctttgagacttttaacaaacacataaaaggaattttaaagttatgttttttctttttggaatgttgcttgttttgaaatatgtttttccctaaatgtctatggtttagtcctatcttgaaaagaaaagaacctggcaataagaatctttgaaaagattaattatatctcttcattggtgtgca

SEQ ID NO: 111079 - DNA, 884 bp, Homo sapiens
catttttattgcgggggagtgatctctttacatagcttcaaatggcataacattcagcagtatccaagcttagatatatctgatgagaggaaagtaattgtgaggcctttgttctagttacaactttgtcactatctgactccatgactccagcaaattgcttcaactgtctggcctgcagtttttttcttgcgttaaataacagacttagtctagatcggtggttcttatcatgtggtttctggactagcagcatcaatattacctgggaaacttgttagaaatgcaaattcttgggctctgccctaggacctactgaaacatactctgtgggcggggcccagcaatctgtgtttgaaacgcgattctgattatttgacaaaagtttgcaaaccactggtctagataagtagctcttagccttggctgcacattaaaatcatctgggcaacttttataacctaccaatcctggcctcttcctccaaagattctgacttaaatggtttcagatggggaccattgttatgcggttatagccgacgtctaggtgctacctgaggtcttcaaagctaaaggtcagtgtttcccagccgtaaatgcatacctctagacctggccttctcaagccactaggtgttgctataatagagaagaaaaggcattttcagaaccgtctttggatatggatgaggaggaggaaaatgtatttcttagcttctgataagagattattttgttattttaatctgagtgcaatttgctaaatattcatttgcaacttgttaaatttattcaaagaaattaaatgcccataaatgacagaaagaataaagaattgtgatatatatttacaataaaatactctttagcaataaaaagaaa

SEQ ID NO: 111080 - DNA, 609 bp, Homo sapiens
caaacttctgcccagactaaggagaattgcctatggacatttaaccaatcctcctgattttaactgccccttcacctccagaagtatctggtgctgccaattgctgagctttggaggttctgcaagtagaaactgagtcggttctcagattctaccctctgctgccttagacttcagttttctaggatctgctattcttttagtattcatctatctgcattataacatcccacgttttttcatatgtgactcttttatggtttcccagtccttctgtgtttatggctttttaaaaaaggatttttgtggtttattttggatcactcaaaatcaccctcaaataaatgtataatgcagtgatttttagtaactaccaagtgtgtgcaaccatcatcataaataagtgttagaacattttcatcccctccttaagatctctcaacccatttccagttcatccccattgatgccctaggcaacgattagtctactctcttagtgaatttggcttttctggacatatataagtgatctgactcttttcgtttagcatgtttttgaggtcctgcaatggcatcatttattatttccttcttctgcttatctttg

SEQ ID NO: 111081 - DNA, 350 bp, Homo sapiens
gtattaaaaagttcacaccaaacccagaacctctagtatatgcagaagccatataggtttttgcttgttttttgagaggctgcttctatcaccttacgcattttcagtgagttaaaataccatcagataactgtcactgccaaaagaagcctgtgaagacatagcaactaaattattagctgggcccggtggtgcatgcctgtagtcccagctactcaggaggctgacgcaggagaatcacttgaacccaggaggtggagtttgcagtgagccgagattgcaccactgtactccaggcggggtgacagagcaagactctgtctctaaaaaataaaataaaagggctgggc

SEQ ID NO: 111082 - DNA, 3838 bp, Homo sapiens
cctacggaaatcctaacgggaatgtaacccaaaccggaagtggcctagagcgaccatttagcttctggttgttaagtggatctaagcctatgtcgcttactggacgctgaagtgattgggaatattagcagtgggggttctgtagggtcaggaaggggcggctggctttgggggagtgatgaggggcttgttgggggtgggggtgcgtgataaagggatttctcggctgaagacgaggctgtgaggcttctgcagaacccccaggtcaggccacatcattgaggctgcaggatctctcttcatagcccagtacgactctccgccgtgtccctggttggaaaatccaaacacctatccagcttctggctcctgggaaaagtggagttgtcagcaagagagaccgagagtagaagcccagagtggagatgcctgctgatgtgaatttatcccagaagcctcaggtcctgggtccagagaagcaggatggatcttgcgaggcatcagtgtcatttgaggacgtgaccgtggacttcagcagggaggagtggcagcaactggaccctgcccagagatgcctgtaccgggatgtgatgctggagctctatagccatctcttcgcagtggggtatcacattcccaacccagaggtcatcttcagaatgctaaaagaaaaggagccgcgtgtggaggaggctgaagtctcacatcagaggtgtcaagaaagggagtttgggcttgaaatcccacaaaaggagatttctaagaaagcttcatttcaaaaggatatggtaggtgagttcacaagagatggttcatggtgttccattttagaagaactgaggctggatgctgaccgcacaaagaaagatgagcaaaatcaaattcaacccatgagtcacagtgctttcttcaacaagaaaacattgaacacagaaagcaattgtgaatataaggaccctgggaaaatgattcgcacgaggccccaccttgcttcttcacagaaacaacctcagaaatgttgcttatttacagaaagtttgaagctgaacctagaagtgaacggtcagaatgaaagcaatgacacagaacagcttgatgacgttgttgggtctggtcagctattcagccatagctcttctgatgcctgcagcaagaatattcatacaggagagacattttgcaaaggtaaccagtgtagaaaagtctgtggccataaacagtcactcaagcaacatcaaattcatactcagaagaaaccagatggatgttctgaatgtggggggagcttcacccagaagtcacacctctttgcccaacagagaattcatagtgtaggaaacctccatgaatgtggcaaatgtggaaaagccttcatgccacaactaaaactcagtgtatatctgacagatcatacaggtgatataccctgtatatgcaaggaatgtgggaaggtctttattcagagatcagaattgcttacgcaccagaaaacacacactagaaagaagccctataaatgccatgactgtggaaaagcctttttccagatgttatctctcttcagacatcagagaactcacagtagagaaaaactctatgaatgcagtgaatgtggcaaaggcttctcccaaaactcaaccctcattatacatcagaaaattcatactggtgagagacagtatgcatgcagtgaatgtgggaaagcctttacccagaagtcaacactcagcttgcaccagagaatccactcagggcagaagtcctatgtgtgtatcgaatgcgggcaggccttcatccagaaggcacacctgattgtccatcaaagaagccacacaggagaaaaaccttatcagtgccacaactgtgggaaatccttcatttccaagtcacagcttgatatacatcatcgaattcatacaggggagaaaccttatgaatgcagtgactgtggaaaaaccttcacccaaaagtcacacctgaatatacaccagaaaattcatactggagaaagacaccatgtatgcagtgaatgcgggaaagccttcaaccagaagtcaatactcagcatgcatcagagaattcacaccggagagaagccttacaaatgcagtgaatgtgggaaagccttcacttctaagtctcaattcaaagagcatcagcgaattcacacgggtgagaaaccctatgtgtgcactgaatgtgggaaggccttcaacggcaggtcaaatttccataaacatcaaataactcacactagagagaggccttttgtctgttacaaatgtgggaaggcttttgtccagaaatcagagttgattacccatcaaagaactcacatgggagagaaaccctatgaatgccttgactgtgggaaatcgttcagtaagaaaccacaactcaaggtgcatcagcgaattcacacgggagaaagaccttatgtgtgttctgaatgtggaaaggccttcaacaacaggtcaaacttcaataaacaccaaacaactcataccagagacaaatcttacaaatgcagttattctgtgaaaggctttaccaagcaatgaattcctagtgcatcagcatattcataaatgaaatatactccgagtttcttgaagaagagaaaatcttctcagaatcaggtctaattatatgttattgaattcatgcttcagaaaaactctagggatgcactgcatgtgtgaacacatgataaaaaagtcatgctttattttagtgagggcaattacagagaaaagagtaagcagaaatgtccttctgagtactggcctcattaaggattataaattttctccccgggaagaaaccctgactaacgcattgagaaaagcctttctgtaaagaatggtacaagacaggttgttactcgattatttatagtaaaatatgtgggaaattatatcaatgataaccctgtttattgtgggatatcaatatttttaaagtgccaacacagtcatgataggacaatattttatgtgtgtgtgtgcgccttatgtatataagcatatatataatatataagcatattattatatacaggttgagtatcccttctccaaaatgcctgggatcagaagcattttggatttcagatacttacagattttggaatatttgcattatatttattggttgagcatccctaatctgaaaatccaagattaaatgctccaattagcatttcctttgagcgtcatgttagagttcaaaaagtttcagattttgggttttcagattaggaatacccaacctgtatgtacgtatatttctgtatctatgtatgtatatatatgcatatgcagacatatgtatatggtctggtcagcatatgtgtatgtatgcgtatgtatgtatgtatgtatgccctcagtgcagtggggtttgctgcagaattcactgcatagcaggagatgtaagcagatgagttattttttaagagaatctaatctaattgtttttataaaaattattccctattgaatatttatataatgaggttgtatcaacaatgattaactcctttattatacatacacatgaatgtgcatttttggtaaatgcataaatgagattctataatgtttactgatctttatattacagattttctcttcttttaggattagctcagcttgccccccctttccatctccaccatctatagtgagcctctccataattagtgccaaccattagtctcgttcatatttttacaccaggagtcaacaaactgtggccattggccaaatatggcctcccaactgtttttttaaaataaagttttattggaacacagccatgttcatttggaaaagta

SEQ ID NO: 111083 - DNA, 3784 bp, Homo sapiens
cctacggaaatcctaacgggaatgtaacccaaaccggaagtggcctagagcgaccatttagcttctggttgttaagtggatctaagcctatgtcgcttactggacgctgaagtgattgggaatattagcagtgggggttctgtagggtcaggaaggggcggctggctttgggggagtgatgaggggcttgttgggggtgggggtgcgtgataaagggatttctcggctgaagacgaggctgtgaggcttctgcagaacccccaggtcaggccacatcattgaggctgcaggatctctcttcatagcccagtacgactctccgccgtgtccctggttggaaaatccaaacacctatccagcttctggctcctgggaaaagtggagttgtcagcaagagagaccgagagtagaagcccagagtggagatgcctgctgatgtgaatttatcccagaagcctcaggtcctgggtccagagaagcaggatggatcttgcgaggcatcagtgtcatttgaggacgtgaccgtggacttcagcagggaggagtggcagcaactggaccctgcccagagatgcctgtaccgggatgtgatgctggagctctatagccatctcttcgcagtggggtatcacattcccaacccagaggtcatcttcagaatgctaaaagaaaaggagccgcgtgtggaggaggctgaagtctcacatcagaggtgtcaagaaagggagtttgggcttgaaatcccacaaaaggagatttctaagaaagcttcatttcaaaaggatatggtaggtgagttcacaagagatggttcatggtgttccattttagaagaactgaggctggatgctgaccgcacaaagaaagatgagcaaaatcaaattcaacccatgagtcacagtgctttcttcaacaagaaaacattgaacacagaaagcaattgtgaatataaggaccctgggaaaatgattcgcacgaggccccaccttgcttcttcacagaaacaacctcagaaatgttgcttatttacagaaagtttgaagctgaacctagaagtgaacggtcagaatgaaagcaatgacacagaacagcttgatgacgttgttgggtctggtcagctattcagccatagctcttctgatgcctgcagcaagaatattcatacaggagagacattttgcaaaggtaaccagtgtagaaaagtctgtggccataaacagtcactcaagcaacatcaaattcatactcagaagaaaccagatggatgttctgaatgtggggggagcttcacccagaagtcacacctctttgcccaacagagaattcatagtgtaggaaacctccatgaatgtggcaaatgtggaaaagccttcatgccacaactaaaactcagtgtatatctgacagatcatacaggtgatataccctgtatatgcaaggaatgtgggaaggtctttattcagagatcagaattgcttacgcaccagaaaacacacactagaaagaagccctataaatgccatgactgtggaaaagcctttttccagatgttatctctcttcagacatcagagaactcacagtagagaaaaactctatgaatgcagtgaatgtggcaaaggcttctcccaaaactcaaccctcattatacatcagaaccagaagtcaacactcagcttgcaccagagaatccactcagggcagaagtcctatgtgtgtatcgaatgcgggcaggccttcatccagaaggcacacctgattgtccatcaaagaagccacacaggagaaaaaccttatcagtgccacaactgtgggaaatccttcatttccaagtcacagcttgatatacatcatcgaattcatacaggggagaaaccttatgaatgcagtgactgtggaaaaaccttcacccaaaagtcacacctgaatatacaccagaaaattcatactggagaaagacaccatgtatgcagtgaatgcgggaaagccttcaaccagaagtcaatactcagcatgcatcagagaattcacaccggagagaagccttacaaatgcagtgaatgtgggaaagccttcacttctaagtctcaattcaaagagcatcagcgaattcacacgggtgagaaaccctatgtgtgcactgaatgtgggaaggccttcaacggcaggtcaaatttccataaacatcaaataactcacactagagagaggccttttgtctgttacaaatgtgggaaggcttttgtccagaaatcagagttgattacccatcaaagaactcacatgggagagaaaccctatgaatgccttgactgtgggaaatcgttcagtaagaaaccacaactcaaggtgcatcagcgaattcacacgggagaaagaccttatgtgtgttctgaatgtggaaaggccttcaacaacaggtcaaacttcaataaacaccaaacaactcataccagagacaaatcttacaaatgcagttattctgtgaaaggctttaccaagcaatgaattcctagtgcatcagcatattcataaatgaaatatactccgagtttcttgaagaagagaaaatcttctcagaatcaggtctaattatatgttattgaattcatgcttcagaaaaactctagggatgcactgcatgtgtgaacacatgataaaaaagtcatgctttattttagtgagggcaattacagagaaaagagtaagcagaaatgtccttctgagtactggcctcattaaggattataaattttctccccgggaagaaaccctgactaacgcattgagaaaagcctttctgtaaagaatggtacaagacaggttgttactcgattatttatagtaaaatatgtgggaaattatatcaatgataaccctgtttattgtgggatatcaatatttttaaagtgccaacacagtcatgataggacaatattttatgtgtgtgtgtgcgccttatgtatataagcatatatataatatataagcatattattatatacaggttgagtatcccttctccaaaatgcctgggatcagaagcattttggatttcagatacttacagattttggaatatttgcattatatttattggttgagcatccctaatctgaaaatccaagattaaatgctccaattagcatttcctttgagcgtcatgttagagttcaaaaagtttcagattttgggttttcagattaggaatacccaacctgtatgtacgtatatttctgtatctatgtatgtatatatatgcatatgcagacatatgtatatggtctggtcagcatatgtgtatgtatgcgtatgtatgtatgtatgtatgccctcagtgcagtggggtttgctgcagaattcactgcatagcaggagatgtaagcagatgagttattttttaagagaatctaatctaattgtttttataaaaattattccctattgaatatttatataatgaggttgtatcaacaatgattaactcctttattatacatacacatgaatgtgcatttttggtaaatgcataaatgagattctataatgtttactgatctttatattacagattttctcttcttttaggattagctcagcttgccccccctttccatctccaccatctatagtgagcctctccataattagtgccaaccattagtctcgttcatatttttacaccaggagtcaacaaactgtggccattggccaaatatggcctcccaactgtttttttaaaataaagttttattggaacacagccatgttcatttggaaaagta

SEQ ID NO: 111084 - DNA, 1066 bp, Homo sapiens
gaaattatatcaatgataacccacatattttactataaataatcgagtaacaacctgtcttgtaccattctttacagaaaggcttttctcaatgcgttagtcaggttgttactcgattatttatagtaaaatatgtgggaaattatatcaatgataaccctgtttattgtgggatatcaatatttttaaagtgccaacacagtcatgataggacaatattttatgtgtgtgtgtgcgccttatgtatataagcatatatataatatataagcatattattatatacaggttgagtatcccttctccaaaatgcctgggatcagaagcattttggatttcagatacttacagattttggaatatttgcattatatttattggttgagcatccctaatctgaaaatccaagattaaatgctccaattagcatttcctttgagcgtcatgttagagttcaaaaagtttcagattttgggttttcagattaggaatacccaacctgtatgtacgtatatttctgtatctatgtatgtatatatatgcatatgcagacatatgtatatggtctggtcagcatatgtgtatgtatgcgtatgtatgtatgtatgtatgccctcagtgcagtggggtttgctgcagaattcactgcatagcaggagatgtaagcagatgagttattttttaagagaatctaatctaattgtttttataaaaattattccctattgaatatttatataatgaggttgtatcaacaatgattaactcctttattatacatacacatgaatgtgcatttttggtaaatgcataaatgagattctataatgtttactgatctttatattacagattttctcttcttttaggattagctcagcttgccccccctttccatctccaccatctatagtgagcctctccataattagtgccaaccattagtctcgttcatatttttacaccaggagtcaacaaactgtggccattggccaaatatggcctcccaactgtttttttaaaataaagttttattggaacacagccatgttcatttggaaaagta

SEQ ID NO: 111085 - DNA, 917 bp, Homo sapiens
cctacggaaatcctaacgggaatgtaacccaaaccggaagtggcctagagcgaccatttagcttctggttgttaagtggatctaagcctatgtcgcttactggacgctgaagtgattgggaatattagcagtgggggttctgtagggtcaggaaggggcggctggctttgggggagtgatgaggggcttgttgggggtgggggtgcgtgataaagggatttctcggctgaagacgaggctgtgaggcttctgcagaacccccaggtcaggccacatcattgaggctgcaggatctctcttcatagcccagtacgactctccgccgtgtccctggttggaaaatccaaacacctatccagcttctggctcctgggaaaagtggagttgtcagcaagagagaccgagagtagaagcccagagtggagatgcctgctgatgtgaatttatcccagaagcctcaggtcctgggtccagagaagcaggatggatcttgcgaggcatcagtgtcatttgaggacgtgaccgtggacttcagcagggaggagtggcagcaactggaccctgcccagagatgcctgtaccgggatgtgatgctggagctctatagccatctcttcgcagtggggtatcacattcccaacccagaggtcatcttcagaatgctaaaagaaaaggagccgcgtgtggaggaggctgaagtctcacatcagaggtgtcaaggattagctcagcttgccccccctttccatctccaccatctatagtgagcctctccataattagtgccaaccattagtctcgttcatatttttacaccaggagtcaacaaactgtggccattggccaaatatggcctcccaactgtttttttaaaataaagttttattggaacacagccatgttcatttggaaaagta

SEQ ID NO: 111086 - DNA, 434 bp, Homo sapiens
tgggtatgataatgcccatgatatttagctgacaattaaattgacaactttctttttttaattcatatttatcacgtgccaggcaggcactgaggacttgacaagcttcatcttggttaagtttcccaacatctgtgataaatacctgcattttcattttggaaactacaactaaagtaatattttcatattctcacagtgaaaatgtggcaaagctgcaatgaattcaccatttagtccagactcagtctttatttttaaccctgactaataactagagttgggctttctgaactttgtctactccaatgtctgacacagtgacttcacctcagtgccctcaggaaatatttgtggagtgaatgttgaatgagtgaccatgtactcattgcttttccaaggcttctgcagaacccccaggtcaggccacatca

SEQ ID NO: 111087 - DNA, 651 bp, Homo sapiens
ccatcatcgctacctcctgaggttattatgcagattaaatgagtatgtgtgcaccatgtaggccactgcctggcacatgctaagtgctatgtagataaatgctcatcatgtaataagggctctgtgtttctgctcattgtcagcatcattagcagcattattacatgactcagcaatttccttgtgttctgtgtcaatcagcttcatgcagtttctcctctttcttgttcattgtgtctatttcatcttctctttctccttttagaaagggagtttgggcttgaaatcccacaaaaggagatttctaagaaagcttcatttcaaaaggatatggtaggtgagttcacaagagatggttcatggtgttccattttagaagaactgaggctggatgctgaccgcacaaagaaagatgagcaaaatcaaattcaacccatgagtcacagtgctttcttcaacaagaaaacattgaacacagaaagcaattgtgaatataaggaccctgggaaaatgattcgcacgaggccccaccttgcttcttcacagaaacaacctcagaaatgttgcttatttacagaaagtttgaagctgaacctagaagtgaacggtcagaatgaaagcaatgacacagaacagcttgatgacgttgtt

SEQ ID NO: 111088 - DNA, 1304 bp, Homo sapiens
cctacggaaatcctaacgggaatgtaacccaaaccggaagtggcctagagcgaccatttagcttctggttgttaagtggatctaagcctatgtcgcttactggacgctgaagtgattgggaatattagcagtgggggttctgtagggtcaggaaggggcggctggctttgggggagtgatgaggggcttgttgggggtgggggtgcgtgataaagggatttctcggctgaagacgaggctgtgaggcttctgcagaacccccaggtcaggccacatcattgaggctgcaggatctctcttcatagcccagtacgactctccgccgtgtccctggttggaaaatccaaacacctatccagcttctggctcctgggaaaagtggagttgtcagcaagagagaccgagagtagaagcccagagtggagatgcctgctgatgtgaatttatcccagaagcctcaggtcctgggtccagagaagcaggatggatcttgcgaggtaaacaggggcagccctggggatagttctccagaacgtgagggcagacacaggatgcagcaggtctgggctccctgctcctgagtcagtcttgagcctcctgtcaagcgaggaccacagaggctgatgtttccacattcataggctatctgtgttctagaggaaaccatgaactggctgataaaagaggatagtagagggttggccttgggtcaagaaagaagaaactgtagtccctggtctgatcagaagccccagtcataggatggaaaagctgactctttcctgctaagcactggttctgctccttcatccaccactgggtctttgaaaaatttcaagtggtcccccccaccaaattccttgcttggtccatggggtttggcccgtttttcctctgttctcataaggtgcggcaaaatctccttcctttgtaatttaaatagtcacagggaggtagagtgagaagaggcttttaaggaccatgtgaagaggcttttaaacactttttcctgtttaaaaaggtgaacaaaaaatgctggaaaacagtgtttccagattgcccacagatagaaatagtcaggatttggtaacaagaaatcagaattcttggtatagtcaagatttcctgaaatcctaaattattctgtgtatctcttgatgctttatttacaagtctttaaatagtatgtgactataatagtaaacagtgtaccattgttctgtgatgggtttataaccaaatttacagagatgttctgttttttaaaaaaagtataataaatatgtgtgttattatcctgaacc

SEQ ID NO: 111089 - DNA, 3530 bp, Homo sapiens
aaaggcccggccgtattgtgaaactcactataacccagcctatttggtgatgtttgcttcccactgcaatcgtgttatagaaggtgatgtggtctctgctcttaataaggccctggtgcgtgaacctgctttgcctgttctacctgcaacactaaattaacactcaagaataagtttgtggagtttgacatgaagccagtctgtaagaagtgctatgagaaatttccattggagctgaagaaaagacttaagaaactagctgagaccttaggaaggaaataagttcctttattttttcttttctatgcaagataagagattaccaacattacttgtcttgatctacccatatttaaagctatatctcaaagcagttgagagaagaggacctatatgaatggttttatgtcatttttttaattaaaaaagaaaaattcatataatcgtgtttaaaacacaaatgaagtcagtatttgcctttgttaacccttatccatttgttgacatgtagactgtttacaaaaaaaaaacacatggttaaatgttaaattttaattaaggcccccaaaaattaaatataactttttaaaatgaaaggagtcaccttttacatgactcaggtgaaaaaacagtataaacattaatttactttgtgttcaaaagaaaattccaactgctgttggggaaggacacagaaaagaaaaataaccacccaagaaaaacaaaaacaagaaaaacaaatcttatacaatcttagtatatttatcaaactagtagctagaaagtgaatatgcacattactaagacaaaaaacaagtgtaattcagaactacttgattttttttagttaaatgcaataattattatgcttagttttataacctgctctccttgtgaattcttccttcaaatgattacttaacgcagtagtaatagctagctagtaggatgtcctttaaatttttgtgcaaaaaaaaatttataccaggtatttggaaatatactttacaatattggaaaatgaagtatttttaatgtattacagcaattatgtttctaagcttaatgttaagcatgtagtcttagaataggacatgaaattaaattgtatgtagcttggaatatattgcttcagaaaactgaatgtgtatgtcggtcatattgcctttataaccatgctaatatctatgctttatacatactcaaacttgccttgccttaaaaaaatacatactacatacttaaatcaggaattctagccatctcacagaataccaactaaaactaagtgcattgagatctgagattggtaaacccagattcatttaccacagctgtaattaagtttttagaaactattctctttttggggaaatccattgaagttaatttctgttatcttattagaagaaaatgatgttgatatgtgtttcagattttccatttgaaatcttataattaatttgatttatttactgtaagtaggaggtataaatgacactcttaaattggaaggaggggtgttttagtgtctgttttaggtcaaaattagtgattctatttttatcaaaagttttatcctgaagtttcaggaccactcttccttaataaacttgttaatggaaagcgagctttatgaacatttaaaaatgttgctgctgctttgttgcttaaaaagaaagttgccaagagagacttcttagggaaaatatttgggttttttttccaaaaattgctgaaatattgttttgccatttttaaaaagtctcaggttattaccactctgccattaaatatttgtatgcctgcatttttaaaaattctgtgcatgtactttatggagtacattctatttttgttttcagataccctacaaccaatttttttagtaatcttttagaattgaaattatcataaatgatcgagaataatcatcacatagtttaagattgtatatgttgagtagtttaaaacaatctttgcattttacagtaagaatcaaagtcccttcagtgtgcctttgtcagctaatatgtgaccagcaatgacaaccttgggagtatttattaaatattatgctatgaatataggcaacacagaacagggtttgcagtatagcgtcttgatgctaaattctcatatacctctacacgagaaatatggaggagaaaaacaagcatttacatatattcttcgtcactttgaagatgcatggcctgaactcgactgcttgtgtttgtttacatatcaggcatacccaggcatctcctgcagccagaggttccattgctgtctttgctcagtcctcttttaaaatatgaattagtggacaggcacggtgcctcacacctgtaatcccagcactttgggaggtcgaggcaggtggatcacgaggtcaggagatcaagaccatcctggctaccactgaaaccccatctctactacaaaaaaattagccgggcgtggtggcgggcacctgcagtcccagctactcgggaggctgaggcaggagaatggtgggaacccgggaggcagagcttgcagtgagccaagatcacgccactgcactccagcctgggcaacagagcaagactctgtctcaaaaaaaataaataaataaattatgaatgagtattttctagaaattcaacttgctaagcctgtaatacttaagggtagtttatctagatacagtactttcttccctgataagtagtatcattggagcccttaggtataggagaagaggaagaagtttaaaaagtgtaagtgggccgggcgtggtggctcatgcctgtaatcccagcactttgggaggccgaggggggcggatcacgaggtcaggagatccagactatcctggctaacaaggtgaaaccccgtctctactaaaaatacaaaaaaaaacattagccaggcgtggtggcgggcgcttgtagtcccagctactcgggaggctgaggtaggagaatggcttgaacccaggaggcggagcttgcagtgagccgagattgcaccactgcactccagcctgggcgacagagcaagactccgtctcaaaaaaaaaaaaaaaagtgtaagtggattaaaagagaaacttggtctagttcataatatttttaatagggctttccctggctgctggaaaacttaggccagtaagcatctctttgtttaaagtcctacaagacaatttgaaataattcattgttcatgccaaaattctaagtactgtttttcttagcaagtgtaacataatcaggaacaatgggtacaagtaaaacattctttggatgatattcaaagccttattagcactgcacctgaataataggtcattttgcctcactcatttgccaaagtagccatttctaagttaaggaagtttttagataggctcatagccttgtatttcgttttagattgtaagctcaatggcagggatactatattggtaattatgttttcatatagcaaccaccacagtatattcttggtgcttaataaatgtttataattgttaacaataa

SEQ ID NO: 111090 - DNA, 3773 bp, Homo sapiens
aaaggcccggccgtattgtgaaactcactataacccagcctatttggtgatgtttgcttcccactgcaatcgtgttatagaaggtgatgtggtctctgctcttaataaggccctggtgcgtgaacctgctttgcctgttctacctgcaacactaaattaacactcaagaataagtttgtggagtttgacatgaagccagtctgtaagaagtgctatgagaaatttccattggagctgaagaaaagacttaagaaactagctgagaccttaggaaggaaataagttcctttattttttcttttctatgcaagataagagattaccaacattacttgtcttgatctacccatatttaaagctatatctcaaagcagttgagagaagaggacctatatgaatggttttatgtcatttttttaattaaaaaagaaaaattcatataatcgtgtttaaaacacaaatgaagtcagtatttgcctttgttaacccttatccatttgttgacatgtagactgtttacaaaaaaaaaacacatggttaaatgttaaattttaattaaggcccccaaaaattaaatataactttttaaaatgaaaggagtcaccttttacatgactcaggtgaaaaaacagtataaacattaatttactttgtgttcaaaagaaaattccaactgctgttggggaaggacacagaaaagaaaaataaccacccaagaaaaacaaaaacaagaaaaacaaatcttatacaatcttagtatatttatcaaactagtagctagaaagtgaatatgcacattactaagacaaaaaacaagtgtaattcagaactacttgattttttttagttaaatgcaataattattatgcttagttttataacctgctctccttgtgaattcttccttcaaatgattacttaacgcagtagtaatagctagctagtaggatgtcctttaaatttttgtgcaaaaaaaaatttataccaggtatttggaaatatactttacaatattggaaaatgaagtatttttaatgtattacagcaattatgtttctaagcttaatgttaagcatgtagtcttagaataggacatgaaattaaattgtatgtagcttggaatatattgcttcagaaaactgaatgtgtatgtcggtcatattgcctttataaccatgctaatatctatgctttatacatactcaaacttgccttgccttaaaaaaatacatactacatacttaaatcaggaattctagccatctcacagaataccaactaaaactaagtgcattgagatctgagattggtaaacccagattcatttaccacagctgtaattaagtttttagaaactattctctttttggggaaatccattgaagttaatttctgttatcttattagaagaaaatgatgttgatatgtgtttcagattttccatttgaaatcttataattaatttgatttatttactgtaagtaggaggtataaatgacactcttaaattggaaggaggggtgttttagtgtctgttttaggtcaaaattagtgattctatttttatcaaaagttttatcctgaagtttcaggaccactcttccttaataaacttgttaatggaaagcgagctttatgaacatttaaaaatgttgctgctgctttgttgcttaaaaagaaagttgccaagagagacttcttagggaaaatatttgggttttttttccaaaaattgctgaaatattgttttgccatttttaaaaagtctcaggttattaccactctgccattaaatatttgtatgcctgcatttttaaaaattctgtgcatgtactttatggagtacattctatttttgttttcagataccctacaaccaatttttttagtaatcttttagaattgaaattatcataaatgatcgagaataatcatcacatagtttaagattgtatatgttgagtagtttaaaacaatctttgcattttacagtaagaatcaaagtcccttcagtgtgcctttgtcagctaatatgtgaccagcaatgacaaccttgggagtatttattaaatattatgctatgaatataggcaacacagaacagggtttgcagtatagcgtcttgatgctaaattctcatatacctctacacgagaaatatggaggagaaaaacaagcatttacatatattcttcgtcactttgaagatgcatggcctgaactcgactgcttgtgtttgtttacatatcaggcatacccaggcatctcctgcagccagaggttccattgctgtctttgctcagtcctcttttaaaatatgaattagtggacaggcacggtgcctcacacctgtaatcccagcactttgggaggtcgaggcaggtggatcacgaggtcaggagatcaagaccatcctggctaccactgaaaccccatctctactacaaaaaaattagccgggcgtggtggcgggcacctgcagtcccagctactcgggaggctgaggcaggagaatggtgggaacccgggaggcagagcttgcagtgagccaagatcacgccactgcactccagcctgggcaacagagcaagactctgtctcaaaaaaaataaataaataaattatgaatgagtattttctagaaattcaacttgctaagcctgtaatacttaagggtagtttatctagatacagtactttcttccctgataagtagtatcattggagcccttaggtataggagaagaggaagaagtttaaaaagtgtaagtgggccgggcgtggtggctcatgcctgtaatcccagcactttgggaggccgaggggggcggatcacgaggtcaggagatccagactatcctggctaacaaggtgaaaccccgtctctactaaaaatacaaaaaaaaacattagccaggcgtggtggcgggcgcttgtagtcccagctactcgggaggctgaggtaggagaatggcttgaacccaggaggcggagcttgcagtgagccgagattgcaccactgcactccagcctgggcgacagagcaagactccgtctcaaaaaaaaaaaaaaaagtgtaagtggattaaaagagaaacttggtctagttcataatatttttaatagggctttccctggctgctggaaaacttaggccagtaagcatctctttgtttaaagtcctacaagacaatttgaaataattcattgttcatgccaaaattctaagtactgtttttcttagcaagtgtaacataatcaggaacaatgggtacaagtaaaacattctttggatgatattcaaagccttattagcactgcacctgaataataggtcattttgcctcactcatttgccaaagtagccatttctaagttaaggaagtttttagataggctcatagccttgtatttcgttttagattgtaagctcaatggcagggatactatattggtaattatgttttcatatagcaaccaccacagtatattcttggtgcttaataaatgtttataattgttaacaataaaaaaaaaaaaaaaaaaaaaaaaaaaaaaaacaaaaacaaaaaaaacaaaaaaaaaaaaaacgaaaaaaaaacaaaaaacacaaaaaaacaaaaaacaaaaaaaaaaaaaacaaagatggtggtggcgggcgcgcacgccgcaggaatagacatcgacacagcaaccgactgttggtgggggggccggccgacgaaagaagctaaaaagaacaacggagaagagagtgtagaaggaaaaagagc

SEQ ID NO: 111091 - DNA, 3470 bp, Homo sapiens
aaaggcccggccgtattgtgaaactcactataacccagcctatttggtgatgtttgcttcccactgcaatcgtgttatagaaggtgatgtggtctctgctcttaataaggccctggtgcgtgaacctgctttgcctgttctacctgcaacactaaattaacactcaagaataagtttgtggagtttgacatgaagccagtctgtaagaagtgctatgagaaatttccattggagctgaagaaaagacttaagaaactagctgagaccttaggaaggaaataagttcctttattttttcttttctatgcaagataagagattaccaacattacttgtcttgatctacccatatttaaagctatatctcaaagcagttgagagaagaggacctatatgaatggttttatgtcatttttttaattaaaaaagaaaaattcatataatcgtgtttaaaacacaaatgaagtcagtatttgcctttgttaacccttatccatttgttgacatgtagactgtttacaaaaaaaaaacacatggttaaatgttaaattttaattaaggcccccaaaaattaaatataactttttaaaatgaaaggagtcaccttttacatgactcaggtgaaaaaacagtataaacattaatttactttgtgttcaaaagaaaattccaactgctgttggggaaggacacagaaaagaaaaataaccacccaagaaaaacaaaaacaagaaaaacaaatcttatacaatcttagtatatttatcaaactagtagctagaaagtgaatatgcacattactaagacaaaaaacaagtgtaattcagaactacttgattttttttagttaaatgcaataattattatgcttagttttataacctgctctccttgtgaattcttccttcaaatgattacttaacgcagtagtaatagctagctagtaggatgtcctttaaatttttgtgcaaaaaaaaatttataccaggtatttggaaatatactttacaatattggaaaatgaagtatttttaatgtattacagcaattatgtttctaagcttaatgttaagcatgtagtcttagaataggacatgaaattaaattgtatgtagcttggaatatattgcttcagaaaactgaatgtgtatgtcggtcatattgcctttataaccatgctaatatctatgctttatacatactcaaacttgccttgccttaaaaaaatacatactacatacttaaatcaggaattctagccatctcacagaataccaactaaaactaagtgcattgagatctgagattggtaaacccagattcatttaccacagctgtaattaagtttttagaaactattctctttttggggaaatccattgaagttaatttctgttatcttattagaagaaaatgatgttgatatgtgtttcagattttccatttgaaatcttataattaatttgatttatttactgtaagtaggaggtataaatgacactcttaaattggaaggaggggtgttttagtgtctgttttaggtcaaaattagtgattctatttttatcaaaagttttatcctgaagtttcaggaccactcttccttaataaacttgttaatggaaagcgagctttatgaacatttaaaaatgttgctgctgctttgttgcttaaaaagaaagttgccaagagagacttcttagggaaaatatttgggttttttttccaaaaattgctgaaatattgttttgccatttttaaaaagtctcaggttattaccactctgccattaaatatttgtatgcctgcatttttaaaaattctgtgcatgtactttatggagtacattctatttttgttttcagataccctacaaccaatttttttagtaatcttttagaattgaaattatcataaatgatcgagaataatcatcacatagtttaagattgtatatgttgagtagtttaaaacaatctttgcattttacagtaagaatcaaagtcccttcagtgtgcctttgtcagctaatatgtgaccagcaatgacaaccttgggagtatttattaaatattatgctatgaatataggcaacacagaacagggtttgcagtatagcgtcttgatgctaaattctcatatacctctacacgagaaatatggaggagaaaaacaagcatttacatatattcttcgtcactttgaagatgcatggcctgaactcgactgcttgtgtttgtttacatatcaggcatacccaggcatctcctgcagccagaggttccattgctgtctttgctcagtcctcttttaaaatatgaattagtggacaggcacggtgcctcacacctgtaatcccagcactttgggaggtcgaggcaggtggatcacgaggtcaggagatcaagaccatcctggctaccactgaaaccccatctctactacaaaaaaattagccgggcgtggtggcgggcacctgcagtcccagctactcgggaggctgaggcaggagaatggtgggaacccgggaggcagagcttgcagtgagccaagatcacgccactgcactccagcctgggcaacagagcaagactctgtctcaaaaaaaataaataaataaattatgaatgagtattttctagaaattcaacttgctaagcctgtaatacttaagggtagtttatctagatacagtactttcttccctgataagtagtatcattggagcccttaggtataggagaagaggaagaagtttaaaaagtgtaagtgggccgggcgtggtggctcatgcctgtaatcccagcactttgggaggccgaggggggcggatcacgaggtcaggagatccagactatcctggctaacaaggtgaaaccccgtctctactaaaaatacaaaaaaaaacattagccaggcgtggtggcgggcgcttgtagtcccagctactcgggaggctgaggtaggagaatggcttgaacccaggaggcggagcttgcagtgagccgagattgcaccactgcactccagcctgggcgacagagcaagactccgtctcaaaaaaaaggctttccctggctgctggaaaacttaggccagtaagcatctctttgtttaaagtcctacaagacaatttgaaataattcattgttcatgccaaaattctaagtactgtttttcttagcaagtgtaacataatcaggaacaatgggtacaagtaaaacattctttggatgatattcaaagccttattagcactgcacctgaataataggtcattttgcctcactcatttgccaaagtagccatttctaagttaaggaagtttttagataggctcatagccttgtatttcgttttagattgtaagctcaatggcagggatactatattggtaattatgttttcatatagcaaccaccacagtatattcttggtgcttaataaatgtttataattgttaacaataa

SEQ ID NO: 111092 - DNA, 2636 bp, Homo sapiens
cgacccacgcgtcgcggacgcgtgggtgacccacgcgtccggctagctagtaggatgtcctttaaatttttgtgcaaaaaaaaatttataccaggtatttggaaatatactttacaatattggaaaatgaagtatttttaatgtattacagcaattatgtttctaagcttaatgttaagcatgtagtcttagaataggacatgaaattaaattgtatgtagcttggaatatattgcttcagaaaactgaatgtgtatgtcggtcatattgcctttataaccatgctaatatctatgctttatacatactcaaacttgccttgccttaaaaaaatacatactacatacttaaatcaggaattctagccatctcacagaataccaactaaaactaagtgcattgagatctgagattggtaaacccagattcatttaccacagctgtaattaagtttttagaaactattctctttttggggaaatccattgaagttaatttctgttatcttattagaagaaaatgatgttgatatgtgtttcagattttccatttgaaatcttataattaatttgatttatttactgtaagtaggaggtataaatgacactcttaaattggaaggaggggtgttttagtgtctgttttaggtcaaaattagtgattctatttttatcaaaagttttatcctgaagtttcaggaccactcttccttaataaacttgttaatggaaagcgagctttatgaacatttaaaaatgttgctgctgctttgttgcttaaaaagaaagttgccaagagagacttcttagggaaaatatttgggttttttttccaaaaattgctgaaatattgttttgccatttttaaaaagtctcaggttattaccactctgccattaaatatttgtatgcctgcatttttaaaaattctgtgcatgtactttatggagtacattctatttttgttttcagataccctacaaccaatttttttagtaatcttttagaattgaaattatcataaatgatcgagaataatcatcacatagtttaagattgtatatgttgagtagtttaaaacaatctttgcattttacagtaagaatcaaagtcccttcagtgtgcctttgtcagctaatatgtgaccagcaatgacaaccttgggagtatttattaaatattatgctatgaatataggcaacacagaacagggtttgcagtatagcgtcttgatgctaaattctcatatacctctacacgagaaatatggaggagaaaaacaagcatttacatatattcttcgtcactttgaagatgcatggcctgaactcgactgcttgtgtttgtttacatatcaggcatacccaggcatctcctgcagccagaggttccattgctgtctttgctcagtcctcttttaaaatatgaattagtggacaggcacggtgcctcacacctgtaatcccagcactttgggaggtcgaggcaggtggatcacgaggtcaggagatcaagaccatcctggctaccactgaaaccccatctctactacaaaaaaattagccgggcgtggtggcgggcacctgcagtcccagctactcgggaggctgaggcaggagaatggtgggaacccgggaggcagagcttgcagtgagccaagatcacgccactgcactccagcctgggcaacagagcaagactctgtctcaaaaaaaataaataaataaattatgaatgagtattttctagaaattcaacttgctaagcctgtaatacttaagggtagtttatctagatacagtactttcttccctgataagtagtatcattggagcccttaggtataggagaagaggaagaagtttaaaaagtgtaagtgggccgggcgtggtggctcatgcctgtaatcccagcactttgggaggccgaggggggcggatcacgaggtcaggagatccagactatcctggctaacaaggtgaaaccccgtctctactaaaaatacaaaaaaaaacattagccaggcgtggtggcgggcgcttgtagtcccagctactcgggaggctgaggtaggagaatggcttgaacccaggaggcggagcttgcagtgagccgagattgcaccactgcactccagcctgggcgacagagcaagactccgtctcaaaaaaaaaaaaaaaagtgtaagtggattaaaagagaaacttggtctagttcataatatttttaatagggctttccctggctgctggaaaacttaggccagtaagcatctctttgtttaaagtcctacaagacaatttgaaataattcattgttcatgccaaaattctaagtactgtttttcttagcaagtgtaacataatcaggaacaatgggtacaagtaaaacattctttggatgatattcaaagccttattagcactgcacctgaataataggtcattttgcctcactcatttgccaaagtagccatttctaagttaaggaagtttttagataggctcatagccttgtatttcgttttagattgtaagctcaatggcagggatactatattggtaattatgttttcatatagcaaccaccacagtatattcttggtgcttaataaatgtttataattgttaacaataa

SEQ ID NO: 111093 - DNA, 2467 bp, Homo sapiens
  misc_feature (2)..(2): n is a, c, g, or t
  misc_feature (6)..(8): n is a, c, g, or t
cnggtnnngttcgagcaggaggaaataggacatgaaattaaattgtatgtagcttggaatatattgcttcagaaaactgaatgtgtatgtcggtcatattgcctttataaccatgctaatatctatgctttatacatactcaaacttgccttgccttaaaaaaatacatactacatacttaaatcaggaattctagccatctcacagaataccaactaaaactaagtgcattgagatctgagattggtaaacccagattcatttaccacagctgtaattaagtttttagaaactattctctttttggggaaatccattgaagttaatttctgttatcttattagaagaaaatgatgttgatatgtgtttcagattttccatttgaaatcttataattaatttgatttatttactgtaagtaggaggtataaatgacactcttaaattggaaggaggggtgttttagtgtctgttttaggtcaaaattagtgattctatttttatcaaaagttttatcctgaagtttcaggaccactcttccttaataaacttgttaatggaaagcgagctttatgaacatttaaaaatgttgctgctgctttgttgcttaaaaagaaagttgccaagagagacttcttagggaaaatatttgggttttttttccaaaaattgctgaaatattgttttgccatttttaaaaagtctcaggttattaccactctgccattaaatatttgtatgcctgcatttttaaaaattctgtgcatgtactttatggagtacattctatttttgttttcagataccctacaaccaatttttttagtaatcttttagaattgaaattatcataaatgatcgagaataatcatcacatagtttaagattgtatatgttgagtagtttaaaacaatctttgcattttacagtaagaatcaaagtcccttcagtgtgcctttgtcagctaatatgtgaccagcaatgacaaccttgggagtatttattaaatattatgctatgaatataggcaacacagaacagggtttgcagtatagcgtcttgatgctaaattctcatatacctctacacgagaaatatggaggagaaaaacaagcatttacatatattcttcgtcactttgaagatgcatggcctgaactcgactgcttgtgtttgtttacatatcaggcatacccaggcatctcctgcagccagaggttccattgctgtctttgctcagtcctcttttaaaatatgaattagtggacaggcacggtgcctcacacctgtaatcccagcactttgggaggtcgaggcaggtggatcacgaggtcaggagatcaagaccatcctggctaccactgaaaccccatctctactacaaaaaaattagccgggcgtggtggcgggcacctgcagtcccagctactcgggaggctgaggcaggagaatggtgggaacccgggaggcagagcttgcagtgagccaagatcacgccactgcactccagcctgggcaacagagcaagactctgtctcaaaaaaaataaataaataaattatgaatgagtattttctagaaattcaacttgctaagcctgtaatacttaagggtagtttatctagatacagtactttcttccctgataagtagtatcattggagcccttaggtataggagaagaggaagaagtttaaaaagtgtaagtgggccgggcgtggtggctcatgcctgtaatcccagcactttgggaggccgaggggggcggatcacgaggtcaggagatccagactatcctggctaacaaggtgaaaccccgtctctactaaaaatacaaaaaaaaacattagccaggcgtggtggcgggcgcttgtagtcccagctactcgggaggctgaggtaggagaatggcttgaacccaggaggcggagcttgcagtgagccgagattgcaccactgcactccagcctgggcgacagagcaagactccgtctcaaaaaaaaaaaaaaaagtgtaagtggattaaaagagaaacttggtctagttcataatatttttaatagggctttccctggctgctggaaaacttaggccagtaagcatctctttgtttaaagtcctacaagacaatttgaaataattcattgttcatgccaaaattctaagtactgtttttcttagcaagtgtaacataatcaggaacaatgggtacaagtaaaacattctttggatgatattcaaagccttattagcactgcacctgaataataggtcattttgcctcactcatttgccaaagtagccatttctaagttaaggaagtttttagataggctcatagccttgtatttcgttttagattgtaagctcaatggcagggatactatattggtaattatgttttcatatagcaaccaccacagtatattcttggtgcttaataaatgtttataattgttaacaataa

SEQ ID NO: 111094 - DNA, 3472 bp, Homo sapiens
aaaggcccggccgtattgtgaaactcactataacccagcctatttggtgatgtttgcttcccactgcaatcgtgttatagaaggtgatgtggtctctgctcttaataaggccctggtgcgtgaacctgctttgcctgttctacctgcaacactaaattaacactcaagaataagtttgtggagtttgacatgaagccagtctgtaagaagtgctatgagaaatttccattggagctgaagaaaagacttaagaaactagctgagaccttaggaaggaaataagttcctttattttttcttttctatgcaagataagagattaccaacattacttgtcttgatctacccatatttaaagctatatctcaaagcagttgagagaagaggacctatatgaatggttttatgtcatttttttaattaaaaaagaaaaattcatataatcgtgtttaaaacacaaatgaagtcagtatttgcctttgttaacccttatccatttgttgacatgtagactgtttacaaaaaaaaaacacatggttaaatgttaaattttaattaaggcccccaaaaattaaatataactttttaaaatgaaaggagtcaccttttacatgactcaggtgaaaaaacagtataaacattaatttactttgtgttcaaaagaaaattccaactgctgttggggaaggacacagaaaagaaaaataaccacccaagaaaaacaaaaacaagaaaaacaaatcttatacaatcttagtatatttatcaaactagtagctagaaagtgaatatgcacattactaagacaaaaaacaagtgtaattcagaactacttgattttttttagttaaatgcaataattattatgcttagttttataacctgctctccttgtgaattcttccttcaaatgattacttaacgcagtagtaatagctagctagtaggatgtcctttaaatttttgtgcaaaaaaaaatttataccaggtatttggaaatatactttacaatattggaaaatgaagtatttttaatgtattacagcaattatgtttctaagcttaatgttaagcatgtagtcttagaataggacatgaaattaaattgtatgtagcttggaatatattgcttcagaaaactgaatgtgtatgtcggtcatattgcctttataaccatgctaatatctatgctttatacatactcaaacttgccttgccttaaaaaaatacatactacatacttaaatcaggaattctagccatctcacagaataccaactaaaactaagtgcattgagatctgagattggtaaacccagattcatttaccacagctgtaattaagtttttagaaactattctctttttggggaaatccattgaagttaatttctgttatcttattagaagaaaatgatgttgatatgtgtttcagattttccatttgaaatcttataattaatttgatttatttactgtaagtaggaggtataaatgacactcttaaattggaaggaggggtgttttagtgtctgttttaggtcaaaattagtgattctatttttatcaaaagttttatcctgaagtttcaggaccactcttccttaataaacttgttaatggaaagcgagctttatgaacatttaaaaatgttgctgctgctttgttgcttaaaaagaaagttgccaagagagacttcttagggaaaatatttgggttttttttccaaaaattgctgaaatattgttttgccatttttaaaaagtctcaggttattaccactctgccattaaatatttgtatgcctgcatttttaaaaattctgtgcatgtactttatggagtacattctatttttgttttcagataccctacaaccaatttttttagtaatcttttagaattgaaattatcataaatgatcgagaataatcatcacatagtttaagattgtatatgttgagtagtttaaaacaatctttgcattttacagtaagaatcaaagtcccttcagtgtgcctttgtcagctaatatgtgaccagcaatgacaaccttgggagtatttattaaatattatgctatgaatataggcaacacagaacagggtttgcagtatagcgtcttgatgctaaattctcatatacctctacacgagaaatatggaggagaaaaacaagcatttacatatattcttcgtcactttgaagatgcatggcctgaactcgactgcttgtgtttgtttacatatcaggcatacccaggcatctcctgcagccagaggttccattgctgtctttgctcagtcctcttttaaaatatgaattagtggacaggcacggtgcctcacacctgtaatcccagcactttgggaggtcgaggcaggtggatcacgaggtcaggagatcaagaccatcctggctaccactgaaaccccatctctactacaaaaaaattagccgggcgtggtggcgggcacctgcagtcccagctactcgggaggctgaggcaggagaatggtgggaacccgggaggcagagcttgcagtgagccaagatcacgccactgcactccagcctgggcaacagagcaagactctgtctccctgtaatacttaagggtagtttatctagatacagtactttcttccctgataagtagtatcattggagcccttaggtataggagaagaggaagaagtttaaaaagtgtaagtgggccgggcgtggtggctcatgcctgtaatcccagcactttgggaggccgaggggggcggatcacgaggtcaggagatccagactatcctggctaacaaggtgaaaccccgtctctactaaaaatacaaaaaaaaacattagccaggcgtggtggcgggcgcttgtagtcccagctactcgggaggctgaggtaggagaatggcttgaacccaggaggcggagcttgcagtgagccgagattgcaccactgcactccagcctgggcgacagagcaagactccgtctcaaaaaaaaaaaaaaaagtgtaagtggattaaaagagaaacttggtctagttcataatatttttaatagggctttccctggctgctggaaaacttaggccagtaagcatctctttgtttaaagtcctacaagacaatttgaaataattcattgttcatgccaaaattctaagtactgtttttcttagcaagtgtaacataatcaggaacaatgggtacaagtaaaacattctttggatgatattcaaagccttattagcactgcacctgaataataggtcattttgcctcactcatttgccaaagtagccatttctaagttaaggaagtttttagataggctcatagccttgtatttcgttttagattgtaagctcaatggcagggatactatattggtaattatgttttcatatagcaaccaccacagtatattcttggtgcttaataaatgtttataattgttaacaataa

SEQ ID NO: 111095 - DNA, 2089 bp, Homo sapiens
  misc_feature (1)..(1): n is a, c, g, or t
  misc_feature (6)..(6): n is a, c, g, or t
  misc_feature (11)..(11): n is a, c, g, or t
  misc_feature (23)..(23): n is a, c, g, or t
nccccngggcntgcaggaattcnggcacgagttactgtaagtaggaggtataaatgacactcttaaattggaaggaggggtgttttagtgtctgttttaggtcaaaattagtgattctatttttatcaaaagttttatcctgaagtttcaggaccactcttccttaataaacttgttaatggaaagcgagctttatgaacatttaaaaatgttgctgctgctttgttgcttaaaaagaaagttgccaagagagacttcttagggaaaatatttgggttttttttccaaaaattgctgaaatattgttttgccatttttaaaaagtctcaggttattaccactctgccattaaatatttgtatgcctgcatttttaaaaattctgtgcatgtactttatggagtacattctatttttgttttcagataccctacaaccaatttttttagtaatcttttagaattgaaattatcataaatgatcgagaataatcatcacatagtttaagattgtatatgttgagtagtttaaaacaatctttgcattttacagtaagaatcaaagtcccttcagtgtgcctttgtcagctaatatgtgaccagcaatgacaaccttgggagtatttattaaatattatgctatgaatataggcaacacagaacagggtttgcagtatagcgtcttgatgctaaattctcatatacctctacacgagaaatatggaggagaaaaacaagcatttacatatattcttcgtcactttgaagatgcatggcctgaactcgactgcttgtgtttgtttacatatcaggcatacccaggcatctcctgcagccagaggttccattgctgtctttgctcagtcctcttttaaaatatgaattagtggacaggcacggtgcctcacacctgtaatcccagcactttgggaggtcgaggcaggtggatcacgaggtcaggagatcaagaccatcctggctaccactgaaaccccatctctactacaaaaaaattagccgggcgtggtggcgggcacctgcagtcccagctactcgggaggctgaggcaggagaatggtgggaacccgggaggcagagcttgcagtgagccaagatcacgccactgcactccagcctgggcaacagagcaagactctgtctcaaaaaaaataaataaataaattatgaatgagtattttctagaaattcaacttgctaagcctgtaatacttaagggtagtttatctagatacagtactttcttccctgataagtagtatcattggagcccttaggtataggagaagaggaagaagtttaaaaagtgtaagtgggccgggcgtggtggctcatgcctgtaatcccagcactttgggaggccgaggggggcggatcacgaggtcaggagatccagactatcctggctaacaaggtgaaaccccgtctctactaaaaatacaaaaaaaaacattagccaggcgtggtggcgggcgcttgtagtcccagctactcgggaggctgaggtaggagaatggcttgaacccaggaggcggagcttgcagtgagccgagattgcaccactgcactccagcctgggcgacagagcaagactccgtctcaaaaaaaaaaaaaaaagtgtaagtggattaaaagagaaacttggtctagttcataatatttttaatagggctttccctggctgctggaaaacttaggccagtaagcatctctttgtttaaagtcctacaagacaatttgaaataattcattgttcatgccaaaattctaagtactgtttttcttagcaagtgtaacataatcaggaacaatgggtacaagtaaaacattctttggatgatattcaaagccttattagcactgcacctgaataataggtcattttgcctcactcatttgccaaagtagccatttctaagttaaggaagtttttagataggctcatagccttgtatttcgttttagattgtaagctcaatggcagggatactatattggtaattatgttttcatatagcaaccaccacagtatattcttggtgcttaataaatgtttataattgttaacaataa

SEQ ID NO: 111096 - DNA, 2017 bp, Homo sapiens
tgctgcggcgactctgaggatccctttagtcaaaattagtgattctatttttatcaaaagttttatcctgaagtttcaggaccactcttccttaataaacttgttaatggaaagcgagctttatgaacatttaaaaatgttgctgctgctttgttgcttaaaaagaaagttgccaagagagacttcttagggaaaatatttgggttttttttccaaaaattgctgaaatattgttttgccatttttaaaaagtctcaggttattaccactctgccattaaatatttgtatgcctgcatttttaaaaattctgtgcatgtactttatggagtacattctatttttgttttcagataccctacaaccaatttttttagtaatcttttagaattgaaattatcataaatgatcgagaataatcatcacatagtttaagattgtatatgttgagtagtttaaaacaatctttgcattttacagtaagaatcaaagtcccttcagtgtgcctttgtcagctaatatgtgaccagcaatgacaaccttgggagtatttattaaatattatgctatgaatataggcaacacagaacagggtttgcagtatagcgtcttgatgctaaattctcatatacctctacacgagaaatatggaggagaaaaacaagcatttacatatattcttcgtcactttgaagatgcatggcctgaactcgactgcttgtgtttgtttacatatcaggcatacccaggcatctcctgcagccagaggttccattgctgtctttgctcagtcctcttttaaaatatgaattagtggacaggcacggtgcctcacacctgtaatcccagcactttgggaggtcgaggcaggtggatcacgaggtcaggagatcaagaccatcctggctaccactgaaaccccatctctactacaaaaaaattagccgggcgtggtggcgggcacctgcagtcccagctactcgggaggctgaggcaggagaatggtgggaacccgggaggcagagcttgcagtgagccaagatcacgccactgcactccagcctgggcaacagagcaagactctgtctcaaaaaaaataaataaataaattatgaatgagtattttctagaaattcaacttgctaagcctgtaatacttaagggtagtttatctagatacagtactttcttccctgataagtagtatcattggagcccttaggtataggagaagaggaagaagtttaaaaagtgtaagtgggccgggcgtggtggctcatgcctgtaatcccagcactttgggaggccgaggggggcggatcacgaggtcaggagatccagactatcctggctaacaaggtgaaaccccgtctctactaaaaatacaaaaaaaaacattagccaggcgtggtggcgggcgcttgtagtcccagctactcgggaggctgaggtaggagaatggcttgaacccaggaggcggagcttgcagtgagccgagattgcaccactgcactccagcctgggcgacagagcaagactccgtctcaaaaaaaaaaaaaaaagtgtaagtggattaaaagagaaacttggtctagttcataatatttttaatagggctttccctggctgctggaaaacttaggccagtaagcatctctttgtttaaagtcctacaagacaatttgaaataattcattgttcatgccaaaattctaagtactgtttttcttagcaagtgtaacataatcaggaacaatgggtacaagtaaaacattctttggatgatattcaaagccttattagcactgcacctgaataataggtcattttgcctcactcatttgccaaagtagccatttctaagttaaggaagtttttagataggctcatagccttgtatttcgttttagattgtaagctcaatggcagggatactatattggtaattatgttttcatatagcaaccaccacagtatattcttggtgcttaataaatgtttataattgttaacaataa

SEQ ID NO: 111097 - DNA, 1087 bp, Homo sapiens
catggtctacagactggaatgcagtggtgtgatctcagctcaccacaacctctgctgctgaggcaggagaatggtgggaacccgggaggcagagcttgcagtgagccaagatcacgccactgcactccagcctgggcaacagagcaagactctgtctcaaaaaaaataaataaataaattatgaatgagtattttctagaaattcaacttgctaagcctgtaatacttaagggtagtttatctagatacagtactttcttccctgataagtagtatcattggagcccttaggtataggagaagaggaagaagtttaaaaagtgtaagtgggccgggcgtggtggctcatgcctgtaatcccagcactttgggaggccgaggggggcggatcacgaggtcaggagatccagactatcctggctaacaaggtgaaaccccgtctctactaaaaatacaaaaaaaaacattagccaggcgtggtggcgggcgcttgtagtcccagctactcgggaggctgaggtaggagaatggcttgaacccaggaggcggagcttgcagtgagccgagattgcaccactgcactccagcctgggcgacagagcaagactccgtctcaaaaaaaaaaaaaaaagtgtaagtggattaaaagagaaacttggtctagttcataatatttttaatagggctttccctggctgctggaaaacttaggccagtaagcatctctttgtttaaagtcctacaagacaatttgaaataattcattgttcatgccaaaattctaagtactgtttttcttagcaagtgtaacataatcaggaacaatgggtacaagtaaaacattctttggatgatattcaaagccttattagcactgcacctgaataataggtcattttgcctcactcatttgccaaagtagccatttctaagttaaggaagtttttagataggctcatagccttgtatttcgttttagattgtaagctcaatggcagggatactatattggtaattatgttttcatatagcaaccaccacagtatattcttggtgcttaataaatgtttataattgttaacaataa

SEQ ID NO: 111098 - DNA, 1511 bp, Homo sapiens
aaaggcccggccgtattgtgaaactcactataacccagcctatttggtgatgtttgcttcccactgcaatcgtgttatagaaggtgatgtggtctctgctcttaataaggccctggtgcgtgaacctgctttgcctgttctacctgcaacactaaattaacactcaagaataagtttgtggagtttgacatgaagccagtctgtaagaagtgctatgagaaatttccattggagctgaagaaaagacttaagaaactagctgagaccttaggaaggaaataagttcctttattttttcttttctatgcaagataagagattaccaacattacttgtcttgatctacccatatttaaagctatatctcaaagcagttgagagaagaggacctatatgaatggttttatgtcatttttttaattaaaaaagaaaaattcatataatcgtgtttaaaacacaaatgaagtcagtatttgcctttgttaacccttatccatttgttgacatgtagactgtttacaaaaaaaaaacacatggttaaatgttaaattttaattaaggcccccaaaaattaaatataactttttaaaatgaaaggagtcaccttttacatgactcaggtgaaaaaacagtataaacattaatttactttgtgttcaaaagaaaattccaactgctgttggggaaggacacagaaaagaaaaataaccacccaagaaaaacaaaaacaagaaaaacaaatcttatacaatcttagtatatttatcaaactagtagctagaaagtgaatatgcacattactaagacaaaaaacaagtgtaattcagaactacttgattttttttagttaaatgcaataattattatgcttagttttataacctgctctccttgtgaattcttccttcaaatgattacttaacgcagtagtaatagctagctagtaggatgtcctttaaatttttgtgcaaaaaaaaatttataccaggtatttggaaatatactttacaatattggaaaatgaagtatttttaatgtattacagcaattatgtttctaagcttaatgttaagcatgtagtcttagaataggacatgaaattaaattgtatgtagcttggaatatattgcttcagaaaactgaatgtgtatgtcggtcatattgcctttataaccatgctaatatctatgctttatacatactcaaacttgccttgccttaaaaaaatacatactacatacttaaatcaggaattctagccatctcacagaataccaactaaaactaagtgcattgagatctgagattggtaaacccagattcatttaccacagctgtaattaagtttttagaaactattctctttttggggaaatccattgaagttaatttctgttatcttattagaagaaaatgatgttgatatgtgtttcagattttccatttgaaatcttataattaatttgatttatcccctcaggtttttacgcctatccactaacactcttaaa

SEQ ID NO: 111099 - DNA, 332 bp, Homo sapiens
ctgggctcaagcagtcctcccattttggcctcccaaagtcctaggattatagatatgagccatccacccagcctatactttttttaattaccatagttttatagtaagttttgaaattggacaatgtaagtcctcctactttgttctttttcattattatttttggctattcaggggacacttgcaatttcatatgaattttaggaaccgtgtatccattgctgcaaaaaggcagttggaattttgataagaattatagattaatttggggaaatattacatacaatcttaattataaactattacctctatatacattgtttacctgtttt

SEQ ID NO: 111100 - DNA, 171 bp, Homo sapiens
ataatttgactacacaagagtaaaaatagcatgtattcgaatcatagtttaggctagatgtggtggctcacacctgtaatcccagcactttggaaggcagaggctggaggatcatgtgaacccaggaattcaagaccagcctgggaaacatagtgagaccctatccctacc

SEQ ID NO: 111101 - DNA, 365 bp, Homo sapiens
attttttctttagatacttattattaatatattctctaattataaaatcattaaaatcggaaggagcactctaaataaagcaaaattgtcttaaaaatgttttttattattacaaagcaaattggtttatataatgtatatttttacatgataaaaaaggtaaactggatcctagactagacaccatcatcaaacatgagaagctaagcaaaattttggagaatgggtatggtaaatttcccttccttttaggaaaatatgacttttttatagaagaagggaagggctagaagttctcatgaggctcctcaagaagtttgtgtctggggcggtcagtctgccttggagcaaattccagtgtcact

SEQ ID NO: 111102 - DNA, 381 bp, Homo sapiens
tcttcacccttcattttaacattgcctctcaacccaatctgagcattttctctccgaagatctgcccagattacagtggtttactctaaaatttggtctctctcagtgggagctgcacttcctggctgcatctagtcagccatcttaaccttatgtctcctttgatctttttgctattaatcagtgcagtttgataatcacttcatctcctgatatacttggcagtctcactatttcaaagaagggagaagttcaacaatgtactatgtataacccgtaaagtactcatggaatcaattttaaaatggctatttttagctcgcattttagattctgcaatgaaattttatatgcaaccatactgtctaaaatgccttacca

SEQ ID NO: 111103 - DNA, 384 bp, Homo sapiens
cactcccagtgttggtgattttctcaggaggactcacagccctcatcacgtggtgctatcctcacagcatggttcattactacgaaaggacacagagcaagccagcaggggaaagtcacgtggggcagagtccggggatctgggcgcaagttcccaagagcctgtcctggtgcagctacacaggacaaggttattttctccagtgtcaggttatgacaacacttgtgaactgtcagctacagggatactcttagggactcagcgcccagggtttttactagggcgtagcatgtacccaaattctaggctccctgagggaaagcaggtgttcagtggaaagcacacttgttaaaagtggctgaggcacagggagccacccttacc

SEQ ID NO: 111104 - DNA, 192 bp, Homo sapiens
cgctatgaatacacacattgtagtacatgtgttttggtggggatatgtgtttctgttgaatgtgtatctgggagaatttcattgtcgtaagccttatgttaacagtgttccaatatatactcccaggatatgaaagtgcaattgctggctgggcatggtggcttgtgcctgtaatcccagcactttgggaag

SEQ ID NO: 111105 - DNA, 346 bp, Homo sapiens
caacctggcatgtgaaaatacctatgaaggctggacacgtgtcatgcctgtagctggaactcttcaagttaattgccttattttcctggcaggaaacagcttataaccacacacatgacttgagccaggaagtcagcttcagcttaatcaatatttagagtgtgatgtgttgctaatcagtgttggttttgtgcataggaaaggtagccacgactcgtggtgaatcagctgcccacaggtctgctacaagccaccggatgccagcttccttcattgcatgggtgcctcaaagcaccttcttgaagggtttagaccatgttctgcacaggccatgcagggtgatttt

SEQ ID NO: 111106 - DNA, 614 bp, Homo sapiens
gttggacaatttaacctctaaaaagactcaacttccttaattgtaataacataataatagtatttgtagggctgttgtaaagcacataaaagtaagaacctaatacattatagctattatttttatttctattttaatagatattagggaaaaaatgttaagaatatagaaaattcattcataactaaagaagaggatttatttcacaggacacagcaaagaggttaatagagtgtaaaatacaaatacagagggaaagatctaggctaaatgtggggaaaggcagtggccaaagagttgatagtctgattatccaaagctagatctcagggtgggctggtcctacctatttcccagttcttacataatttcattaatgtgtatgcctggaaaaagatgactaaataaaataccaataactctatttttgggtcagtgccagtagggagaggcacaatcatttgggcataattttatcagtgggaggtctgggaatgagtttggatgcagtccttttcaggtattgtgaaatttcttagtaaggagaaaaaatttaaaacataaactaattcatgaaatcctcttattaactgttactgtgataaaaatctatg

SEQ ID NO: 111107 - DNA, 624 bp, Homo sapiens
tgatctcttctgtcctttttgatggcttttcctcttaaccttgtaagaacatgctagacttgggtcctcctctgctgttccttacatatatatattttatattttttttctttttctttttttttgagatagagcctcattctgtcacccagctggagtacagtggcgtgatcttggctcactgcaacctctgcctcccgggttcatgcgattctcccacctcagcctaccaagtagctgggattacaggagcaccaccacacctgggtaatttttgtgtttttagtagagatggggtttcactatgttggccaggctgggcttgaacccctgacctcgagtgatcctcccacctcggcctcccaaagtgctgggtttacaggcatgagccaccatgcctgtcactcatctcagtcacagctgccacagggaccccaagcccgttataacccaggctgtactttctgctttcacctgccccaaatctgctcctcctcgaagggccatctgtgggccaggcgctccagtcccctcactctgttcccacaagccagcagccagtgaccaaggctgtaaatcctgtcattgccttgatgtagtcaccaatatttatgtgacaccata

SEQ ID NO: 111108 - DNA, 384 bp, Homo sapiens
gagattacaggcatgaaccactgtgcctatcctggactttattttttaaatgaaaccagaatgccagtttattgatatatgagaaatggaactgctaagcagagtagattcctttttttttgaggacagtgtatgcttcctttcggaagaatagccaggtgaagcaaatataaaaggagaaggctacttatactggctaagtatagactcaggacccagtgaattggaaatcaaaaagacccaagagctttaatgctggagaaagattaccatgttaatgcttcctcaaaactggctatacatgaaaatggcacagggagcttttgtttaaaacatgctcacaaaagagtgtaaattgattcaaccattgtggaagacagtgtg

SEQ ID NO: 111109 - DNA, 536 bp, Homo sapiens
tggatttgacttattcagtatacaaaaatagagatcattaatgcaatcatcagtggcaggcctagtgaagtgggcctaggaaaactgtcccagattctcactcttgcattttctctcctataaagacactccagcaattcgagttcaaacaagtaaaactgttttgaacaccaaggctcttgttcacttcctaaattacccctaatagcactgttcttgctttgtttttgaaattaaaagcagttatttcagagtcttgcttgtgtctctgattatatttatgcactatttaaaatcactgctgaggccaggggtaattcgtactggtcatcttctctgggtgtgagtcaaatataagtttaacaattagctctgaaaacattccattgagctggggaatgcaacagtcttattacctcatcatggaattctctagcttagttaatttaaatattgtttcttagtttctgggtcaattaaatttaaatgatgtagtttatgcttcgtgaccaattaaattactaggttattacaaa

SEQ ID NO: 111110 - DNA, 145 bp, Homo sapiens
gagccaagtggatttctctccatccctgaaacattctctacattttatcacactctcctgcttaaaaaccttgattaatgtatacagatagtatgtgtataaatgcacctatgttggagtcaagtggatttctctctatccctga

SEQ ID NO: 111111 - DNA, 599 bp, Homo sapiens
gcacatgtatacatatgtaacaaacctgcaagttgtgcacatgtaccctaaaacttaaagtataataataataaaattaagaaaataataaataaagttacagtaatatatacattcatctgaatggtctgtcttttgcacagttatgatctgagttctagatgtattattaatggcttcaaaagtgtgaggctatgaacgcactgagatcataattactgcggtatagatgataaaatgcccactataatatggatttaagtagaaagcagggtacattggatcacagctatatgattttctaaatgaaaatgtcaaatagtactcaatatcacaatctcttgtagtgtagcgctacatcaaggtaactaagcatactgacagctgtatttcaaggcccagttgtcccacttctatctggggtctttcaaaatgttacctaccactttatgtctgtacttctctcatttggtggtgacatgaagaatattaataacacagattttagcaggcttccacagcagtggtgactcctacaaattccaaattatttcttctctcctttgatctcacatctttatatcactctagtaaaaatt

SEQ ID NO: 111112 - DNA, 350 bp, Homo sapiens
ccagcaaatgccaagtcctgaacttaatcctgtctttcagggcagccactcagagatccatttccaagttgtacttacatagcagaaaaaaataaataaataaaaaatgtttcataataatgtgatccatcacattctgccagccaaaattctttgcctgctcctcaaatgtagggtccacaagcaagagaaagaagtactgaggtcctctctgtgagtctcctcttagagcaaacagtctcctgtttgaggctctgaaccatcattggtgacacagtccaccgagattttctaccaccatatagagctgcccaaactttgccagggcagtgggcgatgctgcctggcag

SEQ ID NO: 111113 - DNA, 352 bp, Homo sapiens
tgcctgcagtcctagctactcggcaggtgaaggctgcagtgagcagagatcacgccacctgcactccagcctgggtaatagagcaagactctgtctcaaaaaaaaaaattactatatctttaggatctgtggagaagagaggctgaaaattaaaaacatcaacctgccaataagattgtctctagaagaggctggccatggtggctcgccccggtaatcccaggactttgggaggccgaggtaggcggatcacctgaggtcaggaattcgagaccagcctggctaacacagcaaaccctgtctctactaaaaatacaaaaattagccgggcatggtggtgcatggtacacac

SEQ ID NO: 111114 - DNA, 364 bp, Homo sapiens
catatctgaattggcctgataaaaagcctaaatttccctttttaattttcttattttttaaggaagattagaagccagcaagtcctgtgaatttcatttctcattgcattctcctaaacctcatgcaccttctgattaaaaggaagggtgtagtcttcatcttgaatttcattttgacaaaaaaaattagtttcaatcatttttctttataaatatttgtaaactctttcctctgtgcattggtgccagagtctggctctattacggtcatccacaattgatcttgaaaatatggcagaaatggtatgctggaagccttggagaatatgttttaaaagttcagaccaagttctgttttagtcag

SEQ ID NO: 111115 - DNA, 683 bp, Homo sapiens
tactctcaaattatatgattagaacttattgttcctgatacttaaccagttttcaattcaggtggctataaaccatgaatactttggaaacttctacgtggtaattagacagttatcaaaattttgtattcagagagtattttagatatgtactatatgggaattataatattttgactacagaataacaaataactgatatgtgttggatttttaaatattaatccttactaattttattctgaaatgtacacataaggtattctggaatcacagacagattatcatctgtcgtttcaagcaaataatgaccattttgttccccacaccctgatgcttaccgcaggggctactttctgaaacccaggtcaaatgccctatccatacaagcttcagagtctgtatcatagatgaagaacggagaaataggttttcttctgttcttgatttatatacaggaaagagacaactaaccccctccctcctgaaaggagaaaaaaaaaaaaaccttttgctccattgacctgttggagaattagagtcagccagatgtgagataattataagaaaaactaccaactttcttgctatttttaaaaaacgatttatgtcctgtttttgtttgtttgttgggtccctcagcaagggtccagcctgggcaacaagaacgaaactccatctca

SEQ ID NO: 111116 - DNA, 515 bp, Homo sapiens
gatgcttaccgcaggggctactttctgaaacccaggtcaaatgccctatccatacaagcttcagagtctgtatcatagatgaagaacggagaaataggttttcttctgttcttgatttatatacaggaaagagacaactaaccccctccctcctgaaaggagaaaaaaaaaaaaaccttttgctccattgacctgttggagaattagagtcagccagatgtgagataattataagaaaaactaccaactttcttgctatttttaaaaaacgatttatgtcctgtttttgtttgtttgttgggtccctcagcaagggtcttgcctgttgccccggctggagtgcagtggctggatcatggctcaccgcaacctccactttccaggctcaagcagccctcctgcctcagcctcctgaggagctgggactacaggtgtgcaccaccatgcccggctaccaactttcttgcttttaaagacaattcccaaatgattttttagtttagaaatgattcagg

SEQ ID NO: 111117 - DNA, 317 bp, Homo sapiens
cataagcagcttgataaaacgccacaagttttatgaaaataattgcttcaaaaaatataaaaagcaactgtagtttagatggattttactggccaaactgccaatattactcattaggatgcttgaaatagtactgtcttcatagcttctatggtgagcctgtataatttgaataacttatatttattatccttctcattttcaactagatgaaaaccccaagactacagatatttctaccacatattttaaactaaacccatatgtaaagtcccttcgctggagcgttaatatgtactcagaatttgttacatatt

SEQ ID NO: 111118 - DNA, 340 bp, Homo sapiens
aactttataataacagattttaaatttagatttttacataaaattgtgatataatagataaaacatttctcagaaaaatatttttactatagataaactatcagctattgtaaaatctttttacaaatgaagctaagacttttcaattttatttacaaacttttacaagctttgaaaatttggcaaaaccttaggataaaaatgactgttgaaattattctaaaagaaaaaaggttttgttttctgaacgatgtgtccttctcagtgacaaatacatacagaaaaatactcctttttaggaaaagtgtaaagggaaatggtagaaaacttgccagatatc

SEQ ID NO: 111119 - DNA, 317 bp, Homo sapiens
agaataccatcccaataaacataattcattttgttaacttcattcagtgtctcatcacacattctacctgggatttatcttttctaagttttattttattttaaattgacaaatagttgtatatacttttggaatacaatggaatgttttgacacctatacatgtggaatggtcaaatcaggctaattagcatactcatcacttcagatatttatgatatatctttaatctcaatcactttcatatatcatgctttggaattatcctaaaacttggatttctattgaaggctacactcaaggttgaggatatgttgt

SEQ ID NO: 111120 - DNA, 502 bp, Homo sapiens
tccggcgttcctccagcatgatgtgtctgggtcttaggatacaggcttaggataaaggaagtgaattttcatctccaacaggttacatttgaagatgcttctcatttactgcaggagtttgaaaacattgtaatattctcctttaattatcagtatctcagtgggaagcctgacattataattagcacaggctcctacatgggatgacattttgctcaacatatcatgttcctggtgtgcactgaggcagaagccggtagcacacttctaaatgacgctgttggatttgagcatgagagttggcaccaacgcccagagggcaaaatcacaactctgggaatcctccgtgatcccaaataaaagtggcagggaaacttttagacattctgtcatctcctgcacaggcgacagacgcgcagatgcctgagccctactttctggccttcagatcaaggaagctacagccagagtgaaagtctaatgctgcgctaggattggggtt

SEQ ID NO: 111121 - DNA, 720 bp, Homo sapiens
gtctattgaccaaggaatcacttcttacagatttccagcagtgtcattcacatgcattaaaatgtttaaaatgaaatgtatatgtaacttactttcaagttagccacctttccctttgcattccctcaccgttaccgtggtcctccatctacccctagcccaactcctaaatagttctggagctctgtagtttatagcactttaacaaattacttcagagaaacagaaagccctgtgctaaactttgagtaaaatcccagcagtttaaaccctgtgcatcagcgttcggaaggcattttctgcacgactttctcccacttcccttcccacctgccagcctcttcctgctcacaccactgtggccccctctccagcgggccccagtggccagtgttctgtgctcacccactgatgtcattcttagctccctgttcattccctcctgtgttcccagcttcttccgtgctatttgtgcagctcagaactcacatccttcatgaggcctccttgtctggttactaccctgtcccctccaacgagttattcctcctgctcagcaatctgcatagaggccgtgtgcttttatttctctgcaactgatctcagtttgtcagttaatgtgtattttcttcccagctaaatcacaactttgataggtcattttctcttgcatgtcttctccaattctgttctacccattcagtcaacacataggaattg

SEQ ID NO: 111122 - DNA, 484 bp, Homo sapiens
catttacctttttgaacattttctctgtaaaatggggcagtgttccccacctcatagcaatgtgaggagggttagatgatatagtgctgtaaggtgcccacaagggctggtgctgaagagattgtcaacacaagttctatgaagtcacaccatgtaggtaactttctacttatgaatccagacttaccccaaacttccatctctcacacactcaatcagaggcctatgtgggagtcccttttctcctggttcctcccttcatggccttgtctgcctgcaggaatatttggtcaacatgctggatcccaagttgttgaaccagctgctggtgaagaagggaagtggctgcaggggcttcgtgatgacgctggcctgccctgaacttgtgcctgtcctctggcctcctgtccggccatcctcaggctgagggaggaaagaggctgctgagcctggagtgagctgccagctaccaagaagtccctcc

SEQ ID NO: 111123 - DNA, 3748 bp, Homo sapiens
agcggcgctccgctcccgcgcggttgggagtgtccagcgccctccgcgatttgggctccagcgggcagggtgacttcctttttctgcccactctggtaacttattgctctgctgggctctttcccttagggtctctggccctgttcttgccccagcatgacttttatcgggacgccgttgtggaagcctcacgcaggagccctgcccccgtggagaagatcccactggtgactccaaccctaccaccatgaatggggtcctgatcccccatacgcccatcgcagtggacttctggagcctgcgccgggctggcaccgcacgtctcttcttcttgtctcacatgcactcggaccacaccgtgggcctgtctagcacctgggcccggcccctctactgctccccaattacagcccacctcttgcatcgtcacctacaggtatctaagcaatggatccaagccctggaggttggtgagagccatgtattacccctagatgaaattggacaagagaccatgaccgtaaccctcctcgatgccaatcactgtcctggttctgtcatgtttctctttgaaggatattttggaaccatcctctacacaggtgattttcgatacacaccatccatgctaaaggagccagccctgacactggggaaacagatccatactttatacctagacaacaccaattgcaatccagccctggttcttccttcccgacaagaagctgcccaccagattgtccagctcattcgaaaacacccacaacataacataaagattggactctacagcctgggaaaggaatcactgctggagcagctggccctggagtttcagacctgggtggtattgagtcctcggcgcctggagttggtacagctactgggcctggcagatgtgttcacagtggaggagaaggctggccgcatccatgcagtagaccatatggagatctgccattccaacatgctgcgttggaaccagacccaccctacgattgctatccttcccacaagccgaaaaatccacagctcccaccctgatatccacgtcatcccttactctgaccattcctcttactccgagcttcgtgcctttgtcgcagcactgaagccttgccaggtggtgcccattgtaagtcggcggccctgtggaggctttcaggacagtctgagccccaggatctccgtgcccctgattccggactctgtacagcaatacatgagttcttcctctagaaaaccaagccttctctggctgttagaaaggaggctaaagaggccgagaacccaaggtgttgtgtttgaatcccctgaggaaagtgctgatcaatctcaagctgacagagactcaaagaaggccaagaaagagaaactttctccctggcctgcggaccttgaaaagcagccttcccaccatcctttgcggatcaagaagcagttgttcccagatctctatagcaaagaatggaacaaggcagtgcctttctgtgagtctcaaaagagggtgactatgttgacggccccactgggattttcagtgcacttaaggtctacagatgaggagtttatttctcaaaaaaccagggaggaaattggtttagggtcccccttggtacccatgggagatgatgatggaggtccagaagccacagggaatcagagtgcctggatgggccatggttctcccctgtcccacagcagcaagggcacccctcttctagctactgaattcaggggtctagcactcaaatatcttctgactccagtgaactttttccaggcagggtattcttccaggagatttgaccagcaagtggaaaaataccataaaccctgctgaagacaggagagtacagaatgacaacattgagcccacactgcagttttgaagatagtaactgatggctggtgggaaagagtttgtttttggggcctacttttctatctttacaagactcttatgggcccaccgtggagcagcacttcccaaaacttgttcactggggtcctcgtgcctatggaatccttctttttataactaagtttaagaaatactttttttataaaatctttggagtatgcgtgagcaaattaaaagttctttgaagtcctacagtaacttaatctgtttaaccttgtttaacccagtatttctcaaacttttgtgaacatgcaatcatcttatgtgggtacagaaagaggtaaagagtctgaatcaaaaaggaccaggttattgctgttgctgttttgtggtgtcatgagccattctccatgtccccttctccctcttctcagatcaaaatccctagggagttctatttttaaaattatgaactatggcgctgcatgcttcaatcctgaacgtcactgacttgctgtgaccatccaaataattttcctgtctctgcctctgggagggaacaggaagcgatgaagaggtcttggaacagtagtgaaaattctacctctatgtccttcatgaggatgtgcagtatcccagtatcactgggatccatgtggaacagagccagctggggggttgggcagctctctccaaggcagtacctagagcccagctgaacaacaaggctttgggtgtgaagggactccccagcctggagaccctatttggctgaaacagttacaaaatatcaaatgtgttgtcagatattcctccaattgttcacatagctgggatatttgttgctcccctcaccccttggattatgtagggagccagtgcacacagcctgtttgttttagtatccaaggaagagaccaaggagccagctggcgggaaggggtgggggtgtgcagtctgccctgtccttctgctcataacctgacaaaatgccaaactagtaagcaggatagctgataccacggctatgagggagtaggctctgagagggcacagacttgtggagctgggcgtctggatcaaaactgctttgggatggaacctcgagccctagcagtgaagaagattccatttcttgtccaggggatttaaaagagttttctgctttgagagagaaatagagagtttagaaagcaattgctcttgggaaagctatacacagctctgttttgtcaatgacctttgttgtaagtctcccaacgtcctattaggagccacagcaggtgaggcatttggtgcagcaggaaacatggggactgcctaggctcgaatctgtggcaccctgagcaattacttaaattgtggagcctagttcctcatctgtaagatggacttgagattcctacctctcatgattactatggagattgaataattggtaaaattctcctagctcagtgactgccacaggatgggtctttcagattttggttctctttagcttctggttcttgaaagaaattaatctgtatataacataagaaactttgaaagtcaaaaaaacaaaaaattttaattcctcgtagattaattgatttgctatcttttagtttttttttctatgcatgtagatgtattaaatatgtaaatgtttttcaaagttgaggtaatattgtatagaattttatagcctacattttaatttcttgatatcttaagcatttcacttattagatattgttcaaaaatgccatttttaatatttgtataataccctatcatgtgagtataccttaactaagccattcccatattcaacattttgtgtactgtttttctaattacatatattacaatgaacaaccttatgcataaaaaaag

SEQ ID NO: 111124 - DNA, 3695 bp, Homo sapiens
ctaacgttacttgcgtctgcagtgggcatcatttcccattaagggtctcgtggccactgattcgtttgacccctagacagtagacatttattaatcgggggaaacgacacgtatggtcggtaaagacacatcgaccgtcgacggagccctgcccccgtggagaagatcccactggtgactccaaccctaccaccatgaatggggtcctgatcccccatacgcccatcgcagtggacttctggagcctgcgccgggctggcaccgcacgtctcttcttcttgtctcacatgcactcggaccacaccgtgggcctgtctagcacctgggcccggcccctctactgctccccaattacagcccacctcttgcatcgtcacctacaggtatctaagcaatggatccaagccctggaggttggtgagagccatgtattacccctagatgaaattggacaagagaccatgaccgtaaccctcctcgatgccaatcactgtcctggttctgtcatgtttctctttgaaggatattttggaaccatcctctacacaggtgattttcgatacacaccatccatgctaaaggagccagccctgacactggggaaacagatccatactttatacctagacaacaccaattgcaatccagccctggttcttccttcccgacaagaagctgcccaccagattgtccagctcattcgaaaacacccacaacataacataaagattggactctacagcctgggaaaggaatcactgctggagcagctggccctggagtttcagacctgggtggtattgagtcctcggcgcctggagttggtacagctactgggcctggcagatgtgttcacagtggaggagaaggctggccgcatccatgcagtagaccatatggagatctgccattccaacatgctgcgttggaaccagacccaccctacgattgctatccttcccacaagccgaaaaatccacagctcccaccctgatatccacgtcatcccttactctgaccattcctcttactccgagcttcgtgcctttgtcgcagcactgaagccttgccaggtggtgcccattgtaagtcggcggccctgtggaggctttcaggacagtctgagccccaggatctccgtgcccctgattccggactctgtacagcaatacatgagttcttcctctagaaaaccaagccttctctggctgttagaaaggaggctaaagaggccgagaacccaaggtgttgtgtttgaatcccctgaggaaagtgctgatcaatctcaagctgacagagactcaaagaaggccaagaaagagaaactttctccctggcctgcggaccttgaaaagcagccttcccaccatcctttgcggatcaagaagcagttgttcccagatctctatagcaaagaatggaacaaggcagtgcctttctgtgagtctcaaaagagggtgactatgttgacggccccactgggattttcagtgcacttaaggtctacagatgaggagtttatttctcaaaaaaccagggaggaaattggtttagggtcccccttggtacccatgggagatgatgatggaggtccagaagccacagggaatcagagtgcctggatgggccatggttctcccctgtcccacagcagcaagggcacccctcttctagctactgaattcaggggtctagcactcaaatatcttctgactccagtgaactttttccaggcagggtattcttccaggagatttgaccagcaagtggaaaaataccataaaccctgctgaagacaggagagtacagaatgacaacattgagcccacactgcagttttgaagatagtaactgatggctggtgggaaagagtttgtttttggggcctacttttctatctttacaagactcttatgggcccaccgtggagcagcacttcccaaaacttgttcactggggtcctcgtgcctatggaatccttctttttataactaagtttaagaaatactttttttataaaatctttggagtatgcgtgagcaaattaaaagttctttgaagtcctacagtaacttaatctgtttaaccttgtttaacccagtatttctcaaacttttgtgaacatgcaatcatcttatgtgggtacagaaagaggtaaagagtctgaatcaaaaaggaccaggttattgctgttgctgttttgtggtgtcatgagccattctccatgtccccttctccctcttctcagatcaaaatccctagggagttctatttttaaaattatgaactatggcgctgcatgcttcaatcctgaacgtcactgacttgctgtgaccatccaaataattttcctgtctctgcctctgggagggaacaggaagcgatgaagaggtcttggaacagtagtgaaaattctacctctatgtccttcatgaggatgtgcagtatcccagtatcactgggatccatgtggaacagagccagctggggggttgggcagctctctccaaggcagtacctagagcccagctgaacaacaaggctttgggtgtgaagggactccccagcctggagaccctatttggctgaaacagttacaaaatatcaaatgtgttgtcagatattcctccaattgttcacatagctgggatatttgttgctcccctcaccccttggattatgtagggagccagtgcacacagcctgtttgttttagtatccaaggaagagaccaaggagccagctggcgggaaggggtgggggtgtgcagtctgccctgtccttctgctcataacctgacaaaatgccaaactagtaagcaggatagctgataccacggctatgagggagtaggctctgagagggcacagacttgtggagctgggcgtctggatcaaaactgctttgggatggaacctcgagccctagcagtgaagaagattccatttcttgtccaggggatttaaaagagttttctgctttgagagagaaatagagagtttagaaagcaattgctcttgggaaagctatacacagctctgttttgtcaatgacctttgttgtaagtctcccaacgtcctattaggagccacagcaggtgaggcatttggtgcagcaggaaacatggggactgcctaggctcgaatctgtggcaccctgagcaattacttaaattgtggagcctagttcctcatctgtaagatggacttgagattcctacctctcatgattactatggagattgaataattggtaaaattctcctagctcagtgactgccacaggatgggtctttcagattttggttctctttagcttctggttcttgaaagaaattaatctgtatataacataagaaactttgaaagtcaaaaaaacaaaaaattttaattcctcgtagattaattgatttgctatcttttagtttttttttctatgcatgtagatgtattaaatatgtaaatgtttttcaaagttgaggtaatattgtatagaattttatagcctacattttaatttcttgatatcttaagcatttcacttattagatattgttcaaaaatgccatttttaatatttgtataataccctatcatgtgagtataccttaactaagccattcccatattcaacattttgtgtactgtttttctaattacatatattacaatgaacaaccttatgcataaaaaaag

SEQ ID NO: 111125 - DNA, 335 bp, Homo sapiens
accagcctggccaatatggtgaaaccccgtctccactaaaaatacaaagattagctgggcatggtggtgtgcgcctgtagtcccagctactcgggaggctgaggcagacgaatcgcttgaacctgggtaggcggaggttgcagtgagctgagatcgtgccactgcattccagcctgggtgacagagtgagactccatctcaaaaaaaaaaaaaaaaaaaaaaaaagtgaacaaacatcatgaatcatacaaataacaatattttaattaactaactgccttaaacattttatgactttttttccttacatccttggctacatatccttcagtctt

SEQ ID NO: 111126 - DNA, 716 bp, Homo sapiens
aggtagtaggttgcatagttttagggcagggattttgcccacaaggaggtaactatacgacctgctgcctttcttagggccttattattcaccgataacctgtttccttgctactttgctttggtgtaagcagagttctttctgtaggttttttcaaatgaaaacattgcaagaatatcaaagagagcagtgtttgcgttagtgattataaactgcagcatggtgctgacattgataactgaaagtcaactaatgagaatttgagacttctgaagtacacttagttgctagtgtctcccttttggtgtcactggaaagtttagaaagcatggttttgtttttgctcaggtttctctttctgtgatgcagagactctcagctgttcctcctctatgtctacattatgtctgaaggaaagaatttaacaaaacttgaaatactgctgtttttctacaatgtttgtaaatatttatcttgctgcttttctaggtttgtcttctggatttaaaatttggggcggctggggtggaattgcatggtttgggaatgggtaattgagctgctgctcattatggtatgtaacagtgatttgtctgtttaatatgtacaagaactggaaggtcaataaaatgaaagtggttgtcttgactgggtaatagtgttacatattttgttaaaagttatacatcttttcaataaaaacactgcatacttca

SEQ ID NO: 111127 - DNA, 822 bp, Homo sapiens
aggtagtaggttgcatagttttagggcagggattttgcccacaaggaggtaactatacgacctgctgcctttcttagggccttattattcaccgataacctgtttccttgctactttgctttggtgtaagcagagttctttctgtaggttttttcaaatgaaaacattgcaagaatatcaaagagagcagtgtttgcgttagtgattataaactgcagcatggtgctgacattgataactgaaagtcaactaatgagaatttgagacttctgaagtacacttagttgctagtgtctcccttttggtgtcactggaaagtttagaaagcatggttttgtttttgctcaggtttctctttctgtgatgcagagactctcagctgttcctcctctatgtctacattatgtctgaaggaaagaatttaacaaaacttgaaatactgctgtttttctacaatgtttgtaaatatttatcttgctgcttttctaggtttgtcttctggatttaaaatttggggcggctggggtggaattgcatggtttgggaatgggtaattgagctgctgctcattatggtatgtaacagtgatttgtctgtttaatatgtacaagaactggaaggtcaataaaatgaaagtggttgtcttgactgggtaatagtgttacatattttgttaaaagttatacatcttttcaataaaaacactgcatacttcaaaactagtgctttttaagtcatccttaacccttatccccatccttgcagtagtagatgcatttttcatttgtaattattatgatttgttcttagtttcatttttca

SEQ ID NO: 111128 - DNA, 470 bp, Homo sapiens
aataaaactacagggaaaaactcacaagatgaaaacctgccgcttctcccccatgtcccacacctccatacacttcctgtctaatcacagttgctaacattatttgtcctactttgcagaagtcaccaaatgcttaggaagccctggatctatcaaaatgtgtcatttttgcttttcagaaaatgagaaaggaatgaaacagaaaaacgcaatggattctttctttaatcaatgtcaaagacatctatctcatcacatgaatggaagcctagacgtgtcatctcatcaataacctgagagaccctaaccatcagtgcatattgacatattaccgcttttgctttttaaaatttactacaggccaaccagatgggaagtgttaaggtggcatcttctcatcagcacagtgatgaactgatcatgcaaaaccaatcctgaaggattttacttggaaacattacatgaatcat

SEQ ID NO: 111129 - DNA, 393 bp, Homo sapiens
gctttgctgttgtttgctggcctcatgacccttagtaaatcattaatctctctgagccttagggccactgagagaatgtatttaagggccacataatggcctgtgaaaacagtatttgttgttggtttttattgccaatactactttaagtttaaggtgcctgaagggcattagaagcctgctagcacctgtgacccttgcaggttacttctcgtgtcttgatttccaagcattagtgatgactaccttggaagctattggctgatagaggatgagcttgaatgctgttcccaaagtctcccgtctcccaagtttccagtgccttctcagggcaatgaaaatagtttgtggacagctgggggatggtttcagtgtcaaactttgggagtaaaa

SEQ ID NO: 111130 - DNA, 827 bp, Homo sapiens
tttcttttctttctctcagtatggaaggagacagagaactgtgactgcctgcaggtcttctaggtgacccactcactgggcagaggcacaggctctggaatgggcactctcattagcaagatctgagaagagtaccctgattgcattgtgaacatcttcagtgtagtgccttcacccaaagtgacaccaaggtcgagccctacagtgccaccctctctgtccatcagttggtagagaacactgatgagacgtattccattgacaatgaagccctgtataacatctgctcccgcactctgaagcggaccacaccaacctacagggatatgaaccccctcgtctcagcaaccatgaacagtgtcatcacctgcctctgtttccctggccagctcaatgccgacctccacaagttggcagtcaacatggtccccttcccacatctccatttctttatgcctggctcttcccctctcaccagccatggaagccagcagtatcaagctcacagtgtctgaattcacccagcatgtcttcaatgccaagaacatgatggctgcctgtgaaccccgccatggcttatacttcaccttggctgctgtcttcactggtcagatatccatgaaggacgtcaatgacaaaatgttaaatatgcaaaacaaaacacggcagctactttgtggaatggatctccaacaacgtcaagaacagtctgacatcccattctatggcctgaaatggtattcactggtattgtcaacatggtcttccaaagctcttcaagtacatcgcagatcagagaaagggatcaagtggggaaaagagaccat

SEQ ID NO: 111131 - DNA, 118 bp, Homo sapiens
cagagaggcttcaggaagcatgttgccaagatgaaagaaccagtgcccgagtggaggggaaagacacaggaggggactgggcatggagaggcccccaagggaggtgtgtggtccggca

SEQ ID NO: 111132 - DNA, 1570 bp, Homo sapiens
tacatgacaagatgtttagccttattggtatattcgtatcagggaaagcaaactaaaaccacaatgacagggtgatgtcagcgaaaatggtagagtaggacttctgtgggtcatccctctgcagaaacaccaaacaccttgacagaaaagtcagaatttagcttatcaaaactctggaaaggtaatcaaaggtttacagcagccaagcaaatacttcgccagaagaaagggcactgaaacaaggtaagagatctttgtggcattttagcttaccctagcctcacctcccttcctggtatggctgcagtcttgaagatgacagcctgtgttccccatgctggtgcctgattccagagagtggacactcttcctcctgagggattctgtgttctgttttgtcctttctccaaaggactgccaccaggggcaaaaaacaaacaaaaaaaccaaaaaaagaaaaaaaaaaaaacagggcaaacaataagatattgaaagcctgagaggaaaagctgtagagtgagtttttgtagaggaataggagctttgaaaagctattgtggatgagaaactagaaagccaagtgcacagctcagggcagtatgtgtgctcagaaaagacctgagaaagccattagctttcacctctggcttgtctttaggttcaacacaaacaggaagtgaatattaaggtagatttataaaggccctgggtaagttttgaaggagtgccccaacagctaatcagtagagacctggcgagcattttacttttctttttctttcttttttttttctttttggtttatttgttttgaaatgtggtcttgccttgctcaggctaatcttgaactcgttggttcaagcgatccttccacttcagcttcctgagtagctggaattacaggcacacaccactgtacccatctatttttgtttttattttttacacattataaatgttcagtttttttaaaaaaaattacgaagcatgtgaagaatctagaaaatatgcttcattcacaagaaaaaagaaatgaacagaaactaccccgaggaagcactaatactagaattactagacaaaaactttaaatcagctgtcttaagtatactcaaagagctaaaggacaccatggacaaagaagtaaaggaattcaagataataatgtctcaacaaatagagaatatcaataaagagaaatttttaaaagtaggcaaagagaaattttggagctgaaggttacaataattgaaatgaaaattcactaggggagctcaacaaaagatatgagcagacagaagaatcagcaaacttggagataggtccactgaaattatatagtttgaagagcacacatttaaaagactgaagaaaaatgaacagagtccaggagatgtgtgggataccaacatatatatcatggtaaggagagggagaaaggtgcagaaaacatgtttaagaagtaattgccaaaaccatttcaaatttgacaagacatgaatatacacatcaagaagctcagctaacacccaagaaggataaactcaaagacatccatacaagacacatt

SEQ ID NO: 111133 - DNA, 742 bp, Homo sapiens
ggagcaatgtttgcttctaggactggggcagtgaaaacataagatgatcctggagcatcctgatgtgccagcaggccagaaagtgctcaaaacacaaggatgtggcatgcgtcgtaatccaaagtaaaatataaagagacgtgagtccatactatgcaaatacattgttaattaaatgaatgagaaggaagagactaatctttcccatggaagaatttcaaataatttatgtagaaaacatgagggcaaagaaaatcaccattagaacactatagtgatagtggctgttggcaagatccaatgagggacccatattagtgggtgaaacttgaggaggaaacagggtatttgcaaagcctgaaagtatctttaaccgaatatttactaattaccatggttgttttaatatacactcacaaatatattgttatttctgccttaaagaggtggagtttaattttcctctccttaagtgtgggctggatttagtgactcaattttaacatatagaggatggaagggaaaaataacctcgcagaggagcaacctggcagacacaagctaaaccgagtgattgcggttcatgtcaccagtgatgccttatccccataggatgtgatgaaaaggccacctcacctctgcaacattcttccctcaaatccataatcctagtctagtcagacaaacataaaccaagggaactccacacatatccaactggttttcagcaaaagtgccaagg

SEQ ID NO: 111134 - DNA, 351 bp, Homo sapiens
ttcaatgggacctccatctcctttgttatagccagaaatcttgaggtcacccctgattggaactttccctctcctgtctcactaatcctcagtctcctcccctctaccctgaaattatttgggaatctgttcatttttctccctccctcctgccaccacatctaattcaaatcttggaaagcacttagatcagaactctatgacattggtcttggcagtaatttcttggatatgacaccaaaaagcacaggcaacaaaagcaaaaatggccaagtggaactgtgttaaactaacagctcttgcacagcagagggaaccatggaaaagagtgaaaaggcagcctgtggaatg

SEQ ID NO: 111135 - DNA, 450 bp, Homo sapiens
aaaaaaaaaggtaccactggatttaggacagaagaaattgggagttcctcaataagagagctatagtttgcttggtcctgtgaccttgtttcctaggcagaggcttaggaactaaagaaaaaaatgcaaacaggaagaagaaactttgcagatacatttgtaaatgattgttcaaggatggagtacactccttcccgtgccttggtcctccattaccccagcccctgtcaatttagacaaacctccagaaagaaggaacttggctgacattgaccaagattaaatttcagttcccaggcaaagtgaggtcttaaaatagaaactaatctatatggggcatggtggctcatgcctgtaatcccagcactttcggaggtcaaggagggaggatcacttggagaccacgagtttgagaccagtctgaggaaccttaatgagaccctgttccct

SEQ ID NO: 111136 - DNA, 1523 bp, Homo sapiens
gatgctaaataatgtagagaagacacaagcacttgttttggagacagaatatttgccctctgggcccagatgtgccatttaaaattgagtgttctttcattcatttattcattcttgcccttgtttggtaaagggtattgggaaagatctgtaattaaagataaaagtgtaaaaagaaagaaaaattgccttgaaaacaaaacaaaagtgccagcaacggggctaaaaagataacataatgttatatgcccttgctataaataggtcataatttttgtttcaagatttctagcagccaatgcaaaaaaggaaatcctggtgaaattacacaagtttaggatatcttccagaccacgaatcaaccagtcacaaagaatatgaatacttattttcttaatattaggaacagaaatctcccatgggtcctagtaaggagaacatggaaagtaagtgattacgtcaattgtagtatcttttaaaagcagtattgagttttataaggaagtcacttcttcttcagcctatacacttccataatttggagatgtttgggcttcctttaaggttcctttcagtttcaacatacgtgactctaagctggaacccgatgagatcagtgagttgttaaatgtgaacatgatcaaactgaattaaaaagctgttaagaaattagatatctcatcttcagtttttggactttatgatttttctttccattcctaatgttttttctatcacagaaaaaaagtctcatggtaactgcttttaattttgactattttctattcttccaagaaaatcatttattttaaacatacaacttatcttttttagcatattctgattgatgcaaatactcttgtataactttcaatagtcaatgaaatattggataaaatgtatttctaagaagatagccatatatgtgtactttttcaaaattgctgctttttgcctattattgtttgctcgtttgtcttttggttttgccttactataatagaagacttattagttatatttaactttcctcctttgaggaactaatcattatccaacttaattcataaacttcacagatggcatttcttcttaacttagaactatttttgtcttactattctgattctttcttctataagacagcctcatgaaacctaaacacccaacatggaaatattagatggcaaatatgttttccattttgtttggccttaattttattcaggtaaataattgggttgtgcttaacttacatggaatactgcagtttatatgatgtgtcataacatcaaagctaaattaaggaacaagggagagagttgtgcttttttccaaactagtacaacttataatgttatgctgttttttaaaattattgtcagtcttgtttctcttatagcacaaggtctctcttaattatgtaatttaaaaaatgtatccttctcttcaagaccagcctgactaacatggtggaaacgctgtctctacttaaaaatacaaaaattagcctggtgtggtgg

SEQ ID NO: 111137 - DNA, 429 bp, Homo sapiens
gtagccagggtttagatgaggtatatatgctttttagcctgaaacaagatggtaactacagtgaacaacttcattttgtcttttttgataatccattcagttttctttttttgtgtacttttgcatatagaggcacagccttcactgaatggtggtgtctccatggaagcaaagttgaaacttatgaatatctggaaatttcaaggaaaaactaccttctgcctaaatcatttgagaaatactagccaaaataattgtttcctatcaggaactaattatatcatgacttaacactgccattgatgctagttatctgtattaagtaaacatgtcatagggttagtttgtgtagacaaatgacatttgcattattttttcagtgcagacttttttttctttctttttttttttttttttttttgagacaga

SEQ ID NO: 111138 - DNA, 309 bp, Homo sapiens
cttatgtccagcaagggagaaaatattaatcccaatatggaacagggtgtacacacccatgaggtattgttcctaatatccagggagggaaaggatgatattactcccaatgttgcagtggtgtataaccccccgtgatattgttcctaatatctaggtggggaaagtacagtattactcccaatatggcaggggttgtacaccacctttgtgatattgttctacatatccatggggaaagaaaatgatagtactccataatatcacaggtggtgtacaaccccttgtgatactgtttctaatatccat

SEQ ID NO: 111139 - DNA, 243 bp, Homo sapiens
tcctacagtgtggcaccatgcaggtgtgtgtgtatctgtgcacctatgtcttcagggacccacctgaagaggagcagcacggcctggtggtagaatgaaagggaactgcttcccggggagtaggaagggagaggatgtgttgcttgctctctgcctgacaaggaggccagtgggtccattgtcatttatgataactttccacagagcaacccactatgcactgcacacctgctggaaaccaga

SEQ ID NO: 111140 - DNA, 912 bp, Homo sapiens
ttcttccggccgctctgaccccggggctgcggctccgagatagctcagggcctggaagtgcatgctgggaccaactacataatccttggtaagaaaaggaggtggccctgacaagtgcaactcgagaaatgcaatgctgtagagtccaaaggtgtctgacttgaacgaaatgatcccactgggggacaatgcaacatatactccagggtcatgttttgtcatgatgcagcaaggagatctgttcctaacttggacttggttgtctaaccctcatctcttctctttattacaaggtgaactggaacttacaccttgcttctcctgttctcaggagacttggactggaactataccaccagctgtctcggatctccggcttgcagacggcacatcatgggacttctcagtctccatcactgcatgagccaattccttataataaatctctgtctctctcattatacatatcttggagaaccctcaggaaccttgactaatacacaagataaattcagttttaattgtatgtgaggcattgtggtggagatatatactagatacccacacgcaagtgggcaaaggtctgggatcaaaatatctatttgggaatcttcagcatatgggtgatagttgaaatcataaaagtggttgaactcttctgggactctcatatattgtaataggatgaacggcagaaagaacagatacagatacatgtaggttggttaatctgatggttggaatgtggacttcgtattcgatgtacttggtgtgtgtgtctttgtttataatgaagtcaattactcagtaatgtgcatataataaattccgtagtgtgtgtggttcaaaaaaaaaaacattcctaaaaacgcacattttaattattatttaaaaaaggcctttttggcctca

SEQ ID NO: 111141 - DNA, 318 bp, Homo sapiens
gcacatacaaacctcgacagatgttaagcacggtcatttctgctttcacccttggttcctggacctgggtattctacctctcaggaatgtggcatcatatacaggtctttgaatatatatagtgaatataaagtgtcctgaagtatagcatcccttccttgtaaagtgttgttaaatacctatttcctgggtctcctgatggtagtttgccttaaaccaaataggatatgtgatgctggtcttttctctgccagcatgctcttgagtattctcttttttttaacctcctatgaaaaaaaaaaaagctgccacccaaac

SEQ ID NO: 111142 - DNA, 353 bp, Homo sapiens
cactctggtctcaccactgcactccagcctgggtgacagtgagactctgtctctaagaaaattacaaaaattacaaaaataaacacagcataacaactatttatatagcatttacattgtgttaggcattataagtaatttggtatcttttgggtgggggtagtagttcctggaaccagtccctcatggatacctagggacaacgtccctaatgacatatgacgttgagcatcttttcatgtgcttagtggccatttgcatatcttctttggagaagtatctattcacagcctttgcccctgtaaaattgtatttgtctttttatgaatgagttctaagagttatttatatat

SEQ ID NO: 111143 - DNA, 158 bp, Homo sapiens
taactcatccagataacatttttaagtgtctgggttatttttctaattacaaaggtaatacctgctcacttaaaaatattcaaagaatacaaaaatatgccaggcacagtggctcacgcctgtaatcccagcactttgggaggccgaggcaggcagat

SEQ ID NO: 111144 - DNA, 344 bp, Homo sapiens
gtcacgcctggtgccctttgatccagctggactgtgacctgatcaagctgcttgggtgcaatggctgacataggtggaatgaatgatcccgtcacccactgagatagcctttcacaaagtctagacctctttttttttctttttcttttttttgagagggagtctccctctgtcgcacaggctggagtgcagtgtcgtgatctctgctcactgcaagctccgcctcctgggttcacaccattctcctgcctcagccttccgagtagctgggactacaggcacccgccaccaggctggctaatttttttgtatttttagtagagacggggtttcactgtgttagc

SEQ ID NO: 111145 - DNA, 1762 bp, Homo sapiens
ggggcgtggctcttcggagaggcggcaaattgcaaggagacgccgccgccttcatgctgccggcgggctgctcgcgccggtgaggcctgcgcggcaggagggggtgggaggatgcgggcgggccggtagccaggcgcggggcccgaggcccgacgctggccgaggtgctgagccgccggtgcgtcccccaggctggtggccgagctgcagggcgccctggacgcctgcgcacagcgacaattgcaattggagcagagcctgcgcgtttgccgtcggctgctgcatgcctgggaaccaactgggacccgggctttgaagccacctccagggccagaaactaatggagaggacccccttccagcatgcacacccagtccacaagacctcaaagagttggagtttctgacccaggcactggagaaggctgtacgagttcgaagaggcatcactaaggccggagagagagacaaggcccccagcctgaaatctaggtccattgtcacctcttctggcacgacagcctccgccccaccgcattccccaggccaagctggtggccatgcttcagacacgagacccaccaagggcctccgccagaccacggtgcctgccaagggccaccctgagcgccggctgctgtcagtgggggatgggacccgtgttgggatgggagcccgaacccccaggcctggggcgggcctcagggaccagcaaatggccccatccgctgctcctcaggccccagaagccttcacactcaaggagaaggggcacctgctgcggctgcctgcggcattcaggaaagcagcttcccagaactcgagcctgtgggcccagctcagttccacacagaccagtgattccacggatgccgccgctgccaaaacccagttcctccagaacatgcagacagcttcaggcgggccccagcccaggctcagtgctgtggaggtggaggcggaggcggggcgcctgcggaaggcctgctcgctgctgagactgcgcatgagggaggagctctcagcagcccccatggactggatgcaggagtaccgctgcctgctcacgctggaggggctgcaggccatggtgggccagtgtctgcacaggctgcaggagctgcgtgcagcggtggcggaacagccaccaagaccatgtcctgtggggaggccccccggagcctcgccgtcctgtgggggtagagcggagcctgcatggagcccccagctgcttgtctactccagcacccaggagctgcagaccctggcggccctcaagctgcgagtggctgtgctggaccagcagatccacttggaaaaggtcctgatggctgaactcctccccctggtaagcgctgcacagccgcaggggccgccctggctggccctgtgccgggctgtgcacagcctgctctgcgagggaggagcacgtgtccttaccatcctgcgggatgaacctgcagtctgagcctttcccatgctgccctcggcctgttcagatggggattgggggtgtcttccctggcactgtgctcggggacccagagatgcctgtgcttccctgggaaacctggtgaactggaccaggtggcctcactggctcttctcaggacaactaagcctgctggtcagggctggctttcagccttcctaaggctcctggactccagaggccagcggggagcctttcctggctccctctgttttctctcactgtagaccaaagagccgcttgtgtgatattaaagccactttagaaagca

SEQ ID NO: 111146 - DNA, 1650 bp, Homo sapiens
ggggcgtggctcttcggagaggcggcaaattgcaaggagacgccgccgccttcatgctgccggcgggctgctcgcgccggctggtggccgagctgcagggcgccctggacgcctgcgcacagcgacaattgcaattggagcagagcctgcgcgtttgccgtcggctgctgcatgcctgggaaccaactgggacccgggctttgaagccacctccagggccagaaactaatggagaggacccccttccagcatgcacacccagtccacaagacctcaaagagttggagtttctgacccaggcactggagaaggctgtacgagttcgaagaggcatcactaaggccggagagagagacaaggcccccagcctgaaatctaggtccattgtcacctcttctggcacgacagcctccgccccaccgcattccccaggccaagctggtggccatgcttcagacacgagacccaccaagggcctccgccagaccacggtgcctgccaagggccaccctgagcgccggctgctgtcagtgggggatgggacccgtgttgggatgggagcccgaacccccaggcctggggcgggcctcagggaccagcaaatggccccatccgctgctcctcaggccccagaagccttcacactcaaggagaaggggcacctgctgcggctgcctgcggcattcaggaaagcagcttcccagaactcgagcctgtgggcccagctcagttccacacagaccagtgattccacggatgccgccgctgccaaaacccagttcctccagaacatgcagacagcttcaggcgggccccagcccaggctcagtgctgtggaggtggaggcggaggcggggcgcctgcggaaggcctgctcgctgctgagactgcgcatgagggaggagctctcagcagcccccatggactggatgcaggagtaccgctgcctgctcacgctggaggggctgcaggccatggtgggccagtgtctgcacaggctgcaggagctgcgtgcagcggtggcggaacagccaccaagaccatgtcctgtggggaggccccccggagcctcgccgtcctgtgggggtagagcggagcctgcatggagcccccagctgcttgtctactccagcacccaggagctgcagaccctggcggccctcaagctgcgagtggctgtgctggaccagcagatccacttggaaaaggtcctgatggctgaactcctccccctggtaagcgctgcacagccgcaggggccgccctggctggccctgtgccgggctgtgcacagcctgctctgcgagggaggagcacgtgtccttaccatcctgcgggatgaacctgcagtctgagcctttcccatgctgccctcggcctgttcagatggggattgggggtgtcttccctggcactgtgctcggggacccagagatgcctgtgcttccctgggaaacctggtgaactggaccaggtggcctcactggctcttctcaggacaactaagcctgctggtcagggctggctttcagccttcctaaggctcctggactccagaggccagcggggagcctttcctggctccctctgttttctctcactgtagaccaaagagccgcttgtgtgatattaaagccactttagaaagca

SEQ ID NO: 111147 - DNA, 1827 bp, Homo sapiens
ggggcgtggctcttcggagaggcggcaaattgcaaggagacgccgccgccttcatgctgccggcgggctgctcgcgccggctggtggccgagctgcagggcgccctggacgcctgcgcacagcgacaattgcaattggagcagagcctgcgcgtttgccgtcggctgctgcatgcctgggaaccaactgggacccgggctttgaagccacctccagggccagaaactaatggagaggacccccttccagcatgcacacccagtccacaagacctcaaagagttggagtttctgacccaggcactggagaaggctgtacgagttcgaagaggcatcactaaggccggagagagagacaaggcccccagcctgaaatctaggtccattgtcacctcttctggcacgacagcctccgccccaccgcattccccaggccaagctggtggccatgcttcagacacgagacccaccaagggcctccgccagaccacggtgcctgccaagggccaccctgagcgccggctgctgtcagtgggggatgggacccgtgttgggatgggagcccgaacccccaggcctggggcgggcctcagggaccagcaaatggccccatccgctgctcctcaggccccagaagccttcacactcaaggagaaggggcacctgctgcggctgcctgcggcattcaggaaagcagcttcccagaactcgagcctgtgggcccagctcagttccacacagaccagtgattccacggatgccgccgctgccaaaacccagttcctccagaacatgcagacagcttcaggcgggccccagcccaggctcagtgctgtggaggtggaggcggaggcggggcgcctgcggaaggcctgctcgctgctgagactgcgcatgagggaggagctctcagcagcccccatggactggatgcaggagtaccgctgcctgctcacgctggaggggctgcaggccatggtgggccagtgtctgcacaggctgcaggagctgcgtgcagcacccaggagctgcagaccctggcggccctcaagctgcgagtggctgtgctggaccagcagatccacttggaaaaggtgcttctggaagaggaggtgggggtgcaacagaggtccgcagccttgaggacccgagggtaggggcttgactgctccaccccccaggacccaggaggatgggggcaagcctggggtctgtgtgtgtgggttgggaagtgcatgggtcagacggggctgggacggcaggagggagcctggagcctcagaaggagggaggagggctgaagcatgggggcctcgaagcctgtcccaggattgccccccgcctaggtgcccctgagaccttggccctgccctgccctgcccccaggtcctgatggctgaactcctccccctggtaagcgctgcacagccgcaggggccgccctggctggccctgtgccgggctgtgcacagcctgctctgcgagggaggagcacgtgtccttaccatcctgcgggatgaacctgcagtctgagcctttcccatgctgccctcggcctgttcagatggggattgggggtgtcttccctggcactgtgctcggggacccagagatgcctgtgcttccctgggaaacctggtgaactggaccaggtggcctcactggctcttctcaggacaactaagcctgctggtcagggctggctttcagccttcctaaggctcctggactccagaggccagcggggagcctttcctggctccctctgttttctctcactgtagaccaaagagccgcttgtgtgatattaaagccactttagaaagca

SEQ ID NO: 111148 - DNA, 1942 bp, Homo sapiens
ggggcgtggctcttcggagaggcggcaaattgcaaggagacgccgccgccttcatgctgccggcgggctgctcgcgccggctggtggccgagctgcagggcgccctggacgcctgcgcacagcgacaattgcaattggagcagagcctgcgcgtttgccgtcggctgctgcatgcctgggaaccaactgggacccgggctttgaagccacctccagggccagaaactaatggagaggacccccttccagcatgcacacccagtccacaagacctcaaagagttggagtttctgacccaggcactggagaaggctgtacgagttcgaagaggcatcactaaggccggagagagagacaaggcccccagcctgaaatctaggtccattgtcacctcttctggcacgacagcctccgccccaccgcattccccaggccaagctggtggccatgcttcagacacgagacccaccaagggcctccgccagaccacggtgcctgccaagggccaccctgagcgccggctgctgtcagtgggggatgggacccgtgttgggatgggagcccgaacccccaggcctggggcgggcctcagggaccagcaaatggccccatccgctgctcctcaggccccagaagccttcacactcaaggagaaggggcacctgctgcggctgcctgcggcattcaggaaagcagcttcccagaactcgagcctgtgggcccagctcagttccacacagaccagtgattccacggatgccgccgctgccaaaacccagttcctccagaacatgcagacagcttcaggcgggccccagcccaggctcagtgctgtggaggtggaggcggaggcggggcgcctgcggaaggcctgctcgctgctgagactgcgcatgagggaggagctctcagcagcccccatggactggatgcaggagtaccgctgcctgctcacgctggaggggctgcaggccatggtgggccagtgtctgcacaggctgcaggagctgcgtgcagcggtggcggaacagccaccaagaccatgtcctgtggggaggccccccggagcctcgccgtcctgtgggggtagagcggagcctgcatggagcccccagctgcttgtctactccagcacccaggagctgcagaccctggcggccctcaagctgcgagtggctgtgctggaccagcagatccacttggaaaaggtgcttctggaagaggaggtgggggtgcaacagaggtccgcagccttgaggacccgagggtaggggcttgactgctccaccccccaggacccaggaggatgggggcaagcctggggtctgtgtgtgtgggttgggaagtgcatgggtcagacggggctgggacggcaggagggagcctggagcctcagaaggagggaggagggctgaagcatgggggcctcgaagcctgtcccaggattgccccccgcctaggtgcccctgagaccttggccctgccctgccctgcccccaggtcctgatggctgaactcctccccctggtaagcgctgcacagccgcaggggccgccctggctggccctgtgccgggctgtgcacagcctgctctgcgagggaggagcacgtgtccttaccatcctgcgggatgaacctgcagtctgagcctttcccatgctgccctcggcctgttcagatggggattgggggtgtcttccctggcactgtgctcggggacccagagatgcctgtgcttccctgggaaacctggtgaactggaccaggtggcctcactggctcttctcaggacaactaagcctgctggtcagggctggctttcagccttcctaaggctcctggactccagaggccagcggggagcctttcctggctccctctgttttctctcactgtagaccaaagagccgcttgtgtgatattaaagccactttagaaagca

SEQ ID NO: 111149 - DNA, 1891 bp, Homo sapiens
ggggcgtggctcttcggagaggcggcaaattgcaaggagacgccgccgccttcatgctgccggcgggctgctcgcgccggctggtggccgagctgcagggcgccctggacgcctgcgcacagcgacaattgcaattggagcagagcctgcgcgtttgccgtcggctgctgcatgcctggtacgcggaccccggacccactggccagacctccctcgggccctcagagtcccgccccgagcgcccagggctgggagaccgggcgcagccgcccacttcggagctgtgggttgtcagtgccaccctccttaccctgcaggctctgagctgggggcctgccgcggggcccggcggccccctcgggtctgtttgggctgggccctgcctcctggccgtgcgatggctgcccgtgtctttgcagggaaccaactgggacccgggctttgaagccacctccagggccagaaactaatggagaggacccccttccagcatgcacacccagtccacaagacctcaaagagttggagtttctgacccaggcactggagaaggctgtacgagttcgaagaggcatcactaaggccggagagagagacaaggcccccagcctgaaatctaggtccattgtcacctcttctggcacgacagcctccgccccaccgcattccccaggccaagctggtggccatgcttcagacacgagacccaccaagggcctccgccagaccacggtgcctgccaagggccaccctgagcgccggctgctgtcagtgggggatgggacccgtgttgggatgggagcccgaacccccaggcctggggcgggcctcagggaccagcaaatggccccatccgctgctcctcaggccccagaagccttcacactcaaggagaaggggcacctgctgcggctgcctgcggcattcaggaaagcagcttcccagaactcgagcctgtgggcccagctcagttccacacagaccagtgattccacggatgccgccgctgccaaaacccagttcctccagaacatgcagacagcttcaggcgggccccagcccaggctcagtgctgtggaggtggaggcggaggcggggcgcctgcggaaggcctgctcgctgctgagactgcgcatgagggaggagctctcagcagcccccatggactggatgcaggagtaccgctgcctgctcacgctggaggggctgcaggccatggtgggccagtgtctgcacaggctgcaggagctgcgtgcagcggtggcggaacagccaccaagaccatgtcctgtggggaggccccccggagcctcgccgtcctgtgggggtagagcggagcctgcatggagcccccagctgcttgtctactccagcacccaggagctgcagaccctggcggccctcaagctgcgagtggctgtgctggaccagcagatccacttggaaaaggtcctgatggctgaactcctccccctggtaagcgctgcacagccgcaggggccgccctggctggccctgtgccgggctgtgcacagcctgctctgcgagggaggagcacgtgtccttaccatcctgcgggatgaacctgcagtctgagcctttcccatgctgccctcggcctgttcagatggggattgggggtgtcttccctggcactgtgctcggggacccagagatgcctgtgcttccctgggaaacctggtgaactggaccaggtggcctcactggctcttctcaggacaactaagcctgctggtcagggctggctttcagccttcctaaggctcctggactccagaggccagcggggagcctttcctggctccctctgttttctctcactgtagaccaaagagccgcttgtgtgatattaaagccactttagaaagca

SEQ ID NO: 111150 - DNA, 1551 bp, Homo sapiens
ggggcgtggctcttcggagaggcggcaaattgcaaggagacgccgccgccttcatgctgccggcgggctgctcgcgccgggaaccaactgggacccgggctttgaagccacctccagggccagaaactaatggagaggacccccttccagcatgcacacccagtccacaagacctcaaagagttggagtttctgacccaggcactggagaaggctgtacgagttcgaagaggcatcactaaggccggagagagagacaaggcccccagcctgaaatctaggtccattgtcacctcttctggcacgacagcctccgccccaccgcattccccaggccaagctggtggccatgcttcagacacgagacccaccaagggcctccgccagaccacggtgcctgccaagggccaccctgagcgccggctgctgtcagtgggggatgggacccgtgttgggatgggagcccgaacccccaggcctggggcgggcctcagggaccagcaaatggccccatccgctgctcctcaggccccagaagccttcacactcaaggagaaggggcacctgctgcggctgcctgcggcattcaggaaagcagcttcccagaactcgagcctgtgggcccagctcagttccacacagaccagtgattccacggatgccgccgctgccaaaacccagttcctccagaacatgcagacagcttcaggcgggccccagcccaggctcagtgctgtggaggtggaggcggaggcggggcgcctgcggaaggcctgctcgctgctgagactgcgcatgagggaggagctctcagcagcccccatggactggatgcaggagtaccgctgcctgctcacgctggaggggctgcaggccatggtgggccagtgtctgcacaggctgcaggagctgcgtgcagcggtggcggaacagccaccaagaccatgtcctgtggggaggccccccggagcctcgccgtcctgtgggggtagagcggagcctgcatggagcccccagctgcttgtctactccagcacccaggagctgcagaccctggcggccctcaagctgcgagtggctgtgctggaccagcagatccacttggaaaaggtcctgatggctgaactcctccccctggtaagcgctgcacagccgcaggggccgccctggctggccctgtgccgggctgtgcacagcctgctctgcgagggaggagcacgtgtccttaccatcctgcgggatgaacctgcagtctgagcctttcccatgctgccctcggcctgttcagatggggattgggggtgtcttccctggcactgtgctcggggacccagagatgcctgtgcttccctgggaaacctggtgaactggaccaggtggcctcactggctcttctcaggacaactaagcctgctggtcagggctggctttcagccttcctaaggctcctggactccagaggccagcggggagcctttcctggctccctctgttttctctcactgtagaccaaagagccgcttgtgtgatattaaagccactttagaaagca

SEQ ID NO: 111151 - DNA, 974 bp, Homo sapiens
cagctcagttccacaggctcgagttctgggaactgacctgtgggcccagctcagttccacacagaccagtgattccacggatgccgccgctgccaaaacccagttcctccagaacatgcagacagcttcaggcgggccccagcccaggctcagtgctgtggaggtggaggcggaggcggggcgcctgcggaaggcctgctcgctgctgagactgcgcatgagggaggagctctcagcagcccccatggactggatgcaggagtaccgctgcctgctcacgctggaggggctgcaggccatggtgggccagtgtctgcacaggctgcaggagctgcgtgcagcggtggcggaacagccaccaagaccatgtcctgtggggaggccccccggagcctcgccgtcctgtgggggtagagcggagcctgcatggagcccccagctgcttgtctactccagcacccaggagctgcagaccctggcggccctcaagctgcgagtggctgtgctggaccagcagatccacttggaaaaggtcctgatggctgaactcctccccctggtaagcgctgcacagccgcaggggccgccctggctggccctgtgccgggctgtgcacagcctgctctgcgagggaggagcacgtgtccttaccatcctgcgggatgaacctgcagtctgagcctttcccatgctgccctcggcctgttcagatggggattgggggtgtcttccctggcactgtgctcggggacccagagatgcctgtgcttccctgggaaacctggtgaactggaccaggtggcctcactggctcttctcaggacaactaagcctgctggtcagggctggctttcagccttcctaaggctcctggactccagaggccagcggggagcctttcctggctccctctgttttctctcactgtagaccaaagagccgcttgtgtgatattaaagccactttagaaagca

SEQ ID NO: 111152 - DNA, 892 bp, Homo sapiens
ggggcgtggctcttcggagaggcggcaaattgcaaggagacgccgccgccttcatgctgccggcgggctgctcgcgccggtgaggcctgcgcggcaggagggggtgggaggatgcgggcgggccggtagccaggcgcggggcccgaggcccgacgctggccgaggtgctgagccgccggtgcgtcccccaggctggtggccgagctgcagggcgccctggacgcctgcgcacagcgacaattgcaattggagcagagcctgcgcgtttgccgtcggctgctgcatgcctgggaaccaactgggacccgggctttgaagccacctccagggccagaaactaatggagaggacccccttccagcatgcacacccagtccacaagacctcaaagagttggagtttctgacccaggcactggagaaggctgtacgagttcgaagaggcatcactaaggccggagagagagacaaggcccccagcctgaaatctaggtccattgtcacctcttctggcacgacagcctccgccccaccgcattccccaggccaagctggtggccatgcttcagacacgagacccaccaagggcctccgccagaccacggtgcctgccaagggccaccctgagcgccggctgctgtcagtgggggatgggacccgtgttgggatgggagcccgaacccccaggcctggggcgggcctcagggaccagcaaatggccccatccgctgctcctcaggccccagaagccttcacactcaaggagaaggggtaggtttcccggaccctcactggagggacttctgtctctgcctcctcagaccctggctagcaaggagcctgggatttggggtgacagggaaggcagggcatcgagccctgtggcatacccc

SEQ ID NO: 111153 - DNA, 2058 bp, Homo sapiens
ggggaggaaggttagggaggcggagagggaccgcgcccgcaggagagaggcgcgggccagggctctagcagggactggggccgcggcaggggtagcaaggtgagtcggtgcttgccaagaggcagagcgcaaaacctactaggagatcgcgcccggtgagcagcacccgcagctcagagcccgggacgtccggagcgcggggagcagtcccctctccatcagggagtggtctatctgggcagtctgggacccaggcaccgcgccatccctgagagagcagcagtctggagagcaggcatctcagatccctaagaaaccagccgtccgagaagccgcggatctcaggtgcccaggatcgttaggactgaacgggagggtactagaggaccactggctctggaccgtcgggagctgcccctgacgtaacccacgaggggcctccccttgacggacggcttggggagcggcaccgccgggctggagcccgcagaggcagggtaaggggagcggggggcagccgtcgggggagtgcagacccaggcccaaggcgggtcaccgctcctggcccgcggagagccccggccccggcagccattgcgcccaagagtgaggaagatttgctggccctggcagcgtcgcggctgagccgccgcaagagggtggcgggcgcggccgtcggagtggccatggtgctgctgctgctggtggccatcccgctgctggtgcacagctcccgcgggccagcgcactacgagatgctgggtcgctgccgcatggtgtgcgacccgcatgggccccgtggccctgtgtcccgacggcgcgcctgcttccgtgccccccttcccgccaggcgccaagggagaggtgggccggcgcgggaaagcaggcctgcgggggccccctggaccaccaggtccaagagggcccccaggagaacccggcaggccaggccccccgggccctcccggtccaggtccgggcggggtggcgcccgctgccggctacgtgcctcgcattgctttctacgcgggcctgcggcggccccacgagggttacgaggtgctgcgcttcgacgacgtggtgaccaacgtgggcaacgcctacgaggcagccagcggcaagtttacttgccccatgccaggcgtctacttcttcgcttaccacgtgctcatgcgcggcggcgacggcaccagcatgtgggccgacctcatgaagaacggacaggtccgggccagcgccattgctcaggacgcggaccagaactacgactacgccagcaacagcgtcattctgcacctggacgtgggcgacgaggtcttcatcaagctggacggcgggaaagtgcacggcggcaacaccaacaagtacagcaccttctccggcttcatcatctaccccgactgagccggccccgccccgtgcccccgctcgccccttctctcccgtcctcacccacctcctgcccgccccacccgaggcgccaccccaccctttgagagcctggcggtggggtggacccttccgttcccggaggcggcctaaatgggcgaactcttggtgctcaagggtataagtggccgggaagaggaggagacccggccagaggagcagagcgacttccggagggatcacccgcacccaagtgcgcgctggaccccataggggcagaggtcgtggctttctcttttgtacagagatggggagcagttttaatagcgggactcagaggcccagaaagccggagggaagcccccgcagcttgcgagggaaataacagaaacaggaggagcccatttaggcaagagaagacattaaaacagggtagtgcaggttctccgtcacaactttctctcgccaccctctcgtcccctcgtctccactttcaggctcaggctccagccttggcagccttcctgtgaactggaggaaccagtgaattctttcctggcatttaaaacgcattctgtacagtccccattcccccctatccggactaggccctggggctacagctgctgctgcctcttctaataaagtgaggttgggggattgtgtgtg

SEQ ID NO: 111154 - DNA, 742 bp, Homo sapiens
cacaggtgtatcatggaacaaaggcagaatttgtgtaaattttcaaagtaaatgtaaaacctcaaagaaatttcacatttgtggctggacaacttgggctccacctttagtccttttagtcctttctggggtatgtattcctttacttgctttcaaaagaaggcttgttttaggttaagaagctttgcgtatatataaaacttttggcatttgagtctcctgtcccttaagcagaggcattatccaaagctttgttgtcttactattctgacccttggtgactaatacatttccaggtgaaagtgcttgtatctagatagttgacttccaaagattatgatctattctgacttaatgaatttaaattacaaatatccatcttgcatgttagatatttctagctaaatgcctttgttacgtggtcctagcaggatggcagtggacaggtagtattgagattttggaggttcttaatgatatttcaacaagtaaaaggaaaaacgaactgggaactccagccttgtttaacaacttttcaaatgtcaactcttctgcaggcctcagatccaagcagttgggtgaataataaatgtaggctgtatgctgtttgtactgtgggtataactgttggcacatctgttcacaaggcatcttctacagaatctctcaagttagttcttcctagtctccaccactgtaattcagccttccctctcaaatagactaccccattagcttcctg

SEQ ID NO: 111155 - DNA, 511 bp, Homo sapiens
taccaacgcctccagattctctaactgctcagacatccacctgaacacgagcccctaagatgtcaaacacacagagcccagtccaccgccttccccacagcctgctgcatctggcgtcggtggatggccctgccaggtgcctgctgcccccataggagcaccaggagtgcctctccaggtttctcccttcctcagccctcacccagcccctcctgtttctcctcatttaccatttcaaatcctgtacagatatcccagttttagtcatttgattatttcctttagataaattccaaaaagtgggattgcaagtgaaagagtgtgcttttattttctagcactttagtacatattactaactcagcttccagacaaagttgagcagattagactctccaggcctcccgtgagcagacaggtttctctacaccctcggcaacactgagcatcgctgtgctctctcatccttaatgaaaaacttcagaagcgaaaaaatatctcatctcaatgg

SEQ ID NO: 111156 - DNA, 258 bp, Homo sapiens
gagtcaaggtctcccagaaagtactgtcaatacagaataaaactgggcagtgattctgctgagaggaagcatttacggaataataaaatacctaggcggaagatcaacaacaaaaaagacatgaacgacacaatactccttgacgaaacaaacatctgcagaaccctcagcctagcaagggcaaacacacctgcttctcaggcacacacacaatattttccaggatggacaaatggcaggccacaaagcaagcctcca

SEQ ID NO: 111157 - DNA, 680 bp, Homo sapiens
acagaaggagaggcagcacttctaaaaagatgttgtgttgatggggaaggtgatccctcttcctgacctctggccctagtgtcctcaggttaacaggagaccagtttttcttccttattagcaatatctgagtacagctttggctacctgcaaagaaaaataaagcaaaacctttcccttaatggaaattgaggaggaatctgcacttttaatgatcatccaggtggttctcatgtaggtgccccaggactaccctttgacactgctctagctgcctagaatgttgtttcttttatgtaaaaaaatacatacatatctcaagcatagtaagaataatatgaagtaactccgagtgaattgagtccattcttataaataagcttttaaattttacacatgccaaggacttttagcagcctttttgaccctcgtgctctaaaaatgatccgtcagtgaggagaagaggcagaatgaatagtccctgacttaaaatcatccttttttttttttttacattgaaactgttgattgaaacaggattcctttaaagtcagcctcactttttctcaggcctgaatcttagaacatattgtcagatattcagctgtgctctcgcctccaacccacttttattcctaaatgtgttcgtttatacatggagtgtttgctgttgtgattta

SEQ ID NO: 111158 - DNA, 318 bp, Homo sapiens
atttctcatgatgcgaatgtacagatgaggaatattgaggccaggggggtttaggtgactttcccaaggtcacagttgggtggtaaagagccctattcaaccccagttcatggtcccagcatcagtggccacatacgacatccgcacctgtgctctaataaatacggctcatgctgttttgtgggattccacctcagactggaatttagaagagggcgtccttgctttgaaaaacactgatttaaaaataaagtggagccaggcgcagtggctcatgcctgtaatcccagcactttgggaggctgaagcgggtggatc

SEQ ID NO: 111159 - DNA, 266 bp, Homo sapiens
gtgtgtatgggtagataggatggatggatggatagatggatgggtgggtggacgggtgggtgggtgagtgagtgaactgatatgtgggtggagagattagtgggatggatgtatggctatgtgtgtgtatgggtagatagataggatggatggatggatggatagataggtgagtggatagattagtgggtggatgtatgtttatgtgtgtggatgggtggatggaaggagtgtgcatggataaatggacaaatggatggatgtgt

SEQ ID NO: 111160 - DNA, 230 bp, Homo sapiens
cagccaggcttctacagagcacaggccacacactgtaaacctctccagtcccacccccaaaccacactggcatggacctccaaaggcctcccagttgccaagtccggggcacaccctcggtcctccctctgcacctctctgccccactggatactgttggccatctgctccctcttactctctgagcttctctcttcatctcacggcctctaaatgctctttctctcctt

SEQ ID NO: 111161 - DNA, 254 bp, Homo sapiens
taggcgtgagccaccacgcccagccgcaatcactttgttaaatgagttaagaacggcagagacatgtgcattcatactatcttttataatgacccggctgtctttactagtgctctttgtcattttatgttggtttaaattattatctgtggtcacttgattttagcctaaaaaagctttcgttgctattttctataaggtgggtagatcaactagcatcagattttctcagtttttgtatatctggaatgtgt

SEQ ID NO: 111162 - DNA, 696 bp, Homo sapiens
atcaactaatagatatatttcaactagtgattatttacctttaccacttttgtaaatgatccatttgaggcggggcacagtggctcacacctgtaatcctagcactttgggaggccaagggaggtggatcacctgaggtcaggagttcaagaccaacctggccaacatggcgaaaccccatctctactaaaaaataaaaaaaattaggccaggcgcggtggctcacgcctgtaatcccagcactttgggaggccaaggcgggcagattacttgagatcaggagttcaagaccagcctggccaacatggtgaaaccccatctctaaaaaatacaaaaattagccaggcgtggtggcgtgcacctgtaatcccagccgagatcacgacacttcactctagcctgggcaaaaaagtgaaactccatctcaataatgaaataaaataaaccatttgggccaggcgtggtggctcatgcctataattccagcactttgtgaggccagggcaggtggatcacctgaggtcaggagttcgagaccagcctgaccaacatggtgaaaccccgtctctactaaaaatgcaaaaatggccaggcacagtggctcatgcctataacccagcactttgggaggctgaggcaggtggatcacgaggtcaagagttcaagatcagcctggccaaggtggtgaaacccctg

SEQ ID NO: 111163 - DNA, 214 bp, Homo sapiens
tgcatcttgaagcccacatacagtgagttaaattacagcaatagcatatttctcaaccaccatatagttgcaaatcctttatcctgaagtacatagtaaaggattttctccttgaacagtgaagaaagttgaactttggggttgtttcaatttaacacatgatgtgctgctgcacacttaaagctgcgttttgactttcctactttttcttctt

SEQ ID NO: 111164 - DNA, 957 bp, Homo sapiens
gaggggaaggttccctggggcttgagctccccttttatgcattaccagggaggggaaggttccctggggcttgagctccctctgtggaggtgaggaggggagattccgttcacatccaggaggggcaaaatgactgatgtatttttatgtatctacacagagagtgcattttctctccagagatgctgtctggttaacaaaggaataacttaagaaattgattgattatcttaataaactgtgcaaacccaaaaaaaaaaaaaaaaaaaaaaacataaaaaaaacacaaaaaaaacaacaacataatcaaaatcaacaatcaaaacataagacaacaacacaaaaaacacctacacacacacaccacacaacaacacacaagaccacaacaccacacacctccgcgtaagaacctcacgctacatcacctgatctgactccagacacacatcccgcgtggagcggagcgtgggtgtggtgcagggtcggggtggagggcggcgggcgcgtttggcttcttgtcgcgccggtggtggcgctggctacgctggtgtgccgcggcgctgcgccggccggtgacgctgtcgatgtcggggcgcgcggcgggcgccggccgggggtggcgcgtgccgtctgtctgccgtggcggccgggcgggcgggcccgccgcgcggccgcgccgtcgcgggcgggacgcctgccgccggcctgctccgtcgctgctcgccgggcggcggggctcccttccgcttgggtggcggccggcccgccccgcgggcgccgcggcggcgcccgccacgcgcgccctcgccgcgcccgggcgcgcgtacgtttgcgttgttggggcggtgcggtgtggcgcggcgctccgtccttcctcggtcgggctcgggcgctgcgtcgccgtggcccctctgcttcgcgtggcggccctgggcggcgcgacgtgaccagccc

SEQ ID NO: 111165 - DNA, 2055 bp, Homo sapiens
cagccccagccccagcccgcccttctactccctggcgcccggcatcctcgacgcgcgcgcggggggcgccggcgcctcctcggagcccccgggacccagcgaggccagagcgcccccctcccaactcccaaatcccccggcgtcggagatgaggccccggatgctgccagtgttctttggggagagcatcaaggtgaacccggaacccacgcatgagatccgctgcaactctgaggtcaagtacgcctcggagaagcatttccaggacaaggtcttctatgcgcccgtacccaccgtcacggcctacagcgagaccatcgtggcagcacccaactgcacgtggcgcaactaccgcagccagctgaccctggagccacgcccgcgcgccctgcgcttccgcagcaccaccatcatcttccccaagcatgccaggagcactttccggaccaccctgcactgcagcctgggccggcccagccgctggttcaccgccagcgtgcagctgcagctttgccaggaccctgcccccagcctcctgggccctgccacgctctgacggggctggggccggcccggggtgctggaggagccgggagccctggggagaagccgggaggatggacacgatgagctcggcctggcactcgggcaggaggcgggaagggaggctgccagaccaaggacccgtgtggaaggaggcggctccccgctgcctgccctgacctacaggctaggtggtggtctccttgttttggtgtcaaggactcagtaaaagcatctatttttttagcacttaagctggcaaggcggtaggggcatgcactgttaggtggtggccacccccagggtcaggggaaaagaatgggtccatagagtgcccttgaagcagagaacagccccgagcagtgtgaggacagaggcatcccagcctcagccggtgggaacggctgccactcccccagagccctgccaccccatgtgtcctaggctggtggccaaggccatgtgtgagggaagaggggtacctctcttccctgctgctggcctggggtatttccaaaacagccttttcgcacacatgcaggttgcaccgagaggtctggagctgtggctgagccacctctggtggatgttgagccaggaggttgggcaaaggccggatgctgatgccagcgctggaggtggtgatactgggggcggggaaggcctagaaatactttgagccatggccttgccagtgtcccgtgccctccagtgtcaaagatttggggcactgcccgtcgaaatggaaaggttggtgctcagcctctggagcctcacctgcagggcgtccccagctaacacccatccacgcaccacctccaggacgagaacccttgatgtcaaaaccaagtgcccagtggaggcggtgaagctctcggaaatgctgccacctgtgtgaggccgggtctgaactcgagggagtcggagctcagctgtcggtttaaagagacactgaggggaccgggctgccgccctcagcctgcattcctgtgcgcaatcgattccgcaatgacagcaccttactccttcctgcggcaggctcacccctgcctgtgggatgttgtgagaggaacatgagccagacaaagacttggctcagggctccgtggaacaagccaggatgcacggggagctgggggagcccccagcctggggcagcccagcaggccgctgaacaaacaccccagaagccagcactgtggcagggtgctggggagatgcccctctgagccttcctcccccctcagacctgaatgcaccccacagttgggggctgcccctgccactcccctggtaatgcataaaaggggaggggaaggttccctggggcttgagctccctctgtggaggtgaggaggggagattccgttcacatccaggaggggcaaaatgactgatgtatttttatgtatctacacagagagtgcattttctctccagagatgctgtctggttaacaaaggaataacttaagaaattgattgattatcttaataaactgtgcaaacccaa

SEQ ID NO: 111166 - DNA, 1910 bp, Homo sapiens
cagccccagccccagcccgcccttctactccctggcgcccggcatcctcgacgcgcgcgcggggggcgccggcgcctcctcggagcccccgggacccagcgaggccagagcgcccccctcccaactcccaaatcccccggcgtcggagatgaggccccggatgctgccagtgttctttggggagagcatcaaggtgaacccggaacccacgcatgagatccgctgcaactctgaggtcaagtacgcctcggagaagcatttccaggacaaggtcttctatgcgcccgtacccaccgtcacggcctacagcgagaccatcgtggcagcacccaactgcacgtggcgcaactaccgcagccagctgaccctggagccacgcccgcgcgccctgcgcttccgcagcaccaccatcatcttccccaagcatgccaggagcactttccggaccaccctgcactgcagcctgggccggcccagccgctggttcaccgccagcgtgcagctgcagctttgccaggaccctgcccccagcctcctgggccctgccacgctctgacggggctggggccggcccggggtgctggaggagccgggagccctggggagaagccgggaggatggacacgatgagctcggcctggcactcgggcaggaggcgggaagggaggctgccagaccaaggacccgtgtggaaggaggcggctccccgctgcctgccctgacctacaggctaggtggtggtctccttgttttggtgtcaaggactcagtaaaagcatctatttttttagcacttaagctggcaaggcggtaggggcatgcactgttaggtggtggccacccccagggtcaggggaaaagaatgggtccatagagtgcccttgaagcagagaacagccccgagcagtgtgaggacagaggcatcccagcctcagccggtgggaacggctgccactcccccagagccctgccaccccatgtgtcctaggctggtggccaaggccatgtgtgagggaagaggggtacctctcttccctgctgctggcctggggtatttccaaaacagccttttcgcacacatgcaggttgcaccgagaggtctggagctgtggctgagccacctctggtggatgttgagccaggaggttgggcaaaggccggatgctgatgccagcgctggaggtggtgatactgggggcggggaaggcctagaaatactttgagccatggccttgccagtgtcccgtgccctccagtgtcaaagatttggggcactgcccgtcgaaatggaaaggttggtgctcagcctctggagcctcacctgcagggcgtccccagctaacacccatccacgcaccacctccaggacgagaacccttgatgtcaaaaccaagtgcccagtggaggcggtgaagctctcggaaatgctgccacctgtgtgaggccgggtctgaactcgagggagtcggagctcagctgtcggtttaaagagacactgaggggaccgggctgccgccctcagcctgcattcctgtgcgcaatcgattccgcaatgacagcaccttactccttcctgcggcaggctcacccctgcctgtgggatgttgtgagaggaacatgagccagacaaagacttggctcagggctccgtggaacaagccaggatgcacggggagctgggggagcccccagcctggggcagcccagcaggccgctgaacaaacaccccagaagccagcactgtggcagggtgctggggagattccgttcacatccaggaggggcaaaatgactgatgtatttttatgtatctacacagagagtgcattttctctccagagatgctgtctggttaacaaaggaataacttaagaaattgattgattatcttaataaactgtgcaaacccaa

SEQ ID NO: 111167 - DNA, 679 bp, Homo sapiens
  misc_feature (32)..(33): n is a, c, g, or t
gtgtcgagttcccaaaaagctccgcagggctnntagggaggttgaagcatatgaagaaaacaccagccttgaacagatacgtagcaggaaaagcgaggatcttacaagcctgctgaaaggctcctggggacatccaggggtcctgagaccacagtttgagaaagctgatttaaccatttttggattggtgggctgttaggttgtttaaaattttacactgttacaacccttgcaacagtgaaagttctttgtgatgttttctggtgtatgcgtgctagtgttttttctgtaagtagaattgctaggtcatagagttttgcttttttttaagtttgttaaacacattacttttgatgcctgtataatttgcttttgtgcactaatgttggtgtttagattgtttcaactaatgatttggtgaaatatctttgcatgtttttagttgttttgaattattttctttttgagggggctggggggagtccagtaaaaaccagacaactgccagatacattttaagagagctttaacacatggattcttttctaaaatttctaaaaagataattgttagatcaaatattaggaatctttctcaggctattggtacatattgtcacattgttttcatgggagatagtaccagtttgtttcctgtcagcagtgtctgacatgcttta

SEQ ID NO: 111168 - DNA, 509 bp, Homo sapiens
agactcatgtattaaataattttttagtgaaaagtaaccattttctaaaacaaaacttagaagaggagcgtggcattgtttcaaatttttgcgaatcactttaatgtctggcattatagaagacagctggattttcatgtttgcttctgttcagtctgttgtgctatctggtttaggttgaagcatatgaagaaaacaccagccttgaacagatacgtagcaggaaaagcgaggatcttacaagcctgctgaaaggctcctggggacatccaggggtcctgagaccacagtttgagaaagctgatttaaccatttttggattggtgggctgttaggttgtttaaaattttacactgttacaacccttgcaacagtgaaagttctttgtgatgttttctggtgtatgcgtgctagtgttttttctgtaagtagaattgctaggtcatagagttttgcttttttttaagtttgttaaacacattacttttgatgcctgtataatttgcttt

SEQ ID NO: 111169 - DNA, 195 bp, Homo sapiens
gagtgagggtcttctgtgaaaagcttatctccatctgagccccagacctggcagaaggctggaaaggcagtgactggggttatgaaggacaaaggaaggctggctccccagaaccacacacttaggggaggaaagtccttaggtgtcatgtctgtgcttggcaggctggtgcactcttggcctcagtttgtctat

SEQ ID NO: 111170 - DNA, 455 bp, Homo sapiens
cactaaacatagctatttttattaactaataatattattactattaaaactcagatcttctgtttcagcccagtacccttttcactacactaaatagcacacctctttcccacactgaagtaaaaaaacaggaacaggttatagaatcactgattttaaaatattattggtgttttaacaagactaaacgtggttttcactcactccccagacatctgatccactcagatcctcaagtttctaccaagatgacatcaaaatggccacagatgatccttttggagatggatatcccttacttaggaaggccttatagccattttatctcttctgctctgtaaaatgaagataagaatgttcatcctgtgtaactgaaagctcaaataagatgacagatatgaaggctctttaaaagtgaagtgacaccgggcgcggtggctcacgcctgtaatccc

SEQ ID NO: 111171 - DNA, 480 bp, Homo sapiens
atgaccccatctttaaaaaataataataatagtaatggcagagctggaggagtgggcaaagctcccccttggtttcctcctatctccactcccttggaagatctggaagtatctgatgccttccacagcacagtttgaaaaacgaaaatctggtccaatgccaccatttcaccaacaagggaatggcccagaaacatgcagttgtattttcagtggtatggccgcactgcagcctgaatttatattcccctacagcatcatgagaaagaataaccaagactgtagcatgtgggactatatggcagaacactacagagaagctttaaaagacctagagctttagttcatcctgtgtgaaccatttttcccctatagattgtagatgataatcttttgcatggcccatttccattttcatgtttgtttttcaactgtttctgatgtcacttaaagtatttcctgtgagattccagtactttc

SEQ ID NO: 111172 - DNA, 126 bp, Homo sapiens
atctttccagtcatcttgctgctttttgcttctcgtggtcttctctctctgcaggacctagaaaagagaaagctgaaacctaaatcaattatcgctaatccttcccgtcttccaaaatggggtcga

SEQ ID NO: 111173 - DNA, 249 bp, Homo sapiens
ggtgcagggagcagtgggctcctgacttgagctgaagagctaggggtgggcgggagcagacctgcgagcagctgagtgtgcatgagtgcgcacacgtgcgtgtgtgagcatgtgtcagtgcaagcgtgtgtgagagcatgtatgtgtgtgagtgcacacgagtatgtgaacatgtatgtgtgagcatgtgtgtgtccgttagtgcatgcatgtgtgtgtgtgtgtgtgtgtgtgtgtgtgtgtgtgtgt

SEQ ID NO: 111174 - DNA, 490 bp, Homo sapiens
agatgagcaactcttctgtggccccgacccagaagcagactcatcgcataggatggttttccacactcctacaattgcatctccaaccagtcagcagcactcatagcctcgccctgcctggcaaactatctttgaaaaaccctagcctctaaattttcaggggggctgatctgatttgagttaacagtaaaactccggtctcctgtttagctggctctatgtgtattaaactctctctattccaattcctgtcttgataaatcagctgtatgtattgggcacttacagaatgaagtgctgacaacacatgctacatggatgaaccttgaaaatattaagctaagtgaaagaagccagtcacagaaaaccacttatatgattccactgacataatatgaccagaataagtaactttatagagacagaaaatagattagcagttgtgtagagctgggaagaaatgggggaagggaagaatgatagctaaaag

SEQ ID NO: 111175 - DNA, 687 bp, Homo sapiens
gaagttctaaggcataggacttcctgatttgacttaatgtgtatctcagaaacaacggggagatttcgcatcccccccttgtagaagatctgtaacaggagttggtgtgttgcttggcagggagcgtgtcaaaaatctcagacacacaaaatcccatttcagacggccaagcaccatgacaaatgctcagcgttgtcatcagcgaaacccaaattgaaaccacagtgagatatcacttcatacctgtcaggatggctagaattaaaaaaataagaatataacatgttggcgaggatgtgaagaagttataactcttgcacgttgctggtgggaatgaaatggtgtagctgctgtggaaacagtttgggggtttctcaaaaagttcagcataaaacctaccacgtgagccagcattcccacttctaggtatatgccaagaagaattgaggacaggtgtattcaaacagatacttgtatacaaatgttcataacagcactactcacaatagccaaacggcagcaacaatccaagtgtccatccactaatgcgtagataagcaaatcatagtgtatccataccatggaatatcattcagttctaagaaggagcgaagtactgagacatgccacaacatggacgaacctagaaaacattgcgctaagaggcagacatgaaaggtcatgtgt

SEQ ID NO: 111176 - DNA, 138 bp, Homo sapiens
tagctcggcccccaaaatcaagcagattacttccctgctgaaactcagcacttgttctatcttcttagctgaaaaatgatggtttgatggtacttttctatcacttggtaaagtttatttcattttctggaagacaga

SEQ ID NO: 111177 - DNA, 391 bp, Homo sapiens
cttgctcctggtgtccatctaactgatgctctcaggctttatgcctcctttcctcttccagttgtcgctggcaatttctcattcctcgggatggctgaggccatctctgtgactgtccccccaaagctagaagccagacactgttcacacttgtggtgcccacctgtcttccttgagcctttcaggtacacagggaggcctgcggtggcaggtggaggtgagcaatagggttcagaagggaaggtggagagggatgcagctgggaaaaaaaaaaaaaagattccagagcagtgagaaaggcacagccaggcctgagtgagggaaggaaaggccagtcccttctcttgcctggctacaggagtgggacaaagtggttggctaactgctgtgg

SEQ ID NO: 111178 - DNA, 235 bp, Homo sapiens
tgggtcctaggatacctcagtggtgaactgagctctgagcagagacttaaagaaagctatggagggagccacagaacgtgaggggacctggcttctgactttgtcacgtcacttgattcccctgggccacggtatccaaaagacagttgtactgtgtgactttttaaggtctcttcctggagaaaatctatttagtttccaaaagcctgcctttccaggactcagcaagcaaata

SEQ ID NO: 111179 - DNA, 411 bp, Homo sapiens
aaaaaaataaaccatctcaaaagggatccaaagctaaaagggccaacagaattgtgtcccatgagacatggagggcctttgagaggaaaaagcccagacctggcccagctctgggactccacacgttaggaggggctgaggcgaggagcggccaccctgccaagctgagccttacaggcaggggccatgtagcctgccgtccaccggggaaatggatcattgcatccagacaaagaccaaggtgtgaccacgcagacctggatgtccagccacccacgtgcgcccagagcggcccactgtcctcccgcggtccccggggcccagcgcccatccctccagcagccgttcccagtcagcacgctgccacccccgcccccggtgagggcttcccctctgttcagacccctgtca

SEQ ID NO: 111180 - DNA, 514 bp, Homo sapiens
cgactatgttcataaagataaaagattccaatcaataccaaccatccatcttaggtaagtaaaaagagtatggctgggcatcgtggctcacgcctgtaatcccaacactttaggagtccacctgggagaacccaggaggcggaggttgcagtgagccaatatcacgccactgcactccaacctgggcaacaagagcaaaactccgtctcaaaaaaaaaaacaaaaccccaaacacaaaaaatttcgaaagaaaagctaactgttggggatggggcagtgggggagagaaaatactgtacaaatttttccagcgaagcctaagagactctccctcaatcacccacagggtaaacatcattcactaggtgtcaatcttacacttgtacttgcaatgaaaaatataaatccattacattgctcccatgatgtctactttcttttaatcccaagtttattttctaaagatgttcaggattaaagaattaaagaacaattctaaatttacttatgcaaa

SEQ ID NO: 111181 - DNA, 364 bp, Homo sapiens
gttccctgggattcttatcctccaggaagcctgggaaacaacacagcaaaggacagctgttgcagggactaccagtgtctgctgaagtccatcctctccttcctcagggccaacactggaacagagctcatggtgaaaccacatttgccccttgccacgtgactaaaggcttcctaaagaaatacaagtggaagtgacctgtgctgcttaagagccagagcttttaacagagcagatatgagtcctccatactttctttcctctccttttgaatggacacaggtgacaaaaaaagtaacaaaacacacacacacacaaaaaccaaagagatggtagagtgacaagatggagaagcctggatccc

SEQ ID NO: 111182 - DNA, 166 bp, Homo sapiens
taatactgagacaggcttataaaaccaacggggaggtactaaacctcagagtctaagcaatgggcacaatgttttctacttaatatgtaattggaccagaaagactgagtgaggatgttgagtgtaggtaacggggcagtgcatggagggcggcctctgccctgca

SEQ ID NO: 111183 - DNA, 617 bp, Homo sapiens
agaaagtcttactccctaactctgcagttccaaagagacgcgttttgagaggggtgattttgagtcggtcttttacttgtaaagaaatactctcgggaaacgttggtgtggacattttggcgtatatttacgatgtcttactatccaagcccggaatgtcccaccctagggcgtcggcaggtccaccacctctggcgttacgagaataactcgcccttattcactacgagatctctaattgagatccctagatatgatcctgccggccagagggtggggtccttgagatatacacggggagtgtgccagttccatggtgtaatgatggatttattgctggagctgagccagtattaggcctccggttactttttctccgcacatgtctgtcgctgccaacacagtgtgagagaagttcttacatactgcccaagatgtgcgtcagctaaatggtaaatatttattgagcagatatcattgcaagcctacgagctaatggcttaattctgatcctcaactgcccagcgtccggtgataaaaatagaaaggtactttttaaaaaaccgagatgttccttcttaaaccacgggtcattgaccatcaaggtgataacattg

SEQ ID NO: 111184 - DNA, 771 bp, Homo sapiens
gtagctgggattacaggcacgcaccaccacgctgggctaatttttgtgtttttagtagagacggggtttcgccaggttggccaggctggtctgagaactcctgacctcatgatctgcctacctcagcctcccaaagtgctgggattacaggcatgagccactgcacctggctagttcttctcaatttggattgcacatttaaaaactgggacatttaaaaattgcctgggtctcacttgtatcccatctccactctcccccgagatatttatttaatggttaagaataaggcctgaccattagaacttttaaaatctcataaggtgattataatttgcaacaagtttaaacaagtttaaaaaccagtgcacttaaacaagttctcaaagtgtggccccagaccaatggcatcagtatcacctgggaactgagaaaggccaggctctcaggccccagtccagcctagtgaatcagaaactctgagtgcagggcctctccaggtaatttggatgctagttaaagtttaatagccactgctctaaattatctccaaggccaggaatctccaaattctctttcactcatgcaactacttgctcaactcacaaatatgtaatgagaacattctatatgccagattctgtactggaaacagtattaggatgactcagaccagtccctttcttgaaggcactcaaacttaagtgctgagctcctacccactttgtaaaagtgccacgtactgtgccaaatcatcagtagtgaggtcga

SEQ ID NO: 111185 - DNA, 207 bp, Homo sapiens
caccagatgctcccaccactcctacacaaataacaccccaacacgtacccctaacactcctacacacacaacaccccaacactacatactccaacactcctacacacacatcaacaccaacacatgacccaacactcctacacaaataacaccccaacacgtacccctaacactcctacacacacaacaccccaacactcctccaca

SEQ ID NO: 111186 - DNA, 353 bp, Homo sapiens
tgttctattctcctttccattatcctctaccctggtgcccttccctccatccacattttaaagtctgaggttttccaggaccttgtcctctctttatcttcagcgtcttgtccctaaacagtctcgtctacttccaagcctttagctgttaactttgtgatggccctgtgcgatggctcattcctataatcccagcacttcgtgaggctgaggcaagaggatcacttaagctcaggagtccgagaccagcctgggcaacatggtgaaaccccatctctaccaaaaatacaaaaaaattagtcaggcatggtggcatgtgcctgtattcccagcttcttgggggcctgaggcag

SEQ ID NO: 111187 - DNA, 370 bp, Homo sapiens
catttactgggacaccaatggcattgccgtatcctagtatttatttcccaggtttaaatcatatctaatctgataaattcatttccttcagacatgattatttttctccatcttataaaattaaagtaactaggaatgtttggctcagaaaagcaacaaattaggaggaacatgggaattgtcttcaaacaactgaagtatggtcatgttagaaaagatttgattctttttgtatagtcccagtggattgaacctatgtattgaatttatagtaaaacagatttcagttcagtttaaggaagaactatcctaacagtcaaatctgcttagagagggagttggctgcctaggaagggaatgcagtggtccc

SEQ ID NO: 111188 - DNA, 601 bp, Homo sapiens
agggagcagggcttatgtttcatcctagaaagccaaggctaaactaggagaggtggcagggcctgtgtaattctcagaggtacagactagatgttgtcataagtgagagcagagggctgggaatgacacctgcccatgagagccaggaagaaagttaagtctttaatggctgaccttttctagagcattctttgtgccgagagccatgctagatggttacttatctccccaaatcctaacaatcccagaagataacgcttatcctctcactttacagatgtagaaactgagccggaatatccaaaacaggtcaaattctaggactggttattaaatttcaggcacgtgcaggctctccacaacacctgtacaggtcatgctctgtgtaagttcagtggttgctttcctggagttatgtggtacaaacctgcacaaccatacaatggggtacaagcatagtccctggagccaggctggctggcttcaaatgtcaactccattaattaatagctttgtggccttgggatagccacttaacatctctggggctcactttctttatttgcaatggaggcaataatgacacctaactcataggctc

SEQ ID NO: 111189 - DNA, 314 bp, Homo sapiens
ttttcttttttcgagatgggaatctcactctgtcacccaggatggagtgcaatggtgcaatccatagcctagtggtgagtccatagcctattatgataggtccttccaggatcaataccattagtattgtgatctataacagcatcactaatattgtgatcgataccactaatcaataatcttgtgatctagcaataccactgctaggtatttatctaaaagaaagaggccgggcatggtggctcaccctgtaatcccagcactttgggaggccgaggtgggaggatagcttgaggccaggagtttgagagaag

SEQ ID NO: 111190 - DNA, 433 bp, Homo sapiens
ctgtcatccccagaggcccaagttcccagaaaggtttggcttggccagggcacaggctgaggctgggggcctcctttaaggctgggataaggagaagttaacccttctcctcttgctccccctcccaggccctaagctatttccacctctttgttgaggatggaaataactccggctcagcccctagagaccacgacagctattttcatcagccccaagaagcacagctccagtcattgcagagaggaccgagggacaccctgatccccagttccagttcttggccaagtggcaacagtggtcagagccaaaaggggtctctgggaagaacagggagaccgaggcccagagagagtagggaccagctcaaggtcactccctgtctgctccccaccataacatgcaggtggatttggggaaatgcctctagagc

SEQ ID NO: 111191 - DNA, 325 bp, Homo sapiens
gatcataggaaaagaggtcccacaaatatttaagaaacatttatggaccaagaagatgtagaaagtcacatttacatatattccggaagatgtgagagtctaatggtgagctctatgaagatgaattggacacagttcatacccccagaggaatctggtaaagaagacaaacagggccaggcgcggtggctcacttctttaatcccagcactttgggaggacgaggcaggcggatcacctgaggtcaggagttcgagaccagcctggacaacatgatgaaacctcgtctctagtaaaaatacaaaaaaaaaaaaaaaaaaaaaag

SEQ ID NO: 111192 - DNA, 199 bp, Homo sapiens
atagaccgcaatccaattacaataaattatattaaatattaattaactgaaaatcacaatgaaaatgtacagacctcatttttatctaaataaatcagaaaaagaatagaaaataaagtgtaagttagagacaaaagaaaaaatctagaaattgagaacagaagaacaataaaaataagttattaaaaccaaaggatca

SEQ ID NO: 111193 - DNA, 1944 bp, Homo sapiens
cgcggctgcatggacgcgggtccggcgcgcgggaggcgatgacggccccgccatggcccgggcgggcagctgcggcggcgccgcggcgggcgcagggcggccggagccctgggagctgtccctggaggaggtgctgaaggcctacgagcagccgctcaacgaggagcaggcgtgggccgtgtgcttccagggctgccgcgggctgcggggctcgccgggccggcgcctgcgggataccggggacctcctgctgcgcggggacggctcggtcggggcgcgggagcccgaggccgcggaacctgcaaccatggtcgtgccactagccagctcggaagcccagctgcacagatgaggggcacagctgacgtctgcagggccggcctcccagacacagagccggggtcagggagacgacttcaggtgcaaacaggaaaaatcagcctggtgaccagtgccccgaaaccccacccgaccaaaactggaacctcaccgcagggcagggccttcctctcccattcacctgccctgaagtcatgtctggaacgtcatgtttccactttctactgcctttttagttttctttctttgttttttttgcttttgttcattttattttattttattgttttgagatggagtcgcgctctgtcgcccaggctggagtgcagtggtgtgatctcggcttactgcaagctccgcctcccgggttcacacctttctcctgcctcagcctcccaagtagctgggactactggtgcccgccaccacgcccggctaatttttttctatttttagtagagacggggtttcaccgtgttagccaggatggtcttgatgtcctgaccttgtgattcacctgcctcggcctcccaaagtgctgggattacaggagtgagccaccgcgcccggccttattttattttttaatagagatgtctcactatgttgcccggactagtctcaaactcctgggctcaagccatcctcccacttggcctcccaaagtgctgggattacagttctgagccactgtgcctggcctctttttttttttgagatagaatctccctctgtcacccaggttggactgcagtggtgcgatctcagctcactgcaacctcggctagttgcagcgcaacctccgtctcctgggttcaagcaattctcctgcctcagcctcccgagtagctgagattacaggcgcatgccaccacgcctggctaatttttgtgtttttttttgtttttgagacagagtctctctctgtcaccaggctggagtgcagtggcgtgatcttggctcactgcaacctccgcctcccgggttcacgccattctcctggccagcctctcaagtagctgggactacaggcgcccgccaccatgcccggctaatttttgtatttttagtagaagtggggtttcaccatgttggccaggatggtctcaaactcctgacctcatgattcacccacctcagcctcccaaactgctgggattacaggtgtgagccatcacgcccagccttttttttttttttttttagatctaccctcttgttgcccagggggagtccagtggcgtgatcttggctcactgcaaccgccgcctcccgggttcaagcaattctcctgcctcagtctcccgagtgtcttctgtcttttgtaaaagtttttcatgcccaagtgagattaattgtttaaaaaaaaaaaaacaagaagaaaacaacatagatttaccgcaagacctattgatatattattaaacatggtggtatacccagggtgggtgtgacacagaccaaaagaggctgtgtgttctgttgttgataatttaaaaacaataataaaaccgaagtctatgtcaccacaaacagcacttaacaattcagtgataaggcacctgccaccgtggagaacctcggggcggggatgtttagactgca

SEQ ID NO: 111194 - DNA, 1869 bp, Homo sapiens
cgcggctgcatggacgcgggtccggcgcgcgggaggcgatgacggccccgccatggcccgggcgggcagctgcggcggcgccgcggcgggcgcagggcggccggagccctgggagctgtccctggaggaggtgctgaaggcctacgagcagccgctcaacgaggagcaggcgtgggccgtgtgcttccagggctgccgcgggctgcggggctcgccgggccggcgcctgcgggataccggggacctcctgctgcgcggggacggctcggtcggggcgcgggagcccgaggccgcggaacctgcaaccatggtcgtgccactagccagctcggaagcccagctgcacagatgaggggcacagctgacgtctgcagggccggcctcccagacacagagccggggtcagggagacgacttcaggtgcaaacaggaaaaatcagcctggtgaccagtgccccgaaaccccacccgaccaaaactggaacctcaccgcagggcagggccttcctctcccattcacctgccctgaagtcatgtctggaacgtcatgtttccactttctactgcctttttagttttctttctttgttttttttgcttttgttcattttattttattttattgttttgagatggagtcgcgctctgtcgcccaggctggagtgcagtggtgtgatctcggcttactgcaagctccgcctcccgggttcacacctttctcctgcctcagcctcccaagtagctgggactactggtgcccgccaccacgcccggctaatttttttctatttttagtagagacggggtttcaccgtgttagccaggatggtcttgatgtcctgaccttgtgattcacctgcctcggcctcccaaagtgctgggattacaggagtgagccaccgcgcccggccttattttattttttaatagagatgtctcactatgttgcccggactagtctcaaactcctgggctcaagccatcctcccacttggcctcccaaagtgctgggattacagttctgagccactgtgcctggcctctttttttttttgagatagaatctccctctgtcacccaggttggactgcagtggtgcgatctcagctcactgcaacctcggctagttgcagcgcaacctccgtctcctgggttcaagcaattctcctgcctcagcctcccgagtagctgagattacaggcgcatgccaccacgcctggctaatttttgtgtttttttttgtttttgagacagagtctctctctgtcaccaggctggagtgcagtggcgtgatcttggctcactgcaacctccgcctcccgggttcacgccattctcctggccagcctctcaagtagctgggactacaggcgcccgccaccatgcccggctaatttttgtatttttagtagaagtggggtttcaccatgttggccaggatggtctcaaactcctgacctcatgattcacccacctcagcctcccaaactgctgggattacaggtgtgagccatcacgcccagccttttttttttttttttttagatctaccctcttgttgcccagggggagtccagtggcgtgatcttggctcactgcaaccgccgcctcccgggttcaagcaattctcctgcctcagtctcccgagtgtcttctgtcttttgtaaaagtttttcatgcccaagtgagattaattgtttaaaaaaaaaaaaacaagaagaaaacaacatagatttaccgcaagacctattgatatattattaaacatggtggtatacccagggtgggtgtgacacagaccaaaagaggctgtgtgttctgttgttgataatttaaaaacaataataaaaccgaagtctatgtcaccac

SEQ ID NO: 111195 - DNA, 727 bp, Homo sapiens
agtcctgatggagcctctgctctcccccaggtacctgtcccgcgagtgtctctgaccccagccaccccctactcagcaaccggggctcctcgggggacagacccgaggcctccatgacccccgatgccaaacacctgtggctgcccctctgccctcggtttcttatctgacctgtaattgtgaagagctcacctttgctgacatcttgaggcccacgtggacctgagttctggtgcaggatttaatcaactgaggagttcagccaccccgtggagagcctggcgctgactgtggaagaggtgatggacgtgcgccgtgtgctggtgaaggccgagatggaaaagtttttgcagaacaaggagctcttcagcagtctgaagaaggggaagatttgctgctgctgccgggccaagttcccgctgttctcgtggccgcccagctgtctcttctgcaagagaggtctctgcaagggccacagtggcagagcgtggaggaggcgttcccccacattgctccctgcccttgccctttccctttccctggggtccaaaccacatgtgtcctgcctctcctggccctaccacattctggtgctgtcctcactcgcccctggcccagaggctcctgaagatgctgggcggtcctggcacagggaggagcagctctgtaaatctgtgcacatggccactcttggcctaataaaggaggtctcacagtcaaaaaactg

SEQ ID NO: 111196 - DNA, 719 bp, Homo sapiens
cgcggctgcatggacgcgggtccggcgcgcgggaggcgatgacggccccgccatggcccgggcgggcagctgcggcggcgccgcggcgggcgcagggcggccggagccctgggagctgtccctggaggaggtgctgaaggcctacgagcagccgctcaacgaggagcaggcgtgggccgtgtgcttccagggctgccgcgggctgcggggctcgccgggccggcgcctgcgggataccggggacctcctgctgcgcggggacggctcggtcggggcgcgggagcccgaggccgcggaacctgcaaccatggtcgtgccactagccagctcggaagcccagaccgtgcagtccctcggcttcgccatctaccgcgcgctggactgggggctggacgagagcgaggagcgcgaactcagccctcagctggagcggctcatcgacctcatggccaacaacgacagcgaggacagcggctgcggtgccgccgatgagggctacgggggtcccgaggaggaggaggaggccgagggcgtcccccgcagcgtgcgcacctttgcccaggccatgcggctgtgcgcggcgcggctgaccgacccccggggcgcacaggcgcattaccaggccgtgtgccgcgcgctcttcgtggagaacgctggagctgcgggccttcctggccagggtccgggaggccaaggagtgaacggtgggtggggccgac

SEQ ID NO: 111197 - DNA, 652 bp, Homo sapiens
ggctcagatgagaacagatgttaaaatgctttgagaactatgagccttatataaatgcaaggcactgtgcgtatccccaccgaaacgcagggcctgccctgttagcctaggtcgtatcccaccgaaggcagggcttgccccgttagcctaggattagctatatatcactgcatcaaaagttacctcaaaatgcagcatcttaaaataacaaatatatattatctcacagtttctgagggttgggactccggcagtgtcttagctgtgtggccatggctcagggtctttcgtgaggctgcagttaggatggcagtggggcctgatctcgactgaagggtcaaatcggggctggaggagccgtctgaagtggcgtcttcacccagctgtgagcaggaggcgtgagtcccttgctgtgtaggcctctctcgggctgcttggggatccccacagcgtggtggctggcgtcccccagagcacgtggttcaagagtgagcgcagtgaaagccactgagtatttatgaccaagtccagcagtgccacattgtcccaactcactaggaatgagtcactaagtccagcctattctcaaggggagggagagaattaaggcccacttctttttttttttttttttgagatccgtctcaaaaac

SEQ ID NO: 111198 - DNA, 3353 bp, Homo sapiens
  misc_feature (438)..(438): n is a, c, g, or t
cttgctttgtcacccaggctggagtgcagaggcccgatctcggttcactgcaacctccacctcccaggttcaagcgattctcctgcctcagcctcccaagtaaatgggatttcaggcgtgcaccaccacgcccagctaatttttgtatttttagtagagacggggtttcatcatgttggtcaggctggtcttgaactcctgacctcgtgatccgcccgcctcggcctcccaaagtgctgggattacaggtgtgggccaccgcgcccggccgggaacatccttttcatccggtccatgtcttgcttgtgccttggtctcttgtggaccgacagctgctgtctccctggccgggtgctgggccctctgcacccaccagccgcgttctccccgccccacccccctgcagtaccgcccagtgaccgcgcccctgtcccgcanaccgtgcagtccctcggcttcgccatctaccgcgcgctggactgggggctggacgagagcgaggagcgcgaactcagccctcagctggagcggctcatcgacctcatggccaacaacgacagcgaggacagcggctgcggtgccgccgatgagggctacgggggtcccgaggaggaggaggaggccgagggcgtcccccgcagcgtgcgcacctttgcccaggccatgcggctgtgcgcggcgcggctgaccgacccccggggcgcacaggcgcattaccaggccgtgtgccgcgcgctcttcgtggagaacgctggagctgcgggccttcctggccagggtccgggaggccaaggaagatgctgcagaagcttcgggaggacgagccgcatctggagacgcctcgggcagagctggacagcctgggtcacacagactgggcccgactgtgggttcagctcatgcgggagctccgccgcggagtgaagctgaagaaggtgcaagagcaggagttcaaccccctccccaccgagttccagctcacgcccttcgagatgctgatgcaggacatccgggcccggaactacaagctgcgcaaggtcatggtggatggggacatcccgccccgggtgaagaaggacgctcacgagctcatcctggactttatccgctcacggcctccactgaagcaggtctctgagaggcggctgcgcccgttgccaccaaagcaaaggtccctgcatgagaagatcctggaggagatcaagcaggagcggaggctgcgcccggtgcggggcgagggctgggctgcccgcgggtttggctctctgccctgcatcctcaacgcctgctccggagatgccaagtccacctcctgcatcaacctgtcagtcacagatgctgggggcagcgcccagcgcccgcggccccgcgtgctgctcaaggcgcctaccttggctgaaatggaagagatgaatacatctgaggaagaagagtctccgtgtggggaggtgacgctgaaacgggaccgctccttctcagagcatgacctggcccagctccgaagtgaggtggcctctggcctgcagtcggccacccaccccccaggagggacggagccaccacggccccgagctggcagtgcgcatgtgtggaggcccggctcccgagaccagggtacctgtcccgcgagtgtctctgaccccagccaccccctactcagcaaccggggctcctcgggggacagacccgaggcctccatgacccccgatgccaaacacctgtggctggagttcagccaccccgtggagagcctggcgctgactgtggaagaggtgatggacgtgcgccgtgtgctggtgaaggccgagatggaaaagtttttgcagaacaaggagctcttcagcagtctgaagaaggggaagatttgctgctgctgccgggccaagttcccgctgttctcgtggccgcccagctgtctcttctgcaagagagccgtctgcacttcctgtagcataaagatgaagatgccttctaagaaatttggacacatccctgtctacacactgggctttgagagtcctcagagggtatcagctgccaaaaccgcgccaatccagagaagagacatctttcagtctctgcaagggccacagtggcagagcgtggaggaggcgttcccccacatctactcccacggctgtgtcctgaaggatgtctgcagtgagtgcaccagctttgtggcagacgtggtgcgttccagccgcaagagcgtggacgtcctcaacactacgccacgacgcagtcgccagacccaatccctctacatccctaacaccaggactcttgacttcaagtgacagccccaggtggccaggcctccaggaggcaccaggcaggccctgtatcaggctaggacgctctgagctgtgcatgtacatatatacatatatagatacatttataatatatacacacagtctatatatttatatacactgtttcctggccccagagctcatttgggttcaggcgcacttcaaaaccctccctgggggaggctgtttcttctcaggattccttgccagggaggaaggggagggaacagggtgggttttctcactgaagagagaaagcagaaggttctagatcctggcacagactgcatcccatgttcccatgctcttctccgtccccaggaatgcgaacggcagtttcccttccccagtggacgtctaggtggggacagggtatcttggctcccagctggaccagagtgccctgcttgcctctgctctccctttgtggggactcaggcagcagaggcatctgggaagtctctgagtaggcagggtcctcctgggaggcacccccacctgtttgaaaggtctggccaggcgtggtggttcaggcctgtaattccagcactttgggaggccgaggagggaggatcacctgaggtcaggagtttgagaccagcctggccaacatgatgaaatgttgtctctactgaaaatgcaaaaattagccaggtatagtggcaggaacctgtaatcccagctacaggggaggctgaggcaggagaatcgcttgaacccgggaggtgtaggttgcagtgagccgagattgcaccactgcactccagcctgggcgacagagcgagactctgtctcgaaaaaaaaaaaggtccgtgccaagctgctccctgcccttgccctttccctttccctggggtccaaaccacatgtgtcctgcctctcctggccctaccacattctggtgctgtcctcactcgcccctggcccagaggctcctgaagatgctgggcggtcctggcacagggaggagcagctctgtaaatctgtgcacatggccactcttggcctaataaaggaggtctcacagtcaaaaaactg

SEQ ID NO: 111199 - DNA, 3370 bp, Homo sapiens
cgcggctgcatggacgcgggtccggcgcgcgggaggcgatgacggccccgccatggcccgggcgggcagctgcggcggcgccgcggcgggcgcagggcggccggagccctgggagctgtccctggaggaggtgctgaaggcctacgagcagccgctcaacgaggagcaggcgtgggccgtgtgcttccagggctgccgcgggctgcggggctcgccgggccggcgcctgcgggataccggggacctcctgctgcgcggggacggctcggtcggggcgcgggagcccgaggccgcggaacctgcaaccatggtcgtgccactagccagctcggaagcccagaccgtgcagtccctcggcttcgccatctaccgcgcgctggactgggggctggacgagagcgaggagcgcgaactcagccctcagctggagcggctcatcgacctcatggccaacaacgacagcgaggacagcggctgcggtgccgccgatgagggctacgggggtcccgaggaggaggaggaggccgagggcgtcccccgcagcgtgcgcacctttgcccaggccatgcggctgtgcgcggcgcggctgaccgacccccggggcgcacaggcgcattaccaggccgtgtgccgcgcgctcttcgtggagaacgctggagctgcgggccttcctggccagggtccgggaggccaaggaagatgctgcagaagcttcgggaggacgagccgcatctggagacgcctcgggcagagctggacagcctgggtcacacagactgggcccgactgtgggttcagctcatgcgggagctccgccgcggagtgaagctgaagaaggtgcaagagcaggagttcaaccccctccccaccgagttccagctcacgcccttcgagatgctgatgcaggacatccgggcccggaactacaagctgcgcaaggtcatggtggatggggacatcccgccccgggtgaagaaggacgctcacgagctcatcctggactttatccgctcacggcctccactgaagcaggtctctgagaggcggctgcgcccgttgccaccaaagcaaaggtccctgcatgagaagatcctggaggagatcaagcaggagcggaggctgcgcccggtgcggggcgagggctgggctgcccgcgggtttggctctctgccctgcatcctcaacgcctgctccggagatgccaagtccacctcctgcatcaacctgtcagtcacagatgctgggggcagcgcccagcgcccgcggccccgcgtgctgctcaaggcgcctaccttggctgaaatggaagagatgaatacatctgaggaagaagagtctccgtgtggggaggtgacgctgaaacgggaccgctccttctcagagcatgacctggcccagctccgaagtgaggtggcctctggcctgcagtcggccacccaccccccaggagggacggagccaccacggccccgagctggcagtgcgcatgtgtggaggcccggctcccgagaccagggtacctgtcccgcgagtgtctctgaccccagccaccccctactcagcaaccggggctcctcgggggacagacccgaggcctccatgacccccgatgccaaacacctgtggctggagttcagccaccccgtggagagcctggcgctgactgtggaagaggtgatggacgtgcgccgtgtgctggtgaaggccgagatggaaaagtttttgcagaacaaggagctcttcagcagtctgaagaaggggaagatttgctgctgctgccgggccaagttcccgctgttctcgtggccgcccagctgtctcttctgcaagagagagtttcactcttgttgcccagtcggaagtgcaatctcggctcactgcaacctacacctcccgggttcaagcgattctcctgcctcagcctcctgagtagctggcattacagagccgtctgcacttcctgtagcataaagagatgaagatgccttctaagaaatttggacacatccctgtctacacactgggctttgagagtcctcagagggtatcagctgccaaaaccgcgccaatccagagaagagacatctttcagtctctgcaagggccacagtggcagagcgtggaggaggcgttcccccacatctactcccacggctgtgtcctgaaggatgtctgcagtgagtgcaccagctttgtggcagacgtggtgcgttccagccgcaagagcgtggacgtcctcaacactacgccacgacgcagtcgccagacccaatccctctacatccctaacaccaggactcttgacttcaagtgacagccccaggtggccaggcctccaggaggcaccaggcaggccctgtatcaggctaggacgctctgagctgtgcatgtacatatatacatatatagatacatttataatatatacacacagtctatatatttatatacactgtttcctggccccagagctcatttgggttcaggcgcacttcaaaaccctccctgggggaggctgtttcttctcaggattccttgccagggaggaaggggagggaacagggtgggttttctcactgaagagagaaagcagaaggttctagatcctggcacagactgcatcccatgttcccatgctcttctccgtccccaggaatgcgaacggcagtttcccttccccagtggacgtctaggtggggacagggtatcttggctcccagctggaccagagtgccctgcttgcctctgctctccctttgtggggactcaggcagcagaggcatctgggaagtctctgagtaggcagggtcctcctgggaggcacccccacctgtttgaaaggtctggccaggcgtggtggttcaggcctgtaattccagcactttgggaggccgaggagggaggatcacctgaggtcaggagtttgagaccagcctggccaacatgatgaaatgttgtctctactgaaaatgcaaaaattagccaggtatagtggcaggaacctgtaatcccagctacaggggaggctgaggcaggagaatcgcttgaacccgggaggtgtaggttgcagtgagccgagattgcaccactgcactccagcctgggcgacagagcgagactctgtctcgaaaaaaaaaaaggtccgtgccaagctgctccctgcccttgccctttccctttccctggggtccaaaccacatgtgtcctgcctctcctggccctaccacattctggtgctgtcctcactcgcccctggcccagaggctcctgaagatgctgggcggtcctggcacagggaggagcagctctgtaaatctgtgcacatggccactcttggcctaataaaggaggtctcacagtcaaaaaactg

SEQ ID NO: 111200 - DNA, 2217 bp, Homo sapiens
cgcggctgcatggacgcgggtccggcgcgcgggaggcgatgacggccccgccatggcccgggcgggcagctgcggcggcgccgcggcgggcgcagggcggccggagccctgggagctgtccctggaggaggtgctgaaggcctacgagcagccgctcaacgaggagcaggcgtgggccgtgtgcttccagggctgccgcgggctgcggggctcgccgggccggcgcctgcgggataccggggacctcctgctgcgcggggacggctcggtcggggcgcgggagcccgaggccgcggaacctgcaaccatggtcgtgccactagccagctcggaagcccagaccgtgcagtccctcggcttcgccatctaccgcgcgctggactgggggctggacgagagcgaggagcgcgaactcagccctcagctggagcggctcatcgacctcatggccaacaacgacagcgaggacagcggctgcggtgccgccgatgagggctacgggggtcccgaggaggaggaggaggccgagggcgtcccccgcagcgtgcgcacctttgcccaggccatgcggctgtgcgcggcgcggctgaccgacccccggggcgcacaggcgcattaccaggccgtgtgccgcgcgctcttcgtggagaacgctggagctgcgggccttcctggccagggtccgggaggccaaggaagatgctgcagaagcttcgggaggacgagccgcatctggagacgcctcgggcagagctggacagcctgggtcacacagactgggcccgactgtgggttcagctcatgcgggagctccgccgcggagtgaagctgaagaaggtgcaagagcaggagttcaaccccctccccaccgagttccagctcacgcccttcgagatgctgatgcaggacatccgggcccggaactacaagctgcgcaaggtcatggtggatggggacatcccgccccgggtgaagaaggacgctcacgagctcatcctggactttatccgctcacggcctccactgaagcaggtctctgagaggcggctgcgcccgttgccaccaaagcaaaggtccctgcatgagaagatcctggaggagatcaagcaggagcggaggctgcgcccggtgcggggcgagggctgggctgcccgcgggtttggctctctgccctgcatcctcaacgcctgctccggagatgccaagtccacctcctgcatcaacctgtcagtcacagatgctgggggcagcgcccagcgcccgcggccccgcgtgctgctcaaggcgcctaccttggctgaaatggaagagatgaatacatctgaggaagaagagtctccgtgtggggaggtgacgctgaaacgggaccgctccttctcagagcatgacctggcccagctccgaagtgaggtggcctctggcctgcagtcggccacccaccccccaggagggacggagccaccacggccccgagctggcagtgcgcatgtgtggaggcccggctcccgagaccagggtacctgtcccgcgagtgtctctgaccccagccaccccctactcagcaaccggggctcctcgggggacagacccgaggcctccatgacccccgatgccaaacacctgtggctggagttcagccaccccgtggagagcctggcgctgactgtggaagaggtgatggacgtgcgccgtgtgctggtgaaggccgagatggaaaagtttttgcagaacaaggagctcttcagcagtctgaagaaggggaagatttgctgctgctgccgggccaagttcccgctgttctcgtggccgcccagctgtctcttctgcaagagagccgtctgcacttcctgtagcataaagatgaagatgccttctaagaaatttggacacatccctgtctacacactgggctttgagagtcctcagagggtatcagctgccaaaaccgcgccaatccagagaagagacatctttcagtctctgcaagggccacagtggcagagcgtggaggaggcgttcccccacatctactcccacggctgtgtcctgaaggatgtctgcagtgagtgcaccagctttgtggcagacgtggtgcgttccagccgcaagagcgtggacgtcctcaacactacgccacgacgcagtcgccagacccaatccctctacatccctaacacccgggcggtgggggcactgctccgcgccttggccagcagc

SEQ ID NO: 111201 - DNA, 1636 bp, Homo sapiens
catagaagacttcctacctgaggccgtcccctaggagttcagccaccccgtggagagcctggcgctgactgtggaagaggtgatggacgtgcgccgtgtgctggtgaaggccgagatggaaaagtttttgcagaacaaggagctcttcagcagtctgaagaaggggaagatttgctgctgctgccgggccaagttcccgctgttctcgtggccgcccagctgtctcttctgcaagagagagatgaagatgccttctaagaaatttggacacatccctgtctacacactgggctttgagagtcctcagagggtatcagctgccaaaaccgcgccaatccagagaagagacatctttcagtctctgcaagggccacagtggcagagcgtggaggaggcgttcccccacatctactcccacggctgtgtcctgaaggatgtctgcagtgagtgcaccagctttgtggcagacgtggtgcgttccagccgcaagagcgtggacgtcctcaacactacgccacgacgcagtcgccagacccaatccctctacatccctaacaccaggactcttgacttcaagtgacagccccaggtggccaggcctccaggaggcaccaggcaggccctgtatcaggctaggacgctctgagctgtgcatgtacatatatacatatatagatacatttataatatatacacacagtctatatatttatatacactgtttcctggccccagagctcatttgggttcaggcgcacttcaaaaccctccctgggggaggctgtttcttctcaggattccttgccagggaggaaggggagggaacagggtgggttttctcactgaagagagaaagcagaaggttctagatcctggcacagactgcatcccatgttcccatgctcttctccgtccccaggaatgcgaacggcagtttcccttccccagtggacgtctaggtggggacagggtatcttggctcccagctggaccagagtgccctgcttgcctctgctctccctttgtggggactcaggcagcagaggcatctgggaagtctctgagtaggcagggtcctcctgggaggcacccccacctgtttgaaaggtctggccaggcgtggtggttcaggcctgtaattccagcactttgggaggccgaggagggaggatcacctgaggtcaggagtttgagaccagcctggccaacatgatgaaatgttgtctctactgaaaatgcaaaaattagccaggtatagtggcaggaacctgtaatcccagctacaggggaggctgaggcaggagaatcgcttgaacccgggaggtgtaggttgcagtgagccgagattgcaccactgcactccagcctgggcgacagagcgagactctgtctcgaaaaaaaaaaaggtccgtgccaagctgctccctgcccttgccctttccctttccctggggtccaaaccacatgtgtcctgcctctcctggccctaccacattctggtgctgtcctcactcgcccctggcccagaggctcctgaagatgctgggcggtcctggcacagggaggagcagctctgtaaatctgtgcacatggccactcttggcctaataaaggaggtctcacagtcaaaaaactg

SEQ ID NO: 111202 - DNA, 1855 bp, Homo sapiens
cgcggctgcatggacgcgggtccggcgcgcgggaggcgatgacggccccgccatggcccgggcgggcagctgcggcggcgccgcggcgggcgcagggcggccggagccctgggagctgtccctggaggaggtgctgaaggcctacgagcagccgctcaacgaggagcaggcgtgggccgtgtgcttccagggctgccgcgggctgcggggctcgccgggccggcgcctgcgggataccggggacctcctgctgcgcggggacggctcggtcggggcgcgggagcccgaggccgcggaacctgcaaccatggtcgtgccactagccagctcggaagcccagaccgtgcagtccctcggcttcgccatctaccgcgcgctggactgggggctggacgagagcgaggagcgcgaactcagccctcagctggagcggctcatcgacctcatggccaacaacgacagcgaggacagcggctgcggtgccgccgatgagggctacgggggtcccgaggaggaggaggaggccgagggcgtcccccgcagcgtgcgcacctttgcccaggccatgcggctgtgcgcggcgcggctgaccgacccccggggcgcacaggcgcattaccaggccgtgtgccgcgcgctcttcgtggagaacgctggagctgcgggccttcctggccagggtccgggaggccaaggaagatgctgcagaagcttcgggaggacgagccgcatctggagacgcctcgggcagagctggacagcctgggtcacacagactgggcccgactgtgggttcagctcatgcgggagctccgccgcggagtgaagctgaagaaggtgcaagagcaggagttcaaccccctccccaccgagttccagctcacgcccttcgagatgctgatgcaggacatccgggcccggaactacaagctgcgcaaggtcatggtggatggggacatcccgccccgggtgaagaaggacgctcacgagctcatcctggactttatccgctcacggcctccactgaagcaggtctctgagaggcggctgcgcccgttgccaccaaagcaaaggtccctgcatgagaagatcctggaggagatcaagcaggagcggaggctgcgcccggtgcggggcgagggctgggctgcccgcgggtttggctctctgccctgcatcctcaacgcctgctccggagatgccaagtccacctcctgcatcaacctgtcagtcacagatgctgggggcagcgcccagcgcccgcggccccgcgtgctgctcaaggcgcctaccttggctgaaatggaagagatgaatacatctgaggaagaagagtctccgtgtggggaggtgacgctgaaacgggaccgctccttctcagagcatgacctggcccagctccgaagtgaggtggcctctggcctgcagtcggccacccaccccccaggagggacggagccaccacggccccgagctggcagtgcgcatgtgtggaggcccggctcccgagaccagggtacctgtcccgcgagtgtctctgaccccagccaccccctactcagcaaccggggctcctcgggggacagacccgaggcctccatgacccccgatgccaaacacctgtggctggagttcagccaccccgtggagagcctggcgctgactgtggaagaggtgatggacgtgcgccgtgtgctggtgaaggccgagatggaaaagtttttgcagaacaaggagctcttcacaattacaggtcagataagtaaccgagggcagaggggctgaccagtaccgtgtcggagtcacggccagagtcaaggtctcgacccagtgaaccccccacactgcctcgtgc

SEQ ID NO: 111203 - DNA, 251 bp, Homo sapiens
agtcccttgctgtgtaggcctctctcgggctgcttggggatccccacagcgtggtggctggcgtcccccagagcacgtggttcaagagtgagcgcagtgaaagccactgagtatttatgaccaagtccagcagtgccacattgtcccaactcactaggaatgagtcactaagtccagcctattctcaaggggagggagagaattaaggcccacttctttttttttttttttttgagatccgtctcaaaaac

SEQ ID NO: 111204 - DNA, 399 bp, Homo sapiens
ggttcactgggtcgagaccttgactctggccgtgacgccgccacggtactgctcagcccctctgccctcggtttcttatctgacctgtaattgtgaagagctcacctttgctgacatcttgaggcccacgtggacctgagttctggtgcaggatttaatcaactgaggtaaggggagtgtgcggcccgtgggccacggtggcagcatgcaggtgttggagggatgtgaacggtgtggttgctgtcactatttgaggttttatccagcggctcagatgagaacagatgttaaaatgctttgagaactatgagccttatataaatgcaaggcactgtgcgtatccccaccgaaacgcagggcctgccctgttagcctaggtcgtatcccaccgaaggcagg

SEQ ID NO: 111205 - DNA, 154 bp, Homo sapiens
catattctctcagtcactcacccaggtgcagaaacataggttccttatggagttttctatttttacctctattttacccacaaaccctgctagtcctccctgccatatgcctggcttattttaaggaaacacatgttgagtgaatggatgtctc

SEQ ID NO: 111206 - DNA, 275 bp, Homo sapiens
ataaactcttacaaactccaaaactaaagaaaacaggcttttaagtgtgacagaaactactgctttgacaacatttactgtatttgtttacatatagaagagcccaagtcccctacaattgtcttacaagtgtcttatgtccagagaacatgtaagatgagtgctagagacttgtcttactgagcttgtaactccagagcaggaccatgtagtcactactcatttatgcttttaattacaccactcggcactcttcaattgggttaggggaaatg

SEQ ID NO: 111207 - DNA, 487 bp, Homo sapiens
agagtccccatccagctctccaaattagcccctttccccatcttgccttgcgatgattatttacacacttcaccagccaccgcttcacccttctctcctccagtggaaaacatcaccatgtgatggacagaatatagctatgcagatgcaaacagacgttactggaaaaagagctctgtgatcaaaaagtttgataactgttgtttgataaatcttatgaaattattctcacagctttaagattccagtgtgcactgtgatcttttgaaagacaatgtatcattttgcaagagttttcagctacatttcttttaacgtgctggttatctggaaggactggtgtgctgaatgctgttcgggactatcacatcgggatcccgctcaactatagccaatataagcagctcaccatccaggtgctgctggacaggctcgtgttgcggagactttaacccctgggcatccagatatgcgagtacttgcgcct

SEQ ID NO: 111208 - DNA, 648 bp, Homo sapiens
agttcaagaccagcctggccaagatggtgaaaccccggctctactaaacatacaaaaattagccaggcgcggtggtgggcacctgtaatcccagttatttaggaggctgaggcaggagaatctcttgaactcaggaggcagaggttgcattgagccgagatcactgcactttagcctgggtgacagagcaagactccatctcaaaaaaaaaaaactggggtagaaatggatgctctagattagaaagaacttaaatgacataacagatttttaaatattggcaaaatgaaacactataaaggtatacatgtgggtgataagtctataaagaaatacagaaaaatagattattattataaatgtcaaagaagttgttacttttaggggcagggagtgaccatttgaagaactttgggaatcctggcaatattctatttttcatgtccaggctagtgattacaaacatttatcctataataattcattgagccaaatatttgtgcaattttctgtggtctgtgaatttacatactctgggaaagagtattccaagcataaaaaataaccaaggaaagtaatctgggatgggagtgagctcagtattcctaagagggagaatgaagggcagggtggttcaatctcataagt

SEQ ID NO: 111209 - DNA, 658 bp, Homo sapiens
gatccgcccgcctcggcctcccaaagtgctgggattacaggcgtgagccatcacgcccggccccaaccatttctgtagtgggtatcttttatcctagaaaaatttagaacatacagaaataataaaagccattactgtgtaccagtaaagcccactgatttagtatttttgcgacaagtttaggaatacgttttgtactgagacaatctatgtatattttgcatatcaagtatgtgttagacttcaactgtaatcaagtaactggttttcagattcactaattctttttttttttttgagacagagttttgctcttgttgcccaggctggagtgcaatggtgtgatcttggctcaccacaacctccgcctcgcaggttcaagcttttctcctgcctcagcctcccaagtagcagagtttacaggtatgtaccaccaagcctgactaattttttttgtatttttaatagagacggggtttctccatgttgggtcaggctggtctcgaactcccctcctcaggtgatgcgcccaccacagcctcccaaagtgctgggattacaggtgtgagtcacagtgcccggcccagattcattaattcctaaggtgaaagatactttctaaattgactaatttggttgcagtggatggtttaagata

SEQ ID NO: 111210 - DNA, 356 bp, Homo sapiens
aaacattccaagcttgtgataagccccctcaccctaaaaccaacatatactctcagtctgtaagagaaagcgctcctgaccaaaatcggccaggagtacctctcaggttttaactaaagaaaacctgtctttgactgccaagctgcgtttcatgtttctttcctctttaactcttacacctgttacagatactgggaggtccagcatgatattatttgaaacaacacatcagggttctatggctggaagaaaccccagctgtctccaccccctgggaggcgccactcaccccgctgtcttggacatggcacctggtgtccaggctgggtgactgggaggtgggggaccctctgctc

SEQ ID NO: 111211 - DNA, 129 bp, Homo sapiens
agcacctttatctctgtgactagaaatcagtcttcagcaaggatcaaggacagtttttacctgtaggctttggaatagtctggaggctctcatttttacctggctgtcaatccctataggaggagtttt

SEQ ID NO: 111212 - DNA, 281 bp, Homo sapiens
aaaaatccagaaagaaaaatatttgataaaagttgattacctatttgataaaatacagttaactcttcaacaacaatgggggttggggcattgaccctcatgcagttgaaaatttgtttataacttttgggttcccaaaaacttaacctactaacagcgtactgttgcacagaagccttgccgataacgtaaaatagtcacttaacatattttgtatgtttcatgtattatatactatattctttaataaagtaacctagagaaaagaaatggtcattaat

SEQ ID NO: 111213 - DNA, 295 bp, Homo sapiens
attttaacagtaaataaatattgaaaagaaagaaaggttaaaactagcctttaagtaaacgtgtcagaaatatatctaagaaaacaggctatttgatatcatgccactggattacaacccactgagaaacaggtgggggcatcataaattcaaaatgccaaaaagtcactataaaacactttttatataaatcatttaactattaagtaaacaattgcttatttaaaaatccagatgaaggcgaggcacaatggctcacacctataatcccatgtctttcggaggccaaggcagg

SEQ ID NO: 111214 - DNA, 403 bp, Homo sapiens
acgttatctatataggtgtattaaaacattcatgaattttgaggaaattatgctaagtgaaataagccagacacagaaatgcaaatactgcatgattccatttatatgaagtatctaaaatagtcaaactcaatgaaggagaaagtagaattgtggttgctatgggccaggggaggggaaatcaggagttgcttttcaaagggtataaagtttcagtcaagcaaaataaaaatgttatagaaatcagctgtgcaatattgtgtttatagttaacaatactgtactgtatgtataaaaatttgtaaagtgagtagatctcatatgcttaacacaataaaaatatttaaaaaataataggaaaaaaaaaagcagtccaataaattgactaaattaaggacaaata

SEQ ID NO: 111215 - DNA, 292 bp, Homo sapiens
tctaagggagtttcccagccccaggggttaaagaactggagtcaagattggaacccagctggcgaaggattccgcaccgctagatcttgacatttgcctcttcttctgccaggaaggctcccctgttcctttttgctgacgtgtcatttctaagtactttctcctactccataaagacttcaagtgagtacacaatactggtgttagtttaatttctaagacagtgagacactcggagaagttcaattttctttaatgcaagtgaaaaattgagttacttaaaagaaataga

SEQ ID NO: 111216 - DNA, 645 bp, Homo sapiens
atgctttggaaagtagctccaaggaggacaattttggatcccacagggagggatttggtagtagtgggagctggctgagattggagggagtccccatccctggagaaatgcacctggggggccgtgggaggcatggaatggtatgttcatgtcctatgctgctgtaacaaatggccactgaagttgtgacgtgaagcaacaggagtttatcatcttacagttacgaggccagaactccaaagtgggtcccactgggttacaatcagggtgtcagcagggcacgatcctccgggaggctctaagggagagtccaagccttcgtcttttctggcttctggaggctgcctgtgttccttgactcatggccttccctccatcctcaaagccagcagtgtcaggccgggtacctctcatgctgcccctctctagggctctcttctgcctccctcttccatttcctgtctcctgtgatttcctcaggcccacccagataatccaggataatctccccatcccgaggtcagctgattagcaaacttaactccatctgcagccttaattttcctttccatgtaccctaacatattcccaggctccagggaccagggtgtgaacatctctggtagggctgttatgctgcccacc

SEQ ID NO: 111217 - DNA, 448 bp, Homo sapiens
agtgcagggcctctgactagcccgggcatcatttataccagttattcaagactgagggaccccgggagttcaggcccaaagaatgtctttagctgcaaaattgcagtacaacatcaagtgaaacgatggatctaccctcttctctggattgcttctgggtatctcagagctgctaataaaattgtcttgtgctttgggctgtcttgtggggagaaacagggggcagggtaagtgtttttgagctctaacctttcaaaaaccccatagaggtggcaggatttctgttcattcctcctcatgcctcttttcccagcccttgtacattttatcaactgttctcggcatgtaatacatttacggagctgcacttttggtctcagggaattcagcagtttctccaagtttatctggtggcacattgtttccttactaggaggcagaggtcaag

SEQ ID NO: 111218 - DNA, 789 bp, Homo sapiens
attgtgggaaaactaccttacatcttgacggaacctgaaaactttctctactttatctggtttcaaattatgcaagaaagtccccatgaggacttcattaaacctgccagagttttataaccaaaaacctcactggaacccccacttttacgaatctatgaaagtaatttaacccctctgtgttctgcttgcccaagatcagatgcaaatactattaaacagtatatacagtttaattctcttgagttttggtgatgaaaaatcctatccaaatattatgatccttgcaatacgtaatgtaaccaaattaacgatagctccaggtggaaattaacaaggccagggctactcacgtttcctctcatctattcccatagtaacagctaatgtattatattgctaaaatatcttatattcagttttatgtctgaacttggtgttgtgtcataaagcgtagcattcctatccagactggattcttaatatgtgtatcctcatgaaatttaggagagtttcgtgtctgcaaatcaacacttcatgtgcatagtctaaaccacatgcagataaaagcaagtcagaacctaccaagactctcaccatagtgaacctacacatggtatagaggaagaattcttacctgggagacctgatgacacattaccagtgcaggacctaaagcgaatcaccatagagagatccacacaggaattatagtgtgaaaaaaaatccccaatcatagacattgttagcttcagttttcagtgaatctaaactcttctagtatgaaaa

SEQ ID NO: 111219 - DNA, 410 bp, Homo sapiens
tcaaaatcctattacaagattttatttgcagatgctaggaacagaaggctagagcctccatagtttattgctactcaacttcatcaggtctgctcactctattgaaaactgtggcaaaaatgatatacatcagctcttttatttttttgttaccactctgtgcaaataaaagcatattggggaatttaatgaagcagtatgtccttggagggagctttaaagattctgagtgtacaactatttgtctttaatactggaggtttctgtgtaaaactggcaggagcaaaataaagtcttcacagaccaatgtttgccacatacacacttgaatcgcacaaatgtctacgcagcggtgaccttggagatggatgcattcagtgactattatagtggcttttgaggtgtgtcag

SEQ ID NO: 111220 - DNA, 650 bp, Homo sapiens
catataaagcataccaaaaagttaatattcataaaagcattttcttgccaaaaatagataaatttaagagaaatcattgttgatttctgagttacatgtaaagtcaatatatgctgctaaactctctttaacttttccagtatgttacagtttttaacaatctgttgttcaaaaactaaataccagaggtatataaaatattagataatatttgagcataaactgttgaaggcaacagcataattttatttccttatgccataatagagcatcacatctcagtcagcctaccccaatgatgacatattttctgaattgtttttacccacacatcttatgctcaatttaacaaatatttattaagtgcatagttggcaaggtgacactatggaggagatgaaaaagactaaggtatcatttgtgcccttgaggaattaataatctgacggcaaaagctgacatgtatacaatcaactgtagtatttgaaaggataaagtaagtcctttaatagcaatataaactgctcggctagtattgagagagcaaggctagagggcagagcaatgtgaagcttggattgaagtggcaggatattaaaggcaagacatcagttatgaagctaaagcatatataggcaataacatgataa

SEQ ID NO: 111221 - DNA, 1458 bp, Homo sapiens
ttcctgcttagttcttcctgaggtctgagcaccctccaaactgagtccagatctgagtttttcctcggagatttgtcagaatgagcctccaggccccatccagactgctggagctggcagggcagagcctgctgaggaaccagttcttgaccatcttcaccctggatgagctgcccagggaggtcttccctctgatgttcatggaggccttcagcatgagacgttttgaggccctgaagctgatggtgcaggcctggcccttcctcagcctccctctgggatccctgatgaagacacttcatctggagaccttgcaagctgtcctgaggggacttgatacactggtggcccagaaggttcgccccaggaggtggaaacttcaagtgctggatttgcgggatgttgatgagaatttctggaccatatggtctggagccagggtcctctcctgctccccagaggccatgagtaagaggcagacagtggaggactgtccaaggatgggagagcaccagcccttgaaggtgttcatagacctctgcctaaaggaaagtacactggatgaatgcctgagctacctttttgggtggatccactacagaagaggcctagtgcacctgtgttgtagtaaggtgcagaattactcaatgcccacttcaagtttcagaaatctattggaaaggatatacccagacagtatccaggagttggaagtctggaaaaagtgctctctcaataaaacgggaaagtttgccccttacctgagccagatgagcaatcttcgtgaactctttttagccttcggttatgagcgtgagttgtacgtgagcgtccagtggccgtgcattcctgacttggactctccattcctctgcctgtactacccccagatgctttatataaaaaagatcagtaatatcaaagagcacctggagcacctgctcaggtacctcaagaaccccttgggggcctttatattcagtgatgcttacctaactgatcgggacatggagtgtctgtctcagtacccaagcctcagtcagctaaaggagctgcgtctgattcatatcctaatgtggaccacccatcttgagccccttggagttctgctggagaaagttgctgctactctcaagaccctcgtcttaaaggactgtcggatccaggacccccaactcagggtcctcctgcctgccctgagccactgttcccagctcaccaccttcaactttcatggaaatgagacctccatgaatgctctgaaagacctgctgcgtcacacaggcgggctgagcaagttaggcctggagttgtatcctgcccctctggagagtcttgactacaagggtcatgtcaattgggagatcctcaccccaattcgggctgagctgatgcgtacactcagggaagtcaggcagcccaagaggatcttctttggtcccgtcccttgccctaact

SEQ ID NO: 111222 - DNA, 430 bp, Homo sapiens
gaactcaaaagttaaatatttcaccatgcttctgtatgattttaacatgttaaatgtggctaatttgtcactgttggacttcaggtgacctaatattcaaaaagttaattaggtcactaagggtaaattagaatttgatttggaaagtttgtcaaatatcaaaggattgaaacagtgttacaaaatagaatcaccaatcacgattaaatgaattactcattaagtcaaaaatgatattttaaatatttctaaaaagcaaaaatctttattctttgatatagagaaaggagatacagtttcttaaacaataaggtctaatatcaggctgagtgcactggcttgtgcctgtaattccattgctttgggaggccgacacgggaagatcatttgagctcaggagttcaagacgagcctgggcaatatagtgaga

SEQ ID NO: 111223 - DNA, 335 bp, Homo sapiens
ccgaggctcacgtgggtgctaagactgacttttctagggtcagctccacttaaagggacttagggctggctacatgcccctctttcccaaacccaggtcttccagaactttcaaaatcaaaatcggggttgcgttaggacatgcctctgggataagattccccatggtgggatggcagcaggtgagcaggtgtgccttcctctcgcctcctgctgtacctttgaagtccatggctgaggttccatgtccctaactcaggagagtgaggacagagggaaggaggctttaccaagatctcagtctaaaaaggctggtgagctgcagagtggagcggg

SEQ ID NO: 111224 - DNA, 301 bp, Homo sapiens
aaaaaaaaaaaatctgggacttttaaaagtgaaatggtgatatacaaaaaataattccttgagtttttatgttggtctctttgttatagtgcttcaattcaagatatatgtgtatgtttgcaagtgtacatgttttctaataaggttgaagatgtagaaattgaaaagattatatcctgctatggagatttacttttttaaagagcaataatcaaggaattaaaataaacatgaagtgtaaaatgcttaggttactcatgtttttcctcaagagaagaaatgctcatgtttttccctgagg

SEQ ID NO: 111225 - DNA, 566 bp, Homo sapiens
tacactgagttaacaatgttcacctataaggtagtccctcacttggcttctcttccctcaatggacaacacacccaattggtgagactctagaggagaggaatggacacactcacatgttgtttattggaatgcagagtggtataacctcctataatggggttttgtcaacatcatctttgatctaggaaatcctaccttaggagtatgccttaaagatagaatggcaaaaatacaaaatgacatatgcacaaggatatattcattgcagcattatttagagtagcaaaagattgaaacaacccaaatatccatctgttagggttctgattgaataaaatggttcatgccccaagtgggatattatgtaggtataaaaatcaaaaacaataccttttaagctgtgattgctactgtacattttgttaagtaaaataataagatacagaacagtgagtaaagtaggctttttatttaagtaaatatatttgagtatgtgttcatgtgtatatctatgtttctacttttatttttttttaaaaaatggaattaacccaaaactaattt

SEQ ID NO: 111226 - DNA, 718 bp, Homo sapiens
gaaagtaggtccagtaaaggaagccatatggtttgccgttcaagtctgatgcatttgtgaagtaacagatgcaaaattgagcacacctggaattcagaggcagaagccctgacagagcaatctgttgtgtaacaccatagatgcttgagaatttgtggggatgaagtccctacagaaataacctgccttgagagaacccacatcttaatacataacctacattggctgttgggcatttcttttttatggctggctacatttatactctcattagttttctgatgattgaataaatatggtcacatagagtttatttgagtgaataaaaagaataagaggtataatacgaaaatgcaggcactgtcttagctgtattgttctgtaatattatagtagggtttttacatatggtgggtgttgtgtgtggtcattgctgagttttgcataactcttttacacaaaaggggcttcttttgcattatttttttgctctactaacagtggtaactccttcaggatagaggttggcagtgttgcagaatgtcacatggattatatgtctggattgtttagaccaaatattactgtataaatctgggctcaaggaagagttgggctgaggcacaatctagttctaatgcatctgtcagttacaaatccctctcatatctctattgcatattagtgcaataacctgaaatgactgatagccagagag

SEQ ID NO: 111227 - DNA, 667 bp, Homo sapiens
gcccaacaaattctagcccccgcagcctccccagctctgatctcaactgaccactctccactccaatctcagatgtcctcagctggcaagactgggccctccttccctgtgcagcagcctgcaacctgccttcaggcagcacagtctggcattccccgtggttcaatgtctaaaagtcattgtttatgtactttgtccagtttcctattgtttacagcaggaagataaatccagcctctagtactccatggccagaagaagtctcatcttctaaatgtaaattaagcatgtattgatacttctagggggaagttaggggacttggctcatcagttcccaacatacttaaatataacacactttaatgtctgctttcttctttgtaacttaagcgatgacataaatgatgctcttcagtgctcacactaggctaatctaagcttgagtgtttttctgtgatcaacttgaaattatctacataaagagtattaattttgacttatttgtggccaacttatatagagtagcttcccatgaatgatggatatgttagtattctgattctaaggacattgttagctatctgtatgtctggttaatttgtcataagaacttatgtcatgtatcatgcttggacttttaaaaatatgaacttgctgattttata

SEQ ID NO: 111228 - DNA, 335 bp, Homo sapiens
atcctcgggggagacacatctaaatgtgtaaaaaggaaattttattgtacacattgtggcctatttattttcgaattactcattctggaattagaaaatagaaacggtttaaggcttctggataattattttgtcatcgcacacacaccaaggattagaaggaaaaaaagagcagtctgctattaaagactcaacaatgtgaacctttggacacgcagtcctacctctccgttaagccagattgactgcccaagaactggcacagtacacaagaactagtattctctgttctgctcacacatgagcgtgtgagggcgatgggcagaggatcactt

SEQ ID NO: 111229 - DNA, 378 bp, Homo sapiens
ccagagcctgccacctaaccccctgccatgggttcctaatgggtatttttgggccatgtccttttcttcctactgcctacaactgccgctgcctcacattctccctaagacccatctcccaatgggtctcccttaccaacacactgagtcttcattctacctcaaggtcaagggctctcttggtcttaataatatttttccttcttaatggagggggagaagagctctggtgccagagagacctagggacagatcctggagctgccccttgctggtgattggaccaggatgtagctcatcgtgtgtgaaatggcagtgctttctacctggaggggcaggtgtaaggatggaaatgggatagtgccctgccccgaggct

SEQ ID NO: 111230 - DNA, 363 bp, Homo sapiens
gtgatgaagcctcctctgccacctccttgtgtgtaccacgtgccgcagccagccatggcagggcccctgctaccacctctgcatctcgcttgagtggcacctggctggggcaggaagaccactgatttggagtcagacagacctactttctagccaccatctggagctctctgagcctcagttcctcactgagcaacgcatgcaggaacacatctgcttaggtccccacagccacgtcctgggtaggctgcctcccccatcctgccctgccctgtgtttaactcccctccaactctaggattgagatactgtggcatcccaatggcagcaaagtaacagctcagataaatctcctccccccga

SEQ ID NO: 111231 - DNA, 515 bp, Homo sapiens
gtgatgaagcctcctctgccacctccttgtgtgtaccacgtgccgcagccagccatggcagggcccctgctaccacctctgcatctcgcttgagtggcacctggctggggcaggaagaccactgatttggagtcagacagacctactttctagccaccatctggagctctctgagcctcagttcctcactgagcaacgcatgcaggaacacatctgcttaggtccccacagccacgtcctgggtaggctgcctcccccatcctgccctgccctgtgtttaactcccctccaactctaggattgagatactgtggcatcccaatggcagcaaagtaacagctcagataaatctcctccccccgacccctgcctgactccttgattccctttaataattagcttctcttccaggctttccatttcaaagcaagaataaatatgtgaaatcaaccagggagctgctgagtcttggctgtcatgagactgatgatggctggtgctccagcaaccacaga

SEQ ID NO: 111232 - DNA, 5361 bp, Homo sapiens
aggaagtagggagagaggagttgggctgtgccggaggccgaggaccgagagggctcaggtgacccctggaaagcctgggtggctggaaaggagcctagcgcctgcatgaaaggaagaacctgctgggaagtacctgagctcgagctgtgggttccgccgcccttcccctgcgtggtggcttggtggccgcgtctgcgcctcagccctgagaatccggatggcggtgaggtggacttgggcaggcaagagctgcctgctgctggcgtttttaacagtggcctatatcttcgtggagctcttggtctctacttttcatgcctccgcaggagccggccgtgccagggagctggggtcaagaaggctctcagacctccagaaaaatacggaggatttgtctcgaccgctttataagaagccccctgcagattcccgtgcacttggggagtgggggaaagccagcaaactccagctcaacgaggatgaactgaagcagcaagaagaactcattgagagatacgccatcaatatttacctcagtgacaggatttccctgcatcgacacatagaggataaaagaatgtatgagtgtaagtcccagaagttcaactataggacacttcctaccacctctgttatcattgctttctataacgaagcctggtcgactttgctccgtaccattcacagtgttttagaaacttctcctgcagttcttttgaaagagatcatcttggtggatgacttgagtgacagagtttatttgaagacacaacttgaaacttacatcagcaatcttgatagagtacgcttgattaggaccaataagcgagaggggctggttagggcccgtctgattggggccactttcgccactggggacgtcctcactttcctggattgtcactgtgagtgtaattccggttggctggaaccgcttttggaaaggattgggagagatgaaacagcagttgtgtgtcctgttatagacacaattgattggaatacttttgaattctatatgcagataggggagcccatgattggtgggtttgactggcgtttaacatttcagtggcattctgtccccaaacaggaaagggacaggcggatatcaagaattgaccccatcagatcacctaccatggctggaggactgtttgctgtcagcaagaaatattttcagtaccttggaacgtatgacacaggaatggaagtgtggggaggtgaaaaccttgagctgtcttttagggtgtggcagtgtggtggcaaattggagatccacccgtgttcccacgtgggccatgtgttccccaagcgggcaccatatgctcgccccaatttcctacagaatactgctcgggcagcagaagtttggatggatgaatacaaagagcacttctacaatagaaaccctccagcaagaaaagaagcttatggtgatatttctgaaagaaaattactacgagagcggttgagatgcaagagctttgactggtatttgaaaaacgtttttcctaatttacatgttccagaggatagaccaggctggcatggggctattcgcagtagagggatctcgtctgaatgtttagattataattctcctgacaacaaccccacaggtgctaacctttcactgtttggatgccatggtcaaggaggcaatcaattctttgaatatacttcaaacaaagaaataaggtttaattctgtgacagagttatgtgcagaggtacctgagcaaaaaaattatgtgggaatgcaaaattgtcccaaagatgggttccctgtaccagcaaacattatttggcattttaaagaagatggaactatttttcacccacactcaggactgtgtcttagtgcttatcggacaccggagggccgacctgatgtacaaatgagaacttgtgatgctctagataaaaatcaaatttggagttttgagaaatagagcacaacagcactttcgtcatgagctgacagtagtgtcaagaaagtcaaaagagccttaagagcctcagtgaagattgtattttattttatcaaaagccacctagcagtcatctgtggagcactggaaagctggggttcattttggtatatcacactgaaactgggtacccagagtgctgctgtttaatatttcacaatgccttacttattggttgttttatataagagtttgtcaatatggtctcttcttaaaagaagttgactatgaattgaaacacacaaaacatttaagtgccagacttaatattaaagaatgtaaaggtccaagtaaaatgaggtatgatttatgttgatgtgtaagttcaccgcacatcccactttttaacaaaactcatgaatgtgcagttgagccattgctattttgattacatagaattgtatttcttttttagccagcacattaaattttagattttattttttaatctaatttttttctaatcaaaaagaaaattgagcttaaggcaaaaggcctggttttagagatatgtgtaattggaagagggcatttgtttgagtgtgagtttggaggcctttttaacatgcagacatacccatatttaaatgaaatggggagatatttacattccgtactttgtaaacttgagctattggacttcactgatgtatatattaatacctcagattcctctgattttgtaagctgtcttctctgtgaacgtgtttgtgtgtgtagggcattttctgattgcacttccttaagttatgaatgtactagaaagggactcatccagaatactatgcctccctttgttaatgcttaatcatttaaagtaaacacaattgaagcctctctgaagttaaacccaactatgtttattaaaatgtgtgaaactgaaagtgggctaggttctaccaaggctgtggaactctcctacgagttctgctgatcaggaaatttaagaatttatcttaaaaatgcaaggaaaaaagactgccttggcaattgtgaatggtgctttcaatctcctagcaccgagcctggcacttaggcagctttcagtaagtgggtgaatgaatgactgaatgaatgaatgaatggctcagctgaggaatgtaactttggtcaagttattatgatgtgtttgggcttagttttctcattggtaaaatgtgggtgctggattggatcttaaagatcccttccagctctgaaatgctgattgtacagtatattcttcccagattgactcactgtgcaatctttacaatactttttatcttttcacttttgacataggtaatgttgttgagcagttgagcaatgttcagtccagttgtgaagctggagaagagaaatgggttttaaaaattaagtgaggggaggccgggtgcggtggctcacgcatgtaatcccagcactttgggaggccaaggcaggtggatcacgaggtcaggagatccagaccatcctggctaacatggtgaaacctcgtctctactaaaaatacaaaaaattagccagctgtggtggcgggcgcctgtagtcccagctactcaggaggctgaggcaggagaatggcgtgaacctgtgaggcagagcttacagtgagccgagatcgtgccactgcactccagcctgggcgacagagcaagactctgtctcaaaaaaaaaaaataataataaaataagtgagctgaactcacctgaagtggtttacttctgtgggttaagaagttctagtcagtgttcatagtcgtttcgttttgataattgttgaaccaattttgtttttaaaacctttagactctgaaagtaatattttgactaagaatgtaaatatttccaaactaaattactcgggaagtaaacgctttttttaaaagtatttttactggttttataccaatattatatgcagaaatcacaggatgaatttagaattaaatctcaattagttcactttggcctagatttatgaaaaatgcatgcctcgtaaagagtccactgtattcacgagtaaagttgcttttagtgttcacttgatgacttggagagtaggaattttgcaaaatctgaatttaaggaaattctttaggataaccatttcaaaaaataaaattgctatgcaatcttgaatattttctcttttgcctcgtaaaatgaaaatgcattcacagtttctgtaaattatttagcagccttaaagtttatcaaaaaattgtccagattccacgtgcagcatgcttggccctgcatttaatttaagaaggattaataataatgctctgaatttttcgaaagggattctcctaaacccacccacttctcttgcccaggctgctttttaaaaatatttttttattttttacttatttttaaattttctctttttatttatttttggttttcttgttagccccctgttatatgggagaacgaaaattgttatattttgaaagtacttattacattatttttattttagtatcttgatgctcctgtcaaaagggaaatgaggcttttaaaaataaagtaccttaattctttattgactttttgccctaaattgctaggtgtgacccagcaatcttttaggaagagattttacagtggtgctttatttatatcaataatccagtatagttaggctgttcattcctcataatagagtacataacagaaaagtgggactttcacattttcatatttaggcacgttccaatttaattccaaaaatactctgtaattctacatctaaaaaaaccgattccctaattcgaatttattggtaccaaagctctctttggctatagacaattaagagttgaccttttaagttaatgtatatgcttaaaaacagttttaggaaaatatttggtagacaaagagtttcaactttaaatgttcactatgtcatttagtgtccaactttacggataggttgactatctaaataggcatttttagtcattaaaaaaaaatctagtcaccaggaggatccctataactcaaaataacttgtttgtaaaagaaaatttgtttacttacccattagtaagttcctgcatattcattataagatggcaaatcaaacttttctaggatgaagacagcttatttttaagttgtatagtcttagttggtttagggtctcaattttaattaataaaatacttggtttttatttgcttgtccttttgaattcctgttttaataattttaaaatgagcacaaagaatgttgaagttcagattaatctcttctgaatgatgtttttttcctctgtgatgagttgtttctgacttttttccttttgtatttgtaatgttgattaagatgtaaaataaaaagtgtgcctgattatttttgcaaaataaaga

SEQ ID NO: 111233 - DNA, 4094 bp, Homo sapiens
aggaagtagggagagaggagttgggctgtgccggaggccgaggaccgagagggctcaggtgacccctggaaagcctgggtggctggaaaggagcctagcgcctgcatgaaaggaagaacctgctgggaagtacctgagctcgagctgtgggttccgccgcccttcccctgcgtggtggcttggtggccgcgtctgcgcctcagccctgagaatccggatggcggtgaggtggacttgggcaggcaagagctgcctgctgctggcgtttttaacagtggcctatatcttcgtggagctcttggtctctacttttcatgcctccgcaggagccggccgtgccagggagctggggtcaagaaggctctcagacctccagaaaaatacggaggatttgtctcgaccgctttataagaagccccctgcagattcccgtgcacttggggagtgggggaaagccagcaaactccagctcaacgaggatgaactgaagcagcaagaagaactcattgagagatacgccatcaatatttacctcagtgacaggatttccctgcatcgacacatagaggataaaagaatgtatgagtgtaagtcccagaagttcaactataggacacttcctaccacctctgttatcattgctttctataacgaagcctggtcgactttgctccgtaccattcacagtgttttagaaacttctcctgcagttcttttgaaagagatcatcttggtggatgacttgagtgacagagtttatttgaagacacaacttgaaacttacatcagcaatcttgatagagtacgcttgattaggaccaataagcgagaggggctggttagggcccgtctgattggggccactttcgccactggggacgtcctcactttcctggattgtcactgtgagtgtaattccggttggctggaaccgcttttggaaaggattgggagagatgaaacagcagttgtgtgtcctgttatagacacaattgattggaatacttttgaattctatatgcagataggggagcccatgattggtgggtttgactggcgtttaacatttcagtggcattctgtccccaaacaggaaagggacaggcggatatcaagaattgaccccatcagatcacctaccatggctggaggactgtttgctgtcagcaagaaatattttcagtaccttggaacgtatgacacaggaatggaagtgtggggaggtgaaaaccttgagctgtcttttagggtgtggcagtgtggtggcaaattggagatccacccgtgttcccacgtgggccatgtgttccccaagcgggcaccatatgctcgccccaatttcctacagaatactgctcgggcagcagaagtttggatggatgaatacaaagagcacttctacaatagaaaccctccagcaagaaaagaagcttatggtgatatttctgaaagaaaattactacgagagcggttgagatgcaagagctttgactggtatttgaaaaacgtttttcctaatttacatgttccagaggatagaccaggctggcatggggctattcgcagtagagggatctcgtctgaatgtttagattataattctcctgacaacaaccccacaggtgctaacctttcactgtttggatgccatggtcaaggaggcaatcaattctttgaatatacttcaaacaaagaaataaggtttaattctgtgacagagttatgtgcagaggtacctgagcaaaaaaattatgtgggaatgcaaaattgtcccaaagatgggttccctgtaccagcaaacattatttggcattttaaagaagatggaactatttttcacccacactcaggactgtgtcttagtgcttatcggacaccggagggccgacctgatgtacaaatgagaacttgtgatgctctagataaaaatcaaatttggagttttgagaaatagagcacaacagcactttcgtcatgagctgacagtagtgtcaagaaagtcaaaagagccttaagagcctcagtgaagattgtattttattttatcaaaagccacctagcagtcatctgtggagcactggaaagctggggttcattttggtatatcacactgaaactgggtacccagagtgctgctgtttaatatttcacaatgccttacttattggttgttttatataagagtttgtcaatatggtctcttcttaaaagaagttgactatgaattgaaacacacaaaacatttaagtgccagacttaatattaaagaatgtaaaggtccaagtaaaatgaggtatgatttatgttgatgtgtaagttcaccgcacatcccactttttaacaaaactcatgaatgtgcagttgagccattgctattttgattacatagaattgtatttcttttttagccagcacattaaattttagattttattttttaatctaatttttttctaatcaaaaagaaaattgagcttaaggcaaaaggcctggttttagagatatgtgtaattggaagagggcatttgtttgagtgtgagtttggaggcctttttaacatgcagacatacccatatttaaatgaaatggggagatatttacattccgtactttgtaaacttgagctattggacttcactgatgtatatattaatacctcagattcctctgattttgtaagctgtcttctctgtgaacgtgtttgtgtgtgtagggcattttctgattgcacttccttaagttatgaatgtactagaaagggactcatccagaatactatgcaaaatctgaatttaaggaaattctttaggataaccatttcaaaaaataaaattgctatgcaatcttgaatattttctcttttgcctcgtaaaatgaaaatgcattcacagtttctgtaaattatttagcagccttaaagtttatcaaaaaattgtccagattccacgtgcagcatgcttggccctgcatttaatttaagaaggattaataataatgctctgaatttttcgaaagggattctcctaaacccacccacttctcttgcccaggctgctttttaaaaatatttttttattttttacttatttttaaattttctctttttatttatttttggttttcttgttagccccctgttatatgggagaacgaaaattgttatattttgaaagtacttattacattatttttattttagtatcttgatgctcctgtcaaaagggaaatgaggcttttaaaaataaagtaccttaattctttattgactttttgccctaaattgctaggtgtgacccagcaatcttttaggaagagattttacagtggtgctttatttatatcaataatccagtatagttaggctgttcattcctcataatagagtacataacagaaaagtgggactttcacattttcatatttaggcacgttccaatttaattccaaaaatactctgtaattctacatctaaaaaaaccgattccctaattcgaatttattggtaccaaagctctctttggctatagacaattaagagttgaccttttaagttaatgtatatgcttaaaaacagttttaggaaaatatttggtagacaaagagtttcaactttaaatgttcactatgtcatttagtgtccaactttacggataggttgactatctaaataggcatttttagtcattaaaaaaaaatctagtcaccaggaggatccctataactcaaaataacttgtttgtaaaagaaaatttgtttacttacccattagtaagttcctgcatattcattataagatggcaaatcaaacttttctaggatgaagacagcttatttttaagttgtatagtcttagttggtttagggtctcaattttaattaataaaatacttggtttttatttgcttgtccttttgaattcctgttttaataattttaaaatgagcacaaagaatgttgaagttcagattaatctcttctgaatgatgtttttttcctctgtgatgagttgtttctgacttttttccttttgtatttgtaatgttgattaagatgtaaaataaaaagtgtgcctgattatttttgcaaaataaaga

SEQ ID NO: 111234 - DNA, 2669 bp, Homo sapiens
gaatgtactagaaagggaggcatagtattctggatgagtccctttctagtacattcataacttaaggaagtgcaatcagaatactatgcctccctttgttaatgcttaatcatttaaagtaaacacaattgaagcctctctgaagttaaacccaactatgtttattaaaatgtgtgaaactgaaagtgggctaggttctaccaaggctgtggaactctcctacgagttctgctgatcaggaaatttaagaatttatcttaaaaatgcaaggaaaaaagactgccttggcaattgtgaatggtgctttcaatctcctagcaccgagcctggcacttaggcagctttcagtaagtgggtgaatgaatgactgaatgaatgaatgaatggctcagctgaggaatgtaactttggtcaagttattatgatgtgtttgggcttagttttctcattggtaaaatgtgggtgctggattggatcttaaagatcccttccagctctgaaatgctgattgtacagtatattcttcccagattgactcactgtgcaatctttacaatactttttatcttttcacttttgacataggtaatgttgttgagcagttgagcaatgttcagtccagttgtgaagctggagaagagaaatgggttttaaaaattaagtgaggggaggccgggtgcggtggctcacgcatgtaatcccagcactttgggaggccaaggcaggtggatcacgaggtcaggagatccagaccatcctggctaacatggtgaaacctcgtctctactaaaaatacaaaaaattagccagctgtggtggcgggcgcctgtagtcccagctactcaggaggctgaggcaggagaatggcgtgaacctgtgaggcagagcttacagtgagccgagatcgtgccactgcactccagcctgggcgacagagcaagactctgtctcaaaaaaaaaaaataataataaaataagtgagctgaactcacctgaagtggtttacttctgtgggttaagaagttctagtcagtgttcatagtcgtttcgttttgataattgttgaaccaattttgtttttaaaacctttagactctgaaagtaatattttgactaagaatgtaaatatttccaaactaaattactcgggaagtaaacgctttttttaaaagtatttttactggttttataccaatattatatgcagaaatcacaggatgaatttagaattaaatctcaattagttcactttggcctagatttatgaaaaatgcatgcctcgtaaagagtccactgtattcacgagtaaagttgcttttagtgttcacttgatgacttggagagtaggaattttgcaaaatctgaatttaaggaaattctttaggataaccatttcaaaaaataaaattgctatgcaatcttgaatattttctcttttgcctcgtaaaatgaaaatgcattcacagtttctgtaaattatttagcagccttaaagtttatcaaaaaattgtccagattccacgtgcagcatgcttggccctgcatttaatttaagaaggattaataataatgctctgaatttttcgaaagggattctcctaaacccacccacttctcttgcccaggctgctttttaaaaatatttttttattttttacttatttttaaattttctctttttatttatttttggttttcttgttagccccctgttatatgggagaacgaaaattgttatattttgaaagtacttattacattatttttattttagtatcttgatgctcctgtcaaaagggaaatgaggcttttaaaaataaagtaccttaattctttattgactttttgccctaaattgctaggtgtgacccagcaatcttttaggaagagattttacagtggtgctttatttatatcaataatccagtatagttaggctgttcattcctcataatagagtacataacagaaaagtgggactttcacattttcatatttaggcacgttccaatttaattccaaaaatactctgtaattctacatctaaaaaaaccgattccctaattcgaatttattggtaccaaagctctctttggctatagacaattaagagttgaccttttaagttaatgtatatgcttaaaaacagttttaggaaaatatttggtagacaaagagtttcaactttaaatgttcactatgtcatttagtgtccaactttacggataggttgactatctaaataggcatttttagtcattaaaaaaaaatctagtcaccaggaggatccctataactcaaaataacttgtttgtaaaagaaaatttgtttacttacccattagtaagttcctgcatattcattataagatggcaaatcaaacttttctaggatgaagacagcttatttttaagttgtatagtcttagttggtttagggtctcaattttaattaataaaatacttggtttttatttgcttgtccttttgaattcctgttttaataattttaaaatgagcacaaagaatgttgaagttcagattaatctcttctgaatgatgtttttttcctctgtgatgagttgtttctgacttttttccttttgtatttgtaatgttgattaagatgtaaaataaaaagtgtgcctgattatttttgcaaaataaaga

SEQ ID NO: 111235 - DNA, 437 bp, Homo sapiens
gtcaggaatagggatagggattgattcctagcacctagaaaagtgcctggaatatgttggatgcttagtaaaaattttccaaatgaattatattgaatcctgggccagatattgagtagatattggggatataaaaagaacaaagtacaaagttccttcttttaaaaaagcatatggtataatagaggagactcatacttgtacaactaactacaataattttaccccctgggagtgatggtgatagttaaggtgtactgaagatggcgtcacagaacgcgtcattgaagtgtacgtttgatctatataagagacacaggggaaagttatttccaggtggaggtaaaaacaaagttaaagagcttaacagtctcagcaatggcttgttgtctaggttaacagtgtgtgtcaacgggtagtcgagggagatagggata

SEQ ID NO: 111236 - DNA, 224 bp, Homo sapiens
ctggggaagagaagcggtcttaaggggaagaatttcgatcaagtaatcctggagtattgagcctgggtaagattatcaattagtttctgccacttttgctgaagctatttgtgaaagaaaaaaagaagaccttttaatgtttaaaattgtataaaaactgtgtaaagaatgggtaagacaggaagcttaatgactcttggttcaaatttcacatccagcaagat

SEQ ID NO: 111237 - DNA, 481 bp, Homo sapiens
agataaagaagcctggggctcaggaggaaagtctagacaggagacatggatttgggagcatggggactaattattggtctgcctgaatcatgaattcacaatgctattaatataacctattcgtacagctgcattacatagatgtctcatttacagattctactctaataattcttaaatatttttacattttttgctactgtgtcagatctaccctatgctatacttgtatttttgcacctttttagactaagtgaagtagaagcctgttaatttatcttttttcaatgtcaatactattgaatattcaacaaagaagtggtcagaacttgggcttcagagcctagtagtcattggggctttttttctcttctcccggacacaatgccattatatccctcctcttcccccatctccaagtaagatttagctacgtgactagcttttagctcttgaaatgtgagtagacagatcatgtcat

SEQ ID NO: 111238 - DNA, 282 bp, Homo sapiens
ctgcagtgaaccaaaatcacaccactgcactccagactgggcttgtctcaaaaaaaaaaaaatttcctttacatttgaataattatttaatggtctcttttttcctccaaattaaagcactcagaggaacctagagacaacatggtctagccgcttgctttcatggctagaatattttaactgaaagtaatatgtacaaaatatgtattgtcagtttttatacctttcaaaacattacacatttcattatgtattttcttaaaaatgatcaccttttatgtt

SEQ ID NO: 111239 - DNA, 272 bp, Homo sapiens
tttagaagtccttcagtagtgttaattcacattcttctcaaaatttaacactcaggctccagaaaatcttctcaaattaatcccatgagactgatctttcctcaacccatgtcctctcaacttcatgtactcttttacactttcttacatttgcaagtactatgttgatgtccttttcacatataggtattatatctccccaactacattgcttacagaaggcagagacaacacattgtgttttgttgaatgaatgagtaagctacatactc

SEQ ID NO: 111240 - DNA, 282 bp, Homo sapiens
atatggacaggacactgctacatggacaggacccccataggtattccaactgaccaccccagctaaggtcccagctgacagccagcatcaaccgctagacacaggagacagccctccagattatcccagccccagctgactgcaatggcgtgaaagaccacaagcaagaaccacatagctgagatgttaataaaatgattctgttgttgtaagccactaagttctggggtgactcattatgcagccatcagtacctgaagcaatgagagaaacagactctag

SEQ ID NO: 111241 - DNA, 384 bp, Homo sapiens
caagtatttagcctgcagtcccagaggcaacaaaaaatagccaagtccaagggagtgccatgagcatatggaccctggtcacaagagtgtcacactgggaggggcttggacatatgccatgggctgcatcaggacatatgccatgggctgccaccccaaataattccctcttccccaggacccagtggaacagcttgttgaataaacaagagactgaaagagtggttgaactggcaccaggccagtgtcccttgccttacccactgaatcaatgaaaacttggcatatactacattttcaaggagcagggaagcatgaaggcataatctctttgtccctcctgtgttttgtcactttgtcttttctccacctacttatctgact

SEQ ID NO: 111242 - DNA, 731 bp, Homo sapiens
ctgttttgagtagatactaatgacttctgggggctgtaaataatcttatgattttagatattatttagacaatttaagaaataatataagcatatcttataaattaagaaaaaaacaattggctgttcattgttttagaatttattaacccagaagcagttttgcaaactgaaatcttgctttagagaattttgaagttctccatgtccacaggtccagtaaatatttactcctatcttgttaatccttgcctcttctgggtctggtgtccccatccccatatccaccccttttaccaagggaaatcaatttgtttcttttaaaacggcagcttccatgattgggtgaagaaacagagtgaaaaaccgaagacagtgggatgccgtaaggtttgagaactcttacgtgggagctggaaggaagcttgccttgaagttgcaactatgctaccaaaccaaaaaaataccaaacaaacaaaagcaaaccctaactactttgcattcagctattgtgactagtcttgagtggatataaaaatactcctaagaaaatgattgttttcctttaaaatatgcattattgaaaggcttgcagcattcttaattgatcatcattccttagagtcaaaatgttttccaagggaacagatctctaatgtggcatttactaaaaaatattgagaaaatgtctttcaatagagaaatctgctttgcaggaaaacatccaggaac

SEQ ID NO: 111243 - DNA, 426 bp, Homo sapiens
atgccccaggcctgagccaaggtggcagtggctgggttgaagtgagctaggccaagttgagagcaattatctcaattggcagaacttccagatttcttgcttgggcagaggtgaaacagagggcagactttttcaatgtaggaggagctaaaggaaaaggaataaactttataggccgggggtgagggaagatgccgtattccatttcagacgtgctgacttcgagctgcctgcaggacagacatcacccccacggggctaaccagtaggcaagatctatgagtctgcagctgataagatcttggggaggtttgcagttgagagttatctcgttggttcattattcagctcatgttcacttagcctctgctgtgtgctaaggtctgtgcccagcatgagaagcgcagttcctgggacagacaccag

SEQ ID NO: 111244 - DNA, 150 bp, Homo sapiens
agtctcatgggaaccaacaggacagagtgtttcagaaatgcgggagagattagccaggtcaaacactgccaggattacaagtacatgctgggccaggcacactttccccaggcttcctggtgaccagcatcacaataggcagcatggttg

SEQ ID NO: 111245 - DNA, 725 bp, Homo sapiens
attttaaaacaatataagtattataagcattgctctacagtttgcttttttccccccacataacatgttttaatctgcattgctctaatgtatctagtttctaagtcagactctgttgtatgaatcccctctcttgttgatggatatctaggtgttttcctttctgttgctgtcatggtcattgcaaacagtgctgaacagacacctttacaagtcaccttatgcacgtgagcaagcattctacttggggagaggaattttggggtttcaaattttatccttaacaaagcagtttattcattcattcagtaaatattgattgactatgtaaaaactgagccaggttctagaggtaaacagaacagaaataatccttcatttatcatgagtttacaatctaattgggaaaatgaacattaaagaagtaattaaagatatgtatgtactatacagctgtatcataaaaataaagaacaatgtattgtgtgccatgaaaaaaatataaggcttattaagggatgtttcttaatgtttcttgtatcataaattacctaaagaatttctggacaggaaaatgctactctcctactgaatttatgtgctttctttatcgaacaatggaagcaatgtaaagcaaagtgtttcttttttgccttagctactaggagtagctctcatgtagatgctgtgcccagctgcagtgcctggaacagcccagctacatt

SEQ ID NO: 111246 - DNA, 893 bp, Homo sapiens
aaaatatataaaacttaaaattcaccatttaaatcatttttaagtgtacagttcagtggcgttaagtaccttcacattgtggtaccacgatgaccaccatccatctccagaatcttttcatcctgcaaaactgaaactccatactcattaaacactaacttcccattcactcctcccctctagaatccaccattctactttctatatctgtgaacttcactactctaagtacctcatataaatgaaattaatattatgtggacttttgtgcttacttatttcgcttagcataatgtcctcaaaattcatccatgcagcagcatgtgtcaaaatttcctttcttttttaggctgaataatatccaattgtatctatatgccacattttgtttattcattcatcttgttgatggtcatttgggctgcttctgccttttatctattatgaatagctctgtacatggatgtacaaatgcttcttaagacctatagataaatctttgagaccttgtttccgattcttctgagtatatatacagatttaaaatggccagattatgtagtaattttatttttaatttcttaaagagttaccatactgttttccatagcagctgtaccattttacaatcctaccaacaatgcacatgattccaattattccacaggctcatcaacatttattattttctgatttttgcttgtttgctcgcttttaaaaatagctatcctaatggatataaggtggtatctcattgtggttttgatttgcctttccccatcttttcatgtgctcattagccatttgtatactttctttggggcaatgtctaagaattgactttttagaatgatccctctggggagaagtaaaagggtagaaggagggtcaga

SEQ ID NO: 111247 - DNA, 432 bp, Homo sapiens
cagcttatttttctacataggatccccacatccctgcttttgctagaatggaaactagacaaggaccaacttttatcaacttgttcatttctctattcctagaacacagcctggtacaaaatttgcgtttaataatgtttgttgaatgaatttgaatgatggatttgtttagaaggtttataacatcccatgccttatgagtttgttgccagaggaaaaaagaagcctgtttttggttcataacatcaggtatgtaacctggaatttggaatcatgagtttttatgcatttgcttcatattatttatttttaagagatctttcaaagtattgacaaagatactttaagattgagagcctccctgataacccaggaatgagagttttagattaagtttacaatatgattgaaggctaatcatataaggagaaa

SEQ ID NO: 111248 - DNA, 429 bp, Homo sapiens
gcgaaaggatggttaggacaggagtgtagtggagggaaagttaaaacaacggtagatggatcatcttagggcttgctggtgggggtaggaacatacttcaatttggtttcagactgagaagaagaaagctatgctccctgatgaaggcacagtttgatctactagatgggaaataccctcattttataacttcagtaatttaacattttctgtattgcaaagtggaatttagtcccaaagtattaaagctaaccatagcttgatcaggagatttgacaatttagcataaaattatgttgtggatttttttatttaagaattattgttactattattgaacaccatgtatgaaatgaaagaaagggtgcttttatttcattatacttatttggtttttttagcggacatcccttgacattagaatagcat

SEQ ID NO: 111249 - DNA, 458 bp, Homo sapiens
tgtccgtgctgtgggtgtgaagatgtgtgctgcacatcccagtttccagcacaggacaaagactcagagaggcacctgccaggagtctcaggtgatggaacccagtggcgggcatgtgggcagctgccccaggtggaagggatcgtggcacagctcttggttccccaggctggccctgaccttcgtgctttcctgcccatggcccagacttccgagctccatgttggggatgctcagggacaacccttcagcctcccccaccatgtcccggctactgcccaggattcttgttctctggagggtggatccagccctccccatcttggtgccctaccagggccaggcttcccatggctctttctgcagcccctggcacagactgtggggcgcacagcccggggagcagtgggccttggaggggccaggtctgcatgttcccacccccatcatggagtttg

SEQ ID NO: 111250 - DNA, 291 bp, Homo sapiens
acaacatctctaatgacttagttccattttgggccacaagtgcatttgtcattgaatgtgtacacgattgtttgaggaaagtatttggtttaacgaattgtgcataattccactgtttgcacttgtgaaatttaagtaaaagggattaatgtactaaaaattagttatgtgtcccagttcctgggaagtagaaaaaataaaataagttgtgtggtaataaaataagttatgatttataattgttttaggtatctgttgcttcaacagttggtatattaagaaaagtaatca

SEQ ID NO: 111251 - DNA, 239 bp, Homo sapiens
atgagacagatacgaatcgagccggtacccctagtttagaagtttcaatagcatttgagaagaaaacatttctttcttggctgtaaataaaacccaaaccatatttgttttaataatagccaagttgtactatagctctccctaaactttgcttccagcgcggcttcccttgctaactctgccaaccagtgtcaaagtggacggtgggcttaacctctgctattaatctgtacaagtgc

SEQ ID NO: 111252 - DNA, 817 bp, Homo sapiens
gctcatgtaaatgcagtttgctaatattttgttgtaaatttttacagttttgatcaagtggagattggcctgtaatattcgttttttaaaatgtctttgatggtttttggtaatacaagtaatgatgctttcttaaaattagctagtaaatattctatctgatgccaaagtttgtgtaagatttatatcttttcaacatgttaggaaaactatactcgtaaagttagctagactagagatctttttgggaaaacttttaattaccgactcaatttctttaatagttgtagaacttttctatcgtctcagttttcataaattgtttctgggaataaaaaaattaacagctctattgatgtaaaatagcatgcatattgaatgtgtacatgttgataaactttgacatataaacacactcaatggaaccattatcaaaatcaaaataatggacatatctttcactctggagagtttctttgtacactctgacatgtatataatattgagtcttccagtccataagtactatataacaccctctcccatcttctgattttgtactggataatcctctgtggtgggggatggacttggggatggttacctgtccttataggatatttaccagcatacctggcctctacctactagacataactagcatcccctgcctccagtccctaacaatcaaaagtattctctagaaattgccaaatggttccaggaggaaaaattccccaaggctaagagattgaagaaccacttacgtagagatctcacacatctttcgtttgaatttatttattccaaggtattt

SEQ ID NO: 111253 - DNA, 543 bp, Homo sapiens
gctgttggtatcttattgttaaaacaaatgaaaaactggctacctgggcactccacagttaaaaatttctcctgaattatcttgcagatttcttcttaaagggaaataataataaagatctgttttattcttgtaaccaacaaaccacaaaatatctcatttgtatttctacctaactatatcaaaatggcattttatacttcaatgaataccaaattggacaatcagctctcaatagttcacatagtttctttagctcctctcttgagtctaattactattttcattaatgggaataaaagtatttagctaaaaatgtaaggggaagctacaagaaaaacaagtcaatctcagaatttccagaacaagcctgctgacacctttactttagcccaagtgaaaatgattcttcacttctagcctccacaactgtaagagaataaatttgtattgttttaagccactacatttgtggtaatttgttacatcagcaataggaaactaatgcacattcctgttttcagaggggtcttgaaagttcct

SEQ ID NO: 111254 - DNA, 196 bp, Homo sapiens
gagattgcgccactgcactccagcctgggtgacagagcaagactgtctcaaaaaaaaaaaaaatctatatgtcaatatatgtaaatgaaaggctgttgctctagttcagatgttgctaagaactgacttatgtatatagttgtttccttccttggaattagtttttggaattaaaatttcaggagttggggagaag

SEQ ID NO: 111255 - DNA, 636 bp, Homo sapiens
tatttaaaggtgaattagatgacctcactagaaatttaaaaaaacacaaatgaaaataagtttcagatgttaaattagcaaagattgataatactgtgttaaggtgttaaattagcaaagactgattatactgtgttacactgcctgaaaaagtataaattaatacagtcttattgtggaatttggggggtgtatatctggagtctttttttttctcctaactccccaaacttgttacagatccagaatcttttaaaatatacatattttagtcagctgttctacttctagaaaggaaatatttaattagatatgaaaacacatactgaaagattgttatcacaatgttttgtattagcaaaaaacttagtatgacttaattgtccatcaaaagggaatttgttagataaattagggtatgtatttaatatactagagtaccaaataacaatttaaaatgttaataaagattcagtgttaaaatttgacctgtaaatatcatataactcatagaagacagcctatcatcaaaaattacaagtctagtattatgcattattttaatgtaatatttagtgttgcagcagaatgatgttctttacctggccagtatcagatgggtgctgactttcatca

SEQ ID NO: 111256 - DNA, 467 bp, Homo sapiens
aaaaagatttgataaatgatacggtgcggagaagtagccactcacccaccgttagtaagagaataaattgctacagtatatatttagggcagtttgacagttttatcaaaaaccgtaaaatgttcatacactttttgacctagcagttttacttcttttctaacccaataaataaaaatttgtgtgaagacatatggtcacctgagtgttattcccagtattctcattgtctgtactgagtttagcttcatccgtgttagtatataaacctactcaaatgggtcttcctgtctctttccctccactccttccttcatactgcagccggtatgatctttttttttttttttttttttgggacggagtctcgctctgtcgcccaggctggagtgcagtggcatgatcttggctcactgcaacctccgcctcccgggttcaagcgattctcctgcatcagcctccagtgt

SEQ ID NO: 111257 - DNA, 725 bp, Homo sapiens
gtttcaaactcctgacctcgtgatccacccgccttggtctcccaaagtgttgggattacaggcgtgagccactgcgcctggccaaattaaagtgtttttaagaactgtgttggtcaggcagagagtaaatagattgatttaatacatcatttaatatactaaatacacatcttaatatttataaaactgaagcttacattatgaaactggtgtttatttttactataaaaatagtaaaagtggtgtgaagtggaatctcattgtggttttggtttgcatttccctaatgactaataatgttgaacttattttcgtgctggttggccatttgtatatcttctttaatattttatttctttttatttatttatttttttggatcaggtttcattcttgctgaggctgaagtgcagtggtgcaatcacggctcactgccgccttgaccgccggagctcaattgatcctcccacctcctgagtagctgggactacaggcacacactaccatgcctgtctaattttttaatttttgtagaggtggggtttcaccatgtttcacaggttggtatcgaactcctgggctgcctcagcttccaaaagcactgggattataggtattagtcaccctgcccaacctaatattttcttctattcaaatcttttgcctacttcaaagccatactatttatgttgctccgggtccatcattcacaatctttaacaatg

SEQ ID NO: 111258 - DNA, 568 bp, Homo sapiens
acattttatactttccactggtttttctgtattgtatgtttttgagtaatttccaaaagtatatctagaaaagtcttttacctaaagttagtctaaaaagtatctatatatgcatgtgtatgtgtatatgaaacacttaagagagagtggcaataacataatcattttttacaaactgccaaattatagaaaatattgtaagaaatttttcagaatcatgaagccatgtgtattcacaatacagttcatattatcatgtttcatttgaaaaatttatgatctctatttataattgttaagaacttacagcttatttcacaaaatcattgctcttttccactgttatttgtaccatacgtatgtaccatagtgtgcttaaacgtgattatttgaacgtctagttttttggatggtatgcgcattctaatctaaatcaataatgaagttttatctttggggtagtttttgttgcataatgaattctaattttatgtttaatttaaagcaaacaattattgttagaaaactatgcacaaaataaaattcaaggatgaaaaataaattggaa

SEQ ID NO: 111259 - DNA, 324 bp, Homo sapiens
gagattacaggcgtgagccactgttcccggcctagaagtaggttcttgatgtatccttcatgtctcgtcttccctctcgcaccctgcacccttctcgcccagtgcttactgcttgctgggtgctggtctcctgcttaaagagcagactgaggacccctggaaagacgcccccacagcacgtggaccccacaccacccaagacgctcccacagcacgtgcactggactccacccaagacgccccccacagcacgtgcactccacgactgcacccaagacgccgcccacagcacgtgcactcacctccacccaagacgccccccac

SEQ ID NO: 111260 - DNA, 826 bp, Homo sapiens
tgcagtggctcacgcctataatcccagcactttgggaggctgaggtgggcaggtcgcctgaggtcaggagttcgagaccagcctggccaacatggcgaaaccccatctctattaaaaatacaaaaattagccaagcatggtggtaggcgcctataatcccagctactcgggaggctgaggcagaagaattgcttgaacctgggaggcagaggttgcagtgagccgagatcaggccacttcaccccagcctggcaagagcgaaactccaccaaaaaacaacattttaagaaagtttacaaatttgtgttgggctgcaatgcggcccacaggcctcaggttggacaagcatgactaggcattcatacagcaaatatttattgagacctactatgtaccaggcactgtcagaggatataccaggaaataaaacatgaagttctctaccctcatggagcttatattttagtggctactgacaattttttgcttttataccaaaaattctagctaggagtttttgagcattgtctgtcttaaatatttggcttttataactaattttataataagcattctcttatttcttcctttggataaatttctaaaaatagacttgctggaacaattattttagaaatgcttttatactaaaaataataaccctttatcatatatattcctaacatttttctaattttcctgcctttgaactatagttcagaggcccccaaacaggcatcttttgctgtagatatgttccgaatgcttaagcagatatcttttcatagcttatagccttattgtcaaactaagaaactctttacct

SEQ ID NO: 111261 - DNA, 187 bp, Homo sapiens
gccaagtgtgttggggaggtgacatcaatccagatgagttgcaatgagctgtgaacattctaacctgatattacgaaatgttatttgactggacttggatgtctgtattaaatgcagtaagattttgataatttaggctcaggttctataaaactgtgtgttggtattccgctatgtttttttgata

SEQ ID NO: 111262 - DNA, 475 bp, Homo sapiens
gatgttgttccagtctgaatctgaaagcctgagacccaggagagctgatggtgttgttccagtctgaaaaccagcaggcttgagacccagaaagagtcaagtttagtctgacttcagaggccagaaaagactcacgtccccatgcaaggcagtcaagcaggagggcatcttctcactcatgggaggggcagcttttgcttttatttgttctattcaggtctccagctgattggatgggcacatgaggagggcaaccttctttactcactctgctgattcaaatgttaatctcatttagaagcaccctcatccacacatccagaatcatgtttggccaatatccaaatacttcgtggcccagttagattgacacataacattttacccctcacataagatgacccctcatgtaacatcaaccctcatgccctcctgagtctgcaagcctctctccttattaactttatgggttttc

SEQ ID NO: 111263 - DNA, 222 bp, Homo sapiens
aaaaaactatcccaaatttttatgtctttacttattacttggcattctcatgttgctatctgttaacaacagttttattttaaagccaaacagtaattatctctctcatcaccatcaccacagacttcactttaacattgaaattacaatgaatgcctgatgagaagtgctaaagatggtggtgtcttccccactcttaagtaatcacagtgctataaaatt

SEQ ID NO: 111264 - DNA, 362 bp, Homo sapiens
catggggcctgggtgtccacttggaacgtgatgtgcacctgggacctgagtttccacctagggcctgatgaccaccggagacccaggtgtccacctggggtctgatgtctacctgaagcctaggtaaccacctgtgccttggtgttacctgtgccttgatttccacctgagcctgatgtacacctggggcctgggtgtccatctgaggcctgatgtacacctcaagtccagtgtccacttgtggcctgatgtcaacttggaagctgatatccacctggggactgatgttctcctggggtctgatatccaactgggatcagatgttcacctaaggcctggagttaatctggggcctgatggtc

SEQ ID NO: 111265 - DNA, 522 bp, Homo sapiens
gaaaagcactccaaaacacaggctggaaagcagcacacagaggagtaaagaccaaacacgtggtcaagggtagggttccggttcaaggcccgtatgaggaaacaaacaggcagaattcacctgaagaatcggaagagcttccctgaatcagtaactagtgggcaggttcctgagtatggctgaaaattagaaacacctgcagaactacagcaacaaaataaccccctatgtaccacagccattaaatcaaaatctatggtttagaggtccaagcactgtccagaacctcctcacaggtgattgcgatgtccaatatgaaaagagtgtatttcacccagaggtctcagaagctccaaaacctcttcaaggacatgaattcagcatcctccaggaaagagccaaggatccagatctttaggggagtagcacatccctggtatgtttacccactctctgcatcacactatgacaaccacaacttcttttaaataaatgtaaaaaaaaaaaaaaaaaaaaaaaaaa

SEQ ID NO: 111266 - DNA, 639 bp, Homo sapiens
gggtgttataatcggtctcttatctttttaaataatatatactttcctttgtattgatgccaagaagcttataggacacctaaatgaaaacttttaaaatgcaaaatgttttatatatgtaagagtatggatatttgaaaatgtctagttaatgctttgagtttgttttgatgcttggctatagatgcagccagtaacaccatactctttgtccatttatgtactcagtaaacatttactgagcatctactcgggtcaggccttggactagtgctgaataggactatgtttcttccttaactaataaggaaacaaactatttaggtacagcaatgctacagagacccatgtgatgctagaaaaacacataggaagggcactgaatcatcccctgttctagttacctaaataagtatacaaactacttctctattcctagttatgcctcagatttttttttaatttattttcttgagacagagttttattctgtcacctaggctggagtgcagtgctgtgatctcagttcactgcagcctccacttcccgggttcaagtgattctcgtgcctcagcctcccaagtagctgggattacaggcatgcaccaccacgcctggccaatttttgtattttttgta

SEQ ID NO: 111267 - DNA, 223 bp, Homo sapiens
gtactaacatatgccacaacatgggtaaacctccaaaatattgctacatgaaagaagcctgtcacaaagtccaaatgttatctgaaacaaccagagtaggcaaatccatagagacataaagtagattagtggatgccaggggctgggggaaagaggaaatgagaagtgactgctaatggtttgcaggatctttcaggagccaagacagtgttccaaaattaga

SEQ ID NO: 111268 - DNA, 281 bp, Homo sapiens
ggtcgaatataatgggtacgcagaaagtcactgtaagtgtaatatgaagatacacagcccttttaagcatttcattatattacatctagcttacttctaagtgatttattcagatgtgactgaagaaagtctaaagggaaaaaaaacaatttaatttgataaattaaattatcaattatagccaaattatttgggtataacaaattaaacattttaagcagacagaagatgcaaacattttaagttgacagaagatataaaatgttcactatcaaatgtag

SEQ ID NO: 111269 - DNA, 344 bp, Homo sapiens
tactgcactccagcctgggtgacagagcaatactctgtctcaaaaaaaaaagcaggaatgaatttactgtctgaaaaccttggagaaaccagagttattttttgtctcccaactgctgtccaggctctccaggccttggggagttggatggctttgtggatgcctcaagcaagtccctgagcaatgctgggaaaactctatcacttcacaatggctgagaagaagagcagtgagggggttgcactagaggaccccagaccacaaggctatgatttggtgcatggaataaccacgtgggtgtagtttgacttctcaggtgctgaggacaaattgtatctctgggg

SEQ ID NO: 111270 - DNA, 419 bp, Homo sapiens
gccctttgacttagcaggcttattttacccattactcatattttgaatatgagtaattttgaatttcatccattcttctcacacatgaatgcacccttcagacaatacacccactgtggacacactgagtacaaggagagactgttactgtggacaccatatgtttccatattgtttacatcttttttcattttttctttttttttcattttagagacaagtcttgctgtcacccaggctggagtacagtggtatgatcatagctcactgcagtcttaacctgctaggttcaggcgatccgctcgcctcagcctcctgagtagctgggactacaagcacgcaccaccacgcccaaataactttttgattttttgtaaaagtagggtcctgctatgttgctcaggctggtctcgaactcc

SEQ ID NO: 111271 - DNA, 434 bp, Homo sapiens
caaaagttgttcactgcccagccttgtggaatttctccctgtgcatgctcagattggttcagcaaagactcaaagggatcccctaggctctctggaactttttatctatgtagcttcctccttttccatatcatgtctcacaaattacagcctcctgggcctcccccaagtcatctgttctaagacagcatttttgccagctatgtctgggtttcccatccctgcacctgcactgtggcagctgctttcggtggaaaggcgggtggactgttaggctcaccatgtttgtctcctttcactctgggaacattgccctgcacagcctgtggtccagtgcctgcaaacagttgttatgtctattttattcagtttcctagctatcagtggcaggtgaagaagtacagacgctgttctctttaggtgggaagagggtg

SEQ ID NO: 111272 - DNA, 385 bp, Homo sapiens
ttccacagttaagctcatcattatcctgatgaaagctgagtctacctgagattcagattcctttaaaatccagcccaataaaaacaggaggttggcatagatgtttttttatttgcccctaaagagccagtgtccacttttctctgccatgttatttcagaaggtcgacctctatgaacaccctagctgtcttctctaacttcgatcttttcattgaatgtggtcagggagaggcctgacaataggtatggagttttcctttctgtgatcccttctgtagaagtcactggtcttattcaagtagccacttcataatttccctcttctgagttttagccgtttctctctcctcttatccctttcagaaagtttacacaatcctgct

SEQ ID NO: 111273 - DNA, 464 bp, Homo sapiens
attagtgcccatgaccatctaatgtgaggccggtcttctgatccgaacctgcaaaaaacattaactccattgtgtgagtctatcacaaactcacgtagcaccctgcagaagcatccaaacacatggaaagctcagtccgtgggtaattggcacgaccctcctccagacccctcctggcttcagcaggaggaagttgaagaactgtttggagcccagctactctgattttcttctggttgagattgtacacttctctccctagctaaaatagagtcaaggaatctgtgcatttgggacataggtacacattggcctcatagagttaaaaagcatttccccaattgaactttcttttgatgattctagtaatgatttttttttttttttttttttttttgcctgtgtaaaaattctgcaatttctgcagttaagtgactccttagactagattgccttttaaatgt

SEQ ID NO: 111274 - DNA, 678 bp, Homo sapiens
ccctaagaaatttcacccaaattatgttctttgaaacagctggcacttcattgctgggtaaagccttttctttatctttttgtttgtgtgtatatatatgtgtgtgtgtgtgtgtgtgtgtgtatgtattttaaagaaactgctgtttttaagatgatagttatataattgatgtaaaatttcagtagactgaaacttcctacatagtatgctggcgctatatgtaactttgaaggaaagaggaataagcaaagaaacctttcacccaactatgatagttttataaacctctttcaaacaactcgggtgtcaatgtgggctctaatattaattctgtgactggatttctaccttcttcaccagtctcatagggttgtttgatgagcaaatggaagtgtatataggaaaacattctgagcacagtaaagcactgcacaagtgacagataatgaaagacacagctttttactgagtttccaacaccagaaactaccaatggtaacaaaaaaaaaaagaatttggcagcaataaattataagccaccatttattccttaacagtaatggccactacttacagagcacttactgtgtgtcagccactgtgataatggctttatcatttaatcttctcaacaatgagaattaaaaccatttaatcttctcaacaatgcttttg

SEQ ID NO: 111275 - DNA, 634 bp, Homo sapiens
gccagcctccagctgcgacttaagcaacagtgaccctgagttcaggaaaagtgtttgctaggagctgaggctgcgtccaaaaatgttgtgcacccactagctgtgagtgtgtctgtggggggaaggaggggcccggatccccagcagggcaggctgctgcttgggagcaggagattaacagaatgctttttaatccgaaatgatgggtcaagtcataattaaggggctgagcaagaactgagagtcagaagggaaactgaggttcaggaaattagggaaggacacccagaaggttggagaatgaaggcaggggtcagaagttcatgagagcagagggtgaatggaacatagcaggggcttggcggaccaacaagccagagtgtaagaggggctgataccacaggttctctgtggtggctgaagcatggtacgtgggaaagccagctatgtttaaagggacagagacaggccaatgcagggtgatgtcatgcagatctgtgtccctgcccaaatctcatgttgaaatgtaatccccagtattggaggtggggcctggtgggaggtgattggatcaagggggttgattgctcatgaatgcattcgcgcactgtacgaacgggggccgagctcgatt

SEQ ID NO: 111276 - DNA, 568 bp, Homo sapiens
tctattctgatgcagcacttaacgtaaaggaggcatctgtaaatgcatgtgatgtggctgtaggcagacctagctctagatcacatcacaaatttggagcattcaccctctaacctgtcccagcctcctgcatcttcactgccacctacccactgcacagttctcccttctcctccatgaagacctaccttaaggaaaggctacgctagtaatcattcagactaaggtcaaatggaatcctacacgcaaaattattccctccgaaaatgtaacccccacactcacactcagggtattatgcacccatccacccttgacctaagggaattaaattataattggataattttagccaatcacaggggtagatattttggttgggttttttgaggaggagctagaaaaactggctcctccagctgcttttgaaagcacacagtgacccactcctggccctcagcaaacccagcatccagggaccaccccccgagcccaggggagttggtccagcctagcccgctgtccagcaatgcctctgttgattttgctaatagagcaaacagaccct

SEQ ID NO: 111277 - DNA, 579 bp, Homo sapiens
caacatggcgaaactgggtctctaccaaaaatataaaaattagccagacctggtggcttgtgcttgttgtcccagctactcaggaggcacaggctggaggatcacttgagcaccactgcatgccagccagcctgggcgacacagtgagaccctgtctcaaaaataaaaaaagaagaagaaaaaaaaaaaaccagaactaccaccaaggttttatgtcaggaaataggtctaaaagtgagagcaaggaaatgatggaggtttacagatcacccttgtatgcaacgtcagcattcaagaaaggtataatgtaatattatgcctgaattattaacaatgtcgttattttataaagtttctatgcagaaagaaaattcttcctagttaatccttaaagactgaggcaccaacgaagtacactgtgtatatgcaaagtacatgaaggtctacatatgctcttctttttcaaaatggaacctagatttcacaatggttaaatcaatgcagtcccaccacctgccccccaaaaagaaaagatactagagagagtactcactcctctcttcaaattttaacatattg

SEQ ID NO: 111278 - DNA, 98 bp, Homo sapiens
cactgtgctggggtgtacatctacactagacaccttcctgcttccctccttccagagcagacctctttgtcaccccgagctccttgtttcttaagcag

SEQ ID NO: 111279 - DNA, 375 bp, Homo sapiens
gactctgtctcaaaaaaaacacaaacaaacaaacaaacaaaaactcaagtgaagtcttgccctagccaggaaactgttgtgataaaggagcatcggggccgggcgcaggggctcacgcctataatcccaacactttggaaggccaaggcaggtggataatgaggtcaggagttcaagaccagcctggccaagatggtgaaaccctgtctctactaaaaatccaaaaattagctgggtgtggtggcaggtgcttgtaatcccagctacttgggagactgaggcagagaattgcttgaacccaggaggcggaggttgaagtgagccaagatcgcaccactgcattccagcctgggcggcagagcgagattccatctc

SEQ ID NO: 111280 - DNA, 1204 bp, Homo sapiens
gtttgggttgctctaaaggaagacctaagggtgggtaatttataaagaaaagaggtttatttgactcggggttctgcagactgtacaaaaagcatgacaccagcatctgtgtctggtgaggccctcaggaagctttcactcatggcagaaggcaaggggagccacgtgtgatgtggtgagagaaaggagcaagagagagagcatggagggaggtcccagactctttaataaccaggtttcatgtgagctaatagtgtgtgaactcactcgttactgcagggaggccaccgagccgtttgtgaggaatccatccccatgacccaaacacctgccacttaggtcccacctccaacactggggatcacatttcaacttgagatttggagtggacagatatccaaacaatatacccattagaggttacccaatacctcccacccacttgcagtctactttctgtttctatggattttgcctactttatagttcaatataaatggaatcatgtaagatataatatagtcaggtaacatataatgatgtttcggtcaatgaccacatataggaaggtggtcccacaagattataatactgtatttttactgtgccttttctatgtttggctatgtttagagacacaaatactcaccatgttacaaccagctacagtattcagtacactgagggccatacagttttgtagcctaagtgcaacaggttataccatttagccagggtgtgtagaaggctgtaccttcttggtttgtgtgaatacactttatgatgtgtgcatgatgacaagttggctaacaacacatttctcagaaggtatccctgccgttaagtgatgcttggctgtatataatacataagatatggtattgtgtgcctgggctcttagacctagcatagtattttcaaggttaatgtgtagcatgagtcactacttcattcctttctgtgtctgagtaacattccattgtatggatatgccacattattcattcatcatttatggacattgggttatcagaattactttagagtaaaactgatgcttgaagaagtgtcagcaatggtcaggcgccaggggcccatgcctgtaatccaagcattttggaggccaacatgggaggatcacttgagcccaggagtcaagaccagcttgggcaacagtgcaagaccctgtatctacccaaaaaaa

SEQ ID NO: 111281 - DNA, 263 bp, Homo sapiens
ggaaaaagtaaaaaaagaaaaaataatcccatcacatattgaatgtagggaacaactatcagccccacccactctaggaaattttggaataaaggaattcctctgtaagtttctttttttttccctccaactttattgaagtatgattgacaaataaaaattacatatatttaaagtgtacaaggtgatggttttatatatgtatacattgtgaaatgattgccacaaactacttaacatatctatcacctcatacaattccc

SEQ ID NO: 111282 - DNA, 809 bp, Homo sapiens
gatgagatctcattctgtcatccaggctggagtgcactggcttgatctcagctcactacagtgtccaccttcagggctcaagcgatcctcccacctcagcctgctgagtagctgcgaccacaggcacgtgccaccatgtctggctaattttctgtatttctggtagagactgggttttgtcatgctggctaggctggtctctagctcctaaactcaggcaatccacctgccttgacctcccaaaatgctgggattacaggcatgagccactgtgcctggcctaattgtagctctatgtattattgactatatgcgaggtactgtgctatttaattttacctaacaacagcccagtgaagcccaatgagtaaattattagttccaatttataagtcaggaaaccaaagctcagaaaggccaaatcacttgctcaaggttactttgtgagtaagtggcatagtaagaattgaaccccagactgctcaaagacaccaaaccactgtgctattttctatgtaacattgtatttttcttttcttttcttttctttttttttttttttttgagacagggtttccctctgtcatcaggaggctggagtgcagtggtgtgattatagctcactttagcctcgacctcctgggctcaagcaatcctcctgcctcagcttcctgagtagctgggaccacaggcacacagcaccatgcctggctcattctttgtatttttggggtctcactatgtggcttgggctgtatcgaacttctggactcaactgattctcccactttggtctcccaaaatgctgg

SEQ ID NO: 111283 - DNA, 360 bp, Homo sapiens
gccgccgcctactactactaaattcgcggccgcgtcgagctggagtgcagtggtgcgatctcagctcactgcaaccactgcctcctgggttcaagcaattctcctgcctcagcttcccaaataactgggattacaggtgtacgccaccatgcccagctaattttttttgtatttttagtagagacagggttttgccatgttggccagcctggtcttgaactcctgacctcaggtgatccatcacctcagcctcccaaagtgctgggattacaggcgtgagccacagcacctggactataatccttcttaataatcatcaccatccaccaaaagaagatggaaatctgagtaattgtgtgc

SEQ ID NO: 111284 - DNA, 341 bp, Homo sapiens
ctcctgacctcatgatctgcccgcctcggcctcccaaagtgctgggattacaggcttgagccaccgcacctggccaagttaataattttttaagctattgattttctttgtgtgggtgtgtgtttttgtttttgtttttgttttttttgagatgggcaataagtttcactcttgttgcccaggctggagtgcaatggcgcaatcttggctcactgcaacctctgcctccccggttcaagcaattctcctgcctcagcttcccaagtagctgggattacaggcatgtgccaccaagctattgattttttaacagctttattgaagtgcaatttatatgccat

SEQ ID NO: 111285 - DNA, 778 bp, Homo sapiens
tcagagctcctgctgatagctggatgttctagaaaattcctgttcccagtctgaatggtgcctctggtagttcttgactaatttgcagagcagagatgattggcattcctgagccccaatgaatggggccttttttaggtcctagttaccaatacttcccatctcccaaaattctctgattgctcatttgtttattcatttattcatctatttgttcaccaaatatttatttagcacataccaagtgccaggcattgtgtggtcgtttcattgtatggtgatgagccaggcagatatggtttctggttttaacaaagagatgtttaacaagagtataacaggtagacctggtatctgtggagtcagggaaagtttccatgaggaagggacatttaaactgagataagaagtagctggatgaagtggggaggagggcatgtaggtgtgaggaccatgggtgctggaattttgaaaatggtaatcaaccacagcatgtgcaaaagtcctgcagtgggaaggaacacgatggactctaggtgaatgagagattcagagagtaactggagatggttctggagacatgggcagggccaaatcacacagggttttgtaagccatgtcagataagaattttaaactctatcttaagatcaatgggaagccactgataaggcaggagagtggcataagcaggttcatatttttaaatgtcactctgtctacactgtggagaatgggtgggaggggaaagtaaaaggatgaaggaagaccaattata

SEQ ID NO: 111286 - DNA, 883 bp, Homo sapiens
gtgccggaagatctggatggagagacctcagccagcggagtgaggtgtgcagcacacacataagctgtccagaagcagtaggtagaggagcatgaaacgcactctctgctgtcaggcaagtgtttttcacagcaagagctccctggcatgttccttttatgtgggcccccatcctaaatcatccctcccttcatgtggctcaagccacaggcatttggcaacttcctttgcctcgtgaccatagatgttacctctcgtatcatgtaccagttaaaacttccctgggtccccttataaaatgaacttcctatgttcatattcacagtagcattatttacaaaaagatgaaaacaacctaaatgtccaacaatgaatgaataagcaacatgtggtatatacatacaatgaaatattattccaccttcaaaagattctgacacgtgttgcaacatggtaagcccttgaggacattacgctcaatcataagccagtcacgaaggaccaatgctgcgcgattccatttatgcgaggtgcctggagtcatcagattcatagagacagaaagtagaatggtgcttgccaggggctgaggggaagagggaatgtggagttagtgtttaatgagtacagaatttcagtttgggaagatggaaagagttctggaggcggatggcagtgatggctgcacagtaatgtgagtgtgcagagtgccactcaactgtccactttaaaatgggtggccggcacagtggctcacgcctgcaatcccagcactgtgggaggctgaggcgggtggatcacgaggtcaggagatcgagaccatcctggcgaacacggtgaagccccgtcgctactaaaaataaaaaaaattaaccaggcatgg

SEQ ID NO: 111287 - DNA, 149 bp, Homo sapiens
tcgaggtatcccttcccaaagccttcacttattggtgagaaaaacctgggcccagggagggcttgcagcttacccagttcggactcctgccagttcagcgctctgcactccattgattgttctaggcccggcagcctgttaggttcctg

SEQ ID NO: 111288 - DNA, 179 bp, Homo sapiens
agtacttgcgctctgggagcacgatgatcttgatcttccttgtgctggcaccagggcagtgatctctttctgcatcctgttggagatgcttgggtacatggtggtgccactggccagcaccgtgttggcatacaggtccttgtggatgcccacatcacaccttatgatagagctgaagg

SEQ ID NO: 111289 - DNA, 319 bp, Homo sapiens
ttgaaaacattatttgtcaacaaatgttagctctgtttgttggagtggaatttaaccattataccttggcagcagtataatacattcataagataccaacatcaccaaatatcaaatgggccagtgttgtgctagcgagtcgcagtggctcatgcttgtatctcaacacattgggagtctgaagtgggaggatcacttgaagccatgcatttgacactagccttggcaacaaagtgagaccctgtctccacaaaaaaaatttaaaaattaaaaaaatattggctgggcgcggtggctcacacctgtaatcccagcactt

SEQ ID NO: 111290 - DNA, 349 bp, Homo sapiens
cagaagcgtccagggccctccttggtatcaaacaagcaaaaccctaaaatgcagagcaagggttttccccagaagtggatggacaagggttagtcttaaagcccagcaaacgctgtaatagcaacctgtatcctcttacctccacccagaccaggattaacaaatctgaaaacagctggaatagatgaccttcaactgaagttccctgaaaagcctctaccaacctaagcacccaggaaatcgagattatgttgcattcatctgtgaagcgccatgacgaccttctagaaataggactgcataagatgaggatatgggagaaagcaaatgcaagtcatattatttaaag

SEQ ID NO: 111291 - DNA, 376 bp, Homo sapiens
ctattatattttagtgggtatgtctatataaattgtggttttggtctggaatatcttttcagcttgtttgtcaggtttaagtattttgctggcctcataaaattattaagtggttggctgggagcagtggctcatgcctataatcccagcactttgggaggccgaggtgggtgaatcacaaggtcaggagatcaagaccatcctggccaacacggtgaaaccccgtctctactaaaaatacaaaatattggccaggtgtggttgcatgcgcctgtattcccagctacttgggtggctgagggaggggaatcactcgaacccaggagtcagaggttgcagtgagcagagatcacaccactgcatcccagcctgggcg

SEQ ID NO: 111292 - DNA, 289 bp, Homo sapiens
tttctggtgctgggacggttcctgacttcagtagccatttcgttacccctcccatgtgcacagcgctcgtcctggcatttggggtgtgcagtgaggccacaggaagagaacacggcagacccagtggagtaggggagtgaggacctggactttgaaatcagacaggggagcttgaatcctgcctctgcagtgtcccaggtggtgaccttgggcaggtcccctagcctgtgtccttatctgtaaagcgaggatcagagaaacttcctcttagcattgatgtcagggtaaa

SEQ ID NO: 111293 - DNA, 523 bp, Homo sapiens
agaaaatacaactggttgcttgcttttataggaattttccctggaggccacacgaaaccacttgtgcctcagaacaactcatgactgggggagtaaggacaagcagtatatccattggcttctttctgtgtctcgtttcttactggttaatgtctactcctgggatatttcacttttccacacttcttagttatgtttcctggcctctttgaggagctgctgggaagacagagctttaattggtcctgttagagttatgaacaggaatggtggtttgtctctcttttctgggaagatacataactccagaaactgtgagagtcttttctggggctacaagacaagtggctgaagccaggggtgaggtgagaggtgatagtgtggttggtgggtgtgcaagcagggccaagcaaattcaaggtggggcatattctaggacttacacaacagtctggaaataaatatgtattttagaatattgagattctaaactaagaatgatgtcttacgtaaaattacaaaa

SEQ ID NO: 111294 - DNA, 369 bp, Homo sapiens
tggtgggaaatggatgaaaagcaggactgtttggatctaatttaactgccttctcattttgaaataaaattgatcttaaaaaaaatccttctactataatacaagtacatcttttcaaaagtaaccctttaaaaaagattaaaccagaaaatggagtacaaaaagcattctaaaaagaattcaaaaacatgttcacatttttcaaagaaatactgtaaagagcttaagagcttaaaaattataagttgtcaacttacagatgaaaaggtaaaatatttctaatacatttaaacttcataaaaggaaacatatcagaacttacacattgaaattggtattatccccttcaaagtattcatcaatgaagca

SEQ ID NO: 111295 - DNA, 123 bp, Homo sapiens
tgtaatcccagctattcgggaagctgaggcaggagaattgtttgaatctgggagatgaaatttcagtgagccaatattacgccactgtactccaccctgggggacagaacgagcctctgtctc

SEQ ID NO: 111296 - DNA, 229 bp, Homo sapiens
attcctgggactctacagagtttgtaaaatcttgtgtaaacctcaagcacagtattaaaattctatttgtagactttttcttattttaatttattttgcatatctaactcaagtgattttttatttgagtctttttcttcaactagtatagtgatcattattttaaattctcagtattaaatgagattgggtgcaattattgaattgatttttaaaaagaaaaccagtg

SEQ ID NO: 111297 - DNA, 388 bp, Homo sapiens
attggttcaaggtcagtaatataaggaaccagtgtggacaagtgtgtgccttaaggagttggcatgagagagtagattatatagttgatgtttttagggttctacgctggaggttggacagagaagagaagcttccctacaaaaatagccagatgcatcttttgtttgttcctcctccctcagttgattatgacaaatttcaaacatgaaatgttgaaagaactgtgcagcgtatacacacagtagcagttagattccaacattttgtgttacatttgctttatcaaaaaagaaaaatttacctgtccatctttttttattttttggtgcattttaaagatagttgaagacattagtacacttcacccccaaatacgtcagcatacat

SEQ ID NO: 111298 - DNA, 431 bp, Homo sapiens
ctaatataataaataggcatattctcggtgctcaataaatatttgttgaatgaatgtataaatggacaagtaattgaatggttaaagaaagaggttcctattaaatgttttcatgtttcaagtccagttcacccctgaattttggtgtaatttccagtttctcaaccatgcactgatgagaattgatatttggactttgtgaaataatgctaatagctattgtatacatttgtgtttaaatcacatgaaatggagaaacctcatgttgtttttagtttggggtgtaacctgggcatatttggcagaaaaatctgttggctgcatggagaatggaagaaactcatgaaaatagatgaagtaggagctgttgaacttgatgtgagagagacgaggaaaggagatgtagatgattaagacatcagcaatggaaa

SEQ ID NO: 111299 - DNA, 242 bp, Homo sapiens
ttcagagcctgaagattgacaagtattcagccaaagaataggaaataggctagatattataacaagtagattgatccctttggatttgtcctttcagatgcattagccatttgtctcagatctaatgtctcaggtttgattatgcctcatgctaagatgtaggttcaatgagaaatttgaacaagctttgaccaggccaaaaaaaaatcactaaaatctttacttaaatgtcagtggcttcc

SEQ ID NO: 111300 - DNA, 3044 bp, Homo sapiens
tgatggaataatgtgaaaaagcaggtaattaattctccttgaacaaagcaaaactgaacagtcatatcacattgctattctccaaagcataatctcaaatggtttcatatcatggttgtgtattacttgcaatgggtgtgttaggatatgacagctttttaaaaaaatgagctgctggttatacaaagcaaatggcatatgaccaagaagctgtgatatgctagtgtttctttttatcatagtgtattactaggccaaataatgacaccttgaatatttttacatttattgcagaaaccttaaactttggaatttccataaggtttttatgtaatattctatttctagctttttagttttatcttgctgtactgtaagtttgaggatatttttcacctgcactcttaggaataagttcataattctgtttatggggctttcctcccataacactgcatttgtatattttctgtataaaatatgtgttgtgtattaacctttatcccatacagagagtggtacatgaatgactagttttctaagatgtcctttttattgtgaataaaatataaaagttaaaggccctctgctaagtcacataaagtacagcatataagttcatataggtacaaataaatgagtttgcagtgaattgggccttcaaattacctcaagtgacagatagtaagaaaagcttcttgagcaggtggaggtcactgaatcccctactatgcacttatcaagattttacttactttaatttactggaaattgattttttaaaaaatgactacactgtaacaagggaagggatctgggtttttttgttgttttattcttgttttttttaagtagttcaaattctgaaactgtgatttaaaaattttttacagtcaagcattctgattttgaacataactcccttccctttctgtgtaacaaaggtctctctgttatctcttaaattttgttacatctccctcagcctctttctttgtccgtctcccttctgtcattgtctatggatgtttacctctctgttctcctaaaagtttgaagattaggtcaactcttatttctagttcattggtaatttaatcttaatttttttttcgtgatttttgttggttgtataatctgctgacgtatttttatactcaagtgtagttttctattaaaaagaaaagtggttggattaaaaatagtaagctatgtaaccctcatgttactttcactttcaaatattgggtacctaaaacattacttcagagattatgtaatcctattatagtatgtttgctttcctttattgttggattttacattctgatttggctttcctccaaaaaatgtatatcatgaaagactagacagttatttgcaagtgtttagaaaggtgttaaaaatgtaaagcaaagagtcttaactttctcctaattgggagaaaaatgctttaacattactataataatattccaggtttggagggggtctccaggccccatatttgctgttaatagttggaccttttagaccatgtgttatttgcaatcccagaatgattgcttctgctattagttaaaaagatactattcttttctttctgtacaagtgcaatactccccttgaagtcttaaaaactatggtgatttttttttcttttctgacctattcttcctttagctaatgacaaaaagaaactcataaaagtcatagtatgttaaaggacacaacaagcaaagagaaaaacactccacaatcaaaagattacagaatgtggaaaccactagtctgatctcatggtatctttatttaagctaaatttccatggaaattagtaatcttttgcttgaaaaatgtgtcctaaagttgaactttttacagattgaatcttcttagaccctcgcccaatgctctaaattaagaacctaatacttaatatttttattttacttctccccttttagaaataaacttttaaataaaagcaaagcacttagctgagttttaaacacttacatatcacctattggagaaattttttttaaaaatatttggagcagtcctgttttcatacaaatttaagtaagaggtatttttcttatacatatttatatgtagtgtgctaattttctttttttatacctgtgtccctgtagtaaaactgctgtaatataaatacatgttttgttaaaagataacatttctttggcatttcttttaaaggcagttactgcatttctgcatttgtacagtatgtgtcttggccattttagatattctttctttaacaataccaaaggtaattagactattttaaagactaattgcttgacagtttctagggtattttgtgttttagaagcaaaaaaagaaaaaaaaataggtcaaaccagtaaacctcattttttttcaaactaataatttggggaaataaaaactattgtttaaaaaagaaatatatatatatatatatataaatatatatgtaaagttaaaattccataccttgtatgtcaggtttgctaagtgtaatgtagtttttttaaggctcaaataccatacctcagaaaatgaggtttactatggaaatactgaaacagtctttgcagctgtgtgacaagtcactctactacatactgatttggagacctccgctaaatagttttatcactgcagactaaaatgtgggacttgtatcttctttgtttttaatgcacacacatacatgttctgtgcatgtatgtggttactgtgtatatgtgtatgagtgttgtatatgcatgtgtgagtgtgtgtctgtatgtgtgtacaactaaagaagctgcagaaactttgtaatactttgtgaaaaggattatattataaaggtttgtactgtctgagtgcacagctactggaataaatttagggaatctcaggaacaagcatataatttgtccaagatttatttcttctcagaagtgtaagtgcagtttttaattctgtatattatttaatattttaccaataaaataaacttctgacataaaaagtttgctata

SEQ ID NO: 111301 - DNA, 656 bp, Homo sapiens
gaaaaactggaatgatcaggcctttaaaaaaatatggaatcagccaggcatggtagctcacacctttaatcccagctctttgggaggccgatgcaggaggattgcttgagcccaggagtgcgagaccagcctggacaatatagcaagaccctgtctctataaaaataaaatttaaaaataaaaaataaaatctagaatcaaggccagctcttctctctatagcaggaactcatgaaccttgagtattctcaagatagcatagcacccaacagattcatatgctttgtaacctctgtctatcactcataacttcaggagaaagtctgataggttccactgagaccatattcccacctatgtctaagactggaaggtgggcttactggcaggcactaccagtaatgctcattgtatctccttcggcttggctccttagttgacatatatcttgtgctcaaagaattaatgttgaatttaaatattctaaatggccagtttttaatgaaggcacatgctggtaagcagtacagctattcttataatcctagacttttgttctttcctatttattttcacatttttctatgctcccgtttttgtcagaaatctgttggaacagttattatctctatttcttccatggtgtctaaaactag

SEQ ID NO: 111302 - DNA, 130 bp, Homo sapiens
cccagatggcgccactgtgctccatcctgggcgacagagcgagagtccttctcaaaaaaaagttgcgaaatgaagaaaagtcttggaatagagcacaaggcattttagctctggggattttcttgaaagg

SEQ ID NO: 111303 - DNA, 328 bp, Homo sapiens
agatggggttttgccatgttggccagggtggtctcgaactcctacaccaaagtcagtctcacgatgacgatagacagccagactattgatgacctggaataataatagttgaaagaatgaaaaggtcaatgacaccgacaatatttcactcagaaagaatcatccttagaaaccgtcaacctcctccaaaaggtaaccacatccctcagatatcaccgtgggattccactgctacaaaaaagaacagaagttagaagtctcatgtttttcagatggctggtagtgtttttaggcattgcaaatgtggggtgttgtctttcttggtata

SEQ ID NO: 111304 - DNA, 525 bp, Homo sapiens
ccttaggtaaaagatacctctgcacacacattatttgacagtacagtgcttagtaaatatttgtcatttgtttattgatctcttgttctttcttgacttccctgttcttgccttgttctcttcccacccacttgtgcttgatcttatctcccatctgggtgacaatgtttgggtctcctctggcacctttcaattctggagaaacacaattcagatcttctatgtgaagtgatggactataatccagtaaaccagaattctaccttcaaaacataaaaaaaagctttgtaactcgtgactggcccatctgagttatctataattagattgcagattcctaagcccacctgaactgtgttcagatgaaaatgagatttaagcactttttgttcgaggaggaattcataactgttattgagaatgagaatgagggggaatatgcaatgagtctctatgttagagccggcatcaatctttaataggaaaatacatgctttttttttgttttgttttttgagacagagt

SEQ ID NO: 111305 - DNA, 750 bp, Homo sapiens
aagagtactcttgaagctgagactcaaatttgcatttcaattgaatagatgcaaaaaaataaagaagataaggaatcaatagccttcaccaagtcatggaaatgtgaactatgagttatacacatctgaacggaatttggcgtaggtggactatgccctgagagctggaatgtttaggcagaggaataaaaagtggtgtgtgtatagggagctggggagcggtaggtatttgaagtataaagaaagtaaaggaaggtgaagttagaagcgaagatttaaggcagtttgtagagggtcttggatggcaggattaggagtctagaatgtgtgctgtgattaaagggagccaaaaggatgctagcagagccctgattggtttagagttttatttaagaaaaaaaggtttctgcttgtttccttatacaaggagacatacattgcaaagatgccacaatttttaggaaagaagcatgtgtgctatacccataagaattcactactggggaataagttcttgctttataaactttctaagaatagtcaagttcacccagaccagagttgagctttagatttaaggatgcttagcttgccaccttgtggctgacagtgaatgctgcacacaagggatgtaatctgggaaataaaccaactccaaaccacttagtgaagtttttttatttgttcaagttcatcacaagcgttagagataataataagaataataacacttagaataaatattaatga

SEQ ID NO: 111306 - DNA, 260 bp, Homo sapiens
ggtctcacaccactctcctatgcatccctacctgctaaaaagatgtgccggctctggcctggccggctcctccaccttccagccacctgtcctgtttattcatttcttccctctcttttctccttttcttttccatttatccagtcattccttccttctacccacccaccaacctgatcacccactcattcttctctccttcaatccaacctttcctcagtacccaacctgtgcaactgtaccatggactccttcaggca

SEQ ID NO: 111307 - DNA, 141 bp, Homo sapiens
aacagcatcactcgtgcctcctcgggtcagcgacagcaaaccttagcgcgccccctcccagggaatgttacctgccaacccccatcccttccttgtgacagcccaggatcggaatcctggcttaggtagaagcaaatgaca

SEQ ID NO: 111308 - DNA, 551 bp, Homo sapiens
ggtgacacatgccttcttaacacttagagtttttattttagttattgaaagagtaattttagacttgtttggacatacgcttttatcatatgtttcttgtgcacaaaaagaggaagaaaaggtgaaacatgttggcaaatgtagtcctaaactttccagctctccacttaaccactttacctgagagctgccatgtctcagcttttgggccatcgggagatggagtgcatcaccttccaagccatcgtccccccatctgcaaggtttgatgctggagctttgttgttcttgtcagaaggcatgagtggacaaccagtgcccacctcctccttggggattattacctggtttgtgggctgatagagttaagtactgcaatcatgccaccacctacctgaggtacagcagctgagatacatccctattttaggctgggagcagtggctcacgcctgtaatcccagcactttaggaggccaaggcaggtggatcacctgaggtcaggagttcaagatcagcacagccaacatgatgaaacccccatctctacta

SEQ ID NO: 111309 - DNA, 1498 bp, Homo sapiens
gattttacttcttagagactccttcctgataggtgaaatggggacagctaacatgtgaaagaaggcaccaccttcacacgtgcttaatagataataaatgtaaattctctttatgctccaaagatgctttttactctaagccatcattttttgaatgttatactatgcctctgcaagaaatagtttttgatatttctttttgattgatgtagtaactattgcattggaggcaatactgtgattttctttcagtgtgtgtcttattgagccagacattgactcattatgagttgagactttaggctaccagatccaaaacgcaataacattggtattattaagcacttgaggctgtcttttgttaatccagaatgtgcttatttagtcagtgagtttttcctttcttcctagacctatatcttgctcctagagttggttagggttacatcatcactgtcagcagtcctcattttatggttatttaggtgccacatctctcaattaccaaagagatcagtacaatgtgaggcaaagtacctttttttttaaaagctataagatatcagatttctttcatttagccaatattttggttttagagggaggtttttaaaaagtcaccgagaactgaggatcatgtgtgtatagaaacactgtaatctgatagatgagtcttaactagcaatgtctttgcttatcatttattctgacagtgatcacctgcattaattatcctaataggcgatatcaagtgtttatactgaggccataagtagaatgttcattgagtttgttatcagggctgctgatcatgaaattaaactgtagttgtgcacatgtgtattgtttcattaacttgcctgcctattcagccttctgcagtaatgtagcttctcagagcacaggagaaaaaacataaatctagtgagccgcattaaagtttcttcatgtctggatggaatagtgtcacttgcataggtctgagggtttcattatttgcctgccccagatttggactccgtttttcaggtgaaagaatccttggataactgtttcattttcataggaaacctctttggtttcgggatccaaagtaatatgtaggttcaatattttgtaggttttataatcaaatgtctccctaaagagatgacatagggaagaaaagcctaatgtatcatcttaatggattcagtttttattatgcacaaataactgggcttgtaacctaggaatatgattagagcgtgatgctggcttaaaaaataggactggtgaatcacagtttgtgaataataaactactggttggaaatatttcccagaagcagttttttttttcctttctatctttacctatatcccatgtttggtttcaaacttccctgccttagagcaacacagctggttttagacagtctttctatcaatatcttataatctttgctcatgtacaaacatacagcaaatacaacggtataaaaatacgatgttatcta

SEQ ID NO: 111310 - DNA, 1549 bp, Homo sapiens
gattttacttcttagagactccttcctgataggtgaaatggggacagctaacatgtgaaagaaggcaccaccttcacacgtgcttaatagataataaatgtaaattctctttatgctccaaagatgctttttactctaagccatcattttttgaatgttatactatgcctctgcaagaaatagtttttgatatttctttttgattgatgtagtaactattgcattggaggcaatactgtgattttctttcagtgtgtgtcttattgagccagacattgactcattatgagttgagactttaggctaccagatccaaaacgcaataacattggtattattaagcacttgaggctgtcttttgttaatccagaatgtgcttatttagtcagtgagtttttcctttcttcctagacctatatcttgctcctagagttggttagggttacatcatcactgtcagcagtcctcattttatggttatttaggtgccacatctctcaattaccaaagagatcagtacaatgtgaggcaaagtacctttttttttaaaagctataagatatcagatttctttcatttagccaatattttggttttagagggaggtttttaaaaagtcaccgagaactgaggatcatgtgtgtatagaaacactgtaatctgatagatgagtcttaactagcaatgtctttgcttatcatttattctgacagtgatcacctgcattaattatcctaataggcgatatcaagtgtttatactgaggccataagtagaatgttcattgagtttgttatcagggctgctgatcatgaaattaaactgtagttgtgcacatgtgtattgtttcattaacttgcctgcctattcagccttctgcagtaatgtagcttctcagagcacaggagaaaaatgtatctgagagttattcgagagagagttcaacaatagcccatatttccgaacataaatctagtgagccgcattaaagtttcttcatgtctggatggaatagtgtcacttgcataggtctgagggtttcattatttgcctgccccagatttggactccgtttttcaggtgaaagaatccttggataactgtttcattttcataggaaacctctttggtttcgggatccaaagtaatatgtaggttcaatattttgtaggttttataatcaaatgtctccctaaagagatgacatagggaagaaaagcctaatgtatcatcttaatggattcagtttttattatgcacaaataactgggcttgtaacctaggaatatgattagagcgtgatgctggcttaaaaaataggactggtgaatcacagtttgtgaataataaactactggttggaaatatttcccagaagcagttttttttttcctttctatctttacctatatcccatgtttggtttcaaacttccctgccttagagcaacacagctggttttagacagtctttctatcaatatcttataatctttgctcatgtacaaacatacagcaaatacaacggtataaaaatacgatgttatcta

SEQ ID NO: 111311 - DNA, 1494 bp, Homo sapiens
gattttacttcttagagactccttcctgataggtgaaatggggacagctaacatgtgaaagaaggcaccaccttcacacgtgcttaatagataataaatgtaaattctctttatgctccaaagatgctttttactctaagccatcattttttgaatgttatactatgcctctgcaagaaatagtttttgatatttctttttgattgatgtagtaactattgcattggaggcaatactgtgattttctttcagtgtgtgtcttattgagccagacattgactcattatgagttgagactttaggctaccagatccaaaacgcaataacattggtattattaagcacttgaggctgtcttttgttaatccagaatgtgcttatttagtcagtgagtttttcctttcttcctagacctatatcttgctcctagagttggttagggttacatcatcactgtcagcagtcctcattttatggttatttaggtgccacatctctcaattaccaaagagatcagtacaatgtgaggcaaagtacctttttttttaaaagctataagatatcagatttctttcatttagccaatattttggttttagagggaggtttttaatgagtcttaactagcaatgtctttgcttatcatttattctgacagtgatcacctgcattaattatcctaataggcgatatcaagtgtttatactgaggccataagtagaatgttcattgagtttgttatcagggctgctgatcatgaaattaaactgtagttgtgcacatgtgtattgtttcattaacttgcctgcctattcagccttctgcagtaatgtagcttctcagagcacaggagaaaaatgtatctgagagttattcgagagagagttcaacaatagcccatatttccgaacataaatctagtgagccgcattaaagtttcttcatgtctggatggaatagtgtcacttgcataggtctgagggtttcattatttgcctgccccagatttggactccgtttttcaggtgaaagaatccttggataactgtttcattttcataggaaacctctttggtttcgggatccaaagtaatatgtaggttcaatattttgtaggttttataatcaaatgtctccctaaagagatgacatagggaagaaaagcctaatgtatcatcttaatggattcagtttttattatgcacaaataactgggcttgtaacctaggaatatgattagagcgtgatgctggcttaaaaaataggactggtgaatcacagtttgtgaataataaactactggttggaaatatttcccagaagcagttttttttttcctttctatctttacctatatcccatgtttggtttcaaacttccctgccttagagcaacacagctggttttagacagtctttctatcaatatcttataatctttgctcatgtacaaacatacagcaaatacaacggtataaaaatacgatgttatcta

SEQ ID NO: 111312 - DNA, 1076 bp, Homo sapiens
gattttacttcttagagactccttcctgataggtgaaatggggacagctaacatgtgaaagaaggcaccaccttcacacgtgcttaatagataataaatgtaaattctctttatgctccaaagatgctttttactctaagccatcattttttgaatgttatactatgcctctgcaagaaatagtttttgatatttctttttgattgatgtagtaactattgcattggaggcaatactgtgattttctttcagtgtgtgtcttattgagccagacattgactcattatgagttgagactttaggctaccagatccaaaacgcaataacattggtattattaagcacttgaggctgtcttttgttaatccagaatgtgcttatttagtcagtgagtttttcctttcttcctagacctatatcttgctcctagagttggttagggttacatcatcactgtcagcagtcctcattttatggttatttaggtgccacatctctcaattaccaaagagatcagtacaatgtgaggcaaagtacctttttttttaaaagctataagatatcagatttctttcatttagccaatattttggttttagagggaggtttttaaaaagtcaccgagaactgaggatcatgtgtgtatagaaacactgtaatctgatagatgagtcttaactagcaatgtctttgcttatcatttattctgacagtgatcacctgcattaattatcctaataggcgatatcaagtgtttatactgaggccataagtagaatgttcattgagtttgttatcagggctgctgatcatgaaattaaactgtagttgtgcacatgtgtattgtttcattaacttgcctgcctattcagccttctgcagtaatgtagcttctcagagcacaggagaaaaatgtatctgagagttattcgagagagagttcaacaatagcccatatttccgtaaagcctgcagaactatgagccaattatgcctcttttctttataaatgagccagtctcaggtatttctttatagcgattcagaatgcttcacacacacccttgcacactttg

SEQ ID NO: 111313 - DNA, 318 bp, Homo sapiens
ggtatttttttcaaatgattactgatgattttggccttgggtgccagcttgagaacttcatccctcctaacacatggttctactcccaaaaagtagatttgccatttactgtttgcatgactataaacaaactccttttcacctttgtttccccacttaggaaagtgagatattagagcctatctcaaatgattatttttaaagattaaattaaataatatgtgtcagtctcctagaacagtgcctggtatctggtaagggctcaataaatgttaagcacttttataataatgttttgtgacctcgctgacttcatat

SEQ ID NO: 111314 - DNA, 269 bp, Homo sapiens
tgcattcataacacatggcaacttcctggaagaaaagcttttctatgcttacctgacacactcttcctttttttaaatttagtctcttattcctgcccatgttattcgacaaactattggctctgagaagatatgactaaaataataatgtgtaattgatgcatctaaatatatgtgtggccatttcattttaaaatatcaatgactactgttttattttaaaatgttaagtaaactaccagaaccaggggaaaatatttgcaagaaat

SEQ ID NO: 111315 - DNA, 3613 bp, Homo sapiens
catctttaaacccatcattcttattgaagcccatttgagaactcttagaattaatagaaccttttataagggaatatatggaatattttttattgttaatgtaacttaattccttaaaacctggaatattaatatatataatctattaaaagctgaagattaaatatgtaatttttgcttttagtttcttgtgttagtatgcttaaaggtatcaatacttttattctatattcattagaagaaaggtaataaatttaagtttcattgctgaaaaattttaaatgagtgccaccccatagccatagtcattttgattaagcataatttaactttcattatagcataaagagaaaataattattttagtatggaaacagtgataggcagtgctgtaaacaatattctctgaaaagttgtgggggtcacaaagaaaattttaaagaatatagaagcttttttaaaaaatctttttagtgtagtttcttagaacaaattataaacataatcattctgaataatcaatttttatttagtccttaactatgtaaaaccgtatcagtagaaaaatgtgctggtgtcgtgtctaaagatggataaatttctttggaatttatctttggagaccaactttatgaggcagactttttgtctacggctttggaaccaaaaaaacttcactctaattcagtcctaaaggctattttacattttgccggggtaaagtgacttcaagatacagcatggtgtcttgtatctagtagaatattgtgctagccatctaaaaaagtggatttgagccttaatttggccgtttctcaattgtctagttgaccttagacaattagtgtccatggctttccttttgtttttcccatactgaggaacttaaactacagctctaaaatgtcttttggttttaaaattctgaatgcttatatactactattaaaaattaaaaatccctcaaatagtagggaaatacaggtaatatgaaattaaatgtatttttatccattatttgattcccacctgttattttatttagaatacgaatacaaccaagtagggaaaaacgtatcagtaactgctattcaacttaaattcagcgaattaatagctgaatagaaatagctaatgacaatgcaaaagagaaaacaagccatattgctaagaaaaggatagtaagctgcttagaaagaaccagcctgtgttggaaataattctcttctagataatttaccttattttcttggcttgtactaattgaatggaagtggttaatttgttcagagtttattgccgtttgatgccaccccagtctatagttctgtgtgactttccatattgaaagagtagggttagtagccaggttgtcagtcttttacaaatgtctacataaatgtctacataaatctgaaagtggtttatattcaaggttagtttttcagtagcgtctcctccttattcattcacttttactgtgaagactgaaatccaaaagccaggttccccaaaaaagtatttttaaaaaattttaggggaccaaaataaatagaggaagaccaatataaaaaaatatgttcaactattccattttaaatttaaagcagaaaaaaaaattgtgcccctcagacctaaaggcagctttaaatgtatatagtttggtgaaacatttgggaaatattaatttggaggtttagaagcatacgaaaaacaaattcaaagcacttgaaagtaaagacaatatcatgaggtcgaaaaaacttcaaaaggatattaggtaagagaaaatgtgaatgaaagcagtgaatttctgcctctcctcgtatttagggtacttaaaattactaaaaaatactgtctttttaccatacagctagatggcctgtattattcttaatgtggccaaaggagtgaagactgattagggttttagaatttggaactgtagtcacataaaggcatcttttgcatttcttaaaccagtaatctacattttctcctggaaatggagaaatatgaaatgtgctgtgcatagcttttggaatagaaaacaaagttttaaaagaatggatatgttttcttgcacaacttgtaaaattttaattaaaaaattacctcatttttcaatccataaggtgctttgctcaagtttgtgggatgtttgtaccatcccataaaaacccccttcacccaaactgtatttgaaatatgcaaaattcataactaagggatagcattccttggagactttgttttgttttactcttgtttaccagctgggccaacatggtagatatatgagattcacatatggtttcattaaagcacataggaaagtgctcagtcaatatttaattagtttaattagataagggaaaggagaaatcctaaatttgatggattcttttatactgtgaatatatttccatcagtgttggtaagatatcaaatgactatcagttgatcccagtcatcagtgacttatttgcatatttaagccctattcacaagagaccataatcattttaatcttatattttccctcaggaaatttagggactctgaagcccctattttattctcttggagtaaactgttgagtgtagttacaaaaacttttatttatgacttaaaaaaagtttagctgctatttcagtgaaagtgtaaaataaaacggtcatgatttttttcaattacagaatagttacaaattttaccatgttcatctattccacagagcatgttaaaaacaacaacaacaaaaacctaacagcaattacaaccttggtgttgcgtttattctaatcagagtgaatgattataatcacactttgctattttaacataaattggtgctttagagcattaaagaggaagcagcaggccctgtactcagtatttattatttcttgcctcagaatgcaaaacaactttaaagtgtctatattcatatatatgtgcatttcttaagatttaaatacaaactgttgttactccttaagcttcaggctttctgcgaaagctctaagaatatcttcattactatgcttggtcaactggaagatggtattaataaggtcagaattaggaattggattgctctgtgggtcctccggtattgtgcagaggaaagaaaaatgtctttcacaccacaaactgtgtgtctgaaccccagccaaacaaatgtgttccattggtccaatatataagcattaacaacaacaacaaaaaatttaaaacaagtaaattaatgcattcacatgatcacttcttgaaaatggttcaaagcatgttttcctgatggtgggattgtttaaatgacatgttttaaagtttttaatactttattagttatgaagtgcttcttttatatgttaagtttaggttgccagtactcataatttttatttctgcaattatgttataatgagttgtttgcatgcctacttaacccaagtaaaacgatgctgtttgctctggaatgttcatcttttagacaggttttggctcatttccaatcatggtgcaatatagtgtaacattcatttgttttcattcaacagttttatttttgtcataataaataattacttttccaataaaaaaagaa

SEQ ID NO: 111316 - DNA, 2566 bp, Homo sapiens
  misc_feature (72)..(72): n is a, c, g, or t
cccaggcatatggtatctctttgcatgtcattagctatttctattcagctattaattcgctgaatttaagtngaatagcagttactaatgacaatgcaaaagagaaaacaagccatattgctaagaaaaggatagtaagctgcttagaaagaaccagcctgtgttggaaataattctcttctagataatttaccttattttcttggcttgtactaattgaatggaagtggttaatttgttcagagtttattgccgtttgatgccaccccagtctatagttctgtgtgactttccatattgaaagagtagggttagtagccaggttgtcagtcttttacaaatgtctacataaatgtctacataaatctgaaagtggtttatattcaaggttagtttttcagtagcgtctcctccttattcattcacttttactgtgaagactgaaatccaaaagccaggttccccaaaaaagtatttttaaaaaattttaggggaccaaaataaatagaggaagaccaatataaaaaaatatgttcaactattccattttaaatttaaagcagaaaaaaaaattgtgcccctcagacctaaaggcagctttaaatgtatatagtttggtgaaacatttgggaaatattaatttggaggtttagaagcatacgaaaaacaaattcaaagcacttgaaagtaaagacaatatcatgaggtcgaaaaaacttcaaaaggatattaggtaagagaaaatgtgaatgaaagcagtgaatttctgcctctcctcgtatttagggtacttaaaattactaaaaaatactgtctttttaccatacagctagatggcctgtattattcttaatgtggccaaaggagtgaagactgattagggttttagaatttggaactgtagtcacataaaggcatcttttgcatttcttaaaccagtaatctacattttctcctggaaatggagaaatatgaaatgtgctgtgcatagcttttggaatagaaaacaaagttttaaaagaatggatatgttttcttgcacaacttgtaaaattttaattaaaaaattacctcatttttcaatccataaggtgctttgctcaagtttgtgggatgtttgtaccatcccataaaaacccccttcacccaaactgtatttgaaatatgcaaaattcataactaagggatagcattccttggagactttgttttgttttactcttgtttaccagctgggccaacatggtagatatatgagattcacatatggtttcattaaagcacataggaaagtgctcagtcaatatttaattagtttaattagataagggaaaggagaaatcctaaatttgatggattcttttatactgtgaatatatttccatcagtgttggtaagatatcaaatgactatcagttgatcccagtcatcagtgacttatttgcatatttaagccctattcacaagagaccataatcattttaatcttatattttccctcaggaaatttagggactctgaagcccctattttattctcttggagtaaactgttgagtgtagttacaaaaacttttatttatgacttaaaaaaagtttagctgctatttcagtgaaagtgtaaaataaaacggtcatgatttttttcaattacagaatagttacaaattttaccatgttcatctattccacagagcatgttaaaaacaacaacaacaaaaacctaacagcaattacaaccttggtgttgcgtttattctaatcagagtgaatgattataatcacactttgctattttaacataaattggtgctttagagcattaaagaggaagcagcaggccctgtactcagtatttattatttcttgcctcagaatgcaaaacaactttaaagtgtctatattcatatatatgtgcatttcttaagatttaaatacaaactgttgttactccttaagcttcaggctttctgcgaaagctctaagaatatcttcattactatgcttggtcaactggaagatggtattaataaggtcagaattaggaattggattgctctgtgggtcctccggtattgtgcagaggaaagaaaaatgtctttcacaccacaaactgtgtgtctgaaccccagccaaacaaatgtgttccattggtccaatatataagcattaacaacaacaacaaaaaatttaaaacaagtaaattaatgcattcacatgatcacttcttgaaaatggttcaaagcatgttttcctgatggtgggattgtttaaatgacatgttttaaagtttttaatactttattagttatgaagtgcttcttttatatgttaagtttaggttgccagtactcataatttttatttctgcaattatgttataatgagttgtttgcatgcctacttaacccaagtaaaacgatgctgtttgctctggaatgttcatcttttagacaggttttggctcatttccaatcatggtgcaatatagtgtaacattcatttgttttcattcaacagttttatttttgtcataataaataattacttttccaataaaaaaagaa

SEQ ID NO: 111317 - DNA, 3559 bp, Homo sapiens
catctttaaacccatcattcttattgaagcccatttgagaactcttagaattaatagaaccttttataagggaatatatggaatattttttattgttaatgtaacttaattccttaaaacctggaatattaatatatataatctattaaaagctgaagattaaatatgtaatttttgcttttagtttcttgtgttagtatgcttaaaggtatcaatacttttattctatattcattagaagaaaggtaataaatttaagtttcattgctgaaaaattttaaatgagtgccaccccatagccatagtcattttgattaagcataatttaactttcattatagcataaagagaaaataattattttagtatggaaacagtgataggcagtgctgtaaacaatattctctgaaaagttgtgggggtcacaaagaaaattttaaagaatatagaagcttttttaaaaaatctttttagtgtagtttcttagaacaaattataaacataatcattctgaataatcaatttttatttagtccttaactatgtaaaaccgtatcagtagaaaaatgtgctggtgtcgtgtctaaagatggataaatttctttggaatttatctttggagaccaactttatgaggcagactttttgtctacggctttggaaccaaaaaaacttcactctaattcagtcctaaaggctattttacattttgccggggtaaagtgacttcaagatacagcatggtgtcttgtatctagtagaatattgtgctagccatctaaaaaagtggatttgagccttaatttggccgtttctcaattgtctagttgaccttagacaattagtgtccatggctttccttttgtttttcccatactgaggaacttaaactacagctctaaaatgtcttttggttttaaaattctgaatgcttatatactactattaaaaattaaaaatccctcaaatagtagggaaatacaggtaatatgaaattaaatgtatttttatccattatttgattcccacctgttattttatttagaatacgaatacaaccaagtagggaaaaacgtatcagtaactgctattcaacttaaattcagcgaattaatagctgaatagaaatagctaatgacaatgcaaaagagaaaacaagccatattgctaagaaaaggatagtaagctgcttagaaagaaccagcctgtgttggaaataattctcttctagataatttaccttattttcttggcttgtactaattgaatggaagtggttaatttgttcagagtttattgccgtttgatgccaccccagtctatagttctgtgtgactttccatattgaaagagtagggttagtagccaggttgtcagtcttttacaaatgtctacataaatgtctacataaatctgaaagtggtttatattcaaggttagtttttcagtagcgtctcctccttattcattcacttttactgtgaagactgaaatccaaaagccaggttccccaaaaaagtatttttaaaaaattttaggggaccaaaataaatagaggaagaccaatataaaaaaatatgttcaactattccattttaaatttaaagcagaaaaaaaaattgtgcccctcagacctaaaggcagctttaaatgtatatagtttggtgaaacatttgggaaatattaatttggaggtttagaagcatacgaaaaacaaattcaaagcacttgaaagtaaagacaatatcatgaggtcgaaaaaacttcaaaaggatattaggtaagagaaaatgtgaatgaaagcagtgaatttctgcctctcctcgtatttagggtacttaaaattactaaccaaaggagtgaagactgattagggttttagaatttggaactgtagtcacataaaggcatcttttgcatttcttaaaccagtaatctacattttctcctggaaatggagaaatatgaaatgtgctgtgcatagcttttggaatagaaaacaaagttttaaaagaatggatatgttttcttgcacaacttgtaaaattttaattaaaaaattacctcatttttcaatccataaggtgctttgctcaagtttgtgggatgtttgtaccatcccataaaaacccccttcacccaaactgtatttgaaatatgcaaaattcataactaagggatagcattccttggagactttgttttgttttactcttgtttaccagctgggccaacatggtagatatatgagattcacatatggtttcattaaagcacataggaaagtgctcagtcaatatttaattagtttaattagataagggaaaggagaaatcctaaatttgatggattcttttatactgtgaatatatttccatcagtgttggtaagatatcaaatgactatcagttgatcccagtcatcagtgacttatttgcatatttaagccctattcacaagagaccataatcattttaatcttatattttccctcaggaaatttagggactctgaagcccctattttattctcttggagtaaactgttgagtgtagttacaaaaacttttatttatgacttaaaaaaagtttagctgctatttcagtgaaagtgtaaaataaaacggtcatgatttttttcaattacagaatagttacaaattttaccatgttcatctattccacagagcatgttaaaaacaacaacaacaaaaacctaacagcaattacaaccttggtgttgcgtttattctaatcagagtgaatgattataatcacactttgctattttaacataaattggtgctttagagcattaaagaggaagcagcaggccctgtactcagtatttattatttcttgcctcagaatgcaaaacaactttaaagtgtctatattcatatatatgtgcatttcttaagatttaaatacaaactgttgttactccttaagcttcaggctttctgcgaaagctctaagaatatcttcattactatgcttggtcaactggaagatggtattaataaggtcagaattaggaattggattgctctgtgggtcctccggtattgtgcagaggaaagaaaaatgtctttcacaccacaaactgtgtgtctgaaccccagccaaacaaatgtgttccattggtccaatatataagcattaacaacaacaacaaaaaatttaaaacaagtaaattaatgcattcacatgatcacttcttgaaaatggttcaaagcatgttttcctgatggtgggattgtttaaatgacatgttttaaagtttttaatactttattagttatgaagtgcttcttttatatgttaagtttaggttgccagtactcataatttttatttctgcaattatgttataatgagttgtttgcatgcctacttaacccaagtaaaacgatgctgtttgctctggaatgttcatcttttagacaggttttggctcatttccaatcatggtgcaatatagtgtaacattcatttgttttcattcaacagttttatttttgtcataataaataattacttttccaataaaaaaagaa

SEQ ID NO: 111318 - DNA, 3559 bp, Homo sapiens
catctttaaacccatcattcttattgaagcccatttgagaactcttagaattaatagaaccttttataagggaatatatggaatattttttattgttaatgtaacttaattccttaaaacctggaatattaatatatataatctattaaaagctgaagattaaatatgtaatttttgcttttagtttcttgtgttagtatgcttaaaggtatcaatacttttattctatattcattagaagaaaggtaataaatttaagtttcattgctgaaaaattttaaatgagtgccaccccatagccatagtcattttgattaagcataatttaactttcattatagcataaagagaaaataattattttagtatggaaacagtgataggcagtgctgtaaacaatattctctgaaaagttgtgggggtcacaaagaaaattttaaagaatatagaagcttttttaaaaaatctttttagtgtagtttcttagaacaaattataaacataatcattctgaataatcaatttttatttagtccttaactatgtaaaaccgtatcagtagaaaaatgtgctggtgtcgtgtctaaagatggataaatttctttggaatttatctttggagaccaactttatgaggcagactttttgtctacggctttggaaccaaaaaaacttcactctaattcagtcctaaaggctattttacattttgccggggtaaagtgacttcaagatacagcatggtgtcttgtatctagtagaatattgtgctagccatctaaaaaagtggatttgagccttaatttggccgtttctcaattgtctagttgaccttagacaattagtgtccatggctttccttttgtttttcccatactgaggaacttaaactacagctctaaaatgtcttttggttttaaaattctgaatgcttatatactactattaaaaattaaaaatccctcaaatagtagggaaatacaggtaatatgaaattaaatgtatttttatccattatttgattcccacctgttattttatttagaatacgaatacaaccaagtagggaaaaacgtatcagtaactgctattcaacttaaattcagcgaattaatagctgaatagaaatagctaatgacaatgcaaaagagaaaacaagccatattgctaagaaaaggatagtaagctgcttagaaagaaccagcctgtgttggaaataattctcttctagataatttaccttattttcttggcttgtactaattgaatggaagtggttaatttgttcagagtttattgccgtttgatgccaccccagtctatagttctgtgtgactttccatattgaaagagtagggttagtagccaggttgtcagtcttttacaaatgtctacataaatgtctacataaatctgaaagtggtttatattcaaggttagtttttcagtagcgtctcctccttattcattcacttttactgtgaagactgaaatccaaaagccaggttccccaaaaaagtatttttaaaaaattttaggggaccaaaataaatagaggaagaccaatataaaaaaatatgttcaactattccattttaaatttaaagcagaaaaaaaaattgtgcccctcagacctaaaggcagctttaaatgtatatagtttggtgaaacatttgggaaatattaatttggaggtttagaagcatacgaaaaacaaattcaaagcacttgaaagtaaagacaatatcatgaggtcgaaaaaacttcaaaaggatattaggtaagagaaaatgtgaatgaaagcagtgaatttctgcctctcctcgtatttagggtacttaaaattactaaaaaatactgtctttttaccatacagctagatggcctgtattattcttaatgtggccaaaggagtgaagactgattagggttttagaatttggaactgtagtcacataaaggcatcttttgcatttcttaaaccagtaatctacattttctcctggaaatggagaaatatgaaatgtgctgtgcatagcttttggaatagaaaacaaagttttaaaagaatggatatgttttcttgcacaacttgtaaaattttaattaaaaaattacctcatttttcaatccataaggtgctttgctcaagtttgtgggatgtttgtaccatcccataaaaacccccttcacccaaactgtatttgaaatatgcaaaattcataactaagggatagcattccttggagactttgttttgttttactcttgtttaccagctgggccaacatggtagatatatgagattcacatatggtttcattaaagcacataggaaagtgctcagtcaatatttaattagtttaattagataagggaaaggagaaatcctaaatttgatggattcttttatactgtgaatatatttccatcagtgttggtaagatatcaaatgactatcagttgatcccagtcatcagtgacttatttgcatatttaagccctattcacaagagaccataatcattttaatcttatattttccctcaggaaatttagggactctgaagcccctattttattctcttggagtaaactgttgagtgtagttacaaaaacttttatttatgacttaaaaaaagtttagctgctatttcagtgaaagtgtaaaataaaacggtcatgatttttttcaattacagaatagttacaaattttaccatgttcatctattccacagagcatgttaaaaacaacaacaacatgattataatcacactttgctattttaacataaattggtgctttagagcattaaagaggaagcagcaggccctgtactcagtatttattatttcttgcctcagaatgcaaaacaactttaaagtgtctatattcatatatatgtgcatttcttaagatttaaatacaaactgttgttactccttaagcttcaggctttctgcgaaagctctaagaatatcttcattactatgcttggtcaactggaagatggtattaataaggtcagaattaggaattggattgctctgtgggtcctccggtattgtgcagaggaaagaaaaatgtctttcacaccacaaactgtgtgtctgaaccccagccaaacaaatgtgttccattggtccaatatataagcattaacaacaacaacaaaaaatttaaaacaagtaaattaatgcattcacatgatcacttcttgaaaatggttcaaagcatgttttcctgatggtgggattgtttaaatgacatgttttaaagtttttaatactttattagttatgaagtgcttcttttatatgttaagtttaggttgccagtactcataatttttatttctgcaattatgttataatgagttgtttgcatgcctacttaacccaagtaaaacgatgctgtttgctctggaatgttcatcttttagacaggttttggctcatttccaatcatggtgcaatatagtgtaacattcatttgttttcattcaacagttttatttttgtcataataaataattacttttccaataaaaaaagaa

SEQ ID NO: 111319 - DNA, 287 bp, Homo sapiens
agagttcttgcaaaagaaaggatagaaggaggcataaacaaaagcacagaaattagggtgtatattttttcctttttaaaaaaagtttcccaattttagtcattttgcaaaagagaaattaccattagagacatgtacattcgacctgccttatgcttgacatatcgttaatgagtggagcgatgataacaagagtcttgggctgggagcctgcaccagaagtagcctaaaaatgccagctgtccaggtaccttccttgttggtgtggttctgggatcacttgcaca

SEQ ID NO: 111320 - DNA, 257 bp, Homo sapiens
aaggagagattgctgtcgttcagagcacaggcctgactaggttcaaatctcagctctgtctgtatcactcacgtgctgcgtgactgccagggagctgtttgatcgctctgtgcctcagtttccctacctgagaatctgaatgatgtccaccccataaggttgttgtaaggcttaccttattcatttaatatttgtaatccttttggggcagtggctattatcatcatcatcatttaaataatttctgttcatggtta

SEQ ID NO: 111321 - DNA, 569 bp, Homo sapiens
ctcgtgctcccactctctcccttccttccttctttttacctatccatgtggaatttcactttctctatgcctgtcctagtacttagcagactcaagggaacccctgtgtaaatttctgcagttctttttctgcattgctctttttttggggaactctgccacacaacttcaagctgaatcaactttcctgagctactatcactgattctttaagtcagcaaggctgctgagctctgttttgattttttctggctgtgcccatgacctagaagtcaactttaggtagataatcctgtaattattaaactcaccttgtttgtttctctttttacagagatagcagttctatgttgcctgatgtccaatgtctgaaaatggctgtttcatatatttttgccaatattctacttgtttataaagtgagagatcatgtctgttccttgttaggctttcgtagctagaagtcttttttttttttttttttaagctataaatactgatttttctactgcattttgtgctccctagggaaagacatctgaacatctttctatctctagcgcacagaa

SEQ ID NO: 111322 - DNA, 434 bp, Homo sapiens
tcactccagcatatccttcattgcataggcaatcacggtgaggctgagcgactcacccccattttgcagtgcacaaggcatttagatccatgttgctttgctttagagatgaatttgtaagtggtcagtgtaactggggagaaggaaccaagtggggagttgccatggataaaaatagatagagagggccaggctggtctcgaattcctgacttcaagtgatccacctgcctcggcctcccgaagtgctgggattacaggcatgagccaccacgcccggcctattacgtatttattgttgtggacatggatttcaggatttactcagtagacatttattgaggtcttactgtgtgtccgatgctgggctatcatcagagaaacacataaaggcctggttcttgcctggaaggaattctggcagtgatggattct

SEQ ID NO: 111323 - DNA, 252 bp, Homo sapiens
catccgggccgacgagactttcaatgggcctgtgttcctgggcagctgctcctgcctcctgctgtgtcacctttgattctctcactggttttgcccgtgatgaaaacctcacactcctgacctggtgcctgatgttgcaaagggagggcagagggcaggaccacatgagtcagacagaaggacggggcctcttggagcatctgacaaggtttatggaaaaagcacgtctcagagactcaatgagatgctgaa

SEQ ID NO: 111324 - DNA, 492 bp, Homo sapiens
gttataaccacagaatatggaataaaatttatttcaatggactgagaatggagtgctatatctaaggcaatgaggacagtgaaaaaattacagggttggtgtgcaagttccctgctaatgtaggcaccaatgaaccacagcatttcatacatagaatgcagcagtccaggaatttaaatgggaaaaaattacatcttcacctatactaatttctgcgtaaaagtttacattttaagaatgattactacaatagtaccacagtggtattagctgctgctgtgactttgtcatcagtagaagttacagatattttcatagcacatttttgctaatatcttagaatattgttttcatttatcacatctggaaaaatgacatcactagaactgccactagatcttgttattatagttaatggtgtgtgcaaagcaacacatatctttaatattttgatagctacataaatataatttatttcctttgtgtgatatg

SEQ ID NO: 111325 - DNA, 490 bp, Homo sapiens
caaatctcatttcacttccctggctcattccagcctagccacaatgtccccatttttcctccaacactgcactcttgggataaactctacttggtcttcttttaggtattgtcacattcaacttgctaaaattttgctaaggatttttcgtctgtgctcacaagggaaattggtccatggttttcattacttatgtctttgattttggtatcagagtaatgctagccttgtggaatgagttgggaagtattcactcctcttcaacttcttagaagagttcacatagaatgagtattatatcatgcttaagtgtttgttagcattcacagatgaaataattcaggcctaggatttacttcgtggaaagtattttcattcatatacttctttataaattgaatttttaaaaataaacttaatttccttaatagatgcagggctatttagtgtcttctgtttcttcttgaatgcattatgatagctgtattag

SEQ ID NO: 111326 - DNA, 257 bp, Homo sapiens
tgtgtctaaaaaaaagagtaaattaaatcagattgatgagagaacctaaaaggaacatgttaaactctgaatacattatcaaagatcactataactacacaccaatactactcactgtagtctcctcctggtgagatacagtaacacagtggaaaaagcatggggtaggagcaagacaaatgtaggcttcaatttctactcagtcatttacttgcagtgtgagcttaggcaagtaatgggattataccacccaactc

SEQ ID NO: 111327 - DNA, 337 bp, Homo sapiens
tgctggtctttcgtgcctggctggcttcacttaggctcatgtcctcaaggttcagccacattggagcgtgtcggtgcctccttcctttttgtggctgaatcatcttccgttgtgtggctggaccacgttgtgtttatgcactcattagctgatggacatttgggtcgtttccactttctggctattgtgagtcatgttgctctgaaggtccatgtacaggatttgtgtggacattcccatggccttaaactccgtttccacctggatgacttcagcccggacctctcccctagaccctgggcttgtcttccggcccgttgagtttctgcatttgagt

SEQ ID NO: 111328 - DNA, 441 bp, Homo sapiens
ccaaaaaaaaaaaaaaaaaagagcatatcctatgtgattccattttgataaaattctttatgatgcaaattgatgtaaggcatcagaaaacagatcagttgtgttggagtggggagtagaagcctgaaagtgcagaggatagggattactaagggcacaaggcaactttgtgaacaatcaacaaatattcactctcttgattgtggtaatgattgaacagatgtgtacattatcaaattatatactttatatgcatagttaattatatattaattatgcctcattaaagatggggacaggaagctacttacttaaatgcttattatagtctcagttactcaggaggctgaggcaggaggatcacttgagtccgggagttcaaggctgcagtacactatgatagtgcctgtgaatagccactgcactccagcttgggtaaca

SEQ ID NO: 111329 - DNA, 206 bp, Homo sapiens
ggcaatcagatcagtggggaaatgaattctttaataaattgtgttaggacaattcattgtggggagcagatccctacttcaccccatacactgaaaataaatagcagatggattaaataactgattgttttaaaaaatgtgtaagaaggccaaagaaatgtctaagagaattctttcaaaatcttagaatgaggaaaaccttctga

SEQ ID NO: 111330 - DNA, 303 bp, Homo sapiens
ggtaagtggtagaatggatcaactcttatcgtcagaccaggtattacatggaattgtgggcacccgccctcttgctcatggcatctcctagaactgttctggaagcaacaacacctagaaaactaaaccttcatttactgtgaacatcttctgactgtggcttccagatgctagtttacagaacaaccacacagcaagaccaagcttatgctgagttgacggaacaatgagtaaacataaggatattactgtgtctttgaaattctgaaagtgttctttcttaacttgcgcattaaaatcaca

SEQ ID NO: 111331 - DNA, 365 bp, Homo sapiens
tacaaagagttttccaactcttcctctaccttctaacactgaattggaaattgtgccctaaggctcactcctgcaagagagggcagataagtgataattggggctttaacaccagaggagctgaactgcctcacagtaattattcacctgaaaggaaggaggtttgaccagcaatctctaacatcttttctggtccaaaacctgtgattataaaaaaagcacttaattggatattgttttatattatgttccagatatctcgattttcccaactaccctgtaaactcctagaggccaggggccatatcttatagacctcatgtagcttctataataattagcataatgctagacacctaggagat

SEQ ID NO: 111332 - DNA, 785 bp, Homo sapiens
cacggctggggcaacccaacccgcgcctgaagcggcttggcttgacctgcggaagcgcgggccgggatggcgtggggagagggaggtaggtgccactgggctgcagatgacgagtgggttgggggcttgctgtgggacaagaggttcaggttccggcctgcgccttccactccgcggtggcgctctctgcctgcggttttccaggaggccgatctaccccagggacactctcatccttcaggcggtctcctggacgccctttcctccccttgcctcccagcctgacctggctctttcgcccctcggagaaccggtaggttggggtccctcggcgggggtctagtgagccgagtcgcgagctttgcgcccccggtatctaggccccgtgccgcgcgcaaatccgggcccaggcgtacagttctggagcctagtcgccgccagacacagggccctttgtacccggaggagcgggagcgggagcgggggcgtcagggcaacccttgcaccccagaggcctgcctaggaccaccctgggaacaaatgtctcgctcggaaaacgaggtgaacccggaggatgtcctacgcatcatacccctccccttcttgagaaggctttttctttttttctttttttttcccggtttccttttctctggcttcttccacaccttaccgcaggtgtgggcctcttttcatgtatgtgcggctgctatctcggggatgcaggggaaggcggtgtaggaggcagcgtggaagggtactaggaggtggcggcgggattttgg

SEQ ID NO: 111333 - DNA, 335 bp, Homo sapiens
ccctactggtgaacacttaggttcttcccagcattttgcggcaatgaacatactaaacagatgtgcttttgtgcacatgtgtgaagttctctagaggtaagtatatggaagtgaaatttctgggtcctagggtttgagcatcttcaccccaactagatattgccaaattgctttccaaagtcattgtacttgttcatgctcctactaacagtttctgagtgctatttctgcacatctccaacaggctggatgttgttcatgttcaacctgactcataatcggtgacatgtaatttaacacaccaatgaaacatattacatctatcagaagccaat

SEQ ID NO: 111334 - DNA, 231 bp, Homo sapiens
ctcttgacaaatatctggtagagaggaccaatgaaaccacgcagatcactgtcctgctttcctaaagtaagctcttccagaatttactttctggtctagagtccttcttcagatcctttgaatatttggcttttctccaaggattaggacttctcaatgctaattttggaagaagcacattaaagaaaaaaattggtgggaagataggagtgccaaaaccttgacatccat

SEQ ID NO: 111335 - DNA, 1700 bp, Homo sapiens
agaaattattctagatcattcgttgagtggcgcgtcactctataggtaagtgaacttggtcaatagactgtgtcctatgagatcctggtgttatgacatagatgcttggatgctcatcttattaaaataagcccggagggaccatgctgagcgtacttgatgcttaattcctacgcatggacgttctggaggtcatatatcgtcgcttctaatctatcaggagtccaacgccggaactcataatattacagattgtgactgctcccgctcgcgtggttagttgttcctatgtgtggcttggagccatggccacttggcttcctagattgtgtcccatgaattcaagcataaggagctcccagtctgctgcacctggcctcccttgtccttcacatccctgcagcatactgtagcaaactttcaagttagctttttattgcattccaccccctgccagggagcaaacttaaactcatgcaactcaaaatgaccatgctgggtctgttctaagtttgaatttggaccttgatccagccttcacatactttctcttatgaattcctcttaatgctagttaataaaaatataatggctttcatgtcccttctcataataacattgccagctttgggggttctttgaaaactttgcttgagaagtccatggcaaaaaaaaaacaaagatatttggctttaaaatatggtctttgcttaccaaactcctctctctgaggaagggagagaaagagttgaaggtttctgggaaaggggcatagaagcaactcttaactctggccatgtggatctgcagacaaaattagggcaaatgtagtgctacagatcccatccccgggcctcacattgtggccagccatatggagtcagatttggagactttttggagatggggaagccactggactcttaggcatctggtgtaaagagagactttttctttgctactttttttttttttttttgagatggagtcttgctcttttgcccaggctgcagggcactggcgtgatcttggcttactgcagcctccgcctcccaggttcaatagattctcctgcctcagactcctgagtagctgggattacaggcacctgctaccatgcctgactagtttttgtatttttagtagagacagggtttgaccatattggccaggttggtcttggactcctgacaagtgatccgccctcctcagactcccgaagtgctagggttacaggtgtgaaccaccatgcctaactatcgttgctactttctattggaagagaaggcagccctgatttagtctgtttacagtctgcattatgtggagaatagagagccatcatagtccctaaaactttccttgccagttaacccagcaggacaacctgtctttgtctcttgacaactgttaactgagaacagggcccttgctcctctaggtgtgcacattaaggactttgcacagtgtggatgtagctcatgctgctctgccgtctagtacatgctgcttgaattttcatcatcatcctccactccttccacctccaagaaaaaaaaaagcgtgcaggaagtagcatttcagatccttctccaccacctctgcttcccttctcccttcttttcctccttgcagcattccctttagtaccagggagggatggtggttgaaaatggggggaatgatgttgctcagaaaaa

SEQ ID NO: 111336 - DNA, 2731 bp, Homo sapiens
agcggagaaccttcaactgtcaagcaccgagctagccaccagcatgctgtactccccagggccgagtcttccggagtcagcagagagcctggatggatcacaggaggataagcctcggggctcatgtgcggagcccacttttactgatacgggaatggtggctcacataaacaacagccggctcaaggccaagggcgtgggccagcacgacaacgcccagaactttggtaaccagagctttgaggagctgcgagcagcctgtctaagaaagggggagctcttcgaggaccccttattccctgctgaacccagctcactgggcttcaaggacctgggccccaactccaaaaatgtgcagaacatctcctggcagcggcccaaggatatcataaacaaccctctattcatcatggatgggatttctccaacagacatctgccaggggatcctcggggactgctggctgctggctgccatcggctcccttaccacctgccccaaactgctataccgcgtggtgcccagaggacagagcttcaagaaaaactatgctggcatcttccattttcagatttggcagtttggacagtgggtgaacgtggtggtagatgaccggctgcccacaaagaatgacaagctggtgtttgtgcactcaaccgaacgcagtgagttctggagtgccctgctggagaaggcgtatgccaagctgagtgggtcctatgaagcattgtcagggggcagtaccatggagggccttgaggacttcacaggaggcgtggcccagagcttccaactccagaggccccctcagaacctgctcaggctccttaggaaggccgtggagcgatcctccctcatgggttgctccattgaagtcaccagtgatagtgaactggaatccatgactgacaagatgctggtgagagggcacgcttactctgtgactggccttcaggatgtccactacagaggcaaaatggaaacactgattcgggtccggaatccctggggccggattgagtggaatggagcttggagtgacagtgccagggagtgggaagaggtggcctcagacatccagatgcagctgctgcacaagacggaggacggggagttctggatgtcctaccaagatttcctgaacaacttcacgctcctggagatctgcaacctcacgcctgatacactctctggggactacaagagctactggcacaccaccttctacgagggcagctggcgcagaggcagctccgcagggggctgcaggaaccaccctggcacgttctggaccaacccccagtttaagatctctcttcctgagggggatgacccagaggatgacgcagagggcaatgttgtggtctgcacctgcctggtggccctaatgcagaagaactggcggcatgcacggcagcagggagcccagctgcagaccattggctttgtcctctacgcggtcccaaaagagtttcagaacattcaggatgtccacttgaagaaggaattcttcacgaagtatcaggaccacggcttctcagagatcttcaccaactcacgggaggtgagcagccaactccggctgcctccgggggaatatatcattattccctccacctttgagccacacagagatgctgacttcctgcttcgggtcttcaccgagaagcacagcgagtcatgggaattggatgaagtcaactatgctgagcaactccaagaggaaaaggtctctgaggatgacatggaccaggacttcctacatttgtttaagatagtggcaggagagggcaaggagataggggtgtatgagctccagaggctgctcaacaggatggccatcaaattcaaaagcttcaagaccaagggctttggcctggatgcttgccgctgcatgatcaacctcatggataaagatggctctggcaagctggggcttctagagttcaagatcctgtggaaaaaactcaagaaatggatggacatcttcagagagtgtgaccaggaccattcaggcaccttgaactcctatgagatgcgcctggttattgagaaagcaggcatcaagctgaacaacaaggtaatgcaggtcctggtggccaggtatgcagatgatgacctgatcatagactttgacagcttcatcagctgtttcctgaggctaaagaccatgttcacattctttctaaccatggaccccaagaatactggccatatttgcttgagcctggaacagtggctgcagatgaccatgtggggatagaggcgctgtaggagcctggtcatctctaccagcagcagcagcagcgaggttctagcccaggagggtggggtgcttcttgtagccctcagctctccggtctctgctgatgaaatgggctccaggtggcagtgcccgggtcccaggtgccgtgtttactgcagcagtgggacctccgtgcccactcccccagctcagaggctttctcttttttccccaacccggcttctgatggctggctttcccccaccatcgctctctcagagtatattttactaaagagtagttgatgcttccccagggtccccctggctggggaggccaagaatagggaagggacttgtagcccgtttcttaccctccatgcttgctgtcctgctcacacctacctgctgaccacccatcctggcacagcctctgttttcctccccatctgtggatactattctaataaatagcacatgccattgg

SEQ ID NO: 111337 - DNA, 151 bp, Homo sapiens
gtcttatttgctcttaacacataaaagcaactttgttttcttgcatttcttcacattgctatgcttgtcgtctcagggtgaatacaaatgccagatgacagataagaactttatagttaagtttctaagaccaagattgaaatttggagct

SEQ ID NO: 111338 - DNA, 340 bp, Homo sapiens
gagttaagagagcaaaggtttgggggactcccagggagccttatgtggtgagtcatcaatggagtacagcaggaggtgaccagagccgttcctgagggaactaaggttcacagagaaggttgctgtttaaggtcacaggtctaggaactgacaaagctggagtttgacccaagtctttggactccaggtccaacatactaaaactgcctcaaataactattttattcttgccatttgatttacagtaatatttctgaaagtgtaactaaaggaatagcagcattggaccctctggtcagcttgttgaaaatcaagattcctgagtcccacttcagatata

SEQ ID NO: 111339 - DNA, 397 bp, Homo sapiens
tgatactcatcatgtacttgtagactaatgggtgcaaaatacagattctaccctcaaaaagtgcaaccttgagatagggtgatgtttcagatccatcagtgcgaaatttaggaagtagaactggtatggtttggctctgtgttcccaccaaaatctcatgttgaattgtaatccccaatactggggaagggacctggtaggaggtgattggatcacaggggcagattccccccttgctgttctcatgatagtgagtgagttctcaccaaatctgatggtttaaaagtgtgtgacacttctcccttcgttcgctgtctttctcctgccgccatgtgaaggcatgcttgcttcccctttcctttctgccatgattgtaagtttcctgaggcctcccagc

SEQ ID NO: 111340 - DNA, 683 bp, Homo sapiens
gacacaactccatgttcctaaacttcatgtgttgctaaaatcttctcagatacaacttcatgttcctaaacttcctcttcccaggcataacttcatgttcgaaaactcttcccagacacaactccacagggttctgcacagattttctgactcgtgctgagggagacctgagtattcttcagctcagctgtctacaggagaagaaactgatgcaagcctttcctttttataagtaccctaaatattgattagtgactctgacagatgtcaacaaccaatttagtttggggagtttgagagagaaaaagaacatccaccaatcttgtctctcctgtacttctccccaggtcctttcattagttttcagtgggtgaaaggaaaagggtgattgttgtggtaggacttattctgccctttgatatgcacatgtgacagtttctgacctagattttagatgactcaatagagctggattactttgtacattgactcaactttgggctatatgaagagaacttatgtatattatacatgagatacaagtattattcgtgggacaacaaagggggaaatgacaactttttctgaagatatttaggaagacactatgattcctcccttacctacacccttgcttctcatagcactttgctcaaggttagagctcaacataagtttccttg

SEQ ID NO: 111341 - DNA, 409 bp, Homo sapiens
acccattagtagttaatccccataccccctcaccccctcactcaccccatctactgcccttcacaagaccctggcaaccactaatctgctttctgtctctatggatttgccaactcttgatgtttcatataaatggaatcacacaatatgtgaccttttatgtctggcttctttcacttaacatcatgtttttaaggttcatccatgttgtagcatggatcagtactttgttcctttttgtagctgagtaatattacattgtatgtatataccatattttgttgatgtactcattagttgactgtttttctaaatttttgaattatgaaaatatccattcaaaaattaaactttaaaaaatagaaacaaaatgaaaaagcccttctcataaaaaacagaaaaatgtaaa

SEQ ID NO: 111342 - DNA, 579 bp, Homo sapiens
agttggccagaccaactccatcaacagagcttgacagctaaggattcaaaattcacattctaagattttacaatgcagtcaactcagtccagacatttcaccatgcacaccttgcatttaagcacagcataggcgtaaatattcagaccattcaccattttcccacaaacaatataaactcaacccaataacctctttatgtgagatttcaatgtgtacagtgacaggcaccctcatatccatgaggggaatcaattaaaacagattaaatggcttcagctttgatttaataaccaattactggcaatcctcattgcaaatactaaatactcactccccataggacaggataatcctaaaattttaacaaagcttcagagggtctacacaacagagctttttactggaagctattagggtcttctagggcaccttcaaagagaaacataaagactcctggtatatccagcacaagaaagagattctagtgttctgtgaaactgaagcaaacacttggggtttcaacacagattatgaggaagcaaagaaatcctttctgaagtctctttggtattcagc

SEQ ID NO: 111343 - DNA, 825 bp, Homo sapiens
caccaggcatgtagagaaatcaacgtttttcagagtttgagctgatttgccaagttgctcttgtccttgtcttgcaggtgttttaagatgtgttgcttctcccgtgcgtgtcgtttgtgtcatttgtgtcactctcagtattgctctgaaggctttggagcagcctccaccttagcattgcaagcggtgtttatgcgcagtctgagttgtgcatgtggtgtctttaggagcatggacattgctcagttattaaggattagggctgctttcaagggcttttaggcatcagcagataagtacaataagacctgagtttactgtaattattgtttaattaaattttcaggtaaatttagggtttgccaggaagtcctgttggtttcaaactgttttctcaatgtgtgaattctttctggacccaccatgtgtgttggggacgttttcccagacacccagacacgcattctttgggggatgtcaaattgtaaagcatcccgcgaagatgttggaaatcatcttgtctccagctgctaggaaggaggacactgaggtcgggaagggatccagatctgcccagttgatccggccgggcagtgaggggcagggcctgagctggtgccatggcctcttcctcccgggacagccatcttgtcttgtggcactgcgtctcagggtgtgcctgcccaggggaggtgggtgggcgccacaggactgaccctgagggaatcctgtaaaccaggctttcctgtgggggtcagtataagcccattttgtgatctgtgggtcacagtgggatggggggtgcctactggcaagactgtggtt

SEQ ID NO: 111344 - DNA, 236 bp, Homo sapiens
ccatatcagacattttgtcagataatttccatatcttttagatagttttcaccttgattccttaaggtaagcagtagaaatattattatctcattgatagatgagaaaattgatacctactggctcaaaagtaagatactagaagaaccattatctcagcctcgtcttttgacatctaaacaatggactttttattatacagtgtgtcttactctcttacaacccacatgctattt

SEQ ID NO: 111345 - DNA, 455 bp, Homo sapiens
ctgggttcaagtgattctcgagcctcccgagtagctgagattacaggtgcgcaccaccatgcccagctaattttctgtatttttagtagagacggggtttcactgtgttgcccaggctggtctcaaactcctgggctcaagtgatccactcaacctcgccctcccaaagtgctgggattacaggcaagagccaccacacccgcccagctatggtgacttctaacagtgtgtgagctgtagatggttacttagtttatgaatggaagccacttgattctcccttaaatatagagctatatatgaccacatagtacccaaccatagtattttgttttggctgcctttctgttgtgcctccttgaaacatttttctttttacatgagtagctgccaacacaatcctccctccaattttcagatgaggctgtaggaaattacatgacacctccctcccc

SEQ ID NO: 111346 - DNA, 321 bp, Homo sapiens
agtcacccttgggagaggcagtgaatgggtggcttcagggaaaccatgctactccaaataaacacagagtcaattaaacatgtgcctttgatgtggaaagcccaggacctccacactactcttctgagtttaggtcagaggtaaagatgcagatggatgcctccttccctgaggaccctgcctataacagcagtgattgcaacggtcctttccccacggcccatgctgggctctggcaggcggtgttgcatgcttcctttgcaatgtggatccactacagcacacaggattaggatgggataaagtcttaaaaaccatgtc

SEQ ID NO: 111347 - DNA, 931 bp, Homo sapiens
gccaggccctgggagccccctccaggagctccgggcaagcagcccctcatggtccatggtggaactgcaccctcagcactggtgagggtgtcgcaggagcctgcgaggaaggtggggtctcagtgcttttgcacagggcgagtggagctggaaatgcagcccccagtggtttcagttattccagacatctcacaaatccttaaggaggaggctgtgtccctagagtcctgtagtcgagacatttgagaatttgggacccagttggaagtggttgcgtatttccattgtgtgggaatatgtaaaaggcccaagcctcaccaagaagggaagaccaggctgctctcatctcaagggccagttgcttcacacaccggagtgggcctaatgttcaaggagcttctttctccatttctccccacagtgcttaacgtctcaggccacgggctgccagcactcacctgccgaggccgccctgcggcctccctgttctgaggcccctgcctctccctgatgaaacttcctccgtgctaacttggcaagaaaaggcaaacgctgctgtgcttccctttgcccttgaaaagaatgaggtttaggggaggctctgcacagtcctgtgctgtccgggatagctgagcagaagctgttgaagccggcctgctggactgagcttggtccagcagcctatccacgtgagagccctggctatctggaggcacagggagctgctgggcctgcagcgtcccacctggagggaaagaacgcaccgccaaggaggcgtgggccctgcagcccgtgctgggccgcgaatctggtagccacgcttctccggcggaacgcggcgccccctggcggcagaacgcttgtggccgccgttacactcgtgtggaaacagcgccatctgccgaatgctccatctcattgctgattggcc

SEQ ID NO: 111348 - DNA, 634 bp, Homo sapiens
caagctgcaacaaatttgtaatgatcacagtggaaaccagcagcctgtcagccactggaaaggtagaatgttactggggctccttcaaaaccccatccccagggaatggtcattatttaacctgtctcataggtccctggaagaccccaattgcaaggttgtcattgtttgacttgagttggagctcatgcagtgaaaagagccttttctctatgggggtttattaaaaacaattagaggcaattgtttaacatcatggctgccggatgcaatcacctttgtaaagattatgacagcaaaagaagtctagcatagctgactccatcttgtttcaagcctcacaggctggctgtcctcacttattcctaggtgtgggtcaagctaaccatgggagacatttagtttatagtttaactttgcatcaaggatgataatagtacctccctaaaactgacctcctccttaaaactgaaaccacctttttaagactaatgaaaggccacaagattaggattatggtgaggggcagagctgatttctgctaaaatgtaggtacagttaaatgataaccagccatttgttccctagcttgcttttctataatgcattactgctcaagagtcatgtggccaga

SEQ ID NO: 111349 - DNA, 691 bp, Homo sapiens
cgcggtggctcacgcctataatcccagcactttgggaggccgaggcaggcggatcgagaccatcctgactaaaaaggtgaaaccccgtctctactaaaaatacaaaaaaaatagctgggtgtggcggtgggcacctgtagtcccagctattcgggaggctgaggcaggagaatggtgtgaacccgggaggtggagcttgcagtgagccgagatcacgccactgcactccagcctgggtgacagagcgagactccgtctcaaaaaaaagaaaacaataactaaaattcaccatatcaatagactaaagagaaaccatatgatgtcaataaatggagaaaaagcatttgacaaaattcaatatccattcatgagaaaaactcagcaaattaggaaggagagggaatgtctttaatctgataaaaagcatgtacacaaatgcctatagctcacatcataattaatggtgaaagactgaatgtttctgccctaagactgggaatgaggcaaggtagacatttctcaccactcatactcaatgttgtactggaggacctagttagtgctgtagagcaagaaaaaaaaaagaaataaaaagcacagattagaaagtaagtaaaactgtctctattcacagatgacgtgattttctacatagaaaatcccaagggattgaactcctcgactaatgaat

SEQ ID NO: 111350 - DNA, 413 bp, Homo sapiens
attaaatagaagtaaatggataaacattgggagaattttagaaattggagagttcatgttatcaaatagcatttccatactttaatgatatgcaaggagcaggactgttcagaaatgaccctggtgttgactgagactagggctctctcctcccagcaagatgcagcacccaaactgaacttcccataagactggtagtgcttcctacctctggcacagaaaactgtaatttcccatagattccagatgctgaacagctggtgttatgtaaagagctagcatcaagtctatactctgtctggtgcctttttcctgaaaaagttctttccctgattgccctctaagaaggaggaacaacaagtgggtagggtcttttcattgaatctccgacccatactgtgtgtccacagagc

SEQ ID NO: 111351 - DNA, 243 bp, Homo sapiens
ctatatgcttcctaacaagaccagaacaactgactcctccacccactccaagtacccactaggcttgcaccataactagcttgcaccataacggaagttcttatcctaaggaagtaatcagtcagaccaaagagctgaatttaagaatggtcagatagatacagaggttgaaatatgtcaagaaaaatctctctttctaatgtttctttccattttccaacatgggggtttcatcctcaagag

SEQ ID NO: 111352 - DNA, 491 bp, Homo sapiens
tgcagccaggcagccaagtgcaggtgtctcgggaggtggcgggggacattctttggtctcaggggccacactggtggccacaggccttatgatggccccgcagatgcagcagtggagaaagatcccgccgaagacaaggaaggtacccctccagcccaggttctccagaaggtattctgagagcagagggaatggtccgaagttggagatggattcgtcagtggtagagattgctgagggccagtgagttccagtggggtgaggagagtcttgtaggaaagtagtcggagagagaagtgtggggctaggggaggctctgtctgcatggattttagatgggaatactgagagggcagcgcccataaaggggaagagaggagagatcttttgtaaaatgcgtattcagggccaaagatgtgccaaggagaggcaggtgatgggcagtgaataagagatgccaacttgccttggtgagaggaatgttacctatg

SEQ ID NO: 111353 - DNA, 139 bp, Homo sapiens
gtgggcaacacggcgaaggacacacagctgggaaagagcaaaagtgaactctgagtccagctcagtgagactccgctgcctggggctctcctgttcttactgaggttgagggaccaagggatgtcccagccagaacctt

SEQ ID NO: 111354 - DNA, 317 bp, Homo sapiens
tatatataggcctgagccactactcctggccccaagaattattttctctgatttgattaaatccctaactctgagtgtgtttgctggtctggcctggttagaggaaagtttcctgactcaatctgggactttgagaataagtggctgacattagtagctttttgccctagtgtatcttctgtgaccttcaagtatttggtacctattaagatgaaggatatatggaaacgttttagaagatacctgttcctgccctcatagacaaagtctagataaatttcataccgatgacacatccaaataacacagttacacat

SEQ ID NO: 111355 - DNA, 316 bp, Homo sapiens
ctattaacagtcattcccaattgcctccctccccatctcctagaaaccatttatctcttttctatctctatggatttcctgttctaaacatttcatataagtgggatcatacaatatgtgatctttcgtggcttctttcactcagcataatgtttttaaggtttatccatgttgcagcatgaatctgtacttcactccttcttgtggctgaattgtatggatggaccacatactggtttttgtttttgttttgttttgttttttgagacaaagtttcgctcttattgaccaggttggagtgcaatggcatgatctc

SEQ ID NO: 111356 - DNA, 323 bp, Homo sapiens
tactgcttcattgggtttaagttcctataacaggtaagtgtattgcaaagaactctagaaaacctttcaatcaaggatatatttcaagttattattcttaaatgtataataaggataatgattagtacgtgtaccctcactactagtcacattattaggtggtttaatgaggtggaaatgtattgagattaataatgcatatgtgattattttaaagaccttactgctcattgtactactgtattaaagcttaatgcaaaacaaaaggcactgtctattttatattgggacacaatcatctgtaagatttggaatatgggtga

SEQ ID NO: 111357 - DNA, 576 bp, Homo sapiens
gggttgagaactaagtcaaatggctaaatatgtacatatattcttttaaaaaacatattttcaccccccataactacagatacactgcttttccccttagaccacaaggggctgctgctgttcatatcggattttgcttcccttagaaacttgtgtaccccaattaactctatctttagtctctttttttttttttgcccccagatcttttaaaatatagctggaaagaagaaaaagaggcttagttagtatcttaataatcagcataaaaatgtattattgtaaatgttttctataatacattccaaggcatttatatttctctacatcaacttaaagcttgtagtcattgaaggcaaattgtgaataataactttttatttcctgttttagtgtatgaataacattcagaatcataccattgtagagatatagtatggagatgaggttaaaaatgcagtccgaggctgggttgcagtggctcacgcctgtaatcccagcactttgggaggccaaatgggcagattgcctgaggtcaggagttcgagaccagcctggccaacatggtgaaaccct

SEQ ID NO: 111358 - DNA, 767 bp, Homo sapiens
ggctctaaataactaatgacacacatttaaatcagttatggtgtagctgctgcaattcctgtgaatacccgaaacctgctgttataactcagagtccatatttgttattgcagtgcaactaaagagcatctatgtgccttcatcaagaagcccatgttttgagattttgctcatgaaccatctgcaacttgcttcatcataagaataatttataacttgaccttcaaagagattagagcatttgtttcatcttacagttggagttcaatgtaacattttaaatgcaatttattatttcagaaatttcccatgaaactaaaaatagaaaataagatatacaagttaattcggtacttggataaatcatttctgcattgttgttccagagaatttgctgagaaatcaaagccatggtcatctggtgatgaagagaaaagtttaatctaaatgatatgtgcatttcctcatttaaaaaatccaattggattattcttaatatatacatgtaatatgaaaattgagattgaagcactaattccaaaattatggctgaatatactaaataacagaaaagttacagataagaatttatttctactgaactctatagttagtgtaatataattcatatttttatgatattggcacactgagaaattcattttgtagagctatggataaggcttgtatgatttgcactattagtacagtatagttaagaaaggaaagctgaacaatataaaattattaacatatttccgaatatg

SEQ ID NO: 111359 - DNA, 354 bp, Homo sapiens
tgaactattgatacaggcaatgaaatgattacatctcaaaatcattatgctaagtgaaagaagccacacacgagagtaccgtctgcaagatatgtttccttttacataaaattctaggaaatccacactaatgtctagaaactgaaagtagttcagtggttcctgggtctggagacaggaaggaagaggagctggaggcagggattgcaaggctcccgaggaaactttgggggtgaagaatatattcattatcttgattgaggacggtttcataggcatatacatatgataaaacatcaagttatatgatttaatatgtacagtttattgtagctcaggtatatctcattaaag

SEQ ID NO: 111360 - DNA, 199 bp, Homo sapiens
aggacatggtaagagcacataaaagagtgtttcacctaactgaggtcaggaggtagtcaaggaaaacttcctcaaagtaatgaagtatatgccagaaggaaaacaaaaatccaatcacagagagcctgtacccaacccttactaggtccagtcagagcttctctcacatctctccctttttatcccatcctcactgata

SEQ ID NO: 111361 - DNA, 383 bp, Homo sapiens
attttatacaaggtgcctcacctgctgtaaccatagattcaaagttgctccatgaaagtaataaatgaaaaatggtgattttttagcatgtaaattttaggaaatttccccagttacgcttaatggcttgatttagtgtgtatgttatttttgaaaacatatgttgggatgtcacaaatggacttagcctacagagatttatattcaacttttgaccagagagttccattttaatgtgacactgagagtaaaaaactatcttttcctccttacctatttctcttcctacattctcggccaggaggaaggcactgctacacacccagtcttccccagcagagcctgagcagctctgttttccttctacttcccctcttctttca

SEQ ID NO: 111362 - DNA, 153 bp, Homo sapiens
tcagggttcgagaccagtctgaacctcatctctcttctgaaaaaaattgtttaaaaagaaaaaataataattagccaggcatggtggtatgtgcctgtagtcctagctactcaggcagctgaggtaggaagatcacctgagcatgggaggtca

SEQ ID NO: 111363 - DNA, 361 bp, Homo sapiens
gatgtacacctcctaactgaacaatgctggaccggctctttgagatgatagcaaagactatgaaacaaataaaactgaaattaataatggactccaggtagactcagcctgagagacattcctttcaaatctctcttgttcaaatgtggctaaaggttttgccactgacttctagctgctaatcacttccctccactgtgggacaagaccagcaaccgcaggacaccacatcccagcaccaacaagggacaatcaaaacctaacaatagaataattgatcagtgattctttcaaagaaagaccttggtaaaaaggggacaatgagaaagttatcagaattaaaatggagtcacttctgtta

SEQ ID NO: 111364 - DNA, 784 bp, Homo sapiens
ggttagagatttgatgggtaagaaagaacacctaacggtaatcctggagggaaaaaaataaagtgtttgctggagagaatgagttggattgctggacttcaatgtgtgtggattcagtttgtgacttaaaaatgaaaccagtctattgcttgtgtggcttttctcaaaatactgttattccattacctatctcttaccccaagagtagtcacattcttatttctggttattttaattcctggtggtatttttatgtgattaatgagatagtactttttaatttgatgatattctagaaacctggtaagtactatgtaccttgtcttaagttttggttacttaattggtaaaattatagcatgcaccattgaattacctaattcaaaatatattcttttattgtttgacatttgtcttgtttttctttaaaatgttatctttgtggagtaaacatttttctttatgctgtttagcatcttcatcagattagttcagggtattgctgaatgtggttgtttggaagtaaaatgctttagttttagttatatagattttaataagatactactttctatataatttatcaggtactttaggcattttaatttgcaaatttaggacaatttgctttaacgtttcttcacttttgtccattggatgtaatttccataaagtattcatttccctaagtaaaaaccaaaaccaaaccgacaactaatggtcactgaagaaagagtgattaaatgcttagattataatggtatttgcattttaatgttaccag

SEQ ID NO: 111365 - DNA, 541 bp, Homo sapiens
tgcctggcccacccatagtttcttcgtatgggaatgttgagtgattacaagggataggaggaaagaagttgagaagtaaaagattaggaaggactactaaagtaggtgttcaggaagagactcttctttctgtaacttctgagaatcgagctctgttgttttgtcgtttgttataaagcattagagtgcaggggtggcatttggcaggatcaacctggtatagggaagtgggcagcactgatcgtggtggtacagctctcccttgaaatctggacccaagctaatgttgtgcagctggctttgggcagggcctaacactgttcactgcatgttttgtctgaaaggaaggaatctcttctatttttcttcctatctagcattgatgtttatgatcgttcttttaaaatccgtattttccactcttcataaaaatgccacagggctgcctgacaaatttgcattaaggaattttgacataattagcacctggctttagttgtaaattatagtcagataaatatataaagagaaggagcattta

SEQ ID NO: 111366 - DNA, 325 bp, Homo sapiens
tggaattgcagtgaagtggtatagatcaagatttgagtatgtggagaatagcattccataaataaagacaatataagatgaatcacagatataagaaagtccaaacgtaacaatgactgtgactaaaggagaggaataggagaaaatgatccaaagatagagctagacaatgttacagctttgatgttagacaaaatctagactttattctagattgcttttgtaagcagtagagagttgttgatggttttggggtaaaaggttgatgcgatattatctatgctttagcaaattaggctggcaggatgtgtaaaatgggtttcag

SEQ ID NO: 111367 - DNA, 729 bp, Homo sapiens
aaatggattaatttctttggattcatgtgagaagtcctggctctgtcagctgatcttcaactagcatctttcaaagcatgactgatgggaaaatgaggactgccctcaaaagcttctccaagatcatgggaggctgccaattggaaggtaccagaaaccaacacaactaaattgctcagcaccctgaacctctttccccacccacactactgatttttcatatactttccagccttctattcatccgtctcttcagccaggcaggcaggcaggcaggcatcctcactgagtgcctcccaggtgccaggtctgtattgggctgaggaggtacaatggcaagttacacctaacccctggctccatggaggttacagtgcacacagcaactacctcctagtgggggtttagtacatatttgttaaataaataacatggaaacatatgaataactacaatatggatttataaaccatatctcctgtcctctccacttatacagattatttatatagagttgcaggatacatcagtagaaaaacctcactggctcttaaggttgtctgtttttctcattttttaaaggtaatgagtatgtagcaatttggaggtgggagcaaatacaatccaatagataacatttgcattttaaaaggcatctgaaataaataacatttaggcagaaaagacaacctaaacagatagcacatgaggaaaaaaatccaaataaat

SEQ ID NO: 111368 - DNA, 228 bp, Homo sapiens
ccgccccccgatgtttttaaggttacattggactagggtgatgcattgtaggggaaaaaaaggtagtattttaaatactagacctttgtatttttcccatcgtttgacaaaaccttgaacacaatgtgttcaagtcatttgttagtcctcaaagtaggttaaaggattctctttctttggaaaagtaagttttgtttctggggcccaaaaatagttgctaaaattttt

SEQ ID NO: 111369 - DNA, 360 bp, Homo sapiens
agttacctgcaatgcagggtagcaattttaattagtgtatgactataaataagggaggtagtacaggacaatggctaaggaggtgggttctagatcagactagccagatttcaaagatcagctgtaccacttactggctgtgtgaccttgggcaagttacttaacctctctgagcctggtttcctgatctgaaaaatggaattgtaaggtacttgtgaagattcagtaacgtagtgcctgcaaagtgttttgaaagtgcacccaatacatatcagctgtgcttattgtcagtgtgatttactaacattcttatttgagcctccttgctaaggactgggagaataaaacatggtcgtacct

SEQ ID NO: 111370 - DNA, 328 bp, Homo sapiens
ggcattttggaagggatgggcagatacccttatatggacaggtgtaatccatcctgtcaggcgctagaacactcaggtccctgagagtgtgacgctaaactgcagcggggaagaaaaatggtctgtcctctgatgctctccctggtcttccaggaaaagagatctaggcctgctgagaatggggaggaggagggggaggggaagagttaaaggcctcctttgtatcttgacctgatgggagaaaaatgacagaagccagttctcacagcagcggtggctgcagagcaacacagtccaggacagggagagaactgagtaggaaacatac

SEQ ID NO: 111371 - DNA, 402 bp, Homo sapiens
ccaacagccagattggaaaaccacataatttagaagacatcagacatttttttttttaggattctaagaagaatcttccctcagtggtgggtaagatttaatcctagaggttgggcacggtgattcacgcctgtaatcccagcactttgtgaggccaaggtgggtggctcacctgaagtcaggagttcaagaccagcctggccaatacggtgaaactccgtctctactaaaaacacaaaattagctaggtgtgatggcacacacttgtagtcccagctactcaggaggcagagacaggaggatcactagaacccaggaggtgaaggctgcagtgagctgagatcatgccactgctcttcagcctgggcaagacagagcaagactctgtctcaaaaaaaaaaa

SEQ ID NO: 111372 - DNA, 451 bp, Homo sapiens
cctgcatttatttgtttatttgggtctgagaagtccaaagtgaagctgtgagaaggggcgcctttgagttttaatacgggatgcaccatcatataaggacactttggtcaacagcagactgcgtatgtgacgttggtcccataagattataatgccatcttttgactgtaccttttccacgtgtaaacacacaaatactgaccatttcattactgtcgactgcagtactcggtacaggaccatgcggtacaggtgtgtagcccaggagtgacaggcgacaccctatcgcctaggtgtgggggaggcgagaccgtctgggtttgtgtaagtcaactccaagacgttcacacagtgacaaaatcgcctcgtcatgcatttctcagagtgtgtccctgtcgctaagcgatgtgtgactgtttatatctgtggtactttgtaggcgttgggggca

SEQ ID NO: 111373 - DNA, 241 bp, Homo sapiens
aagaaaagcaggacagagctttaaaattcttgtttgaaaatgatcatatgcccatatacctcactatgatgttctgtgagagtctaagatcagaaaagaatgaattaaaacagcccttaatcacaccctcggggatggtgtgaccatggttttattttaccctgctacattgtaaagtctgtattttaataagtagaattctatatacccatagccctctaacatggctgcatgaacacca

SEQ ID NO: 111374 - DNA, 391 bp, Homo sapiens
aaatcctgttatatatatttttaaagaacttaaaactttcacaaactcctcttgatcggaacaaaaataaattatactttcagtgtgctttacaagaatcaaaattcacaagatgcaagatttttcatgcttatttaatatagaaattaatcaaatttctataaacaaatgccatacaggacccatgattatattcttagaaattctctttttgataaatagaggagaagtgtagggtaagtgttggaaggtcccaagtgatagtctttctctgcttgcttaaatggtagagaaagttaaatactacttaaaaaatggtatcagctgttcctcaaatttatttttctctcatatacaagctgggtagtcatatactttaaaatgttccttg

SEQ ID NO: 111375 - DNA, 197 bp, Homo sapiens
ttttttgtatttttagtagagacggggttttgcagtattggccaggctggtcttgaactcctgacctcaggtgattcacctgcctcagcctcccgaagttctgggattacaaggcataagtcaccacgcctggcaaggcagatgctttctgggtcagtaagtaccatgtgaagaaaccccagagacttggaagtatg

SEQ ID NO: 111376 - DNA, 424 bp, Homo sapiens
ccagaaagacctgatcccagagtcccattctctgatatgtggtagtacctctgtgtggtctggagcaggtaacccactctctgagtttcttcagcttgttcatttcaaaaatgggaaaaacagtaagacctatgtcatagattgttaaacaagacaacatatataaggagcatagcacattgcttgaaggtgttgagaaatcctgcagtacagaggcctgtcagctctgttgaacccctttctcagtcctatttcaccaggtactacctgttaacatctcaggaacctagagagctttacagcacacatatttagaaacactgttgtagtacttactgttcaatttcctctgggttctggggcttctctggccaaattttttgactcctggctagttgtggagactccaaagtagtgatgattg

SEQ ID NO: 111377 - DNA, 686 bp, Homo sapiens
tccactccttaaagtgtcaaggtccttatgatttgggaccaagagagaaaacatgaggctgactcttcatataaaagtttgaggtaatatggcacatagcttaggattaaatttatacactaggtcaaaattcttgcccccccttaacagaccaaacaatacacacactcttgcatccacacaccagatataattttgctcaattctctaagtgcttcagggagtgttcccattactgcttgattctgggagctttccagtgtcagcagcctgaacaccaacatgagtgggcgatatcttcctccatgcttctggggaagcagtaagcatcctgaatcaaacctgaatatttagggttttttatttgtctttggcaaagctctaaaattccagatttgcaagttgtcggcccaggagccctggcacattatttgagataactcatcttctttgactcttctctgtagctcctgaccatgaaagtctgtagttaagtgcaacaaacacttatttatgggatatccatgccttattgtttaaatcttttataatgaggttataaaagctcctgattctgtagggtaaaatcactaatttggatttcttaagcagctttggatagcatatagagacgacaaaactgttgaatttacaaaagcgagggatgaaggaaaacacctgtctag

SEQ ID NO: 111378 - DNA, 552 bp, Homo sapiens
cttttccccaaggccagccataaaacctgaaaatattcctctaactttccccaaacctttctctgtaagagctggccataaagaaattatctgacctaccttgtgtggtagtagatcataagacccccattccagaaagagtcctgccccaaacccaggaggagggactgctgcacacagagatcgggaacaccctggacagacaggcattgctgagtttctctacctcagtctactagcattatgtcacagtctttgtccaattatatttctacatggctgtccactcttgattggacctaagcatacaagtggatagctgtatctttgggtcttcattgtgagggcttgtcatgtaaaaaaatttttaaaaatttaataaatttgttatgcttttcttttgttaacctgtcttttgttataggagtgtctaccgtgatccttacgatggggaagaaagggatcacctttctgcccctacagttccagccttcttcacttggtggaaagctccagagtgggtttgaaaccttttcctgtgggaattaagac

SEQ ID NO: 111379 - DNA, 302 bp, Homo sapiens
aaggatgtgtgggtatttgtataccttgtaaaaagagttgagctaaattatagctccccatttaaaaaacagtggtagtctaaagctgcagagtgcaaaattcagagattgccatagtaactctgcttttcccaggaagtaattgaaaaaaggcacattttataaaaatagaatattgatgttcatatctataaaggaattaatttactgactgatagaggggaaagaagaaagatgagccattgagctgcattttaatgtgattgcgattatccccagggtggcaagcagcttaaactcgt

SEQ ID NO: 111380 - DNA, 478 bp, Homo sapiens
ccagaggatcccgatagagcatacccctcaaaccttttaacccagtccgacacccagcagcgacttagacaattgcattagagcctctggaaaaccaagagtttaatcgtccagcctttacccctctcgggggcccagagatactaccacttcctaactttcccagaaacttgcccccaagcccttgaagtcccaagcctgctcctctgggtctccaggatcccaagcaccagacttgggctcttcttcaaaacccaaaggtccaattccccagcctctcccctccaatatccagggctctgtcctcctagggagcccaggcatggtgcttcccaggccctgggaaaacaaactggcttcttccagccttttggggatccagggatccaacctctcagactttacccactcccagcccccttcctcccttaggcccaggaatccgggtctccattcccaactcccttagccccagaag

SEQ ID NO: 111381 - DNA, 525 bp, Homo sapiens
gagcaatatatatgcttgggatgcaacagaaacacagagggagtttgcctaatcgctgaaaggactgaaagatgaaaatgacccagaaaggtttataagaagaggtggtagttaggcaaatactgttagttgtgtatttaatatttactcttgtccttattaacatgatggcaatttttattcagtgtggcaatatgctcagctgagagattatatttttcagcctaatgaacatatgactacggttttgactagtgagaggtaaatgggcattttgatgagttttccatgaaggctccttacagggagaaacagacagaactctttctttttcctttcctttcttcttccttcctacctggaatatgggtgtgatagctggagccccagcagccgtgttggatgataggtgagcttgagaataggatccaaggactaaggatggcaaagcaggaaaacataaggaatctgacttcctaatgatcatggtgcccataatacagttctagattgcctctcaactcc

SEQ ID NO: 111382 - DNA, 696 bp, Homo sapiens
taattagagttttcctgatactcagtttcagaatctgaatgcctctcatgtaaaagttgctgataaagcactcaaatatgaaattattatgaagcatacacatttttaagataaaatgtgacatgccataaattttttctttgaggagagctgcaaagggaacagtattaagatgcttttaatcttttgagagggaacgaatggaacattatttctccacatatatctagactgttgagtggatctggtacactgtcccctttgctgtgatatatttggctccatttcatttttgtgtggagctgaagaatgtggaagaagtggtaggaatgtgtaattcaggcacaccctacagactttctcagatttgccctctgaaggtttgctaaataatacatttaagtgataattgactaaatatggtagctgcctatttgttagagctgttggcagcccaagcaatattttcaagtcttttcaaggtaagcttagaggtgagagccaccttattaaaaatagcactgcatttaaaacagtcatgctaaccaactgaattgcttaaaatattagtggactggataaagcacttcaatcggatgcgctttaaacctgtgaaattctaaagggtttgatttcttctctttctaacatatcctaaattctgactgttttaacatgcctttgattgtgggtggg

SEQ ID NO: 111383 - DNA, 365 bp, Homo sapiens
atttaatttacatttaaatttaaaaactgaggtattatgaaaagttttaggccagctgtgagagttagccaactacagactaagagagcatagtctccaagatcacccctcactctgctgtcacctacaagttcaggaaattcccaaaaccggttcagtttgataaatagctagaaggattcacaaaattcactgaaagctaatatactcccggtttggtttaatacaggtaaaggatacagattaaaatcagccagggaaggaagtgcagagtccaggagaagtacgaaatgcagaacttttgttgtcctttccatgtggatacaagatatgttacactcctggtattgatgtgttacattgtg

SEQ ID NO: 111384 - DNA, 321 bp, Homo sapiens
aaaactatgacaagaaaacgattgtccaggcccagttagggagaggcctttagaagcatggagtggaccagtaaccctgtcttacaagtgattgacggagaagttttcttgttcatgaatgaaggctatgagcatttttagtgaagtaagtgtcttttgaaactttctttatctagaaggaatacaggtgatagtatgcctctctttgaaattggtgtcattgctactttattagtcaatcagttgatagtgctgcagttttggcatatctgatgcataccatctgaatgaaaggcatttaattagggttttaatatctct

SEQ ID NO: 111385 - DNA, 306 bp, Homo sapiens
ggagcttgaagacactccacaaatttgatggcttgtatgtgtggttgctatataggtacagatgttatgcagagagcagcagtgaggtgaatggggtgagaattcgtatccccattttatagatgaggaaactgaggctcagagagtttcttctgtagctttctcaaacagtcctccgatttgtctctgtgtattcacttgggaaaagttcttgtgtggggtgacctttgggtcccacgtcattattccgcaaagaaaagggaaaggctgtgaggtttttcatgtaggtaaccctggcaaggaagg

SEQ ID NO: 111386 - DNA, 1455 bp, Homo sapiens
  misc_feature (1455)..(1455): n is a, c, g, or t
aggggcccaggccccgccgtcgcgccagccccgcggccccagcgggccgggcactcgcaaccgcgctcgggcggcggacgctcgcgccggctcaccatgcactgccacgccgagctgaggctgagctcgcccggccagctcaaagcagccaggcggcgctacaagactttcatgatcgacgagatcctctccaaggagacctgcgattactttgagaaactttccctctactccgtgtgcccgtcgctggtcgtgcgacccaagcccctgcattcctgtacgggctccccttccctgcgggcatatccgctcctctcggtgatcacccgccagcccactgtcatctcccacctggtccctgccaccccgggaatcgcccaggcactgtcctgccaccaggtcaccgaggcggtctctgctgaggccccagggggcgaggccctagccagcagcgagtcagagacggaacagcccacgccccgacagaagaagccccgccggagtcgcaccatcttcaccgagctgcagctcatgggcctggagaagaaattccagaagcagaagtatttgtcaaccccagacaggttggacttggctcagtctctgggactcactcagctgcaggtgaagacctggtatcagaatcgcaggatgaaatggaagaaaatggttcttaaaggtggacaggaagcacccacaaaacccaaaggtcgccccaagaagaactccatccccacatcagaagagattgaagctgaagagaagatgaacagccaggcccagggtcaggagcagctggagccctctcaggggcaggaggagctctgtgaagcacaggaaccgaaagcacgtgatgtccccttagagatggcagagccaccagacccgccccaggagttgccaataccctcttcggaacccccaccattaagctaaagtaaaacccttttgagggaagagggagactggggagaagggaaaagagagaaggcagggagagtagggagagaaaaccttccagcagcccagtaaactgcgggcgaagagatctacccgtctccctccctcccacagttaccattggccttgtcatcgcaagcatttgacaaagacttgcttgtcttgggcctgtcacctcctgaaaggctgctttagctgtggatgcccttgattaagggagagagcgcctaggagctgcctgccccagctggggtgacggctgtagggctgggtctatgttgcaagccctatatcctagcatgcagtggaaagtgcttagctctctccctcctgacctctgggcagccagtcatcaaagcagagagacgtggcggcatgtgggcagcatgcccaggttccttgctgactcagcacttatttctgtagttttaaaaaagaatttaatgtttttggttgtatttttttgggggggtgagggtgggcaaaaacatgggn

SEQ ID NO: 111387 - DNA, 2148 bp, Homo sapiens
  misc_feature (1809)..(1809): n is a, c, g, or t
tcttaggcaactcacttaaccttcctggggcaatttactccctctgagatgagaaagttgaattaaataatccgaaagcatcctgtcaagctctgaaaaatgctatgcttcaaggtacacagacttctcaggaagaattcatagctacaagcatgtctttttataaagaccacaggtggttctcaggaagtttgcatattacaaatctatttcgggtttctgaaatatgtgtctctagcttttcctgactacttcttttcatctgcctggtcccatggaccaagaatttagggattccgaagggagagaggggaaagatctgcttaaaaccagaggacttgcaggaacctcttctgggccgtgggcttcatcttcccacaccgagcagagcagacctctgtgcctgccctgcagctgtaggtcttgagttacctctccttccccttcctccatctgtacctccttaagagcagggccctccctgtcagacagacctcagccagcggccctccgcaggtcctggcctgcttccccacaccgttccctgtggtgacctgcctccctgcttgttttccaggctccccttccctgcgggcatatccgctcctctcggtgatcacccgccagcccactgtcatctcccacctggtccctgccaccccgggaatcgcccaggcactgtcctgccaccaggtcaccgaggcggtctctgctgaggccccagggggcgaggccctagccagcagcgagtcagagacggaacagcccacgccccgacagaagaagccccgccggagtcgcaccatcttcaccgagctgcagctcatgggcctggagaagaaattccagaagcagaagtatttgtcaaccccagacaggtgaggacgcagggaagggactctccgcagtgaaggcccctgggaacgggagacttgctcccattgtgggccgtggagccacagcactggtacagtgaggcaggacactatggcggagtccactccttggctcaaatcatctcaaccttggttaacagaacccagcccacatgaatccaccacacggtccctggagcctgcctgcggctaaacttaactcaccactttatctccatatttgaacttaactatttcagtatcataaacaaggtccagtttagcaaatggttgctcaggcggtcagctgggaaacaggcttggtttttaagccactcactcttaggattggaggcagcaggactagatttggaattgggattcatgatcttctcaatcttctccacagcctccagctgattccccactgactcagtttgctggcctggctattgcttgggaaggactggagggatccagttgaggaggtcagacatgttagtgaatttgctggatgtcaagtcagaaccatttgactgagacccaggaggacctggctgagagccccttctttgaacccctctgagatccatgttggggaggctgtgacccttgctttcttggaggcctcaatgcctcacctccttttctttaatttactattttaactgaaacatatgccagagtgtgtgtctgggccgggtattgtggcccacacctgtaatctcagcagtttgggagactgaggcagtaggatcgtttgaggctaggagtttgagagcagcctgggcaacgttgtgagaccccgtctctacaaaaattaaaatatgagccaggtgtgatggcatgcacctgtagtcccagccactcaagaggctaagatgggaggatcacttgaacccaggactttgagactgcagtgaggtatgattgnatcagattgcatcgctgcactctaggcgagaccctgtctccttaaaaaaaaaaaaaaaatagccgggtgtgttggctcacgcctgtaatcccagcactttgggaggccgaggcaggtggatcacgaggtcaggagttcaggaccagcctggccaagatggtgaaaccgcgtctctactaaaaatacaaaaattagctgggtgtagtggcaggtacttgtaatcccagctacttgggaggctgagacagagaattgcttgaacccaggaggtggaggttgcagtgagccaaaatcatgccactacactccagcctgggcaacagagcgagactcagtctc

SEQ ID NO: 111388 - DNA, 242 bp, Homo sapiens
ataaattcacacatttacagccaactaattttggacaaaggcactaagattatacaataaagcacagttctttaataagtggtattgggtaaactagatgtccacatgaagaagaatgaaattagacctttctctctcatcataaacaaaaatcaactcaaagtggattaatgacttaaatgtaaaaccagaaattataaaactacttgaagaaaatataggggaaaagttccataacattg

SEQ ID NO: 111389 - DNA, 487 bp, Homo sapiens
atctaccagaataaatccaaagtctgcccgtgcatggcttacaaagtcctttgctctctggtcaccttgctgacttctctcactgcctcccctcgctccctttatttttatttatttatttatttatttattgagacggagtctcgctctgtcgcccaggctggagtgcagtggtacaatctcggctcactgcagtctccatcttctgggttcaagtgattctcctgcctcagcctcccgagtagctgggattacaggcacccaccaccatgcccagctaatttttgcatctttagtagagatgggtttcaccatgttggctaggctggttttgaactcctgacctcaggtgatccacctgcctcggccacctaaagtgccggaattataggcgtgagccaccgcacctgccctcactccctttattaaagccacagggcctcatggctgttcttcctgcagcccaggacctctgcactccgcctcc

SEQ ID NO: 111390 - DNA, 316 bp, Homo sapiens
tagccataactccaggacttcatattcctatgacagcctccagctcccactgcccaggccctgcctctggccagggtttcctagttcctgctcattgccaccaggtcaattttctcaaatcaccaatttgcacacaggactctcaacaaatcaagctccacaggccttgtctgtgaatctcacactcctcacatgtggctcccgtagcatctgcccatggtccaggaccctcaaccctgagctggccagacaggccttcggcacaaagcttgtctcatgtatggccacggtgattcctgatgtgtgtgtgtctctg

SEQ ID NO: 111391 - DNA, 555 bp, Homo sapiens
accagtatttctaataatatgaggatagctacagttgtttgtctgacctgtttcatcaggatctatctaattagctgactgagggaataaagctctgagtactttaatctcaataactatgttctttggttagctccatggccaagaatctgatattctctcccttgcaatctgttgatttagattcagtagccctattttcagcagaagcctgacaatgttttctgtgaattgtttattttttacaatttcaacttttattttggacacagggggtacatgtgcaggtttgttacagggtatatagtgtgatgctgaagcttgggatacaaatgatcccatcacccaaatagtgagcatagtacccaataatttttcaactcctacccctctttctctttccccatctctattagtccctagtatctattgctcacacctttatgttcataagtacctaatgtttagctcccgcttataagtgagaacatgcagtatttggttttctgtttctgcattaatttgcttagaataatggcctccagctgcatccat

SEQ ID NO: 111392 - DNA, 383 bp, Homo sapiens
ctcgcctgctgcggggcgccctcccagcccccatcacgggcccaccgcctgacactcgcctgctgcggggtgcccacccggcccccatcacggccaccatctctgctcaccaagaagccagtttcccaaatccatgggcaacggtgcctgctgtccagacacacacagggcaatcgaccatccaaacaccggaagtccccagctcagtggcacggctctggaggagagcttggagtgcgattttcacacagcaaaaggcgatatgaaaattgctctgcagtccccgaacaaacaccaagtgtgtctgtgtctgtccctgccagctcccagcaagagccaggagccagcctgctgggacagatcccactgacaggtacggtggg

SEQ ID NO: 111393 - DNA, 210 bp, Homo sapiens
cgagctgatcacctgaggtcaggagttcgagaccagcctgctcaacatggcgaaacccacttcaacttcttttctttctgtaattagaaaactattccattttcattaggttattttacaaaccacataaggaatttttttttttttcagacagtctcgctctgtcacccaggctagcatgcactggcatggtctcggctcgctgcaacc

SEQ ID NO: 111394 - DNA, 244 bp, Homo sapiens
ctgctttcaggtttaaggcagacactatgtatattttttcattgcctactacttacacatgatggtggggtgatgttacttgtaacaaatttctgggaaataaggaactaagtgtaaaaatagcattagctttacttgtattttctataaacaggatggaaatttaaagtactgtagatgtgcacattttttagaagaagcaagttcctggaaaccctgttcagatttggcttgtgaatcatag

SEQ ID NO: 111395 - DNA, 346 bp, Homo sapiens
gatgagacactacccgctttccaagactgctgtccccctgcagtcaagtatgactggcaccaaatccttgggttcagcagctgagcatcttgctattactccttccactggccaagggaaccacagaagagtccattcctcacccacaagacaggactagggatatctgagggtaaggctcacagtcctcttcactctctgcctccaagctgggcatgctccaatctgtcaagcatgatagaggattcaggtcattttcgggccaccttgctaaccctcctccagacacatcccagtgagtctgtctgggttattcagtcagtcaacaaacacacactacagtctg

SEQ ID NO: 111396 - DNA, 731 bp, Homo sapiens
gtttgggtttcttcgcggctgctcaagatgaaccgactcttcgggaaagcgaaacccaggctccgccgcccagcctgactgactgcattggcacggtggacagtagagcagaatccattgacaagaagatttctcgattggatgctgagctagtgaagtataaggatcagatcaagaagatgagagagggtcctgcaaagaatatggtcaagcagaaagccttgcgagttttaaagcaaaagaggatgtatgagcagcagcgggacaatcttgcccaacagtcattcaacatggaacaagccaattataccatccagtctttgaaggacaccaagaccacggttgatgctatgaaactgggagtaaaggaaatgaagaaggcatacaagcaagtgaagatcgaccagattgaggatttacaagaccagctagaggatatgatggaagatgcaaatgaaatccaagaagcactgagtcgcagttatggcaccccagaactggatgaagatgatttagaaagcagagttggatgcactaggtgatgagcttctggctgatgaagacagttcttatttggatgaggcagcatctgcacctgcaattccagaaggtgttcccactgatacaaaaaacaggatggagttctggtggatgaatttggattgccacagatccctgcttcatagatttgcatcattcaagcatatcttgtaaaacaaacacatattatg

SEQ ID NO: 111397 - DNA, 570 bp, Homo sapiens
attaaatcttttaaccgaatccatttcctctagcatagagaccattgagcttcagatgactgtgcaacaaggtttcagccagttccaggtgaaggcaccacccctggccatcaggaagccaccctgcctccactagacagagtaaggacagatgggaaactggctgttctaacaacaaatcagactgattgcgggttaaatattcatttgcaactttgtaacttcactccacaacctatcagactgactgcaggccgagtcttcgtttgcatggaagtagaactttgtaatttcatcctagcctctgattggttgctttgtgcaaccaatcagatgtttgcacaggagtgtgacctttgtaacttcacttcagcctgtggttcatgctgtccgcatccaatctgagacatgaggtgaacataaagtggccaataggaaacttctagggggtatttggacccaagaagattctgtatccgagcccttgagcccctgcttgggtctgctcccacacagcggagtgtacttttgttttcaataaatccctgcttttgtccttttgttgcttca

SEQ ID NO: 111398 - DNA, 159 bp, Homo sapiens
tgttctgacctccgtgacgtttattaccagctgatgtcccgtacactgatttcacggtgtcacccgcaccagaatgtaagctccttaaggacagggggccgggcattgtggctcagggcctgtcatcccagcactttgggaggctggggcgggctgatc

SEQ ID NO: 111399 - DNA, 274 bp, Homo sapiens
gcagaaagaaaatacattttattaagtgggcgtttttccaaagcatgttccccctgaaggagaatcataccttcagcatttcaaagatttctcaaatagcacaaaggtcaaaaagtttgagcaacagaaatgcagtgggtgaaatctccaagctattctttcagcagctgtggctggtgaagctgactccccggtaaagagatatcagctctgcttcagactagtcgataatgtaatcagaatagcacaaacctggaaaagacagagggggatc

SEQ ID NO: 111400 - DNA, 254 bp, Homo sapiens
tatgaatcaggcattctcttatgacaatagtcttctaaactgtttgtctcaggaggttttgggtgctgatgtgcactcaggcatggcccttctttattttaatccctttcccccaaggccttcagagatttaaagctactctcatgtaatagccctttgcaccacaggtcagtctcccactagagaaaacagcagcactcaagaggagtttgctccacaggtacttggagttgatatccatctccaactcagta

SEQ ID NO: 111401 - DNA, 190 bp, Homo sapiens
gagattgtgtccctggactccagactgggcaatagagcgagactatgtctccagaaaaaaaaaaaaaaaaaaaaaaaatttatatagaaaacagaaagcaaaactacctcttgatttgcttttcttgatcttgcatctcagaggtaacactgggaagggttgggttatacctctccccacctttttcttt

SEQ ID NO: 111402 - DNA, 356 bp, Homo sapiens
cagcctgaagcagcgggaattcacagtctaggctctggaggccggagtctcagatgaaggcgcaggcaagggccctcaggtgcggacgcctcctccctgccaggtgccttgcctgcctccctgtgctctgcacagcaatggccctgcaagtcttctgcatcagctttctcttctgcggactcctgctcctctgggtcagggcccacgcctgctgcttctgagagcccctgtttgttaaggatgctctctgaggtgctggggtcttcagtccattgttttttggggggcacagttcaacctgtaacggcccaaggggttcttcctgcccgctgcacacattcagaccgtggattgca

SEQ ID NO: 111403 - DNA, 214 bp, Homo sapiens
ctccatgttagccaggatggtctcgatctcctgacctcgtggtctgcctgcctcggcctcccaaaagtgctgggattacaggcgtgagcgaccatgcccggccaactttattcttttagatgtggatgtctagttgttccagaagtatctgttaaaaatgttactctttctccattggattattttggcaaccttataaacaatcaattgacca

SEQ ID NO: 111404 - DNA, 321 bp, Homo sapiens
taagagacagggtcgtccaggttagagtgcaatgacgtgatcatagctcactcactgtaacactgaactcctgggctcaagcaatcctcctgcctcagcttcccaagtagttaacactagaggcacaaaccaccatgcctcactaatattttttatttttttattttttggagagacagggtctcactttgttgcccaggttggtctctaactcctggccttaagtctaaaatcatcctacctcagcctccccaaagtgctgggattacaggtgtgaaccactgtatccagtctagaatacaatttttacaaaagccttgg

SEQ ID NO: 111405 - DNA, 577 bp, Homo sapiens
aaaccctgcctcctgttgtgggagctagttttcttttcttttttttccttttcattacacagtttcattttgacataacagtagattcacatgcaattttaataaattgtacagagaggtctcatgaatctgttacccacttccccctatggtaacattctgtgaaagcctagcctaatgtcacaatcagaatgttgacttcatacagaatcccttgtggtgcccttttataactacactcacttccctcctgcccccaccccttccttgacccttggcaatactagtctgttctccattcttacagttttgtcatttcaggaatgttctataaatggaattatgcagtgtgtaaccttttgtgattggctgttttcactcagcacagttccctggaaattcatccaagttattgtatgtgtatcagtgttgtttttttttactaagtaggtaaaacaagggacacagacctgttctcctggcatccctccctggttagcaagagattcagcaggccgctgccactctggccttgctgatagctagtgtgtgtgcaggcagcagctcccgctgtctg

SEQ ID NO: 111406 - DNA, 395 bp, Homo sapiens
taaacccacttatatcattataaacaatgagagtttcatttcccccctctctaatccttatattacatattagtttgcttgcttgcttgtttttgttttactacatcatcaagttgagacttgaaaagaatgttgttcctgggtaccttgttttgttttttttttaaaagagaaggcattcaatattttccaattagatataatatatgttatagatattttggtgtattttatatatggattttataatatagatttttaaatatattttttaacccatgataagggaattcttttctatttttaactttgcatgcaaatttcttaatgaaaatttactgaattttatcaatgcttttctgtatctactgcaatgctcatgtgatattttccac

SEQ ID NO: 111407 - DNA, 204 bp, Homo sapiens
acaaaaccccaaaacccataatgtacatgactggagaaaatttagagaaaaggatgagcaaaaggaaggaacaacatataacaatcccatgctgagaaaaaaactctgacaacattatggtatttgtctttctattgatcaaagtggaattttaatgtggtccccaaccatgctagcagaactggagcaaaagttgtcttattc

SEQ ID NO: 111408 - DNA, 287 bp, Homo sapiens
tcctgtccctggaggagattctggccgaggggactgacctggcggagacagccccgccccccttgtgcgccagccgcaacagcaaggccaaactgagggccctgagggaggccatgtatcacagcgctgagcatggctacgtggatgtcacaattgatatcaggagcataggcgtcccgtggactctgcacacgtggctggagtctttgcggatcgccttccagcagcaccgcaggcctctcatccagtgcttgttaaaggagtttaagaccattcaggaggaggaa

SEQ ID NO: 111409 - DNA, 632 bp, Homo sapiens
ctcgaacttaactacttaaaaacaaactaataatttttactctattgctactttgagttttattggatactgttttttaagttatttatttagcaatgagtccaggttttctctctgaatatttatgactttatagactttcagagacatttttctaagcttttatctctccagagtagttctcatgaaattttgtcctatttaaaatgaaatacacctaataattttaattgtctaaatgatttcctttttagctctcttgtgtttattaaatgtagttgagtatatgaagttttctagtttatgagtatataattgtatatgagaataagatatttttgtatggaacatgtattactttaaaaccttacacagaacatatgtctaatatttttacaaagaacttgagctttgtatatccccaaatctaattatcaaatttccaattgataatttagtaagactagattaacaaatagctgaaacatttgatatttcagctataattatcttaatgttttctctaaaatattaatatagaaattagataatttgcatcacttagaaatttcactggtgaaaattattgaaagataagtcaaattcatatacttcaaatattttgttgcttg

SEQ ID NO: 111410 - DNA, 504 bp, Homo sapiens
tgaagttgtaatgagattcaaggtgagtcagtttctatcttctccttctttctctttatctcctttcttccacccccacccccatttagagacatacacctctgcaacattggtctgttttatatgtgtgtatgtgtgtgtgtgtgtgtgtgtgtatgtataacaggaatattttatatatataaaaaatatttgtagtctgagtttgaaaattgtagaatatagaatttgaaaagcaccaaattttaagaatatttaacattataccagcagttaaaaaatatagctaaggaacatctttcagtatctgacatttcaggagtctgaaattgtgctactaaagtatcacagtcagaatgattctctttgccaacaaacttaaagtaaattcaaaaaggagggaaaaattgtgaagactcttgagtttatattaacaaagaagggcaaatttaggcaaggcaaggaaaagatacatatgaaagtcaaagattattactacatcag

SEQ ID NO: 111411 - DNA, 458 bp, Homo sapiens
  misc_feature (42)..(42): n is a, c, g, or t
aacatacataatttttttttaataggatctcgttctgtcacncaggctggaggacagtggtgcaatcatagctcactgtaaccttaaactcctgacctcaggtgatcctcccacctcagcctcccaaagtgctgggattacagacgtgagccaccgcatctgacctgtagatgaacctttctaaacagggcccgcactgggctgtgggacatcctgccttctgcaggtttggtggggcagatacctttctccaccctaggactgtatttgttttcaagtagtctggccaaagcaatattccctaaactttaggcattcttggatccctttatgagttttgctattttggcatgctacatgtaagttttgcttaatgtttttatgtaaagcatcttcctccttttacttcttttattgtgataaaactcatataaaattgaccgttttgaagtgtaaaa

SEQ ID NO: 111412 - DNA, 309 bp, Homo sapiens
ctgaagggtaggaagactttgcaaaggttatcataattcacattttttccttatttaaaaagaaaatcccaatgtgctgttggtagttttcctctttttcttctgaatctgattctgctttgacttgagttttgttggtagaacagttgcagatttgactcttacaagtcaaacatatgaccgtgtgattagtagacttcctcaggtgcacagtaggttattcaggccatcttacactcctaggactggtctccaggagaaacaaagtgagatacaaaaagaaaataaatctgtcgcattattaaattt

SEQ ID NO: 111413 - DNA, 588 bp, Homo sapiens
aggggacactttcccacaagcggggcaactgattcctcgtacgagaaaacacaaacaagacggttcccgggggctgccggggctcaaagtgagggtctgggaccaccagaacggtgtattcaatgcactgcgggcagccctgcagcgggcagggattgagtgaggggtggggcctgcctggctcctggcaagcacccgtctggcgggcggggcccagtgagcctcctccctttgccgggtcctcctgtagtggggcaggaacctctagcatcccacccttgctgccctttttctgccccgctcaccacccacatcaacttgtcaccagcaagggcatgggacaaagcaggacatgccccgggtggccagcgtgagctagctgtgcccaggagcattgcccatgctgtcccccaggcactgtcctgaagccctgctgggttctgagtcctccaggctccgcggccccttctcgccctgcccagagtctctggccaccaccgctgcttggggccctgcaccagcctgtgcgcccgcaaggttgccagggcccctctgcaggtgcagcgtgagctgtgtcctgggcccaca

SEQ ID NO: 111414 - DNA, 436 bp, Homo sapiens
tttttttacttacttttccctcgcttctatgccactctgctttgtggaacaacctttgtgtgtctggccattctagctgtgttctctggtaagaacagattcaaagtcctggctgggcatgctggctcatgcctgtaattccagtgctttgggaggttgaagtgggaggatcgcttgagcccaggagttggaagccagcctgggcaacacagcaagacctcatctctaccaaaaagaaaaatatactagccggacatactgccacatgtctgtggtcccagctaatcaggaggctgacagcggaggattgcttgagcccaggagttagagggtgcagtgagctatgatcatgccactgcagagggagttttaggggattccttatatgagtcagtcttagtatttagctacatcgtcggttacccagctactaaaa

SEQ ID NO: 111415 - DNA, 585 bp, Homo sapiens
accctttttctcttatagttagtgaagagagtagaatatctccagttttggctgacatctctacaacctgaacaattggcttaaacttcacttgggattcccggttgcttgttttagcatggcaaaatttggcgttcacagaatccttcttctggctatttctctgacaaagtgtctggagagtacaaaactgctggcagaccttaaaaaatgtggtgacttggaatgtgaagctttaataaacagagtctcagccatgagagattatagaggacctgactgccgatacctgaacttcactaagggagaagagatatctgtttatgttaaacttgcaggagaaagggaagatttgtgggcaggaagtaaaggaaaggagtttggatattttcccagagatgcagtccagattgaagaggtgttcatatctgaggaaattcagatgtcaacgaaagaatctgactttctttgtcttcttggagtaagttacacatttgacaatgaagatagtgaattaaacggtgattatggtgaaaatatatatccttatgaagaagataaagatgaaaaatctagtatatatga

SEQ ID NO: 111416 - DNA, 647 bp, Homo sapiens
gccagaccctaggccccggccagggagagcacgggctgcccaagtgctgcgcagatcccagcagtactccacagggctgtcagctcagcggcaactcctgggaggtccttgcttgaagggaggtttgagtggtgggcctcctggctgccaagaagaaagctacagtaaacgtgtgtgtaggctgcgcaggtctctatctgtggacagaggcattcaggcctcctgggggtatacctgagtgcaactgccaggtcacagagcagttatgtatttaaggttctcaggcaccgcctttccaaagcgattgtgccgtgttgcactccagtcacagggtggagttccagcagctgcgcgtcctcgctcatgctgatattgttgtattaatgtcccagggctgctgtaacaattgaccacaaacttggtggcttcacacaaatgtattgtcttgcagatctgtgggttagaagtccagcatgggctggaaccagtgtcagcagagccctcctttctggaggcttgaggtgaacccatgtccttgcatttcctagactctagggcctgtccacattttttggcttgtggccttattctaccatcttcaaagccagcaaccttgcatatgcggctgtccctccatccttccacct

SEQ ID NO: 111417 - DNA, 338 bp, Homo sapiens
gataaaatgccatttctacctcagtacttgataagaatcacacagtctagctggcctttgtgttttcactaaaaatatcctgaattatcagtcagttatgtttgactatgagaaattgcagaaaagttaaaagtatttcgcatccaaaagtttgtaatctagtgtaataaataggacagatactcaaagtgtatgaatggtatgacaataaatttagaaaatcatacaggcacacacactgctatagacatgtaaagatacatacatgtattggagctcagcagattcccattcatgaagaatggtgcctgtgtaacagtataaatggatcacttcta

SEQ ID NO: 111418 - DNA, 219 bp, Homo sapiens
aatacgaggaggagatctggctgcttattctaggtgcataacaatcacgttcactttagaagactgagactcttcagatcgatgcacttggtcttttcttctgggaaccttttggagcatttatcttgtaggtctcatgacgtttctggcaagctgtagcctcagagagaagaaatatggagctgacaaaaagaatgcagatgtgcagagagtatcagt

SEQ ID NO: 111419 - DNA, 1093 bp, Homo sapiens
  misc_feature (124)..(124): n is a, c, g, or t
cgtgggtgcaggctgcagtggctggcgccgtcctcgcccggccaggccatgaaggtagagtttgcaccgctcaacatccagctggcgcggcggctgcagacggtggccgtgctgcagtgggtcntttcttttcttacagggccgatgtccattggaatcactgtgatgctgatcatacacaactatttgttcctttacatcccttatttgatgtggctttactttgactggcataccccagagcgaggaggcaggagatccagctggatcaaaaattggactctttggaaacactttaaggactattttccaattcatcttatcaaaactcaagatttggatccaagtcacaactatatatttgggtttcacccccatggaataatggcagttggagcctttgggaatttttctgtaaattattctgacttcaaggacctgtttcctggctttacttcatatcttcacgtgctgccactttggttctggtgtcctgtctttcgagaatatgtgatgagtgttgggctggtttcagtttccaagaaaagtgtgtcctacatggtaagcaaggagggaggtggaaacatctctgtcattgtccttgggggtgcaaaagaatcactggatgctcatcctggaaagttcactctgttcatccgccagcggaaaggatttgttaaaattgctttgacccatggcgcctctctggtcccagtggtttcttttggtgaaaatgaactgtttaaacaaactgacaaccctgaaggatcatggattagaactgttcagaataaactgcagaagatcatggggtttgctttgcccctgtttcatgccaggggagtttttcagtacaattttggcctaatgacctataggaaagccatccacactgttgttggccgcccgatccctgttcgtcagactctgaacccgacccaggagcagattgaggagttacatcagacctatatggaggaacttaggaaattgtttgaggaacacaaaggaaagtatggcattccagagcacgagactcttgttttaaaatgacttgactataaaaaaaaattaaaaaataaaaataaatgac

SEQ ID NO: 111420 - DNA, 886 bp, Homo sapiens
  misc_feature (124)..(124): n is a, c, g, or t
cgtgggtgcaggctgcagtggctggcgccgtcctcgcccggccaggccatgaaggtagagtttgcaccgctcaacatccagctggcgcggcggctgcagacggtggccgtgctgcagtgggtcntttcttttcttacagggccgatgtccattggaatcactgtgatgctgatcatacacaactatttgttcctttacatcccttatttgatgtggctttactttgactggcataccccagagcgaggaggcaggagatccagctggatcaaaaattggactctttggaaacactttaaggactattttccaattcatcttatcaaaactcaagatttggatccaagtcacaactatatatttgggtttcacccccatggaataatggcagttggagcctttgggaatttttctgtaaattattctgacttcaaggacctgtttcctggctttacttcatatcttcacgtgctgccactttggttctggtgtcctgtctttcgagaatatgtgatgagtgttggtaagtgatggcagatcactgtttccacagtgctttggggtagcaggagcacacagaacattccctcccaggcccatgtgtgtttatggtctcttagagtaaaacctgttttatcctcatctggcacttcctatggtgtctgggtgtttcctgccctcccccactggactgtaagtggcagaaacacaaactgtgtcttcttttctgttccatcccaagtatccagcatggtgcctggaacatagaaatgttcaatgaatattaacacaatgatcaaataaagtaatgaatgcagtttgtgtattcagatgtagaaaaagaaatcagggatcaagtaagtgacaaatcacacccttggagagg

SEQ ID NO: 111421 - DNA, 462 bp, Homo sapiens
ggtttcaccatgttgcccaggctggttttgaactcctaagcttgagcaatcctcctgcctcggtctcccaaagtgctgggattaaaggtgtgatgtggctggccttattttgcttttgattgctttcgttcttttttctgctggtggacaaagggagtgcacaaagcactagggagagagcaggtcctcgtgtctaggatagcagtacctgaactatacttggagttacagcatcacccttctaagtaatcagtgatagtgacttaatgctgtgtgaaatagaattgatggtcagactaccagggtaaacctcaagattgtagggggattcctggggggtaggtgtaattggttgtcacctattaacaggacttttcctcaataaaagttgggtttctaggtcataaaaatattttacagaaatttgaagcagagaaaataaaataatgggtaaacttgaac

SEQ ID NO: 111422 - DNA, 602 bp, Homo sapiens
ttagcatcatctttctattcatactttgatcttcttggaaatagttgcttgcattatgtgctcaatcattatgaaaatatgaggatgttggaaacaagcaagtccagctagtgataattatggataaaaacagctgcaatttgcttttcaaaagctataagaacctggatgaaacagggtatgaaaaaactatatgttccaggagaaacaagtcattaagaaacctcacataattttattttaaattcatgacagaaagatttttttaatgagggaaattgttgaaatacctccagctaatacgcttttataaaattccaaattaatatttgcagaatattccaccattattccaaatgaaagtttggcagagtttttgaagtaccgtcttcaaatttgaataagaactctgtgaaggcgggaatcattttgtctcattgctcagtatgttgcctgatacgaagtcagtgctcaataaatatttgttggataaatttaatgaaaatatatgaatgagatttagcaatgaatgttttaagtaacccccattcctagtactgtctttcatacatggtgggcctttcttgagggaaatttagcag

SEQ ID NO: 111423 - DNA, 257 bp, Homo sapiens
ccacaatgggatgtcttcacaagtctggggtgaagacacagacccatggggcctttggactgcgggacgccttccttgcagacaggagccgggcctggccgctgccacatgtcctgacatctcatgagctgacgctgcccgtgattcttggcagcccatagagaccccatggtctctgggagcctgagatggtttgaagacagcagtcctgcttgtgtgcaaccagaaaccaacccataccctaagccctgccttat

SEQ ID NO: 111424 - DNA, 658 bp, Homo sapiens
cttagggccaactgttggtacatactattgtttggtatttccttgttttttgaaatgtggaggctcactctgttacctagctgagatcatgccactgcactccagcctgggcgacagagcgagactctgtctcagaaaaaaataagaaaaagaaaaaaaatatgaaagctagaactggaaacaacaaaatgtggaagttaggactagaaagcttctagaagcaaacatgggaaattaacactacaaacttggggtagacaaagatttcttacataaaatcaaaaaaggggccgagcacggtggctcatgcctgcagtcccagcactttgggaggtcaaggtgggtggatcacctgaggtcaagagttccagaccagcctgaccaatatggggaaaccccgtctctactaaaaatacaaaaatcagccgggcgtggtggcgcacacctgtagtcccagctactcaggaggctgagacaggagaatcgcttgaacctgggaggcagaggttgcagtgagccgagatcacaccactgcactccagcctgggtgacagagcaagactccgtctcaaaaggaaaaaaaaaaaggaattattggtgaattggacatcaccaaaaaacattgctaggaaaatggtaatacaggccacagactggg

SEQ ID NO: 111425 - DNA, 111 bp, Homo sapiens
gtttgtgttaaggtaattctcacatgtggataaaaactgattagtgccaaaagtttacaataaaatataacagtctcctatcctaccctgggttctccagaagcggcaact

SEQ ID NO: 111426 - DNA, 116 bp, Homo sapiens
atgattcaaggatggggacatattccaggaaattgcacaatcttcccctggcagcttcagaggacgagtgaaaatagtgcagtatagtcaaagaagcaatgaatttaggatgagga

SEQ ID NO: 111427 - DNA, 365 bp, Homo sapiens
taaagggttattttctttaaaaagaagacacaatgcagagaactagagtgaactgcattcaccttctgccccgttctggaaaagaggttgccacccctggtccggacaggtaaactgaagcacggggtggggagaaactgccgttcagtggtgacaaggacagcactggggacctggggggtgaggatccccgggacacagaggggcccagcctctggctccagcccgcttgatgacgtggtcccaaagaaagacaggagtcagctggcccggccctctcgcccacacacactggggcctgctgcaggcagggccggaggtccccaaggccagagcccaccgtccagtctcctgtggcgggagca

SEQ ID NO: 111428 - DNA, 488 bp, Homo sapiens
tcatcctgctcattgacactcttctcttgacctctctcattgctctctctgcttttcttccgcccatgtggccagttttgcccactcatcatgcagtccggttggtaatgctcagggttacaggttcaccttctccccctcttctcctttccctgtttctctcagatttgctctctctgtgtcttcccttctcccctttgcggaactcttttaccagtacccttcgcttctaacgtcacttatgtatgaacccaggcctgacccaagcccatataaaaggctgcaatacgttaaatgcagcatgacccaagctgaactctataccaccttttcattttttcctccaaacctccccttcttactgtctcattggatggtacctacattcatgcatttgaccaactcagagagtctatgactcagttctgtcccttcttccccattccctctatggctgccccattttctcccgcaactgtaatagcctc

SEQ ID NO: 111429 - DNA, 369 bp, Homo sapiens
ctgggccccgctgtacagttgcgcggatagacctactgcattgacacgaggcactctacgacatctgtttccgcaccctcaagctgaccacccctcacctacggggatcttcaaccacctggatgtcggccacctatgagcgtggtcaccatctgcctgacgacttcactcggtccagctgaactgccgacctgcgcaaactgaccgtcaacatggtcccctttcctcgtctccccttcttactgtctcattggatggtacctacattcatgcatttgaccaactcagagagtctatgactcagttctgtcccttcttccccattccctctatggctgccccattttctcccgcaactgtaatagcctc

SEQ ID NO: 111430 - DNA, 344 bp, Homo sapiens
ttcagagtcatcccctgcctaccgagatagatgcatatctgattgccttctttggaagggctaatcagaaactcaaaataatgcaaccatttttctcacctggaagcccccctccctactccaagttgtcccgcctttctggactgagccagtatacatcttgattgatgtctcaagtctccctaaaatgtataaaagcaagctgtgccccaaccaccttgggcacatgtcgtcaggacctcatgaggccgtgtcctgggcgtatgtcttcaaccttggcaaaataaactttctaaattaactgagacctgtctcagatattcggggttcacatttagaatgta

SEQ ID NO: 111431 - DNA, 445 bp, Homo sapiens
ctcccactgcctcccagccttttccacttgaacattcccaaggcattctaaacccaatgtgtgcaaaacccagcccagggtcttccctcattcccacactcagacttgttaggaataacattcaaaatcctaaggaaattgaacactcgaacaaaggagtcttagcaaagcaattttacttctgcgcagaggggtgcctccttggccagtcgccatgagagcacacctgaacaaaggggcacgagagcctttattcctgacacaagtcctgcccctgtaccctttccccattggctggggttgggtcgtacaatctaaatgaatcccggttggctaaacatttgatttttttagataaggtgggcatgtaaaagaaagcagagaagaaaggggaaggggtgtctgtaatgagctagaaagttagtcctctttccgaataaggaga

SEQ ID NO: 111432 - DNA, 296 bp, Homo sapiens
gaaagccttccctgactaccctgcccagcagtcccctctcacccaagggtgctaatcacaatcagacattcctgctgatctgtttgcctgttaactgcctggcccccacaacggacacaccatgaaagcaggggctgtcagcctgggaccccccacagctgaaccctggtaccctcatcagccttcccccgtggcccagtacacaccctcggaatgtgctcatgcaggccaggcgcagtggctcacacctgtaatcccagcactctgggaggcagaggcaggcggagcacttgagg

SEQ ID NO: 111433 - DNA, 216 bp, Homo sapiens
tcacttttaacaggagcaagaagagacagctcttccttatagtagaatttaaattatcaaagtgtaagaaatgatagaaggagaaaatcaccgctaggcaaacatcacagtaataattgttacaggtaaaaattatcaatgaatgttaaaactaatgcgtgagaaaacatgatgagaaataggattttggcatagtttcttttttttttttttttt

SEQ ID NO: 111434 - DNA, 181 bp, Homo sapiens
ccccagccaaactccacgtcattccactggttgatggcctgctgatgtgctctggacatcctctcagcatccagccacttgtgtgttcctctgctgatgtgtttctctcgacgtccagccgcttgtgtgcctgcctgctagggtcttgggggatttttataggcacaggatgggggtgtgg

SEQ ID NO: 111435 - DNA, 265 bp, Homo sapiens
ccgcaacctccacctcccgggttcaagtgattctcctgcctctgcctcccgagtagctgggattacaggcgtgtgccaccatgcccggctaattttgtatttttagtagagacagggtttctccatgttggtcacgctggtctcaaactcctaatctcaggtgatctgcccaactcagatcaaaagttttatgtgaattgactgcccaacctttgcattgttcaagggtccactgtgcttcaaatgggtcatctcacccacttca

SEQ ID NO: 111436 - DNA, 265 bp, Homo sapiens
aagcccatggtcctatagatgttcttaatattcagctctaacattcgaatatcctttagattgatagcatttaggggcatttagtttgagttcaatgaggttagaattacagaaaaaacataaaatttttactcactaatcaattcagaaactgcatattttagatccctctggagaattaattaaatattcagttattttgaaactgaattggtgaaggggtaatttgattaaataacacttttgctgtaagagacactctaaa

SEQ ID NO: 111437 - DNA, 304 bp, Homo sapiens
atgaactgtaccctccacatttgtgtgttgaagccctggcccccacctcagcacgggactgtgttttggaaacagggtctttgtggacactggggtgtcctgatccagcctgactggtgtctttgtaggcagagatgaggccacggacgcgcacagagggagcagcatgcgaggacccgaggaggagaagaccacctgcaggccaaggagaggggccatgggggaacccaccctgcctacgccctgatccccgacttccagcctccagaattgtgtgacaataaatgtctgttgtcgaaggccc

SEQ ID NO: 111438 - DNA, 406 bp, Homo sapiens
gtatggtgatgtgtgcctataatcccaggtacttgggaggctgagacaggagaattgcttgcaccaggaggcggaccaagtacatcaaggctgacagctcctggcgatgcgtggggtgtaccatatatagtgacgctgatgcagattatgcatattttataattgaagtgttttttataattgaagtggaattgacataagagaaaattaatcattttaaagtgagtaattcagtgacatttagtgcattcataatgtggggtaatgaccacctctaccaattcaaaacctagttgcagtgagccgagattgtggcactgcactccagcctgggcgaccgagtgaggctccatctcaaaaaataaaaaaataaaataatatattctgtacctgccccttagacagt

SEQ ID NO: 111439 - DNA, 892 bp, Homo sapiens
tagaaatccacccagaacctccaccctctgacaccatggtcagctcctgttgtggctctgtcagctctgagcagagctgtggcctggagaactgctgctgccccagctgctgccagaccacctgctgcaggaccacctgctgccgccccagctgctgcaagccccagtgctgccagtctgtgtgctaccagcccacctgctgccaccctagctgctgcatctccagctgctgccgcccctattgctgtgaatccagctgctgccgcccctgctgctgccgccccagctgctgccagaccacctgctgcaggaccacctgctgcaggaccacctgctgctgccccagctgctgtgtgtccagctgctgcagaccccagtgctgccagtctgtgtgctgccagcccacttgctgccgtcccagctactgcatctccagctgctgccacccctcttgctgtgaatccagctgctgccgcccctgctgctgcgtgcgtccagtctgtggccgagtctcctgccacaccacttgctatcgcccaacctgtgtcatctccacctgcccccgccccttgtgctgtgcctcctcttgctgctaatgtctccttgtgatatttgtcatactatgaatgtcttcattagtcatttaaaatgcactgtagccagccagtcactggaaaaatgaacacttccctgccagtttgtctcatgtggcattcagagtggacattcagctcttctaggaaatgacagacaatcacattcattaaaatatgttatgccaggccccaatgcagttatttttagatgagcagtgtcttcattcgaaggggacactaactgtgatgatctcatataatattgttttcatgtattaataaacagccacttccct

SEQ ID NO: 111440 - DNA, 512 bp, Homo sapiens
  misc_feature (496)..(496): n is a, c, g, or t
  misc_feature (508)..(510): n is a, c, g, or t
aaaacatttaacctagcctttcactaggtttcgagtaatacaaaatagagtagtataatatgatctatgctaaattcatcatttttaaagtagcctaagactattagctgttttgttggcagcctatacactgttaagttatgaagtgcactgttaagtacttagtatgaacgttgatgtcaaggtcttgggctacttttaattcatgccttgccctcgctctacttttacagtaactagctccaagtataggacaagtccaagtccgtctgtgcttgctccagtccagctactttttctaccctaccagtgtctttgtggacttgagttgattcattcactattcatatgcaactctgataaactaaccgtgtaaaaataaaacattggcctggaatctcaacactttgggaggccaaggcaggagaattgcttgaacctgggaggcagaggttgcagtgagctgatcacaccactgcactaaaggaaataaatnaagatgtaaaannnaa

SEQ ID NO: 111441 - DNA, 524 bp, Homo sapiens
  misc_feature (424)..(424): n is a, c, g, or t
  misc_feature (431)..(433): n is a, c, g, or t
  misc_feature (465)..(465): n is a, c, g, or t
  misc_feature (469)..(472): n is a, c, g, or t
  misc_feature (481)..(481): n is a, c, g, or t
  misc_feature (487)..(487): n is a, c, g, or t
  misc_feature (493)..(494): n is a, c, g, or t
  misc_feature (501)..(502): n is a, c, g, or t
  misc_feature (505)..(505): n is a, c, g, or t
aaaacatttaacctagcctttcactaggtttcgagtaatacaaaatagagtagtataatatgatctatgctaaattcatcatttttaaagtagcctaagactattagctgttttgttggcagcctatacactgttaagttatgaagtgcactgttaagtacttagtatgaacgttgatgtcaaggtcttgggctacttttaattcatgccttgccctcgctctacttttacagtaactagctccaagtataggacaagtccaagtccgtctgtgcttgctccagtccagctactttttctaccctaccagtgtctttgtggacttgagttgattcattcactattcatatgcaactctgataaactaaccgtgtaaaaataaaacattggcctggaatctcaacactttgggaggccaaggcangagaatnnnttgaacctgggaggcagaggttgcagtgagcngatnnnnccactgcantccagnctgggnnacaaagnnagnctctgtctcaaaaaaaaaa

SEQ ID NO: 111442 - DNA, 661 bp, Homo sapiens
aaaacatttaacctagcctttcactaggtttcgagtaatacaaaatagagtagtataatatgatctatgctaaattcatcatttttaaagtagcctaagactattagctgttttgttggcagcctatacactgttaagttatgaagtgcactgttaagtacttagtatgaacgttgatgtcaaggtcttgggctacttttaattcatgccttgccctcgctctacttttacagtaactagctccaagtataggacaagtccaagtccgtctgtgcttgctccagtccagctactttttctaccctaccagtgtctttgtggacttgagttgattcattcactattcatatgcaactctgataaactaaccgtgtaaaaataaaacattggcctggaatctcaacactttgggaggccaaggcgggaggattgattgggcccaggagttcgagattagcctggacaacacagggagaccccatctctacaaaatataaaaaattagctgggtgcggtggtatacatccctgtagtcctatttacatgggaagctgaggtgggaggattgcttgagcctgggaagttgaggctacagtgagctacgatcgcatcactgcactgcagcctaagccagagtgagatgtctcaagaaaaaaaaaaa

SEQ ID NO: 111443 - DNA, 912 bp, Homo sapiens
tttttttttttaaatctatgacatgaagttccactttaaccttcctgcagtagaaaaacacattgaggcttccggccatgtctgtgtatatctgtttttcctgaatgactttgagctggcccctcgttagctgggctcctctccgtcctgcccttgtgctgaaaggctcagggagagagcaggcatctcgggtgtgagtggcacctcctctgaaggaggaagcccagatcctacaaataaactgtgatgacattgcctgcttctcctcgggtcaccttatgtatccagagaatctaacaccagcacagggaggaaaataaaattccacctcgaggaaagtccactttgtagagcagagagcatctcatcaatgggccacagagttcatgagtcttacaaaaaagccagctatactcttgccctctcagttctgctgaacaaagcccaggtgccacctgccaagtccttctcttttcaagcctacaagaagccccttcctattctaacggcacttctttttcacccgcagaggataaaaaggagacttttttttcccaagaaagcctttgtccccccagatgacaaaaagttcccacaggcccctgaccctcgtgagatacaagaaaccccagctcaaatgcagaggtcactgcagtaccgcccagcatgggagcagtcctcagggttggaatgtgattacctccagcaataagtagaaaaagttgcatagagctgtaactatcggctaagaaaaagcaatgtggtcacatcattgattcacttacatagctgctcggtcattactccttgggtctttttcctcccttatcaccatatccctagcaaatattagagagcacacaatgggtagccaaacatcgctgattccttcaaccaatacttactacttga

SEQ ID NO: 111444 - DNA, 296 bp, Homo sapiens
ccaataaatttgaaaatttaataaaataaatctgcagaaaaaaaagcttactataacagcctgacttctaagaaatgagaatgtatgaataatttttttttttttgaaacagtctcactctgccgccaggctggagtgcagtggcgtgatcttgattcactgcaatctctgcctcccgagttcaagtgattctcctgcctcagcctcccgagtagctgggactacaagcatacgccaccacgaccagctaatttttgtatttttagtagagatgggttttcaccatgttggccagg

SEQ ID NO: 111445 - DNA, 313 bp, Homo sapiens
tgaagacttactaaatgtgggtttcattcatacgaagttttgctttttatgacatttgaagagagactatcattttaagcaatcaggttaattagcaaaagcattaggaaaggtttaattgccatctgcttctcatagacaaacaacgtggctgtccctcccaaatagtaagaaggcatgtgaactgaaaatttcataccatgtatcaaatgtctcagatattatcagagaactcatatgctgactgacccagtaattatatttctctaattatttcctcaaaacaattttctaaatgtgaacaaagatttat

SEQ ID NO: 111446 - DNA, 260 bp, Homo sapiens
ttcccctgtgttgtctatttcttgagcatgtgtttagtctccccttttagtttttgttagaggcttttctcactttctggtgatccttaagtgttagctggatttaagatggaagaactgaaaagttcatgggaaactttgtacacatgggtgtctaagtcatttcaggctgctataacaaagtatcctaggctgaatggcttaggaagaacagaaatttctggagactgaaatccaagatcagggtgccagcatagtca

SEQ ID NO: 111447 - DNA, 230 bp, Homo sapiens
ccccccaaatgacaaaccagtggagacttagcagtcctcctttgaactgacttccttggcttctgaaaacacctaggatctgccttctaattctctgaccattcttttatagaatcttagatgattatgtaacaagaagaaattgttttaaaaaattcataagtacatgaaaagaatctcagacgaattccctccttctatatgtcctttaaatatggtgtttcaggtgt

SEQ ID NO: 111448 - DNA, 595 bp, Homo sapiens
gagacgtccctgcctccaggaacagcaagaccaggggcccagacagtgactacaacgctttatccctctgtcttcatctctgagctcttcgttctcaggcaggctcacccacatggcgggaagacagcagctggcagcccctgactcacatcgaccatgttagcatccttccatcgcatcgataaaaaggttccagggaggcctctgattggctctgcctggtcacgtgctcaccacttgcctggggtgagggttgaggtcagcacaggcacaacgaaaaccttttgacaagcgtttcccaccgggaaggaggggaaggcatctaggtagagcagaacaaccagagtccactagaggaaaaggagaatgcaagcagagggagggagaaggacctgctacagaaatggtcagatatttttcagccattcagacagagaacttgagacggagaagaaggggcccttagggtgagaatattgggatcgtgtttggtggagtgaggatttaggtttgtgggccgtgacagttttggttttggaagaggataattatgtgcaagcccttgttgaggagagactgtggggtggcagggggg

SEQ ID NO: 111449 - DNA, 344 bp, Homo sapiens
attttaaaaatgtttttatcaatctggagaatgtaaagcatctcctttttatttacagttctgaatatttttttcaaatctttgtaggcagcttgtgtttttcctcttttccttctttctttttaagacatggagtctcgctctgttgcccaggctggagtgtagtggcgtgatctcggctcactgcaacctccaccttccaggttcaagcgattctcccacctcagcctccaaaatagctgggattataggcacccgtcatcatgcccggctaatttttgcatttttgtagagataggatttcaccatattggccagcctggtcttgaactgctgacctcagg

SEQ ID NO: 111450 - DNA, 127 bp, Homo sapiens
attctgctggtgatgcgggatcatgattttgggtctccagcaccatgtcaaagaaaatcccttatttatatttggaataagtagagaaacaggcagagcatggtggctgacacctgtaattccagca

SEQ ID NO: 111451 - DNA, 350 bp, Homo sapiens
ctttctttctttcttatctatcaaactttctttctttctttcttactatcttttctctctctctctctttctttctttcttttcttcagagtcatgctctattgcccaggctggagtgcagcagcgtgatctcggctcactgcaacctctgcctcctggattcaagtgattctcctgcctcagtctcccaaagtgctgggattataggcgtgagctaccacacctggccccttcctgagtaattttgtgggtgaataagaaacagatggattggttatttataaaaataaaaatatatatttagggtagattcctgaggaggtactgttagagttgactccatttgacaa

SEQ ID NO: 111452 - DNA, 477 bp, Homo sapiens
tcttatcctcacacttagccccaaaataaaaagtcatgcacattaaacattaaaaccagaagagccaggattcctgtccacctgtgttggagggacctcttaggtcatacgttgctttgcttctaatgttgtaccttcataccagaggagttctcaacaatacagaggtactggagggaaaatgtggtctaggtgtgagaagtcctcaactctagacccagtgttagaattaggggaggattttctagtctttgaccccaagctttaatgtacataaaatatagaagttaatttatctctctagtgtatcccagctcatctatgctattgttctatagtttcagtctgtctttcttcctccaaggatcctatatgagaaaagcaatacattaaattaggaatgccttctacttccagggagaaactcaaataatgacacaagtgtatttcgacaaaacatgggcacacattatggag

SEQ ID NO: 111453 - DNA, 152 bp, Homo sapiens
gatttatattgatttatccatatcctttagctcaaactactttgagattaataataaacatctgtaaggtggtggccaggattagaaatatagtttctcatcatggaagacagtaatgctaactggtcaatatatggaaataatgctaagtg

SEQ ID NO: 111454 - DNA, 418 bp, Homo sapiens
ggatcaagtgaaactctttatcattaagttcaaggccctcttcagtcaggctcccacctcatgtccaactccagccccacacctacatctagtgtaccagaactccagtcccactaaaataagggacacactcacatacaaccccacattaccatgcctttttaaaacctttgcgcatgttatcccctcttctgaaaatgctcttctctcctcatcctgctccttttctgtctggtaaagttttaagatccagttttaatgttacttcttcaaagctctcccaaatgtaaccagacataattcaccactcctatatctgtgtccttttagcacatgactgtctttcttgcaaaaacttaagctcctcaagggaaagcaaatatgttttactcatctacacaaccgtagtcactaacac

SEQ ID NO: 111455 - DNA, 112 bp, Homo sapiens
ttcatgtatccgtgtgtgtacgtacccgagtgtgtgtatgtgcctgtgtgtacgtacttgagtttgtgcccatgtacgtgtacccgagtgtgtgtacgtgcctgagtgtgtg

SEQ ID NO: 111456 - DNA, 474 bp, Homo sapiens
tgccactgtactcctgactgaacaacagagtgagaccctgtctctaaaaagcaaaacaaaacagaaaacccaaaaccctcaaaactaatgttacacttagtatttaaagaatgctttctctgtaagaagaggagcaaggacaggataaaacattcttgccagttctgttcaacagtgtactggaagtatctgtgacattaattgcattgcaacacggtctctcatgagagaccgtgttgcaatgacaaggggggcaaatgaaatccatgcaagatttgttaataatgggcagacagaaaaatgtaaaaccacacaaaacggactgctgatattattttaaaatatacttatttgtcttctttttgcattgtgaaaaaaacaaaataaattttgtgtgataattctgatgatgaaaggtggaagttctacctagatttgaatgagtgttttttttaagggaatgagaatgtcctg

SEQ ID NO: 111457 - DNA, 359 bp, Homo sapiens
gaaagctggccctgaaattgtcttcatggtccagctggaggactgaggggctctgggcaccaaaggcaggacggtgggaggatgggtcagggtgaagagctgcctcttaaagggaccctgtttgtgcccagacatgtaccctcacccactgcattccagctctgtggaaatcccccagggctggggcacaggagctctcagcgacaaggaacctggttggtttctgcagctcccaggtagtgtgccaccaaacagatgtcagtctaaagcctggagtagcacagcctgctgaggacaagtgtgaggcacaaggccttaactccaacagagcccagccagtgccaatccagtgagagcca

SEQ ID NO: 111458 - DNA, 483 bp, Homo sapiens
gggtgatgggcgcagaccaaggacgtgctcgcggggccattgtgcacagagatgtggaggggtggctggcaggggacacagtcggaacgaccgagtatcacgctctgcacggctcagtgatgtacaacaagttcgggaacgaatatcccatgtaatgaatgctcggtagcgactccagacttgatctttagagttgcctagtggccattctagttgtctacgacatgcatggcttagggttcgacttcgctgctaaacgatgatccgcgaatagggcacggacatgcttgtatagtcgacttggctagtatctcagtgctccgagcaatagactgtccgatacaagcaggcacccggaagcaggaatcagtggttcggtggggagttggtggggagctggggaagtatgtaactggtgcctctgtggtgtgtgtgagagatgaggattgggatttaggaaactcatgggcagctggctggatg

SEQ ID NO: 111459 - DNA, 203 bp, Homo sapiens
ctttgagtcagaaatgggagtgttggtctaaaaactgggctttttgggctgggcgcagtggtgcacgcctgtaatcccagcacttgggaggccaaggcaggcggatcacctgaggtcaggagttcgagaccagcctggccaacatggtgaaaccccgtctctactaaaaataccaaaattagccgggtgtggtggcgagtacc

SEQ ID NO: 111460 - DNA, 440 bp, Homo sapiens
ataccttccagtggtgaagcgtaagtgaatgtgtagccagaggcattgccttactggctgtatttgtgtccaggaaatactcaaaatatgtaactactggtaggttaagagtactaaccaatcagaatggattcctagaggcctcctgttgtgccaggcattaaccttttggtcactgagtcacagagaggttctagaaggcacagggaagggtcagggtagctgtcggagttgggactagaacagctgttctttaccaaaggtacatagtattgtaatagtttaacaaccagtaaagatatactggtgcctgttggctgcatatcaattttgtttatgtttagatcgtcatcttagtgactacaggggcaaaaatcttgtgccacatcttttttgcttatcccagcaggtcacctgaccaaagcccttacctctaaagc

SEQ ID NO: 111461 - DNA, 233 bp, Homo sapiens
tacagggctgcaagagggatcgggaggaccagctgaggagaccacagtgtctgaggcctctatgtaactctgctagagttactgataagttggaaaaagaatggggagaaattaaggaaaaaagttaacaaaagaggccgggctgagaatacaaatgaaaagattttgtgatagaaggtgaccaggatctgctgggggtagttgttcccaccctaggccaatggatgatgtac

SEQ ID NO: 111462 - DNA, 431 bp, Homo sapiens
gacatcgacactaacgttctaggagggcgggatgaaggatcagaggcaatggaactggagatcatggacatcacaacagatcatgtcaagctataatgaacgcaacaaagaaaggcaggaactacaagacaacactgtgttcttctgtacgctgtaggcaatctctaccagcaaactagagaaatcttgttctccctgggtgagtgaccccaggaattgttaatttccagctgtccagctataaagtttcatgaacattcctttagctgcacttagaaataggcactccacgggttccgcgcagtggctcacgcctgtaattccagcactttgagaggctgaggctggcagatcacttgaggtcaggagtttgaaatcagcctggccaagacagggaaaccctgtctctacaaaacatgtacacacgtgcg

SEQ ID NO: 111463 - DNA, 567 bp, Homo sapiens
aactcctgacctcgggtgatccgcccgcctcggcctcccaaagtgctgggattacgggcatgagccaaatgttaagggaacgcatcctattttacataccgattttcccacaagtcaccgggaggatgtcactgtgcatagctgaccgtcgtcctgtgccgagggtctgctcaagggacagaggaggacggtgctgtcctggggcttcgtctggcttcctgtgcctgtcctcggaggctcgctgttacctttctgagcctcagcttctagcgcaggggctgggaagggagctcagaaggggccggagccgcgcggccccctgagcgttctcggtaaacgctcggggtccccactccaagcccggccttccgcatgccgcttcctcggctacccttgagaagcaaagcccccttttcccttgcccaccacgccagtgctggcgctcaggtgctgcctcccctgtaacccacagcccggttctgggtgcaggcgtgtgtgttagcgcgaggggcgttttcacatcccgcgcgcccttaatcgtgggctcctctgcgccccagcggcctc

SEQ ID NO: 111464 - DNA, 434 bp, Homo sapiens
tgacacacatttttggatagccttctgatgcaaggcacatggaattcccgaagatctcaaaatgtcagcctttatataaaaggaagccatagtctagaaagggcagtaccataccaaaaaggaatatgagggataggcatcatatcccgaaatcttggatgaggcaaaggagatcaagggggaaagtggtacttgagtttatcatttaaaaaatgacgaaatttggatctccaaggaaagggaagtaggaagcataatccctggatcacagaagaatgagaatgaaattaccagtggtgtaggcacatgaaagaccccaccatccaaattgagaatttgggatttcgtgtttgttggcaattggttgaggtcatcagggctgttctgacttgacaggtaggaggctctgaacaggaaagcaaaagacagaaagg

SEQ ID NO: 111465 - DNA, 470 bp, Homo sapiens
aattaaagatcttagaaatgattcaaaattatgtaaattaagaactcttgtcctggaaacctatgctggggaaagcaccaataggatttggcaaggacttgtcatgattaactgaatagatgaagaaaaaagatattgatgggatgttaaggactgacaaggaaaaaggaagagaaaagagaagattatgaaatgcaaatgtgtatatttagcaacaaatcagatggccagagtaaatgacaaataccaataaaaaatggctgagatttcattctttggaaagtcagtctcagatgaggaagctgtaagtattcacaaagttcatggaaaacactaaatttctttaggtcatcaaaaaaatatgagaagatactccttcaaacatgaaattattctcacattcataggagtattctaatttaaaagtattcttatatttttaaaaattaaaaaaattaaaagcatgaatt

SEQ ID NO: 111466 - DNA, 377 bp, Homo sapiens
atctaggttcagacccacttattaattgtgtggtcttcggtcagataataacttctccaatctcctttcctacctgtaaaataatagtagtactggtagtaataatgcataacgttaatttttctaccaaccttactaataataagaatcaaaagtagtatggaagtaaaagcactttgtaattgtaaagtgctgtgcaactgctagttgttattatcttagttattattctcattcaagtcgatgcatgaatataacagataataaatgtaacttaaatctgttgggttgcttttttctggccttagtgatttcaaagacttgcttgcatgtggttaaattcaccagttagtgacttattcatatctctttgccca

SEQ ID NO: 111467 - DNA, 591 bp, Homo sapiens
gcaattacttttgcaccaacctaagtacctaaagtatgctttactttcataaagcagaacaaatgtggatttctttaagaagaaaaagaactattagaaaaaaatgtgagtatagcattgatacatatacacacatacatgcacacacacacccgtgtgtgaaaatccaagaatatgaaaaaaaattataatgacttatagacgaccttctctatgcaaagcactttcccaggcaatgaacctacaaaatctttagttctcactaaaacccggcaaggcattcacattttacaaatgagaaaactgaaattgagagagtgttagtaagttggatattgcacatgtaattttttgtatagccaggattccaacctagtgtttgtgatttaaaaatttacagtttttagtatttttttcagtgcatgtaaattagattgagaggattgaatgcagcctcgttacctttgtgtgagcgatttatcccagctaaaggatactgataagtacctttttcatatatttcacaaaattaggaaaagaggaatgaccaaaaattgtggaagactttaattctatagatattagccatgg

SEQ ID NO: 111468 - DNA, 434 bp, Homo sapiens
cacttgtccttcctcaaattctgaagtctctagccattctgtcttcttccttccagctttcagagttcttttattgttatctgatgaataatttttagattacctagttgttttataggagatgaacagggaaaagtgagcctacacaatcctgttctagaactggaggtattcaacctcttttatcctgcaggtggaacacatgtattacgtaatgctcacacatgatatatagcaccatcgtggaagttcaacaatagtttttacataaatggagatgagtttaggattaagctaaacttagctgtgaactaattgtaactctaccccctcccactgctccataacctacagagaatggcgctaaacttaattgatgttacagtgaaatgtatgcgggacaagcttttgcctcaagaattattaaatcatgt

SEQ ID NO: 111469 - DNA, 184 bp, Homo sapiens
atagtggtaccagatatgcagagaacctctggaaatttagtgttgcagtccaatcactgccccaagcagagcccacatgctaaggtgtctacgcagtttgagaataccatttgcagtatccactggcccagggccagaggactgaatctgcgtagacaccttagcatgtgggctctgcttgggg

SEQ ID NO: 111470 - DNA, 826 bp, Homo sapiens
gtactgcggcagggcagccttccaccctttggcacagagtttggtgttccaaaggtcatgaggggttttagaccctggacccaggacatgttccaagactcttttacattatgtcagaaaaacgagccctgcctcagctcttctgccaacatgtctcccttttttgtcctgcaaaaccgccacagctatcattgcttgttcttggcagcggctttctctccagaagcggcttccgcatctgtagattaaaaggagacagcacaagcacataattattagaacaaaatttacaagtgtagagtttccagtggtcttaatccatttaagagaattgattgcagacaacccattggctgcctcgctgaaaatatcagttccagggagcagggttaagtgagcctgagaggcttcaaaaacctgctcttttacttttacaatatcaagggtgagattttcctctctgcccactagatggcatttaatttcccattggtgttctgtttcattctaactatgaggagtaacgcaaaaatcggatgtattccagtcacattgcatttgaattctagtttctaaacttatgatgcaatcccccatccaaattactgtctgagggagatcattaatttgactaactatattttgatctgtttgggcctgagagctccataatttcatagaattctttttccatttatcaacaaatttgacagtttgcacagatgagtgtaaagccacactagctactgcagcagtggtggtaactgcagtgaggccaattatagcaaatataagagcaactataaatctttttgaacgggataag

SEQ ID NO: 111471 - DNA, 232 bp, Homo sapiens
agcttcctgccttgctccatctggcagactcttactcattccatagcacgcagcttaggtaggcatcacccccttcctagctcaggtggagtgggtgctcccgctgagtgctcccatgcactttgtggtttccccttctgtacatttaccacagcatactgatagatttgtttgtgtctgctttcccagagaggccaaaagaccttcaagggaccccttttttttttttttt

SEQ ID NO: 111472 - DNA, 286 bp, Homo sapiens
ctacagagaggaataaaaaactcagaaagggtaaatatctcgaaaatataaaaagtctattaaaaatatctatccacggccaggcacagtggctcacgcctgtaatcccagcactttgggaggccaaggcagatggatcacctgaggctgggagttcaagaccagcctgggtaacatagtgagaccccatttctacaaaaagaaaaagaaaaaaaagttgaacgtggtgtgtgcctatagtcccagctactcaggaggcttagtgggagaattgtttgaggcaaca

SEQ ID NO: 111473 - DNA, 134 bp, Homo sapiens
acagtctgtaactcagccacagacagccgtagccaggatctcacccctgagaaggacatctgctgcagccacatgctggccccaaagaaaactggctctaaattggcctctagacagttctagactgcatctca

SEQ ID NO: 111474 - DNA, 305 bp, Homo sapiens
gtggaaaggacacgctaggcttggggcatggtctgtgcaaaggcagggaggcggaaacactctgggctcctgtggtgaccaggagaagttcatggttgctgaaatagaacccgtgtgggctggagggctgagcgcgaaaggagagatggggagagagaggctcggccctgagcgacctgcacgcgcacaagcttcgggtggacccggtcaacttcaagctcctaagccactgcctgctggtgaccctggccgcccacctccccgccgagttcacccctgcggtgcacgcctccctgggacaagtt

SEQ ID NO: 111475 - DNA, 263 bp, Homo sapiens
cactcctatcagctttccctgccccttgatgacatctcagatagccggctcacctgtttgcaggcatttttagtcaagaaaaaggctgcttcttgtgagaatgactcacttttatgtattaaagagtcaatttgaacttgacatccatgtcaaactccccctcccacagcccccagcacaggctgggctggtgtctgggccaggggtagggaaggggcaacacgtgttcttttcctagttctccctttccctctctcttctca

SEQ ID NO: 111476 - DNA, 475 bp, Homo sapiens
cacagagtggtgaagaatgtgtgagcgagtgcatggtccggccaccgtgcacagccaggtgtgctggctgtggcagggcaggcagctccaggcactggcacaggtgctggctctgtatgagactaaggctggaacaggcatactgcaagtggcttcaatgatgggcaccgggaaatgcagtggcgacaagaagctggtagacaccaggaaccacagagccccaaagagagtatcacaaccatggctcagggagcccctaggtctgggctccctgaagggccccagctcttctcttcctctctccttctctcttctctccttcttatctcccacaacatggcaagcaggggccatgtttcagccctgtttgtgttaacagctctttcggtcatccagactaatgtccagcccttagcagagaggagacccataagaagtgtggctgagtcaggttattttatgggctcagacggga

SEQ ID NO: 111477 - DNA, 815 bp, Homo sapiens
aagctgatatttgtgggttaacctttctgtggtactacagataactgtgttccctcattgaggaatggagtcacaacaggttggtgtgtgcagtatgtgtagcagacaaggaaggcacatggggaggagttgaatcagttgtgtaagtttcaaaattgaaccacactgaatttccttgtaggtatatggcaagaaagaaaagggacaaaaaggaccaggcaggatatatttatatctgtagattttgtattttcttagtactttctggcaatggctgttcctgtgtcctcactgcaaacattagcatcttattaaattctcagtgtcatttgtgtatttaaacaagctcatgatcagtgctggtaggcctgagttacgggcaaataaaaactgtagaatgactgtaaaaactaagactaaagcaaggggtaggcttgagcaaaagaataaaagagactgaaaaaaaagtgaacagcacataaagtgaataaaaagaaagcaaaaaatattagggtttgtatgatagcagggaagtattcctgttcaacagttcatgtgcttaacagagtcaatattagaaatgttctgggatgtctcttccccactcagtacttactgagattgcagaccttgaagctaatacattgccaagagaaaatctgatatgaaagaaaattgctaattatttactttatcttcatatacccaatatatggtagataaccactaacttttggttgaataatggatacatgcctacataaatatcaaattgaaggtgacccaggatatgtaaattccttagaaacaatcag

SEQ ID NO: 111478 - DNA, 243 bp, Homo sapiens
caatctccctgcataggagatctgcccaacacacatttgcattttcagaaagagcagagcagaaaggaagcagaaagccaagtctgtggtggggaaaaaggaaagtgggtttcccatgagattcaggtagctccccaggaccgaaggatcagctgggcacgtgtgcttcctatctgggtagtgctggtcatttctgtttgctgtggccacagtgtggccatcctatcggcacctctacccaag

SEQ ID NO: 111479 - DNA, 265 bp, Homo sapiens
ttcttttcagttcagtgctgagcttggagtctggcaaatcacaggtttttatcaataaatgtccagctgggtacattcctccctctcctaaacacaactcctgccggtcaggcactgtgtcctagaacctttgccatgacgctgatggccatgctttcacttctagatcaccatttctgccacttatgtgctttgacaggtccctgaatccttttggaattcccagaagcacctggaaagtttactgctaaattgttaagaccgg

SEQ ID NO: 111480 - DNA, 483 bp, Homo sapiens
agaatgtaagcctcatgtgaagttatcaatgactgataaacagcttagtggctaaccctcctgccactgtgagtaagcggatgagtggaaccagctcggaacggcccaccccaaggggccttgtaaagagattacggaggaagccagcagttctttctgtaatccacccccagcagagggatcaaaggagaggagcagagaaagagctgagagtccttgtgggcagagagtgatgtgtctcaaggccacagaggccctcgtggggcgtgccgtggtcaccctagtgcttcttcctctagtgtcctcatggaaataactgggcctcctggttatttaaatcagggtttttgtgtcgggtttcaataaattgagatccaggctaacttgttaaataatctggggagagaaaaagagtgaacgtgcgaagctgatggctaagtctgaccatggtggagatcagtggctttcaatacctgtggcacg

SEQ ID NO: 111481 - DNA, 391 bp, Homo sapiens
agtagaaacgggatttcatcatgttggtcaggctggtctcgaattcctgacctcaggtgatccacccacctcggcctcccaaagtacagtttttaagtggtgtgcgtgtgtttaattaagaaagggataaagggccaggcacagtggctaacacctgtaaacccagcactttgggggccgaggcaggcagatcacaaggtcaggacatcaagaccatcctggccaacatggtgaaaccccgtctctactaaaatacaaaaattagctgggcatggtggtgcatgcctgtagtcccagctactcagaagactgaagcaggggaatcacttgaacctggaaggcggaagttgcagtaagccaagatcgcaccactgcactccagcctggcaac

SEQ ID NO: 111482 - DNA, 680 bp, Homo sapiens
ataaaacataaaagagcataagacataaatacaacacacatgaaagatctaacatgatataaatatggtttgagaaagagaaaattaggaagaagcaatatgttaagagataaagaccaaaacttttctgaatctaacaaaagacatcatactataaattcaataagctcagcaaacccaaaacaaaatatagacaaagtgctgggattacaggtgtaagccactgctcctggctggtggtgaccacttctgagctagaagtacaggaggagaggcaggtttgggaggaaggagaagcagggtctagcttccgtcgtgtggatctgaacagcctgaggccatccaagaagagatgtctggggacagctggagatgtaggtctggaattcaggtgagaggtcagagctggaggttgacatttggaaaagatcagcctttggagtgaaattgaaaccatgggaatggatgaacacactcagggagagggtgcagggtgagaaaggaagggaaccagaacagacccctgagaatagtcatggtttcgaagaagcagaaggaagagaagccagcacactggaagcagagacagagaccaaagaggtaggagaaaggcaggaggggtctttgggacaaaatattcccccggcagataaaacaggagagcactgaaagaaggagag

SEQ ID NO: 111483 - DNA, 354 bp, Homo sapiens
ttttttaagtttatgggaatttagattgtttccttatttttactattttgaaccatgttgtaaaaatctttatatatactggataaacttttgtgagtttatcggtagtgtgaattcttacaaagatgaagtgtcaaactgtcaatacatttcattattttaccatttatctatctgcatgtgtttggccaagagaaatttcaaaacaggagagaaactagtgcttcaaaactagtcatgctacccaaaaagtatatgccatgtaaaatttaaaaaaattttactatgaaatgctgttagagatattggtgtgggctaccctgaggcacttcagcttgtgtatactgaagttga

SEQ ID NO: 111484 - DNA, 349 bp, Homo sapiens
aatgaccgtgggcaagagctgggttggaggggtggtctcagatgtgtcctgacttgctgggatggctggaaagctgagacacacatggttctcagctgacgtgggcctgcttgaggtcttgatggagagccggacacttggctaggtatgtcccccgacagctgcatgctctggaggagggaaaactctgctcccagagcactaggcacagccattctgtggtggccctgaccagggggaccccgggacagagccctaggctttcaaacaatgtcaaagttcaacttgctttcgagtccgcatttctgcagcctggagcgctgggcctgctgagtcgcaagctgcctct

SEQ ID NO: 111485 - DNA, 343 bp, Homo sapiens
catataatatatgaaggcatatgttcatggatagcaccttcacgtctggagtcccatcccatacatgctcacattcctttcccgccccacacctagtccccctatgccttctactgcttggggagaaagtacatttagcacaagagctcaccttctccgttttctggccagggaataaaacccgattgccttttccaattggatgttctttctttgcgaccaatactgagtggggaaagaagtgtttaccagggacactgagacacaattatgctcctatagtcaaggcctacagttcatttaaaaatgctctcaggggctgggcgcgatggctcacacctgt

SEQ ID NO: 111486 - DNA, 133 bp, Homo sapiens
tagatggaaattgtgttcatatgtttttcttcatcaagaaaaacaaggaaattttcataaatatttttaaagtctctcagaatctgataagaaagggccaagaggatgaaaatgagaggactggggaaaaata

SEQ ID NO: 111487 - DNA, 624 bp, Homo sapiens
gtagctgggattacaggcatgtgctgccatgcccggctaattttgtatttttagtagaggcagggtttctccatgttggtcaggctggtcatgaactcctgacctcaggtgatcctcctgcctcggcctctgtgctgggattacaggcatgagccaccatgcccggccatattttatttctttagacaagtgtttaagtacatatatggtctctgcgtttaagtaaaatttttatatggagataccaccaggggtggggggagagaagcggagcctgtgtgagccccagccccaagtaatactactgcccttgcgtcattttggagacccccttcccaactaagtgcctctttgcatagcaatggctcccgtccccatgctctctggtatcacaacagctggacgggtagtggcgggtcggcaaggcacagcacacgacctggtggaccagccactgggaacaatgagtctatggtggccaaatccagccttgtcctccactttgtcaagggacaatttcaagagtaccaggagagcataatcagagcagccttccttacacagactgtctgcttagacgacacaatagtcaagtttgagatctggggcagcgctggacaggag

SEQ ID NO: 111488 - DNA, 303 bp, Homo sapiens
cctgctactcaggagggtgagacaggaaaatcacttgagcccaggaggtcaagttatagtaagcaataatcacttcattgcactccagcctggatgacagaataagactccatctccaaaggggggaaaaaaattccaactttagattaaatgtctactgaaaaagttatgttactaattgatttcgtacctatatactcatagtatctaaaaagctctggaaacatgtagttttattaaacggttcactgcagaataacagtattaagaaagattctcagccgggtacagcataccccaaca

SEQ ID NO: 111489 - DNA, 480 bp, Homo sapiens
cctcagcctccagagaagcttggattacaggcactcgccaccatgcctggctaatttttgtatttttagtagagatggggtttcaccatgttggccagaatggtctcaatctcttgaccttgtgatccacccacctcggcctcccaaagtgctgggattacaggcataagtcaccgtgcccggccctaaatcagcaccttctgctctcatctccccttacacctgctcccccttctcctgcactccctttgtcagtgcatgcccttagccataagcctaggaggatgacttaaccccctgagaactctttataacccttccaattctaccctctgaatatattttgaatctgttccttctgctaaatactacctgcaaccaatgtttctctcacctgaataatttcaaaagcatcctcaccaattcccatatctctagtttgtctccttcaaactattccattacgtcgacctttctaat

SEQ ID NO: 111490 - DNA, 643 bp, Homo sapiens
cagggtcttgctctgttgcccaggctggagtgcagtgatgtggtcatggctcactgcagcttcaacctcccaggctcaagcaatcctctcacctcagcctcctgagtagctgagactacaggcacgtgccaccatgctcggctaattttgtgtttttttgtagagactgagtttcgccttttttgcccaggcttgtcttgaactcatggcttaagtgatctgtccgcctcggcttcccaaagtactggaattacaggtgtgagccactttgcccaaccagcaaattctttaatgctcaaattgacttgcccagagtcttgatattttttttttaaagctttcctattttggggggaaatcttcagctagcatacttaatgtttaaacaaaatagagaaattttcattcatacatacaaaagtagtgggaactacccagcttaaacaatttgtcaacacatagtcaatcttatttcatccccatcccaatttactactcctgacccaaccttcattatttgaaggaaatctgacgtcaagtaagttcattcataaataagtattcaatatgctatttgagaagatgtaacttgtgaaaatttctaccagtgcagaactcagtgtttcaaagctagaatgaggcc

SEQ ID NO: 111491 - DNA, 300 bp, Homo sapiens
tttccctcttcctttctgatctcaaaagctgccaaggtctaagccatatttgggatttcactccctgcgggattttatttcgatcaaattcaatcagtatatattgtattcataggttggtgtcaatgctgagattcttcagttttgttatccattatgcatggttatacatttttgctattactttaccatccaacccccatctttataggcttaattctggaggatttggtaaacatcatattagaatgataaaattgtatattaaatggtcctgttgtaaaaagacttccaacagat

SEQ ID NO: 111492 - DNA, 477 bp, Homo sapiens
cttacaggataatgtttagttctcattatcagagaaaaaggtgattcaggtaatttcttcatttgttcgtttctctatccctctaccccagtgtcttgaaaaaatatttagctagaatgctcaaaaatggtgtgttagcattcattttcttccattaggtgatttttgttgactatcattaatagcaatatgtaagacttactattcatttgcctatttattcattctacaacatttattgtttttctactgccaggaacaatttgaagtgctggatatatttagtgggaattggttttcttaggcagattatcatctgtttgtgaagctttttcacagtgtacgtgcctggccccaaatctaggagattcttgtttggtatatttggtgtggtgtaagttcaggcatctgtatttttacagagcttttcaaatgactctaatgcacgtttgcttttgagtaccataggaataaaac

SEQ ID NO: 111493 - DNA, 824 bp, Homo sapiens
atgtgatccactttgtgttcatttttgggcatggtgtaagggaagagtctaaattcatcttttcatggaccgatttccatttgtccaagcaccatttgttgtagagtatcttttccccattgaattgctttgatacctttgtctaaatcaattgggcataaatataagggtttatttctaaactcttagttctgttccattgatctgtgcctgtccatgattgtgtgttattgatgactctggctttaaagtatttgtaagtcattaaatcaggtaatgtaacacctccaactttgttatttttcaaaattcttttgacttttctagatactttgcattcccatgtcacttttatgatcagattgtcagttactacagaaaagccttctgaggttttaaatatatattgtgtttaatttacagatcaagttgagaattgccatcttgacaatatgaagtcttccagtctgtgaacatggagtttgtgtccatttatttagatattccttgatttctcttagcaatattttgttattttcagtatatacatcttacactccttttgttaaaatgttcatattactttgctattacgaatggaattgcttgctgaattttgttttcagactttttggtgctagtatatagaaataccattgatttttgtttattgatcttatatcctgtgacctgtctaaattcaatctgttagttttatcattttttaaaaaaatgtccgtgtgtgtcttccttgagattttctacattatcatgtcatctgcaaataaagacatttacttctttctttaaaatctgtatgcctt

SEQ ID NO: 111494 - DNA, 344 bp, Homo sapiens
atactgtctatacctgtgtgcccagctctgctacttgactaaagggcttgctttcctcgaatctgaaacacactaatgcatagtttgcttcagaagcagaaggcttctgaaaaatgcttttatttccctattgctaagaaaacatttgacattagaactcctttgtgcaggctaggatgtttcctaagttttcttttgcagtgatctgcaaacacttttgcttatgtactcccaaaataactttggagaaccagcattattttattttttaaattaaattttattgtattttatgttttttagaagggatttcactctattgtgcaggctggagtgcagtggtg

SEQ ID NO: 111495 - DNA, 305 bp, Homo sapiens
aagcttctgaaaggcaaataatgggaaggcaatccacatgtaagggaaaacgggatttgtgtcagtaagaagtgatagcctggaaagttggtgatatttaactaaattaaaatacgataagggccatccacttttggaagggtagtaaaaatcaaggttgataagttcacacaaaatttaataagcaatagttgtgttttgttttggggggcaaggggtcagaggtgtgatcataactaaaataagactttaatcctggaaagctgggagagggacaatgctgttaagaacctgagaaatcaaga

SEQ ID NO: 111496 - DNA, 632 bp, Homo sapiens
aggtgggagaaaacctacatataagtggactcatgcagttcaaacccatgctgttcaagggtcacctgtacatataaacttgtatatgtaaacacacacatatgtaaacaaaggcaacaaacattacaaacatttatcaagtgggcacaatatgccagtactgccctgtggcctaggtattactaaggcacagagaagttaagtaacttgtcttagaatgcacagcttgtaggtagcaggactgtaattaaaactcaggcatttcagcacttgggaccgtcttcttcaccttcgtcttcagcctctataaagctgaaatcactgaaactttttcttccaaaaaagaagtatgtaaaaaaatataaaacaaaacaacaaaaaagagaaaaggatcttccagagtatgtcatagggtggtcctcagcattgaatgttacctatattatgggtaagaaaacatttcttctagagatttaataatctacagaaaaaataaatcagggactatatataagtgacaattcatttttttcctagaaaataaaccttaaattcgtaattcatgtacatctctgctcctgtaaggtaaaaattgtaattttcaccgttttttagtagtcttacatatatgt

SEQ ID NO: 111497 - DNA, 672 bp, Homo sapiens
ggacagttgcttccaactccaaacagttattaccttacagaggtgtgggcccaggattgcaagactagatttttcggtgaaagccgccagtgtgacactttttgagttttcagtgttggcagataattcactgttttaaaacatgcagataaaactcaactgtagttggatgtactttacgggttgctagtttgcacacacttatatacataatgcagaacataagtgggaatattctaaataatagacagtgtggaaacttttcttaataatagtaagaaactgagccccaaacaactattaatatgtttagatgtttccctttgggtctttatttactgcatatacattttatatacatgttttaaaatagttgtaatcataggagcctgtgatttttcacttactgttagaagcagtttctttatatgatttataatggctactggatattccatgtagaggatgtattacaatatgcaaaatcatttccttattgttggacctttaagttgcttttgatttaacatagttataagtaatgctgcaattacatatttgcttataccgctttctcctttttttggattagatccttagaatctaaaaggaagattactaagtcaaaagatatgaacgtttttatggcttttggtacatattaccagattg

SEQ ID NO: 111498 - DNA, 738 bp, Homo sapiens
tggaagactcatatttttttttatttcagaatttactagaaaacaacagtaatcaagactgtttggtaccagcatacaggtagacagacatataggacctgggtgcggtggctcatgcctgtaatcccagcagtttgggaggccaaggtaggaggatcacttgagcccaggatgttcaggaacagcctggtcaacctagtgagacacctcatctctacaaaatattttaaaattaggtagctatgttgatgtgggcctgtgatcccagctgttcgggaggatcacttttgcctgggatttagaggctgcagtgagctatgattttgtcactgccctccagcctgggtgaccgagtaaatcttaagtgacttcgggttgggcagctatttcttagatatgacacctgaagcagacaacagaaaacaaattagatagaccagagtttatctaattaattagacaaattagataaaacagagttgcaaattttgtgcatcaaagcatgccatcaagaaagtacagcccacagaatgggagaaaatatttgcatatcatatgactgataagagattagcatctagaatacataaataattattacaacccagtaatgaaaaagacaacccttaaaaatgggcaatggatttgaatagacatttctccaaagaagacacacaaatgaccactaaacatatgaaaggatgctcaacatccttagttattaaggaaaggcgtatc

SEQ ID NO: 111499 - DNA, 379 bp, Homo sapiens
ctttgaacatacacaaatgtccagaaaccatcccatcttcccagcaggggctgtgtttcatgaattcacaggtgactacatacccctgtaacttttattatgagttgaaattcttgactccatcaggaggaacatgtggagataatttaatccctcccctctagcccaagcttgaatgttaacctcactcatccctcactcagtaataatccctgctccttctcccaccaccttctttgtctgggatagggcgggaaagcagtagacacacacacagacacaaatacagacagtcacttgtaacatacacacatatacttgcaaaggccaactatcttggaagactagggaaaaagacagaagtgcctgggactgagct

SEQ ID NO: 111500 - DNA, 214 bp, Homo sapiens
gacatatgagttgtcacagctgtggggagcatgggggaaagttgtccaatgtgtagaggccagagatgctactaagtatcctacagaacacaggacagccctgtgcaacccaggaataggactatttcacagaaaacctgtcttgagaactttaaaggctttgagcccagaagctctctcaaactcattctaagtgcttggtgaaaactgtggt

SEQ ID NO: 111501 - DNA, 276 bp, Homo sapiens
aaagacaaggccacacagccttctcatgcctctccctctcccagaattccaggagcgtgatgacaagtatttctctgtaagggtctttggggtctatacttctcccctaacccagaggccggtttaaactctctctgggaaaaattcccatttaatcggcttgaaggtagatcacagaattctgagattctattatttcagagtaatagaaacgagtcagatggacagttttgaaatagaaaatggtctcaagagttaacaattgatatcaaagtt

SEQ ID NO: 111502 - DNA, 463 bp, Homo sapiens
aggggcacatctgtccatctcagcaaggcttcagtgaacgtgccttcaggacgtggaagcagacaccgcactgtgtcgggggcctgaacacgaagtcggtagaggagcaggtctccaggcacggctccggcaacaccaacaggaagcgggccaccttggagagcgctcttccactgctggagttcctggtcaatacggcatcgtctgcgtggagggtctgatgcatgagatctacgctgctggaaaacacttcaaagaagcagactacctcctgtgggctgaagttctcttctccaccaggtgaaatgaagaaaaagcccactcgttttgtagaaggtaggggtgctggcagccaggaagaccagaccagcaggctttctagcagaatgaactcaggtctacatcattatttttgtaatctggtaagttaataaatggtgactgcctttgaatttaaaagaaa

SEQ ID NO: 111503 - DNA, 301 bp, Homo sapiens
tcaatggtaaaaatagcagcttacatttatcaagcacgcttccctgtatcatcgtactgcccagatcattatatatcttaccttgtttaatctcccaactctagaaacaggtactgccattatccccattttacagatttaggaaactgaagcttagcagagccgacactcaaacccagatagatatacctgactccagaagcaggaactgaactattcacctccactcgtacctgtttctttaaaatgcaaaggtaatatagtataatatcaatggtaggatgcatgctttaaactatta

SEQ ID NO: 111504 - DNA, 510 bp, Homo sapiens
agagagagagagagagagagatgaggatgggggtgggaaggcaggcatgtggtagaccactctgcaaggagctaaaatgctctaggcaacgagatggtttataggataaagcctctgctgtactctcctgcttcctaattgtgcagataacaaatgataataatattctcccaccactaagggtctcactgttagttctaaattatattcgataacaagaagatcaatagctaaggcaagtctaaacagtggctaccccaaacacctttccaacatgtgctggaacgctttcgatgttagtgagagcaagtcttagctccctgaatataactgtcacaggctaatattaaagtcggtttgattccctgagcacattccaaactgtggaaaaggacttgacccatttgactgactactgggtagctcagagagggcagtctaggatccaaatttgctacgaaaagctcaccccacagatactccacatactgtgtccatctcactgcagct

SEQ ID NO: 111505 - DNA, 443 bp, Homo sapiens
tgaatatatggatagaaaattatttgacaaacatttgaaattgaagtcatcaagttcaatacatctggaatcaaacccatcaccttcccctgcctcactccacttctccagccagctcactggatgcccatctcggttcagggcagtctcacagtcctggtcacccagactagaccatgatgtaccaagtggcctcgccctgttctttgccttcagtctctaattcagtagttcccaaacttgtgacatcaggatcactggagggcttattaaagcaccactaggctccacctccagcatgtgcattgctcccaagttcctaagtgttgctgacgggaacatcctttgagaacactgctttactgacatgggggggcgggaaaaaaaaaaaagcaatggaccctttcctgaaaagtgcacacacacatgcatgcacaggtaat

SEQ ID NO: 111506 - DNA, 289 bp, Homo sapiens
taattagaaaacaatccaaaattcagattgcttttctttttttctttttcaaactctgcatgtggcattcaactaattcagattctacaatagaaaggcagagtcttccagctcacctgcctgcacagaaagcctccagcatttggttgtagcagctgagtggtggtgacatctaggtccatttgaagcctgcagagtgggagaagccatcagcatccagtcagagacagtgcaccgggagcctgcagcttcttttcccccaaaacacaaagcagcagtaacacgggct

SEQ ID NO: 111507 - DNA, 697 bp, Homo sapiens
aagcaaattaagtgggcaggggcggtcagtgttggtagaaaggggaggcaacgcctgtcttcgttgatggttaaggaagttcagacccatctgcatctattgaggggtccctagtggagaagtgagaggctacagttcctgacgggattcctgcccctttgggaaagcaacttggcaggtgttttgagaggtttttttggactgggaacaaatcccaagggagaatccaaaggaggagggggcctcagatgtgccaggctattcctgacagcaagaggctgcaattggccatcgggccacagacatggccctggcaagcctgaagagctgccttaaagccatcttttgaggccatcgcctggagcggctccccatgtggagtcaaactgtgtctgtgctgagattaggatctagtgtacttccccagatagatggacaggtgccaagggcatcccagaaacagggcaagggcaggtggtctgtgggggcagtcgctaagggggatagaagacaggttgtgaaggagccaccttgggtcttttgggtctgtttttcctcccggtgtccttacccatggcctctcccctgccgcagggctttggtgctgtctggccagctccctgcccatccttctccagctcttttctgctttccagcatggaagtcggtctccagcccaggtggacacagctcgttc

SEQ ID NO: 111508 - DNA, 561 bp, Homo sapiens
tgattacactcatgatgtttctctcctgtatgaatttttagatgttgaacataagatgaatgtgtactaaaagctttcccacatttaatacactcatagggtttttctctagtgtgaattttacaatgctgaataaagtatgagtgaacactgaaagatttgccacaatcctcacatgtgtagagtttcttaccagtgtggattctctgatgtttactgaggatagagggccaactgaaagcttttccacattcattgtgctcataggtcttctctccactatgaaatctctggtgctggttaaaagctctgttctgattgtaagtttttccacacccagtactctcaaaccatctctctggattattcatcctctgattctcactaagaactgagctctgtctgggcactttcactaacacatctgtctgataggctctttctcctaattggaaactctggaggttaatgaggtcctcatgttgttgcaagttttctacacttgacacacttggatggagactctcctctctagaccctctaaaatgtttggcaggattt

SEQ ID NO: 111509 - DNA, 491 bp, Homo sapiens
gccaaattatcaagtgcagtgtgtgactatttgagggaaatgataatttttaacatattttttaaaacccttattatcgatgctggctatgagaacatagctatactgctaacgtttctccacaaggtggcattgccctacgctttaaaaagtggggctatttttatgtccccccccccacccccatattttcctttcacaaaacaatacaaaccaggtgatgacatacttgttttatcatgtctttttgaaagggtaaaaatatctttaaaacccatcttatcattttatttttatttatttattttttgagttggagtttcgctcttgttgcccaggctggagtgcaatggcatgatcttggctcaccgcaacctctgcctcccaggttcaagggattctcctgcctcagcctcccgagtagctgggattacaggcatgtgccatcacgcccagctaattttgtacttttagtagagatggggtttctc

SEQ ID NO: 111510 - DNA, 404 bp, Homo sapiens
ctcacacctggggcagcgtctgtcacccacctcacagctgaagaaactgaggcacgggcaggtggaggcaccctacccagcagtgggaagcccaggccaggccaagccccccagccctcgcttgggacagatgctgcccctgacctgctgcctgccacgcctgatctctcgccctcctcatggggccttggggaaaagctgccacccccaccagccagacaggaggcagccgagggagagggtggggcaggagggcccggaggccctaggaggggggcgtcaagggcagcccccagaagcaggagcccttttctcagaggccagaggtgctggggggagggacaacgaccggccacccacccaaggtccacccagaattcccatggctccggagagcattgcag

SEQ ID NO: 111511 - DNA, 247 bp, Homo sapiens
tgctcagcagagcccagcccatattgccaagctataagcagataaatggtggttgttttaagccactaaattttggaatggtttgttaatatagcaatagatatctgataaaaccagcttctcatttccttgatttcttcctctccagtgagaaagatgatcccaccctaaaccttgttgctaccaatagcttcacacactccatcatctctattttaagtatcacactttcctattaccaactcct

SEQ ID NO: 111512 - DNA, 945 bp, Homo sapiens
ggtaaatgagcattggcttcaacttcaagtccccagctgcactggcccttaacaagagggttagcctgtcctttgatgctttggaaacagacattgacttctctttagctgcgaaagtcctagatgatatcttccaacagcaggctgtttcatctacactgaaaatctgttgtttagtgtggctaccctcatcagtgatagctggatcttctggataactaacttcctgcagtttctccatcagcagttgctgcttcaccttccacttttatgttatggagatggcttctttgcttaaacctcatgaactaatcactactagcttcacacgtcttctgcagcttcctcacctctctcagccttcacagaattgaagaaagttagggccttgttctgggttaagctttggtttaagggaatgttttggctggtttgatctatccagaccactcaaacttactccctatcagcagtaaggccgtttcacttatcattcatgtgttcactggaatagcatttgtaattttcttcaagaattttttctttgcattctactgtttgttttaatgggcctgcctttcagcctgtcttgattttctacatgccttcctcactaagcttaatcatttctagcttttgatttaaagtgtgagacagctgactcctcttttcatttgaacacttaagaggccattgtagggttattaattggcctaatttcaatattttgtgtctcagggaatagggaggcctgaggggtaagagagagagagctgccattcagtggctgggcagtcagaacacatgtgtaccacatttatcgattatgtttgccatcttatgtgcgctttctgacaccccaaaacagtttcaatagtaacatcaaagatcactgatcggctgggcacagtggctcatgcctgtaatcccagcactttgggaggc

SEQ ID NO: 111513 - DNA, 252 bp, Homo sapiens
attctattttggtgcccataaatatgtactaatgctggccattgtttttgttgtagctaaattctcatttccaaaaattaccaccacttcaataagattttggctttttaaattatttaaggtagtatatcagtatgagtctgaacaataaattataatagaagattagttgtattttagatttgtcttaaatttatagcagagatatattattatccattattattgaatatgaatctagaccatgttttt

SEQ ID NO: 111514 - DNA, 507 bp, Homo sapiens
tcatagaagggatcacatatagtggagcacgaatgtccacaccatctatgttccgagcatcctctaaatgtcagatctggctgcttggaagctcggattcggctgtcagatctgcgatccggctggatcgtcttggatgagtcacctgcaaagtgcacctctaagaagctgaatgtgctgtctgtggttggggtaattaaatactgtggactaaagtgtccgagaatgcttgagagtgcaacctgactgtcatgttagcttggtagagaccgcacgcttaacaccgtcgagactggagcaaaacaaaaaccacaaatgttgagaacaaatgttacaatccacttgtctctagcataaaataaatgtagtattgcttctgcgaacatctgattctgcttttaactgcgtcctgatggatcttcttggatgagtcacctgcaaagtgcacctctaagaagctgaatgtgctgtctgtggttggggtaattaaatactgtggacttaaac

SEQ ID NO: 111515 - DNA, 275 bp, Homo sapiens
ttacatcttaaatacatctcgcaagtgactacaaattctttgagggcagagacaatatattttttttaccttttaatcccttaaagaccttctacctttcctttcacatggtggacttttattaatgtccgctgaatgaatataacatattcataatatagtcatgtctatacattgattaacatatttgttatcaactgcagagtaggcccagtctttctcttttactctctgtccttttaagaattttaagagctttttggggaaaataaagt

SEQ ID NO: 111516 - DNA, 148 bp, Homo sapiens
cctctctcactcctctagactcagtttaaaattcatgtattttcctgaagtcatctctaactagccccaccaaaaggcaatcacctttgagaggagctgactcatgaaggtcaatgggaaacctcagggggctaggattcccactgga

SEQ ID NO: 111517 - DNA, 624 bp, Homo sapiens
gtttcagaacatttcttatcaccctaaaagaaccccatatctcccaattcttccctatccctgtccccaggcaactactaatctactttctatctatggatttgcctgttctggatatgttatataaatggtaatatgtggccttttgtatttggcttctttcactttccttaatgtttctaagattcattgatgttgtagcttatattagtagttcttttttttttttttagacagagtcttgctctgtcgcccagattgtagtgcagtggctcagtaatggctcactatagcctcgacctcccatacttaagtggtcctcccactttagcctcctgagtaggaatcagtagtaaccttactccttatgtcaaaataactttcaaatggatcaaacatttaaacgtaaaaaaggaaaccatgcagatcactagaagaaatatttgtggtttttttttttatactattaaaatgggccaggcgcagtggctcacgcctgtaatccaagcacttaaggaggcagaggcaggcagatcacaaagtcaggagattgagaccatcctggtgaacacggtgaaaccccatctctactaaaaatacaaaaaaattagccgagcatggtgg

SEQ ID NO: 111518 - DNA, 359 bp, Homo sapiens
tgaggggacccaggggctcaggccctcccaccatgctcactcttgatggaggagtggaatcatcaccacagacactgcgtgggaactctcgctacacacccagcgcaacgctctggcccaaccagtcccacccatccagaggtcatcttgggctgccttctgtctgctcagctcacaaggcccaccaatgtctgaggtttccaaaatcgccttcccagtgggtgcttctgtcctctattagccttgctcctttcaacaagaaaatggccttgatgcaaaccagacttacagcgcagctccagagcactgagaatgaagcctagcccatttctgtggagggatgtccatgatttgatctg

SEQ ID NO: 111519 - DNA, 323 bp, Homo sapiens
catgccatgtggagcacaacagcgaggcttggttttgctcactgcttagagaagtgcctggcaggtagcaggcgctcagtgcatgtctatggaataaagcagcatcttctgaccaggcgtggtggctcatgcctgtaatcccagtgctttgggaggccgaggcagatggatcacctgaggtcaggagttcaaaaccaggctgaccaacatggtgagaccccatctctactaaaaatacaaaaattagccgggtgtggtggcgggtgcctgtagtcccagctactcaggaggctgacggaggagaatagcttgagcccgggagg

SEQ ID NO: 111520 - DNA, 215 bp, Homo sapiens
tcttaaagacacccagcgggcctgctgctgctgctgctgctgctctgcctgagctccaaatatcaacagccatagggctgcggccactgcacccccgggataggggcccacaggaggagcccttcttgacagctcctgtagggctccagccttatggctgggagggcccctgggagccgcccagcccacctcctccctggggaaggggcagagaa

SEQ ID NO: 111521 - DNA, 307 bp, Homo sapiens
gtttgaacatgattctttttttgtggaggtgggaggtggctggtcacatgtctatttctgaaccggctgctgtggccaggagaataccatgctctgatgggccaggccagggtcatgtgcctattccttgagttgaggttggggtggcttccacagaggaaactgaggaactgttacctcagaagggtaaataagatgtcaggaggcaatcagtgtttatatgggcagtgacttctaaatttaagccagaatttctgattctcagtcctgttgacatgtggggccggatcattttctgtcctgggag

SEQ ID NO: 111522 - DNA, 2907 bp, Homo sapiens
  misc_feature (358)..(358): n is a, c, g, or t
  misc_feature (597)..(597): n is a, c, g, or t
catgaagacctatggtttgagttgtctgatgagacgctttgtaactggatgatgtttgtacggccagcccagaatcacctggagcagaacctggtggcttaccagtatggccaccatgtgtattatacaaccataaaaaatgtggagcccaagcaggaactgaaggtgtggtatgccgcatcctatgctgagttcgtgaaccagaaaattcatgacatttctgaggaagaaaggaaagttcttcgagagcaagagaagaattggccctgctatgaatgtaaccgccgatttataagctcggagcagttgcaacagcatctcaattctcatgatgagaaactagatgtgtttagcagancaagaggcagaggaaggggacgaggcaagaggcgattcggtccaggtcgacggccggggcgtcctccaaaatttatccgcctggaaatcaccagcgaaaatggggaaaagagtgacgatgggacacaggacttgctacattttcccacaaaggagcaatttgatgaggctgaaccagccactctgaatgggctggatcaaccagaacagaccactatcccaatccctcagctgccacangaaacccagtcttccctggaacatgaaccagaaactcacaccctgcacctgcagccgcagcatgaagagagcgtggtgcccacccagagcacgctgacagccgacgacatgcgcagagccaagcgcatccgaaatgcagctcttcagcatctgtttattcggaagtccttccggccttttaaatgcttgcagtgtgggaaggccttccgggaaaaggacaaactggaccagcacttacgcttccatgggcgggaggggaactgcccactgacctgtgatctctgtaacaagggcttcatcagcagcacatccttggagagccacatgaagctccactcagaccagaagacttactcttgcattttttgcccagaatcctttgaccgccttgatttgttgaaagatcatgtggccattcatatcaatgatggctacttcacctgcccaacttgtaagaaacggttcccagattttatccaggtgaaaaaacacgtgcgcagcttccactcagaaaagatctaccagtgcacagagtgtgacaaggccttctgtcgccccgataaactgcgactccacatgctccggcattcggaccgcaaagacttcctgtgttccacctgtgggaagcaatttaagcgaaaagacaaactacgggaacacatgcagaggatgcataatcctgagagggaggccaagaaagccgaccgcatcagccgctccaagacgttcaagccccgcatcacgtccacagactacgacagcttcacgttcaagtgccgcctgtgcatgatgggcttccggcggcgcggcatgctggtaaatcacttatcgaagagacacccagacatgaagatagaagaggtgccagagttaactctacccatcataaaacccaatcgtgattacttttgtcagtattgcgataaggtttataaaagtgccagcaagcgcaaagcccacattctgaagaaccacccaggagcagagctcccaccgagcattcggaagctccgacccgctggtcctggagagccagaccccatgctgagcacacacacccagctgacgggcaccatcgccacccctcccgtctgctgtccccactgctccaagcagtacagcagcaagaccaagatggtccagcacattcgaaagaagcatccagagttcgcccagctctccaacaccatacacacaccactgacgacagctgtgatcagtgccaccccagcggttttgactacagacagcgccactggagagactgtggtgacgacggacctgctcacccaagcaatgacagaactgtcccagaccttaacgacagactaccgaacgccacaaggggattaccagagaattcagtacatccctgtgtcgcagtcggcgtctggcctccagcagcctcagcacatacagctgcaagtggttcaagtggcctcggccacttcccctcaccagtcacagcagtccactgtggatgttggccagctccatgatcctcagccctacccccagcacgccatccaggtgcagcacatccaggtcagcgagcctaccgcctcggccccgtcctccgcccaggtatctgggcagccgttgagtccctcagcccagcaggctcagcaggggctcagcccctcccacatccagggcagttcttccacacaggggcaggctctgcagcagcagcagcagcagcagcagaattcctctgtgcagcacacgtacctgcccagtgcttggaattccttccgtggctattcatctgagattcaaatgatgacgcttcctccgggtcagtttgtgattacagacagtggtgtggcaactccagttactactggccaggtgaaggcggttacttcgggtcattatgtgttatcagaaagtcaatcagaattggaagaaaagcaaacttctgccctctctggtggagtccaggtcgagccacctgcacacagtgactccctggacccccagaccaacagccaacagcagaccacacagtacatcatcaccgctgggtccaaagtgatccaaaacgaattcacggtgggggaggaatgtgagctggagacaatgacaggggagaaagtcaagacagtggttcagttggaaggtgacaataaactggtgacaactttcaaaaacatcaagtctgtgaccgaactcaacggcgacataatcaccaataccatgacattgggtgacattgtcttcaagagaatcagcaagagaatttaaacaagtctgcatttcatattattttagtgtgtaaaattaatgtaataaagtgaactttgtttt

SEQ ID NO: 111523 - DNA, 344 bp, Homo sapiens
atataaggttcattaagcagagattgagagaggactgaaaagctatgtaatctcagctccgcctataatagagttggagtgtttttcttaattttaaaaaggaagggcttaagattacttaaatattttaatagacactttctgcaacagacgaggggtaaacagagaccagatagttggcttccactttaaaaattctgaaagcagaaaaatggctggatagctagtttaatagctagagctaaaaaagaagctgcttttgttgtgtcaaagaatgcttgaatgcttgagtgttttctctggcccacatgtagatcaggaattagaataaatctaggagtact

SEQ ID NO: 111524 - DNA, 376 bp, Homo sapiens
tgttggccaggctggtctcgagctcctgacctcgtgatctgcctgcctctgcctcccaaagtgctggaattacaggcgtgagccaccgctcccagcccagaaatcttattttttatcacttttccatctgttcatccttccatccatccatccttacattatctatgcatccatcccaccatctagtcaacaaatatttattaagcatctaatatgtgctgtgtactgagtgtaggtactggggatacaacggtgaataggagagtcatggctgtacttgtatagccaatattcactggagaaacagacaaaacacaagtaaacagaccaattaattgtaagtttctatcagcaaagaaggtccaggtatgctggg

SEQ ID NO: 111525 - DNA, 169 bp, Homo sapiens
gcagtggcgcgatcttggctaaaggcattctcccacttccttcataagtagctgggactacaggcccgcaccaccacgcttggctcactttactatttttttgtagaaatggggttttgccatgttgctcaggctggtcttgaactcctagggtcaagcgacccaccca

SEQ ID NO: 111526 - DNA, 362 bp, Homo sapiens
agcccgctacttcagtgaaaaggaagaatcaaactccagcttctccctgcaaaaacgctcacggacgcagacaccgcccggccccatctcctgggagctgcaggtggaggcaccgtaatggtggacggagacggctgaggggaaaggtggggcgcgctcgcgtgcccctcccgcagtacccctaggtcccgacaagtcgctgccacggcaacctgaggccgcagggcgggggaccccctactcccagaccacgatgggtaccttcgagtactcctgagccagcttctggtacttcccctgcaactcagccgaggccatggcctcccccgccccgtacaggccaggccgcccaggcggctcag

SEQ ID NO: 111527 - DNA, 299 bp, Homo sapiens
gggaatacaggcgtgagccaccgtgcccggccgaaacatcctgacatgatcttgttggtattttcttctctgtgtagacgcataagcgtcttaagcattcacatgcccgagtgggaggtgtgtgtccctatgtttgtgtgtacatgtatggataggccattaagatctggcagggtgaggcccgacaacagtggcacaattggcaggaggatttggtcctctcggtcactgggtgggtagagtcaggttcaaagttctggaggttttcccttctctatgatcagcaccaaatagaaacg

SEQ ID NO: 111528 - DNA, 272 bp, Homo sapiens
attcagggttgtcaggagctggtactacttgttcccaaactagaagttcaccaaaggactgacggccttcaggaggtaaacaatagcgatccctggagataatatgtgtctgcattcacccaggggcttattaaaaaaaaacagctttcagagaaagaacatacagagaaaggctgtgttaactcctggttactcagaacttctatctcatatccctgcgagtgagtgtctggcgataactcaagtcccaccttctcaggagtttgtatcag

SEQ ID NO: 111529 - DNA, 779 bp, Homo sapiens
gtgtgtgtgtgtttgtattttgatccaaatgcaaaacacatttcagtgtagccacatgtaactttattcataaatttacttatccaataatgatatttttattatccgccatgtgctacacactggaatgttctttttcttttttaacaaaattatatacatatcatttctgctcattaataacattaatgcaagatcataacttaaaaccgtgtgtaagtttcatatgtggataaaaatattgacttcctgatagactcgtctatcaagaactggtcccttgcctataaccaaatctaaataaataaagccattaaaaattgactatcccagacacttcatactcaacaacactaaaatgtcagcaaattttgaaataagatgattagcaatacacatttatctacttacctgtggctttcaataagcagaataaacaaaaaccagaatctcttgagaatagtaaccttccagaaatctgctttaatgactctaaaggactcaaggcctagttatctaaatgctgccaaaattgtttgtatttgatcaagacttaccttttctttaaaaccttccctgctcctactcaggcagaataattgcttcttcctttggtctccactgctcccagtagtcacttcgtttatttcattcctcataccatattgcaatcacaaatttatttggccattcccctgaggttcaggattatgaactttgacttatttatttttgtatcctgtaccttagcactgttcttggcacagagtggacatttg

SEQ ID NO: 111530 - DNA, 200 bp, Homo sapiens
ggaactcttatacacttttggtgggaatctaaattagtacagcctctatggacaacagtaagcaggttcctcaaaaaactgaaaacagaactatcgtaagatcgggcaataccactgctgggtatatatccaaaagagaaaaaatcgtcaggtacagtggcccacgcctgtaatgtgagcactttgggaggccgaggcag

SEQ ID NO: 111531 - DNA, 272 bp, Homo sapiens
tttttttaattaactgggcgaagtggcatgtgcctgtaatcccagctactctggaggctgaggtgggaggatcacttaagcccaggagatccaggctgcagtgagctatgatcctgccactgtactccagcctgggtgaaggggtgagaccctgtctccaaagaaaaaaaataaaagaggcctaaaaataaggcaaatgtctaaagggaccgctctataaacaaagtgggccagaattttagattctgaaggcagacaaggaatatacgtga

SEQ ID NO: 111532 - DNA, 360 bp, Homo sapiens
cctcagcctccctagtagctggggctacaggcacccaccaccacgcccggctaatttgtttgtatttttaatagagacggggtttcaccgagttagtcaggatggtctcaatctcctggcctcgtgatccgcccgcctcggcctcccaaagtgctgggattacaggcgtgaggcaccgcgcccggcctgtttctgtgtttccttggatgctaggctgcttggttgtgatgtgacctcagctctctaattggctcaagaaaagttatacttttgtcacttatcttttattgttcttagaatgggattgatgcattctggccttctacattttaggcggaaatagaatccacacacacaaaa

SEQ ID NO: 111533 - DNA, 240 bp, Homo sapiens
gtaaaagcataaaataatttaatccagtatagatatctgatttgtggtttagagtgcaaaatcttttcataaattattcatagaaagcaaaatatccttttctcctaatggtattaaatagaatagttttctgctctgctaggaatgcatattccggactccgtttgtttccttaccatgttattgtcagaggctctttagggcatcatctcttttatatatttatttatatatatataa

SEQ ID NO: 111534 - DNA, 515 bp, Homo sapiens
tgctggaatatctggcttacacagatgctcccacctgagcccctgtgtgcccagaagtgacataggcattcaggaaagggactgagggaggaaagaaggagccattcctcttcccaggggcgcctgccctgggttcctgagggacgctccatgtttacatctccaaagcccagtcccaaacacgccagagtgcaatgccctccctcagacccagggccatcctcagagcagccgggaggcagcctgtccacccttaccacaggcaggtcgcccaggcagcctcctcttagagctcctgaattctggagcatgaaatagaaatgtgaaaaacaggctggcgtggtggctcacacctgtaatcccagcactttgggaggctgaggtgggcagatcatttgagatcaggagtttgagaccaacctggccaacacagtgagaccctgtctctactaaaatacaagtaaataagccaggcatggtggtccacacctgcagtcccagttacctgggaggct

SEQ ID NO: 111535 - DNA, 281 bp, Homo sapiens
ctgctcagggctgaatcccaggtgacctgctctgaaaaataacttaacctctgtctgcctgtgaaatagtgatgtagtggcacccacctcatagagtttagtgaggattagatgagcaaatgcaggcaaatcccctggacctgagcaggcaatgctggctgttagcattcttgtttgctatttacctgcctagatgatgaagatcaggtgggagttgaaggtggggggatgcagaggatgtgggaagatgggcttgaagggaaagggaggcagggttacaa

SEQ ID NO: 111536 - DNA, 673 bp, Homo sapiens
gatagacagatagatggatagacagacaaataaaagacccaggtgactaaaatcaggaatgaaagggagaacatcactactgaccttctagaataaaaggattataaaaagaatactatgaacagcagtatgccatcaaattagataacttagatgaacaaaatcctagaaagatgaaatgactgcagtttactcaagaagaaacagagaatccgaatagaccaaaaacagagatattaaatttaaaattttctgacaaagaaaaaccaagggtcatatgaattccctggtgaattctaccaaacatttaaagaataataacacaaaatattccagaaaatagaagaggagggaacatttcaattatatctatatacatgagcaataaacaatttgaaaatcaaattaagaaaacaattgcagttataaataatagcatcaagaagaatataatatttagggatacatttttaaaatgaagtttaagacttgtaaatggaaaactacagaaatattcttgaaagaagttaaagaagatctaaataaatgaaaagacatctcatgttgttggatcacaacacttaatattgttcagatggcagtactccccaaattgatctacagattcaacgtaatctttatcaaactatcatctggctttttaaaagaaatt

SEQ ID NO: 111537 - DNA, 943 bp, Homo sapiens
gcaggcgattctcctgcctcagtctcctgagtagctgggattataggagtgcaccaccatgcctggctaatttttgtgtttttggaggagacagggtttcaccatgttggccaggctggtctcgaattcctgacctcaagtcatccacccacctcggcctcccaaagtgctgggattacaggcatgagctaccgcacctggccaccagttgtatctttttgcattccccagctcagaccccttccccactggaaggctgccatggtctttctgctctataccctttcctggttcctcttctccctccctctccagctgctttctggagcctgtcagagttgcagtgaggacaggaaggagaatgaaggcacaggacatttcttaattggctgggtggctttatgtcctctgaacctggcaggtggttggagctggtgtctttgggtgggtctggtaggtgatgcaagtgaacttttttttattctgaggtggtttctggcatttgaaatttccttgctggacttgttgcttttatagtttcttttcctaggaagctgcatctctgctgtgggtagtcatatgggacagcttcccagcacctggcattttgcagaccacagccagcttctttctgcagaggtctctggtctctatgtcctcatggttactttggaatcttgatatctgtccttttagttccatctcaacattcagttctagaatggctctttggagggtcaccatttgccaggcctcttctgtgttggagaaacacagaaaaggaacaagtacagtccaacatgattatatcaccattgatgggatagcaaccttgaaagatttccttataccgccacccctggtcatcttgtactgggtatctcctaaggcttcatgagtgacatatctatgacccattctcaggagtagagatttctgctga

SEQ ID NO: 111538 - DNA, 279 bp, Homo sapiens
agtgttgtacctgagtgaggtggggagaaagtaaggatgtgtgagcatgcagctctttgcccgtttgccttgggaaatgagtactggcttaccgcgtcctatgcgacagccttcgaaaaacaactctgctatcccagtctcgtcgtgtgtgaccttggacttctgccaaggcgtgggcctcagtttccctttattaccaaatgccgagtacttgtatgttgtcacttctgctgcacccgagggtccacaggatcgtgaagtgtctgcagtaaatgacat

SEQ ID NO: 111539 - DNA, 293 bp, Homo sapiens
tcatggatttatggatgatacacctctctaaaagtttctatacctgaggtataaactatattggataatttacactaatagtaaagcaaaatatttaaagaacaaggcaggatacaaacttactctttccccaaggaagtttccccaagatgttgtaagcaagaattcttgacaaaaatagccaaaccatgtactttgaggtttcgttcttcacaaagaattgcttttgtgaatccacaggctttattaacaggtagttttggccgggcacggtggctcacgcctgtgatctc

SEQ ID NO: 111540 - DNA, 241 bp, Homo sapiens
taaatttgggtttctttgcccatttttaaataatgcttacaaaagaatggctttgaataatgttaagtgactttaccttcagtggtgatcgaaagaaaattagtaatattcaatccattcttagtaccttgtgtaatgaacacgcatgcttgtttcacctataattacgactaaacaggaagttaataccttgtcagtgatgcagtgagatactgtgcagtgcctactgttaatccttaag

SEQ ID NO: 111541 - DNA, 263 bp, Homo sapiens
cagaaccccaggaccctgtcccttgttcctccttttcaggtgcttatacttaagtatacatgaagagagtgacaggaagctatccagatgtgggcggggtttctgacctggctggcatgttttagggtgagagggtagggtgccagctgttacatcgcctcctctttcccacagtgttagaatgaggagtgctttacgttactccagcgcccctttattcatttattcaatatgtttttactgaacctctactttcagtggtt

SEQ ID NO: 111542 - DNA, 309 bp, Homo sapiens
tctcgaactcctgacctcaagtgatccacccacctcagcctcccaaagtgctgggattacaggcataagccaccatgcccggcccaaatgggctaatgttttaaacagatccttcttgtctgccctgtaggaggacaaattatcaggggcaggggtggaagctggagcccagaaaggaggggactgcaggtgggaagtgatggtggctggaccaggatggaggccactgaggggtatgaagcagtcggatttgaagctgtttaaaaggtggaggtgagaggatttcatgaaggagcacatgaggacaca

SEQ ID NO: 111543 - DNA, 397 bp, Homo sapiens
agtagagatggggctttaagcatgttggccaggctggtctcgaactcctgacctcaggtgatccacccacttccacctctcaaagtactaggattacaggcatgagccaccacaaccagcagaacagctttaattgatccttaattgtatcttcttcccattcactaaacaaattttttttttctttttttttttgaatgggagtctcactctgttacataggctggagtgcagtggtgcgatttcggctcactgcaatctccacctctcgggttcaagtgattctcctgcctcagccttccaagtagctggaatgacaggcatacgccactacgcctggctaatttttgtatttttagtagagacagggtttcgtcaagttggccaggctggtctt

SEQ ID NO: 111544 - DNA, 266 bp, Homo sapiens
gaggccagacccaccaggggccccgtgccctcacccacaaagctcagattgagatggagtcaagaatttcatggtggggaccgcagagcctggtgggccagcctgctagaggggcagctcacagccaccatgcatgtccggagctggcagcggctctgcagaagcttctagatagttcccactgtcctgttgggatacagctctgtctgcataaaccaggatcgtccatagagcggggcgaggctcctcctcccccagagcagtgg

SEQ ID NO: 111545 - DNA, 690 bp, Homo sapiens
tacatattgaactcaggaagggactataattcatgaatcctcatagcatttgtatgaggctgaagaggggaatttgtaactctctgtgtttgttagatttttaaaaattaaattaaaactgatttcatatagagatgtttcaattatgtaatttagcctctaagatctcaaatcattgccctgtgctgcatttaagcgaataagcaaccaaagtttttaaagtcttgtatacattagataatatcctttaaaatcattctttcagaacaagtgcattggctccacccataagcttcatggcagctgttatgcctactttcttgttggtatccatgttccagaatcacacccagctgcctgcatttgcatcattgcatcatttgcatcattgcatcatttgcatcattgagggtgatagatgtctgaccttcagataaaggatgacgtctctatattttttcttacattgcccagtaaaaaatccagctggaattaaatcataccagatatttactcctgaggcaaaagtattttggggccaggcacggtggcttacgcctgttcatcctggcactttgggaggctgacgtgggcagatcactggaggtcaggagttcaagaccagtgcagcctgcatagtgaaaccttgtctctactaaaactacaaaaattacctgggcatggtggtgg

SEQ ID NO: 111546 - DNA, 531 bp, Homo sapiens
ttaattatgaaggtcagctttcatttgctgtgaaaacaacacggataatttgggaccataatacgttctgaaatagttcaagacaagcatgttaaaaatgagggtttttttttttccccactgaaccttccctcaagattttattgtcttcataataaaagatgatgcttagaactagttaatttggctctttctcttcttttctcctcccggttcaaaatgcttgcttctcttaataggcagcattctcttagatttgcaactgggctcaaagcactgaagcctcatcacagtcttctttttggcagtagcctttttacagaattccaggatcatgaccctgcattccagcctgtctgaaacagtgagaccctgcctcaaacaaacaaacaaacaaattcatttggctgtgtcttccacctgaaatcagattgggatctcatagtactacagctctcatagcattcaggtagatggagctagaaataagcccaagtatgcattttccttcaggactttttaacactaagc

SEQ ID NO: 111547 - DNA, 728 bp, Homo sapiens
atatcagcattagtatattttatgtctttttaatttgaggtaattagattttttaatttttaaaaagaatggaataggaatcattaaaaacagactaaagtaacatgaaatcttaagatgctacatataaaatacatcactttaaatatgaaactaatttttaaagtcctgcagattaatctgttggagatatatattgaaacccactttcagagacattaaaatgcggggtaaaaagtgcattttagaactgataaactacttcatcaatgattttaatggttccttttctttagattttcaaattcgttgatattggcaaacagaattggctttcagttttcagtctctgtatatatatttgtatttctactcatagttttatttttaaaccactttattcctctaaattgatttgaaggagtcccattcattttacttgttttttttttaaaaaaaaccttatctgggttttcttcatgcttttgactatttttgtttgctttttctatttcaaaaatatatttcactattttctttttatttgtgtgtatttctgttgagtacatgtgcttggttaatatattttcagtctcttttaaattggaagcatttaaggctacaagatttcctttgaatattgctgtatctggggcccatggtttttttttcttcttgagatggagtctcgctctgtcaccaggctggagtgcagtggcgtgatctcg

SEQ ID NO: 111548 - DNA, 1020 bp, Homo sapiens
ttaattaaataagggttactggaacacaagcactgtgacactgtgacagtaaacctgatcaccaaggtggctatgaaagtgactaatgagtgggaatgtctacagtgtggagacactgggcaaagggaggactcatgtcctggggaggaaggagcgggacagtgagagatttcatcctgctgctcagaatggcatgcaacagaaaacttatgaattgtttatttctggaatttttccatttaatattttcagaccatatttgactgaaggtaactgaaggtaactgaagcctcagacagcaaaattgcggataaggggactactgtatacccatctccatttgcacctctggtaactgtgagatcagaatgtgcagcagaaggctgtgtgcctcacaataaccatggagttctgctcaatctgctgccttggcgactctggatctctcttccaatagtaaaatgtcacactgcaaactctgggcctggggtcccatgggacttcagtggttccaggactgatttcactgccatcacttatatatggttagatatggattcaacttgtttgctgtgaggttaagtgtctgaatgtctacatgtctatacatctttaaaactacacacaaaaattgctaaagacaagaaatttgggaatattaaatttacaatacaatttaggaaaccaaacagaaaggaggtatactaactgggttagaagattatagctgtaaattgttgggacttaagaaaaaccacacatttagacaaatagtttctcaatcttctttatgcagaaactcttactattcaacatatctcccctacacccacacccaaagagcagtcagtttagatacaagtttgagaaacagaaaggaggggacaaaggttggaggatgtcaaggccaaaggataggcctctcctctagttcagaggactctttgtctgcctcacaccctcttctccctggggactggctgtgtgctgactgtccccctgctgggatacatgaacagt

SEQ ID NO: 111549 - DNA, 2146 bp, Homo sapiens
ttaattaaataagggttactggaacacaagcactgtgacactgtgacagtaaacctgatcaccaaggtggctatgaaagtgactaatgagtgggaatgtctacagtgtggagacactgggcaaagggaggactcatgtcctggggaggaaggagcgggacagtgagagatttcatcctgctgctcagaatggcatgcaacagaaaacttatgaattgtttatttctggaatttttccatttaatattttcagaccatatttgactgaaggtaactgaaggtaactgaagcctcagacagcaaaattgcggataaggggactactgtatacccatctccatttgcacctctggtaactgtgagatcagaatgtgcagcagaaggctgtgtgcctcacaataaccatggagttctgctcaatctgctgccttggcgactctggatctctcttccaatagtaaaatgtcacactgcaaactctgggcctggggtcccatgggacttcagtggttccaggactgatttcactgccatcacttatatatgatgatgcagacttcaagcatcaaagtacacaaactgaagaaactttatcctttgtatataattatcttaaatatatgccatcatttcaaggggagcttatgctaagtgtgacttcataaacaaatcatttgtgaaagagaaaaaccacatccagggtaaagtcataaggtgaaaaagcctatttcagagagcacttcctgaaagagacaaagcagcaattaaagtcagcccagcaccaactccgacgccaagcgttacactggaaactactttttaaagcaacaaaagagtctaaaacaaaatacaacatttcttaaatacactgtttccagaaagagctattttaacagaagcaactcaaagatatcccttcgacagaagtggaagtgctgaaaaatgctcatctctcacacagacttttgatggacaggagtttctaagtatcatgcctaccaacaagctgtaaaatgatcaccctgaacaatcaagatcaacctgtcccttttaacagctcacatccagatgaatacaaaattgcagcccttgtcttctatagctgtatcttcataattggattatttgttaacatcactgcattatgggttttcagttgtaccaccaagaagagaaccacggtaaccatctatatgatgaatgtggcattagtggacttgatatttataatgactttaccctttcgaatgttttattatgcaaaagatgaatggccatttggagagtacttctgccagattcttggagctctcacagtgttttacccaagcattgctttatggcttcttgcctttattagtgctgacagatacatggccattgtacagccgaagtacgccaaagaacttaaaaacacgtgcaaagccgtgctggcgtgtgtgggagtctggataatgaccctgaccacgaccacccctctgctactgctctataaagacccagataaagactccactcccgccacctgcctcaagatttctgacatcatctatctaaaagctgtgaacgtgctgaacctcactcgactgacattttttttcttgattcctttgttcatcatgattgggtgctacttggtcattattcataatctccttcacggcaggacgtctaagctgaaacccaaagtcaaggagaagtccataaggatcatcatcacgctgctggtgcaggtgctcgtctgctttatgcccttccacatctgtttcgctttcctgatgctgggaacgggggagaacagttacaatccctggggagcctttaccaccttcctcatgaacctcagcacgtgtctggatgtgattctctactacatcgtttcaaaacaatttcaggctcgagtcattagtgtcatgctataccgtaattaccttcgaagcatgcgcagaaaaagtttccgatctggtagtctacggtcactaagcaatataaacagtgaaatgttatgaataataaggttctttcatttcaatcccatcaaaattcacttcactaactactctggcgtcaatggatattctgtataatactatcaagtcccttttctcttgaaaaaataaattcattatcttcattttaaaaactta

SEQ ID NO: 111550 - DNA, 2180 bp, Homo sapiens
ttaattaaataagggttactggaacacaagcactgtgacactgtgacagtaaacctgatcaccaaggtggctatgaaagtgactaatgagtgggaatgtctacagtgtggagacactgggcaaagggaggactcatgtcctggggaggaaggagcgggacagtgagagatttcatcctgctgctcagaatggcatgcaacagaaaacttatgaattgtttatttctggaatttttccatttaatattttcagaccatatttgactgaaggtaactgaaggtaactgaagcctcagacagcaaaattgcggataaggggactactgtatacccatctccatttgcacctctggtaactgtgagatcagaatgtgcagcagaaggctgtgtgcctcacaataaccatggagttctgctcaatctgctgccttggcgactctggatctctcttccaatagtaaaatgtcacactgcaaactctgggcctggggtcccatgggacttcagtggttccaggactgatttcactgccatcacttatatatgatgatgcagacttcaagcatcaaagtacacaaactgaagaaactttatcctttgtatataattatcttaaatatatgccatcatttcaaggggagcttatgctaagtgtgacttcataaacaaatcatttgtgaaagagaaaaaccacatccagggtaaagtcataaggtgaaaaagcctatttcagagagcacttcctgaaagagacaaagcagcaattaaagtcagcccagcaccaactccgacgccaagcgttacactggaaactactttttaaagcaacaaaagagtctaaaacaaaatacaacatttcttaaatacactgtttccagaaagagctattttaacagaagcaactcaaagatatcccttcgacagaagtggaagtgctgaaaaatgctcatctctcacacagacttttgatggacaggagtttctaagtatcatgcctaccaacaagctgtaaaatgatcaccctgaacaatcaagatcaacctgtcccttttaacagctcacatccagatgaatacaaaattgcagcccttgtcttctatagctgtatcttcataattggattatttgttaacatcactgcattatgggttttcagttgtaccaccaagaagagaaccacggtaaccatctatatgatgaatgtggcattagtggacttgatatttataatgactttaccctttcgaatgttttattatgcaaaagatgaatggccatttggagagtacttctgccagattcttggagctctcacagtgttttacccaagcattgctttatggcttcttgcctttattagtgctgacagatacatggccattgtacagccgaagtacgccaaagaacttaaaaacacgtgcaaagccgtgctggcgtgtgtgggagtctggataatgaccctgaccacgaccacccctctgctactgctctataaagacccagataaagactccactcccgccacctgcctcaagatttctgacatcatctatctaaaagctgtgaacgtgctgaacctcactcgactgacattttttttcttgattcctttgttcatcatgattgggtgctacttggtcattattcataatctccttcacggcaggacgtctaagctgaaacccaaagtcaaggagaagtccataaggatcatcatcacgctgctggtgcaggtgctcgtctgctttatgcccttccacatctgtttcgctttcctgatgctgggaacgggggagaacagttacaatccctggggagcctttaccaccttcctcatgaacctcagcacgtgtctggatgtgattctctactacatcgtttcaaaacaatttcaggctcgagtcattagtgtcatgctataccgtaattaccttcgaagcatgcgcagaaaaagtttccgatctggtagtctacggtcactaagcaatataaacagtgaaatgttatgaataataaggttctttcatttcaatcccatcaaaattcacttcactaactactctggcgtcaatggatattctgtataatactatcaagtcccttttctcttgaaaaaataaattcattatcttcattttaaaaacttatataaaacatttttgtgaattattcagagaaaag

SEQ ID NO: 111551 - DNA, 2177 bp, Homo sapiens
  misc_feature (1822)..(1822): n is a, c, g, or t
  misc_feature (1824)..(1824): n is a, c, g, or t
  misc_feature (1826)..(1826): n is a, c, g, or t
ttaattaaataagggttactggaacacaagcactgtgacactgtgacagtaaacctgatcaccaaggtggctatgaaagtgactaatgagtgggaatgtctacagtgtggagacactgggcaaagggaggactcatgtcctggggaggaaggagcgggacagtgagagatttcatcctgctgctcagaatggcatgcaacagaaaacttatgaattgtttatttctggaatttttccatttaatattttcagaccatatttgactgaaggtaactgaaggtaactgaagcctcagacagcaaaattgcggataaggggactactgtatacccatctccatttgcacctctggtaactgtgagatcagaatgtgcagcagaaggctgtgtgcctcacaataaccatggagttctgctcaatctgctgccttggcgactctggatctctcttccaatagtaaaatgtcacactgcaaactctgggcctggggtcccatgggacttcagtggttccaggactgatttcactgccatcacttatatatgatgatgcagacttcaagcatcaaagtacacaaactgaagaaactttatcctttgtatataattatcttaaatatatgccatcatttcaaggggagcttatgctaagtgtgacttcataaacaaatcatttgtgaaagagaaaaaccacatccagggtaaagtcataaggtgaaaaagcctatttcagagagcacttcctgaaagagacaaagcagcaattaaagtcagcccagcaccaactccgacgccaagcgttacactggaaactactttttaaagcaacaaaagagtctaaaacaaaatacaacatttcttaaatacactgtttccagaaagagctattttaacagaagcaactcaaagatatcccttcgacagaagtggaagtgctgaaaaatgctcatctctcacacagacttttgatggacaggagtttctaagtatcatgcctaccaacaagctgtaaaatgatcaccctgaacaatcaagatcaacctgtcccttttaacagctcacatccagatgaatacaaaattgcagcccttgtcttctatagctgtatcttcataattggattatttgttaacatcactgcattatgggttttcagttgtaccaccaagaagagaaccacggtaaccatctatatgatgaatgtggcattagtggacttgatatttataatgactttaccctttcgaatgttttattatgcaaaagatgaatggccatttggagagtacttctgccagattcttggagctctcacagtgttttacccaagcattgctttatggcttcttgcctttattagtgctgacagatacatggccattgtacagccgaagtacgccaaagaacttaaaaacacgtgcaaagccgtgctggcgtgtgtgggagtctggataatgaccctgaccacgaccacccctctgctactgctctataaagacccagataaagactccactcccgccacctgcctcaagatttctgacatcatctatctaaaagctgtgaacgtgctgaacctcactcgactgacattttttttcttgattcctttgttcatcatgattgggtgctacttggtcattattcataatctccttcacggcaggacgtctaagctgaaacccaaagtcaaggagaagtccataaggatcatcatcacgctgctggtgcaggtgctcgtctgctttatgcccttccacatctgtttcgctttcctgatgctgggaaccgcggggggggagaaaaaccaagttttttaaacnananttcccccctggggggggaggcccctttaccaccttcctcatgaacctcagcacgtgtctggatgtgattctctactacatcgtttcaaaacaatttcaggctcgagtcattagtgtcatgctataccgtaattaccttcgaagcatgcgcagaaaaagtttccgatctggtagtctacggtcactaagcaatataaacagtgaaatgttatgaataataaggttctttcatttcaatcccatcaaaattcacttcactaactactctggcgtcaatggatattctgtataatactatcaagtcccttttctcttgaaaaaataaattcattatcttcattttaaaaactta

SEQ ID NO: 111552 - DNA, 2338 bp, Homo sapiens
ttaattaaataagggttactggaacacaagcactgtgacactgtgacagtaaacctgatcaccaaggtggctatgaaagtgactaatgagtgggaatgtctacagtgtggagacactgggcaaagggaggactcatgtcctggggaggaaggagcgggacagtgagagatttcatcctgctgctcagaatggcatgcaacagaaaacttatgaattgtttatttctggaatttttccatttaatattttcagaccatatttgactgaaggtaactgaaggtaactgaagcctcagacagcaaaattgcggataaggggactactgtatacccatctccatttgcacctctggtaactgtgagatcagaatgtgcagcagaaggctgtgtgcctcacaataaccatggagttctgctcaatctgctgccttggcgactctggatctctcttccaatagtaaaatgtcacactgcaaactctgggcctggggtcccatgggacttcagtggttccaggactgatttcactgccatcacttatatatgatgatgcagacttcaagcatcaaagtacacaaactgaagaaactttatcctttgtatataattatcttaaatatatgccatcatttcaaggggagcttatgctaagtgtgacttcataaacaaatcatttgtgaaagagaaaaaccacatccagggtaaagtcataaggtgaaaaagcctatttcagagagcacttcctgaaagagacaaagcagcaattaaagtcagcccagcaccaactccgacgccaagcgttacactggaaactactttttaaagcaacaaaagagtctaaaacaaaatacaacatttcttaaatacactgtttccagaaagagctattttaacagaagcaactcaaagatatcccttcgacagaagtggaagtgctgaaaaatgctcatctctcacacagacttttgatggacaggaggtgctgctttctgtgaaccactgaagtagagcagctgaaatcacaaaacctggaagacttggctttacgtactcccaattgtgcactagaaaacagctcatctattgctctaacagtctagttcttgatctgctgaccatgacacaaaacattgctgtttctcgacctatgataatttaaagagaacataagtttctaagtatcatgcctaccaacaagctgtaaaatgatcaccctgaacaatcaagatcaacctgtcccttttaacagctcacatccagatgaatacaaaattgcagcccttgtcttctatagctgtatcttcataattggattatttgttaacatcactgcattatgggttttcagttgtaccaccaagaagagaaccacggtaaccatctatatgatgaatgtggcattagtggacttgatatttataatgactttaccctttcgaatgttttattatgcaaaagatgaatggccatttggagagtacttctgccagattcttggagctctcacagtgttttacccaagcattgctttatggcttcttgcctttattagtgctgacagatacatggccattgtacagccgaagtacgccaaagaacttaaaaacacgtgcaaagccgtgctggcgtgtgtgggagtctggataatgaccctgaccacgaccacccctctgctactgctctataaagacccagataaagactccactcccgccacctgcctcaagatttctgacatcatctatctaaaagctgtgaacgtgctgaacctcactcgactgacattttttttcttgattcctttgttcatcatgattgggtgctacttggtcattattcataatctccttcacggcaggacgtctaagctgaaacccaaagtcaaggagaagtccataaggatcatcatcacgctgctggtgcaggtgctcgtctgctttatgcccttccacatctgtttcgctttcctgatgctgggaacgggggagaacagttacaatccctggggagcctttaccaccttcctcatgaacctcagcacgtgtctggatgtgattctctactacatcgtttcaaaacaatttcaggctcgagtcattagtgtcatgctataccgtaattaccttcgaagcatgcgcagaaaaagtttccgatctggtagtctacggtcactaagcaatataaacagtgaaatgttatgaataataaggttctttcatttcaatcccatcaaaattcacttcactaactactctggcgtcaatggatattctgtataatactatcaagtcccttttctcttgaaaaaataaattcattatcttcattttaaaaactta

SEQ ID NO: 111553 - DNA, 1458 bp, Homo sapiens
ttactttgaaaattgttaaaatttaaataatattgaagcttctgaatctagatggaatgaggatatgaaagttactaacggcactagcttttttcaaggtgctgctttctgtgaaccactgaagtagagcagctgaaatcacaaaacctggaagacttggctttacgtactcccaattgtgcactagaaaacagctcatctattgctctaacagtctagttcttgatctgctgaccatgacacaaaacattgctgtttctcgacctatgataatttaaagagaacataagtttctaagtatcatgcctaccaacaagctgtaaaatgatcaccctgaacaatcaagatcaacctgtcccttttaacagctcacatccagatgaatacaaaattgcagcccttgtcttctatagctgtatcttcataattggattatttgttaacatcactgcattatgggttttcagttgtaccaccaagaagagaaccacggtaaccatctatatgatgaatgtggcattagtggacttgatatttataatgactttaccctttcgaatgttttattatgcaaaagatgaatggccatttggagagtacttctgccagattcttggagctctcacagtgttttacccaagcattgctttatggcttcttgcctttattagtgctgacagatacatggccattgtacagccgaagtacgccaaagaacttaaaaacacgtgcaaagccgtgctggcgtgtgtgggagtctggataatgaccctgaccacgaccacccctctgctactgctctataaagacccagataaagactccactcccgccacctgcctcaagatttctgacatcatctatctaaaagctgtgaacgtgctgaacctcactcgactgacattttttttcttgattcctttgttcatcatgattgggtgctacttggtcattattcataatctccttcacggcaggacgtctaagctgaaacccaaagtcaaggagaagtccataaggatcatcatcacgctgctggtgcaggtgctcgtctgctttatgcccttccacatctgtttcgctttcctgatgctgggaacgggggagaacagttacaatccctggggagcctttaccaccttcctcatgaacctcagcacgtgtctggatgtgattctctactacatcgtttcaaaacaatttcaggctcgagtcattagtgtcatgctataccgtaattaccttcgaagcatgcgcagaaaaagtttccgatctggtagtctacggtcactaagcaatataaacagtgaaatgttatgaataataaggttctttcatttcaatcccatcaaaattcacttcactaactactctggcgtcaatggatattctgtataatactatcaagtcccttttctcttgaaaaaataaattcattatcttcattttaaaaactta

SEQ ID NO: 111554 - DNA, 598 bp, Homo sapiens
ggtgatggaaatttataagtttctacatacacatcaagttactgaatgacttcttattaatatctacttgtcttagatactccttttttggatttactttgaaaattgttaaaatttaaataatattgaagcttctgaatctagatggaatgaggatatgaaagttactaacggcactagcttttttcaaggtgctgctttctgtgaaccactgaagtagagcagctgaaatcacaaaacctggaagacttggctttacgtactcccaattgtgcactagaaaacagctcatctattgctctaacagtctagttcttgatctgctgaccatgacacaaaacattgctgtttctcgacctatgataatttaaagagaacataaggtaataaatattatgaagtgtttccactttaaaaaaaacaaaaagtttaatagccagctacacaagtcttcattttcaaactagagaattacaaactagagttttttagcaaagtagagttgctgtgaatcatctcatcaaaagttccttcatttattcatcaattcagtaaatatttatttattgagtacctattacatgctcaatagacagtg

SEQ ID NO: 111555 - DNA, 216 bp, Homo sapiens
ataatcttctagagagtgactttactttttcacttccttaatggtgttttttgataaacagtggtgattaattttgatgcagtccgttttatggaccttttttcttattgttcattgtgccctgttataggaaccttcccctatcccgagggcataaagatattctcatgtttttttgagatggagtttcgcttttgttgcccaggcttgagtgcg

SEQ ID NO: 111556 - DNA, 396 bp, Homo sapiens
acacatacacacagtccacacatgcacatcagtccacatacattgcacacacttgcacatagtccacacacatgcatacatacaacacatcaacacacacatatacaaatgtgtgcacacatacagtccacacatatacatacacatacacacagtccacacacacatgctcacatgcacaaacatacacacatacacagacacacacacacacacgtgtattcatagaaatcctgaatccaaccttggattcctcaggggcatccagttaagacccagagagggccatgcactgtaggtaacagcacagcctctgaagtccttctgcccagggttcaattccagcttgcccactttttagccgtgtgacattgactgtgttcgtttacttctcta

SEQ ID NO: 111557 - DNA, 383 bp, Homo sapiens
tgacctcaggtgatctgcccacctcggtctcccaaagtgctgagattacaggcataagccactgggcccagccaaatttcacacctttctgaggagagcaatgaaatctcctgttgtctcataccatccgagagtagaagcatcctttgtccagctattcacgatgtctgtctacattcgctgactgtctgcactccctgcctgttagccactcaggagccctctgcgtatcaataattgtcgtagtctagtagtgcttgtgttcaaggagcccttattttacttcttaatgaccccaaagcccgagagtagtgatgccggcaattcggatgtgccaaaaagaagccgtcaagtgcttcctttaagtgagaaggtggaagttc

SEQ ID NO: 111558 - DNA, 659 bp, Homo sapiens
taatgtaagatgtgatatcttttcagcaggacctaaggagattttctcgaaagaaaaggggaaaatgccgctcttaagcaaaaaatctggaccatgttggcagacatacgtctttgaaacataccagcagagaattatttaatcatttgccccttagttttatcttgatcactcctagcgtgattttttccccctcttagttatgcagcagcctactggctgacatttaactattgattgttcatcctggggaatgaattactgtgatttatagtcaagggtacagatgtaaagagacagaaaggatcagatgtttctagtgccttttttcttcctctgatggcttctcccagaaacttgataaaagcaccaacactaaaacatgtttacaataagaaagctgtttattcatcttaagtagaaaattctataagtttatgtaaaattttgcccatgtgggaacaattagtcttttaatttgagttgtgtattgtaattccatggatggagatgggtggaggttgggccgaggggaagctgaggtaagaagccagaccagagaatttaaaatgatgtctttctttgaggatgccccctttgcccctcctgctgggcctcgcagccgtgggattggccacatcacttcctgtccaagttgg

SEQ ID NO: 111559 - DNA, 744 bp, Homo sapiens
atccaggatccggcatgcgaatgggatgcttaattttgggggatatattttgctctccagctctgcctgtttgttaggccctagaaactgcatgctttccctgccctatttctcaaagggctccaccctgatgccagtaatccaattaagaaactttaaaactggctaatggaaaaaccttacaactactggatcttcttctgtctatgtgttaatatgtgttatgtatgtgaggtttatataaaatagctctgattaattttactgaaaataataaatgcttaaatcaaatgtttttgtcagaaaaatagaactttaacactttttggttcatgtgactatagtaatctttgggaaataaagacagttttaaagattattgataaaataaaaatgtgaaaatttagacatctggtctaaattaagcaggtcagatactgtgttcactaaactacttaaactgcttttttgacttttgatagttgtgcgacttacctgctttggagccatttggttctaggtaaggcctggagaaatgtggagttagctatgcaccctggctatactggaaatagttagaccttacctgtacttctgtctggcatcctggactccacatctggtacataattaaaatcacctacttaccaggtttttcatcaaaaataaaagcttttaagagttaacactataatacatgtaattgagagtaccggagaaacagttttacgtgcaaggtgtgta

SEQ ID NO: 111560 - DNA, 710 bp, Homo sapiens
gtaaaaataaaaactaattttaaaataaatgagaagaaactaggctagaaaggggctaggatattggaagagaacatctacaaagataatggagtcaccaagaatacggcaggaattcgactgtattaacaggactatgggcaaggaacggaaatcttaatttaagaagaagaataaatgataacaaggcacgtgaagttcaaatggcgtaaacctcataaaaaatgcttacgagagagatttttgcaagacagaggaggccgtgttctaaaatagactttactgagatttaacagttctgtctaatacattttattctaatatataccaactactgtacaaacttcctatgtgcctgacagtgtgcttttaataaagaattaaatcatctgaaagtacattttataatatcatggacattaattttctgtgttgtgtttccattagtccaagagccttttctgtgagaaactaatgggaagacctataattcattctaagaaagtttattctctgttattctcttattcctagttaacttcttgaaaatataagcgtttatgacaaaaataattagttgaagttatggcaagatcagctaaagttttctgctatcataatgtgacaaaaccaattgaattttaagtttaggtttttccatttcttctaatgttgacttttagctactgaactagacagtgtgcctgttg

SEQ ID NO: 111561 - DNA, 1054 bp, Homo sapiens
  misc_feature (2)..(2): n is a, c, g, or t
  misc_feature (4)..(4): n is a, c, g, or t
  misc_feature (6)..(6): n is a, c, g, or t
  misc_feature (611)..(611): n is a, c, g, or t
tntncncccttgtgaagaattactaaagaggactgtggccaggctcagtggcttacgcctgtcatcccagcactttgggaggtcaaggcaggaggatcatttgagcccaggagttcaagaccagcctgggcaacatagtgaacccctgtctacacacagtcaaaaaattagctggacgtggtggcctgcacgtttggtcccagctacacggaaggctgaggcaggaagattgcttgggcccaggcggtcaaggctgcaatgagccgtgttcatgtctgtctctgaataaataaataaaaaggactgtgaaagacattctagtcataatgacaacctcatatatttataataaactcgtttatgtcaaaggagtatatctgattacttgttctacaatcggttttgctttatttcattttcacgggaattcagacacctgaaattatttagattttattgtattgtttgttaatgacaaacttacccgttattatactagtttcataatttactcttgtatctctatactaaattgtttggtctttaaaccatctatatagcttagtgtcttatttatacagtctaaatgtctgtgtcaaataatgcagaantaagttaaacttttgtctcttatagattttaatgtttgtaatatgcgtttaagtgtattagcaagatattaccatctctttaggctatgtatactaatggagatttttaagtcacctaactaaagaactaaagaaacttattttttgtattgaaatgttattggtctttgggtcttataccgaaagtgatttttggctttgctgcagattttaacttttctgtccgcagaaatttaattttgcgtatataaacttactgaaattagacaagtcaaattatacaaatattttcagattgtctcatttttcatatttcttgtctaacaatttatgtgaatattttcaggtcgtctaattttacatatttcatctctaagaattcaagccaaaattctcaaccctagctgagaattggcactacctgtagttaattgaaaaaaaaa

SEQ ID NO: 111562 - DNA, 565 bp, Homo sapiens
taccggtcactctagtccaagagtgcagctataggcgggtgagccggtgtgactgtggcagtgtatgtgcgtgtgaggagggagtggtgtaagaaaaccgtgacaagaaatttcctggctgatgctattgggagcagatcccagagttcagggaatttaacctgagcattgctggaccacatctagaaagtgtcattgagttctaggggctgacttcttggttagacttgggccaaacagtcagtgcccatgagaaggagccaggacagccagaggcctggaaacctctatgaatgagggaacacgattatcattttcatgtgaaagagagcagacaatggctctgttttttaagggtagaatctgggtgttcagggagttagatttgggcttaacctgaggaaagctttcttgcagcaagacttgggaagcagaggaattgtttacttgggtaagtgaattagtgtcttgacctccaaggtcaggtggaccccttggcatgctgcagaagggtttgcatgagggcaatttaagatggttagtctgacttgtggcttcaggcttt

SEQ ID NO: 111563 - DNA, 263 bp, Homo sapiens
ttaaacatttttcttctaatttattgtcagttgctccactccattactaatcagctgcatgatctcgaactggctctccctttcaagccctgagggtgagaactgatctgccaggctcgaggaagggcttaatttcacatttacaaaaagaggcgtattcagaaaatggccctttgacacagctaagaaaatctgacatgaataaattttctgtagcatcaaatgcaaagtgtgatgaaaataatttttttaagatttgattt

SEQ ID NO: 111564 - DNA, 388 bp, Homo sapiens
cacaggcaccagtggcaccagagctgtgtcaggccctgggggcctactatatgctgtgtctgattctgtcttcaggcagcatatcggcatttgatcataagaaaacaagcaaatgcaaatgtgattatgactgatcccagtgccatcaaggaaacccaaagactgcatagatggagaatacagggaggacttattctagaagggcagctggggaagaattacttgaggaggtgacatcattgagctgaaactcaggaatgaataggagccagcaatgggaagggacagaggaaggacattccagacagcggggacagcaggagagaaggacctcaggcaggaagggcttggtgggcttgagaaactgagaagtctgtaggggacccta

SEQ ID NO: 111565 - DNA, 292 bp, Homo sapiens
ctgatacttaggtgaggggctcctgtggtctcaggcttgcgctggacctggttcttagcccttgggcactgcaccctgtttaacatcctggctctgaacttaggcctggttctctggctaatatcatgacaacatgcaaaggcaggcaataaagacttaagatagaactgccaacatttttcttttcattcaccccttaggtttaataactccatgtgtatcctataggtctctgtaaataaaaaacaaaatttgttgattaaattttaaccttaatatctaaggatctggt

SEQ ID NO: 111566 - DNA, 275 bp, Homo sapiens
aaattgcaccattgaggaccagaaaccatgaaatagcatggaatatttagggaaccataagatctttatagctgaagcaaaatatgcttgggtggaaatttgggagccacttctagacaaataggagatgctctataccaagtggtctgtactaagaaatttacctttttttttttttcttagacagggtcttgctgtgtcacccaggctgcagtacagtggtgcaatcttggctcactgcagcctctgcctcctgggctcaagcagtcctccca

SEQ ID NO: 111567 - DNA, 223 bp, Homo sapiens
ttccattccattccattcgggttgattctattcagttctttacactgcattcgattccattccattccacacaattccattccattccattccagttgggttgaatccattccattccatttctttccattccattctattccgtacctttccattccattgcattccacttcattgcattccgttgcattccattccattcgagttgattctattcaattcc

SEQ ID NO: 111568 - DNA, 545 bp, Homo sapiens
gggtcttgctttgttggccaggttggtgttgaactcttggccttaagctatcttcctgtcttggcctcccaaagtgctaggattacaggtgtgagccaccaggcccggccaggtatatgtatttctatgtttctcccttcctctcaattcatcctatatactaccaactgagttacctattttgaaaccccattgtttaaattcttccatgacttctaggttaagttcaaactctaagaacagcatgctaaccctctgtaatagctgtgtgtgtagtcatctctctccatccttccatataacatctcatatcctactctcattgaatgtcctctcatccccctgaaaaaactctaccctctcaagctttctagggctttgtggatactgtaactctgcttagagagtcattgctcatctcttaattcttattcacattttgacagtcatcatagttatcaaaaagttacccaattcagcaagactggattaagtatctttgccatgtactcccacaacatcctgggctttcacttccataacaa

SEQ ID NO: 111569 - DNA, 472 bp, Homo sapiens
cacctccctcccactacagtgtgtctagtgcttaaggacgacggggacggacagatttaaagccaaatctgtcttggcttggactcttgttgcatattagccatgtggatttgtgcaagttatataatccttgtaggttttgttttttcgtttataaaacaggaatctctcaggactgatgcaaggattggatgaaaagatctaaagccttctgtgaggtctggcacatggtaagcactcacatggtcgttaaagctgtgctgcccatgatggccgccactggccacaggtggcacttgagcacttgagacatggctagtacaaactgagatgtgctgtgtgaaacacacactggattttgaagatgttgtatgaaacaaagaatgtaaaatatttcatcaattttttacatttattacatatttaaatatttttggatatattgggttaaataaaatatattattagaatt

SEQ ID NO: 111570 - DNA, 412 bp, Homo sapiens
gggcatcctgtgttttatctggcaatcctgagaagagtcttagaatgcttgaaaagagctttaaacatcatttcttaaaatgccaagcctccctttggtggcactccccttatagctgagtgtaagctctagatgacaggcacgtgggtgccaggaggccaggacctaggagcgggacgctgactctctgcagccctctcctctcactctcttttcccttccagtcacagtcactgcagcagacatcatggctgtggatgtggcagaataccatctgagcggtgagtgcccagggcaaacccctcctggatcacgcctgcgagacccttacaccaggcctgggtgggaggtgtctgtgggacatgaataattagtccttgccattaatgtcttcactgtcaaggacagtcag

SEQ ID NO: 111571 - DNA, 702 bp, Homo sapiens
aacacgagtgaggaatgggaggccggagcggggagcagagaggaaacggaaggtctcgggagttgaacttggggagggtgacaagggccaggtcatagccggcttcctaggctgtggtcaggacttgacttttattaggttggtgcaaaagtaattgtgatttccgccattactttttttttttttatcagagcctgtctcggtcacccaggttggagtgcagtggtgtgatcttggatcactgcaacctccgcctcccacattcaagccattttcctgcctcatcctcccaagtagcaggaactacaggcgcacaccaccacccccagctaattttaatttttgtaattttagtagagatggggtttcaccatgttgcccaggctgatctcaaactgctgacctcaagtgatccacctgcctcggtctcccaaactgctggaattacaggtgtgaaccaccatgcccagtcaatttctgccattacttaggagacggaagaagtcatctatacattttaagtcaggcagtggtgtgacccaatgggtatttctaaaagattacagaggccatgcaggaaagatggtttcatatggtctgtggttgcttttgcactacaacagcagagctgttatatttgcaacagagaccacatggcccataaacctgcaatagttcctatctggccattcactaaaagag

SEQ ID NO: 111572 - DNA, 225 bp, Homo sapiens
taattgccaaatccagtggctcttcctcagcttctgttctccttgcctctgttaaatttggctccttcagaccctctcttctttggatccatgctagtccgctgtcttctcttacatctgactgcccacttgcctccttcattgacttttcatattcctccttccctaaagggtaggctttattcaggctttcttcccttccccacagcccaccaagacttcatc

SEQ ID NO: 111573 - DNA, 386 bp, Homo sapiens
tacgcactccttagagaatctaatgcctgatgatctgatatggaagtttcatcccaaaaccttttccccactttggtctatggaaaaactgtctgccacgaaaccggtccctggtgtcaaaaaggttggggactgctgctgtaaaactatccttcaaaaatgaagatgaaatgaaggtattttcagataataaaaggtgaaacaatgtgtcagacctacaccatgaaaaattctaagcaaggtcttcaggctaagaactaaaaataaaatcctaagcactccaactgactgaacaaagcctgttttggttccagccatgacaagatgccttgggacgcacctcattatattccctcccttttgtagttcaggcacaactgaccagc

SEQ ID NO: 111574 - DNA, 352 bp, Homo sapiens
gcctactactactactactaccaaattcgcggccggtcgagtgtgaaaagaagccttggtgggttgtaaagagtcattaacaggaggtacgtgaggaacgtgttcagtagaagactaacaggaagcttgtagattaggagtctgctctcagctcttccctggactggcagtgtagccttggtaaagtcactgagctactctgggccatcatttcagagtttgaattagaaaagagattttccagctctaaaaatccatgctgtttttactcctccaagtcttgctctatgttctgtattctttctagaaaaagagtccttatatatttaatatttgcacttcactgttttaa

SEQ ID NO: 111575 - DNA, 321 bp, Homo sapiens
tagaatcgagctggtacccctagtttagaagttcaatagcaaaggtaaagcaaaaacctgtgaactctcttaatgcagaattgccgtggtccttatttattttttccttgtgttgatagttattagattacaagtaaaacttaaaattgattttttttaaagcctgacattcattgcttagtatattttagttttcttgttaacgttttgaaaatagctttattgggatttaatttatatgccatataatcacccatttaaagtgtacagttcagtggattataatatattcacagagttgtgtaaccatcaacacaataa

SEQ ID NO: 111576 - DNA, 434 bp, Homo sapiens
tagatgcaaagaaatctagaaatactagcacattgaatacaacacaacattaaaaggatcatacccccacaatcaattgtgatttatccctgagatacaaggctgtttcaatatatgtgaatctataaacatgacacacccccattagcagaatgaaggaccaaaaattatatgatcatctcgatagatgtagaaaaagcactggacaaaattcaacatattttcatgattaaaaaagaaacctctcaacaaattaagtatacaaggaatgtgcctcaacataataaagactaggtattacaatcccacagctaatatcatacttagtgatataaagctgagagctttcctctaaagttagaaacaaaagaaaggatttgaactctcgcatctatttaatatagttctggaagtcctagccagagaatttagag

SEQ ID NO: 111577 - DNA, 723 bp, Homo sapiens
cctctggaataagatcttgatcctctgctcggatctgccgactccaccaacagtccagttaatcacaatcccagcttttgaaggctagaatgcccatgcagaactatggagtaacaggcaccatggttctcatttctaatcctttcccacattatttttttgaaaaaaaaaatgcagaaaagtcccgatttttggtaaatcttgcttaacgaatgacacagtctctgtgtttgttttgtttccatattcagggagctttgcagctatgattttgattttggagtttaggcatgttaattaagcctttgtatgaaagcagaggggttctgtttcttgtttgttagtttaataagatttagtgttaagaatggcactgagaatctgtcagaattagcttggctgcatatgtgtagctcagcgctttgagacccttgaaatgtctgtttttaggacataagcagggggctaatgaaaaggctttgttgattttaacgaattgcaagccactgtagccaaaataaatataatctgctttttggattagttgtcacagatgattttacctactaacagtgattaaagaacccgagtggaccagaagcatagctgctctctggtgactcttgttaaaatagcaataaacagaagtaaataaagacttagggcatagttatctttaataaacagtgacaacaaatatacagtgtgcaggcgtgaaagggt

SEQ ID NO: 111578 - DNA, 355 bp, Homo sapiens
tttgataccagcctgggcagacaaatcgagaccccatccctacaaaaaataaaaaataaaaatttttaaattttaaaaagagaaaaaaaatgggtgcctgaaatgggtatgatagtatctacctccaagctattgcagtaattaaatgagctttgcaaattgcctattacgctccagtaaatggtagttattataacaatcattatttcaggaggatagacattttataacttagagtctgatacagacttgtggaatcagaatctctgagcaggaggttttgccttaggtagataaaatgtctacgtctccaggattaagttgtctgaagaccccacatctttcagttcccatg

SEQ ID NO: 111579 - DNA, 184 bp, Homo sapiens
actccccacccccattgtccccaagcctcctagaactaaaagggccatatgagtgaggaccatggtcccagtcctgatgctgccactgcctgtccgatcttgtgaccttaggcacattctgggctctttctgggctttaatttcctcatcagcaagggacatggctggactgtgtcattattca

SEQ ID NO: 111580 - DNA, 369 bp, Homo sapiens
gactatgtttctattaagtatcctccctctggccttgccatagaaatgacgaaaaatggattggatcctgaagctgcctgcagctgctctccagacatgatcctgcaggcatccctggcagcacaagtcattagcctgacagcagggacatgaacatactgcttagcaagctgtggttcctggttgatggatgggtaaaatttcaaggagctgaaatgccaagagagaggggttctggctaattgaattttctcataactgcgtgcaaaccagcaatctttaatttcaaccccggtgcaaaacttttctggaatgtgctcagcttgataaacaacacacagaacagaccaaagctttggttctataatc

SEQ ID NO: 111581 - DNA, 217 bp, Homo sapiens
cccaagctgtcccaggaaggccatgggttccctccttgttcctaggaagtgaccccccttttcagggcaaccaggacaacagagtgtttttggaacatgctcctttctgttcttcttcctggtgcctccccccagctgtaattagcatgactcataaaccaaatattctggcattgaactttgctcatcaaaacaaagatgaaaagaatttcataga

SEQ ID NO: 111582 - DNA, 176 bp, Homo sapiens
ccatatctcagagcctgcctggggtgtcggctgtacaaaggcagggacttcatctatgtgattcactcctgtgcaggcctgcctcacagtcagcaccaagattttaaagaaatgaatgaggccaggtgtggtggcccacacctgtaatcctagcactgtgggaggccaaagtggga

SEQ ID NO: 111583 - DNA, 319 bp, Homo sapiens
tgaagccttgggtcagagaaaggggcagaatgcatgcttaatgtttctgggggatgaaaaggagagtttcccctggggggaaggggcagtgagtgggcaccgcaaacccccagggcaccagtggctgagctcagcactgagagatgaaattgctggctgagcccccatgcttagaaggcttcagtgcctgaccaggcttcagtgcctgaccaggcttcagtgcctgaccgggcttcagtgcctgaccaggcttcagtgcctgaccaggcttcagtgcctgaccaggcttcagtgcctgaccaggcttcagtgcctgacc

SEQ ID NO: 111584 - DNA, 369 bp, Homo sapiens
ggtcgacctgaggcaggagaatggcgtgaacccaggaggcggacttgcagtgagccgagattacgccactgcactccagcctcctgagtagctgggactacaggtgcccaccaccatacccagctaattttttgtattttagtagggatgcgatttcaccatgttagtcaggatggtctcgatctcctgacctcgtgatccacccgcctcggcctcccaaagtgctgagattacaggcgtgagccaccatgcctggacgaaaactctttttttctctgctccagagtctagctttcttatcaaaaattttgtctacaacctccaacatgaccatagcccccaatgtgaccatttccagatctatgatga

SEQ ID NO: 111585 - DNA, 411 bp, Homo sapiens
taatggagtttcgcccttgttgccaaggctggagagcaatggtgtgatctcggctcactgcaacctccatctcccaggttctcgtgattctcctgtttcagccttccaagtagctgggattacagccatgcaccatcacgcttgactaattttgtacttttagtagtgacagggtttcaccatattggtcaggctgatctcaaactcctgacctcgggtgttccgcccgcctcagcctcccaaagtgctgggattacaggcgtcagccaccatgcccagtctgggcatctgtttaaggtaatgtgaaactatgacaaaccaggtattgccagccaatgatacaagtggtgaacacttaacagaaaaagcagcgacaaatggttatctacaggagaataatcagtttactac

SEQ ID NO: 111586 - DNA, 386 bp, Homo sapiens
ctgcctcactggtagctgggactacaggtgaacgccaccacgccttgctgatttttgtatttttttggtagagatggggtctcattatgttgcccagggtggtctcaaatgcctggcctcaggcgatcctccttcttctggcctcccagagcactgggattacaaatgtgggccatcttgcccagctagtcataatctttttgcttgtggaaggttttgcctctatactgatagctgctgactgaccagggtggaggtttctgaaggttgggatagctgtgtcaatttctttttttttctttttttcttttcttgcagtgagctgagatcacaccactgcactccagcctggtgacagagcaaaagtccgtctcaagaaaaaaaaa

SEQ ID NO: 111587 - DNA, 709 bp, Homo sapiens
cctcctttgtgcgatccgtcccgagtccacagtcgctcgcggtcttggttgcagggaccctaagtccgtaggctgtggcttgggagccccgtccaatgcgcggcccctttgctcggctcgggacatctcgccccaaagaaactcgcctcgccggggcccctgggttacccgggactcggggctagggatagagggcgactacactgcgcaagagatcgcaatgaagtccgtagatctccaggctggagccgcagagcgaggtggcgaggtggagaacgcggggctgggcctggacagcggccctggggtcgtctggagtcctcgctccctcaacccggaaggcagcggactgacatctgcgccgaagtcgcgcgtaccccacggagggtcgggaccctggaaatttcgaacgccccagcagttcagggcagtcatcgcttttcccaagccggggagtccggggccccgccagagcggagagcgccaagctctctgctgggtgtcggaggacgcgccgaaaacagggacgtctctgcagtgcgtccgacaccagctctccagtcctgctgccgcccggggttgctgcagcccgggttatcccggccccccaagctgcccggctttcggcctcccctgctccccgcgctgtggggtggcggaggatggacccaggctgacgctgggctgggtacctggaaagagggcccgc

SEQ ID NO: 111588 - DNA, 789 bp, Homo sapiens
gaaaaattgtaaaaaataaaacgatattaacaaatattggtatactggtgaaggccgggctcagtggctgctttccaaagtggttacaccagtcgggcatggtggcacacacctgtaatctcagcacttccggaagctgaagcaggcagatcacttgagctcaggagtttgacacaaacctgggctacatgacaacaccccatttctaccaaaaactgtaaaaatcagctgcacatgatagcatgcacctgtaagtcccagctacttaggaggctgaggtgagaggatcacttgtgcctggaaggtcacagctgcactggccatgttcatgtcactgcactccagcctgtgcaacagagcaagattttgtctcaaaaaaaaaaagttggtgacaattggaataattggaactcacatacattactggtgggaacataaaatggtgtaatcaatttgggtgttttcttggcatttgatttttttaaaaaatcaagacattgtttccctatgttgcccagggttgtcctgaactcctgagctaagaaaatcctccaaactcagcgtctcaaatacctgagattaaaggtgtgagccactgtgcctgaccagtgtaaccactttgaaaaacaacgtggcagtttctcaaagactaaatgtatagtaatcacataatgcaacaatttcactcctgagtgtaaatccaagagaaataaaaatatatgttcacactaaaacttacgtacgagtgttcatagcagcctgactcatgatggtgaatacgcaaaaaca

SEQ ID NO: 111589 - DNA, 373 bp, Homo sapiens
tcctggttcaaaaaagaaaaccaactttacctttgcatggcatggtattaatactaaagcaattttaataaaattttataaatgaattcatcaaatatcaatcagtttaatcataaggtacgatttaagaaatgcttgttaaccttttactattttctactgagaagcagataaattctctgaaaaaatgatgtccagatcctgggcttgcataaatgtgttttttaatgttcaatttatagaaagactgaataataccctttaaatttcagcccacttggtcacagacaatatttcttttgtaaaatcaatctgctacaaatctacaattccgtcaaactttcagttttgtcctacgattttaccttagaac

SEQ ID NO: 111590 - DNA, 761 bp, Homo sapiens
atttgaagaaaatgtcaagtactttcacttacattttcttattgatctccacaagaagacaaccaggcaatctgtctttagctgaggaaacagacccccgagaggttaagagtccctaagtagtaaacattcatctcacgttcaggacctctgactcatgtgtcttgctgtttatattatgtatgaagatagaaattgagaagctgtcagtaaattctgtatgtgctagataagcaccctgtttaaagaaattctgtggcaattgtcaattgtgttttataatcttgtctagacttgtgtctctcaagttttcttattcacacatatgtagttttatcccccccaaaataattattctcttgtgggatctacttagtggtatggtttgcaaatggattaactcattgaactggaatttttagtagattatattttcttttttctcatgtttctttgagacagagttgctctgttgcccaggctggagtgcagtggcctcctgggtacacttccacttcctgggttcaagtgattctcctgactcagcctcccaagtagctaggattaagggcatgcgccaccacacccagtgaatttttgtatttttagtagagacggggtttcactgtgttggcctggctggtcttgaagttccaaccttaggtgatctgcccgcctcggcctcccaaattgctgggattacaggcgtgagccaccatgcccggccagtagattgtattttctaatcaaaactttagaca

SEQ ID NO: 111591 - DNA, 1477 bp, Homo sapiens
tttgattgatctgtcttaaaatttactctttcctttaacatgtccacttggctgttaactccatctggtgaattttctacttaagaaattatacttttcagctgtagaatttacatgaagaagtacattatcaactgtaaatgggccatgaaaagttaaggttgaattttgtaatttataaatcaactattaaacagtgcagaatagctgtaaagcatcaggaaaattaaaatagaatatatcttaaaatattaagtaatttttaaaggcgggaaataagaaatgaagaaacaaatgtcagaggagacaaatagaaaacaaaataaaacaaaaatgatagactcatacccaaccatttcaaaaattacattgaacatttatgagctaaacactccaattaaaagacagagattaataattgtttttaaatggatacaaaaacaattataacatctcaccaaagaagatacacagatgccaaaaaatttgaaaagctgtttaatagtatatgttattaggtaattacaaattaaaacaacaatgagataccactacacatctactagaatagccaaaattcaaaatgctaacaacaccaaatgctggtaaggatgtggaacaacagaaactgtcattcattgttgatgggaatgcaaaatggtttggccactttgaaagacagttttgacagtttcttgcaaaacgaaacatacttttaccatatgattcaacaatcttactcctgggtatttacccaaatgagctgaaaacttatgtccacacaaaaccctgcacatggatgtttatagcaactttattcataattgccaaaagctggaagcaatcaagatgtccttcagtaggcaaatggataaaccgtgatatatccagacaatggaatattattcagtgttaaaaagaaatgagctgtcaagccatgaagacatggaggaatgttaaatgcatattactaactgaaaaaagccaatttgaaagggctgtgtactggatgggtcaaactatacgacattctggaaaaggcaaaaccatggagacaaaaagatcagtagttgccaagggttgggcagaggcaaggatgaatagatttctaaaaaaaagtatcataaaagataaagaagggcactttagaagaagaaaaggaataattgatcaagatgacataaaatttacaaatttatttgtgcctaataatagtctcaaattacataaggcaaaaactgatagaatgaaaggaagaaataggcaattataattggaaattttaatgtctctcagaagttgatagagtaaccaacaaaaaatcagcagacagaaaacctgaacaacattatcagtcactttgacctaattaatatttttagaacatttcactcagcaatagcaaaatgcacattcttttcaagtgcacatggaatgcttaccaagatagaccacattctggaccataaaaaagttt

SEQ ID NO: 111592 - DNA, 1217 bp, Homo sapiens
tttgattgatctgtcttaaaatttactctttcctttaacatgtccacttggctgttaactccatctggtgaattttctacttaagaaattatacttttcagctgtagaatttacatgaagaagtacattatcaactgtaaatgggccatgaaaagttaaggttgaattttgtaatttataaatcaactattaaacagtgcagaatagctgtaaagcatcaggaaaattaaaatagaatatatcttaaaatattaagtaatttttaaaggcgggaaataagaaatgaagaaacaaatgtcagaggagacaaatagaaaacaaaataaaacaaaaatgatagactcatacccaaccatttcaaaaattacattgaacatttatgagctaaacactccaattaaaagacagagattaataattgtttttaaatggatacaaaaacaattataacatctcaccaaagaagatacacagatgccaaaaaatttgaaaagctgtttaatagtatatgttattaggtaattacaaattaaaacaacaatgagataccactacacatctactagaatagccaaaattcaaaatgctaacaacaccaaatgctggtaaggatgtggaacaacagaaactgtcattcattgttgatgggaatgcaaaatggtttggccactttgaaagacagttttgacagtttcttgcaaaacgaaacatacttttaccatatgattcaacaatcttactcctgggtatttacccaaatgagctgaaaacttatgtccacacaaaaccctgcacatggatgtttatagcaactttattcataattgccaaaagctggaagcaatcaagatgtccttcagtaggcaaatggataaaccgtgatatatccagacaatggaatattattcagtgttaaaaagaaatgagctgtcaagccatgaagacatggaggaatgttaaatgcatattactaactgaaaaaagccaatttgaaagggctgtgtactggatgggtcaaactatacgacattctggaaaaggcaaaaccatggagacaaaaagatcagtagttgccaagggttgggcagaggcaaggatgaatagatgaaacatagaagatttttaaaggagtgtaactattctatatgatactgtcatggtggctatatgtacataaatacattagacatttgtcaaaactcatagaatgtataata

SEQ ID NO: 111593 - DNA, 801 bp, Homo sapiens
atttaagtgtaggtgttaccaaagagataaaaatatagacttactgaaactttggtgcttggacataatattaaaacatattacaaaaacagacttcttacaccagaggaatagaagataaaacacattatcttccctctttatcatgatatctttaaagcgtaaatcattttaggcactccaaaagtattttataaatagttgaaatattctgtccacctacaaagaacatgaggtttttcataattggattactattggtttatgttgagctggctgcctcctgtagttctattactttggttccaattttattcataaaaacctgggtttaatgatgtagcctatgactataaaataaataaagctaatgagatataaggggtttgtatgcatggcttaggcctcttttggacccaacctagctttacaagaatagattcaaacattcatttacaaaattccataatttttaaaagatgttttagaagacctgagctccttggaggtacttcaagaaccatgataggaaccaagataaggctaaggaagtgtaatttttgatgatacaagtttcctgaagaggcaggaatagaacagaatggagaacacaggtgaaaacacaaagaggaatatgtctttcactggattccaaaggacgaaggcaaaaatatatacagtaagattgcaggtggggtttcatgaagataagaagttcctacctgaagactacttttttggtaaagtaaaaggtgagagaggttctttgttgagattgtgggagaattctttcagataaga

SEQ ID NO: 111594 - DNA, 268 bp, Homo sapiens
atcctcccctgctccagcttctctaagcatctcttgttctgacccctttccttctagtgtcatacaaagtccaggctagagcgcacctgtgatcctatgcttttcctgtggcccactgagggcaaagctggctagaggtcagatccacagagctagttgagacttgaactcagagcctctgactcacataagcccttgactggcttgtggagcccagtctcgcctcccgagatcggcaatgcacttggagggtggggaggccgcctgg

SEQ ID NO: 111595 - DNA, 260 bp, Homo sapiens
ctttttttggagtgttagaaattgggaagatacttttaaccaaaaggtcatttaagacatcatatacaaaatacttagaaattcacatgtaagaggttttaaaagcatatatgcacgttctgattattcctttatggtaaattctgttgaagtaatctgaaaaactatttatggggaaaacagttgtagataagggtcgtactgatttttttttttaatcttcctgcctgtaaacgtaccagcgttttgccaatgtaaat

SEQ ID NO: 111596 - DNA, 312 bp, Homo sapiens
tcagtccccagtggagaatagaaagttgtcattttacattggcaggaaaacatagaggcccttgcagggaggacctctcccccattctttgctgttcttatttttgatccctacttgatctctgaatcacctcatctgccacctctttcccctgctggacacccttagactcaacatctgacctccgccctgttgctccggtcttggagggtaatcttttcttatgcctttgtgccactctgcacatacatcccaagttacttcattcaaggatttcccacaccagtgtcctgcccttctcctgccccaggg

SEQ ID NO: 111597 - DNA, 720 bp, Homo sapiens
ggccagcaatattatataaatagtggttgtttgagggagagaaacgacaagttccccttttgtgcatgttcacactttgttttgaatgtctctgagatatctttaaagtagaggatcaaaattgggtaccagcatggaatcaggagttatactttggaggaaaatgaattaatattagatcacattttctttaatcttttaagatctggaattttacaagggtcttcatcaacagggaaaaccgtgttctgagtgctaaagtttgggtggtgaactggataattcttttataggatctctgataaagataaacatgtaaataactgcagaaataatgctttatttaagcacattacctatgattcatggtagggggaaaatagagaccacagaaactcctgaagtcttatcagggtttctttgcaaactattatatggatgcccatctgttgttttttcttgaaatttagtgttcaggttgatggatactgaatgtataggattctgaaggttggagtttatttaaaacagaactttccttttgttttactacgagttatgaaatgcagttttaatttgttgcaataaatatagaaactgagatgagtaggaatttatactaacttttctcactgttatggtacatactctatatcatgaaccttgaaattcaaattgatccctacactatcttgcaaatattacaaatgaagaattaca

SEQ ID NO: 111598 - DNA, 637 bp, Homo sapiens
tctcagaggcaggtgaagggaggagacactataacatggggtcgaggttaggttttacgtacagaaaacaaaggacacacagtagggggactgtctcttagtgactggacacgttttacaaaatccgattgcaaggcttcaacattgtctctttaagggaactcctcttccctccgctttccctccctgcatctctgcctccaacttccacctccaccttctttctttcacctttcatttccagcatatcttcccctggagaattcatgagtaaaattcagacacccacccccctaaagaaacccattcttcacagccccttcctttatttctatccacagaggttcctgggtcctcttatctaaagattgggctgtttgtgatcatctgcacttcatttcaacccaaattatatgatgtttcctttaagcccaggacgtcaggagtgttttgcttatatttactcccatagtggggctggtcagttttcattagctttgtcatcattattattaagagtctttgcacaaagagaggagccagtccacgctggcatccacctgcagtatacagcattagcagagagagaacgagagagagagcgagagcaagacagagagaaagagagatgcccctt

SEQ ID NO: 111599 - DNA, 398 bp, Homo sapiens
ggaaacagctgtgagattgcacaaagtattcttgtactcttcagagccattctttagtaggagaaaataaggtccatattttaagcttgatgatagcaagccatttattagcaacccagtttaaccccacacttttctccttttggggttaaattgggtagtattcattagaagtacttcaagaaaccatgaactcatttgctagcagtgtttatatcctgtatactgagaatttgaggtgacttttatagccattcttaatcctcagtatctgtcattgtggaacctgaaccctgtgtgtctaatgttatccaagagaaatattgtgtgagccactagtgtactttcaaattgtggtaaaatgtatatcccataaaaccatcttaaccacatttttg

SEQ ID NO: 111600 - DNA, 228 bp, Homo sapiens
aggcatgtcaaaaacacagagggtcgtcataaagtttccgtcagaccaaaggaaccaagatgaaagcatgtttaagagctactaggttctgggagatttcaaaatcaggacattactaccatgacaaccaatgaaaagttctttcaagtgaacctttggggaaaactatataacgttccttactctctaggctctctggaaataaacttttactttattatggctgtc

SEQ ID NO: 111601 - DNA, 713 bp, Homo sapiens
ccctgagttctggtgaatctgtcccccattcctggctttagaaatgttcatatgacaagtgattcattggtaagtgttaaaaaccaattctaaaaaaaaagaagaaaatccttgatttgtagcatttgacattttccatggtgtaaatacttttaccatggccaactttaagctaccaaggtgaaatcactaaacatggagttgggaagagaggcacatcatcagctcctgggaacctgcagcgcacagtgtcagagatgacccagtctaagtgaatcagaccatttatccctctgggcctaggactcaagccagaccagctccttaggtccaattcctttgatttttttaaagaactgttgtggaagaggcaccatctttcactgcgttcgttgaaaggaaggaattggaaccaattctggtgatctactttccatgtggtctgtttggaaagagcctggctgagaatgcagaccctcagagaagtgactagcagagctgagagatggagacagaccaaattctgggatcactgttggagtccttggatcttgtccagcctgaacctctggacattgctgttacatgagccaataaatccccttcgtttctctgtctctcattctgtttctcttcatctccctcttatccattatttgtttattaatttttcttttattaaagctgtttggtttttatttcattgaaaaata

SEQ ID NO: 111602 - DNA, 399 bp, Homo sapiens
gttgttaaaaatgaggcagatcattgtctttctttccccccttgtttttgggacgaggtgacccttgtagcatcatgatcatggcttgacactgagcttttagaggaaactagacaaagaggagaacatttagaaagaagcatacaggaaggtgcaaagtcttgaaacgatgtcacaggaagaacagctggaagacctggaggtgtttagtctgatttagggggtgacaggattgctttcttaaaatatttgaaggactgtcacttgaagaagggattagatgtgctctgtatggcctcaaggggataaatttaggatctctggttgacagttattaggatccaggttgtggtttaatagatatatttaaaaagccaatcttatgaaaatttaagctgt

SEQ ID NO: 111603 - DNA, 837 bp, Homo sapiens
gcctcccgagcagctgggattacaggcatatgccaccacgcccggctaaatttgtatttttagtagagacggcatttctctatgttggccaggctggtctcgaactccctcaggtaatccgcctgcctcggcctcctaaagtgcttgaactacaggcatgagccaatcatttgtatttttgagtgcttgctctttgttcatcatacttgcttggtattacttcatatagggctaataaaactacaaaagtactatttctatagacttaattctttagctcctgaaaaattgaaagagccaatctatttggtggaaaaccagtcagcctttaactgaattcaggtttctgaaaaggaccaaaattatagccataattctagtaacatgtcattgtagagcttcccaaataaaatgtggcaacctttatttctcacatctaacaccatcatcatcatcatcattatttttgagacagggtcttgctctgtcgcccaggctgaagtgcagtggcgtgatcttagctcactgcaacctctgcctcccaggctcaagcaattctcacatctcagcctcccgagtagctgggaccacaggtgcatgccaccacacctgggtaatttttgtagtctggtaaagatgaggttttgccatgttgcccaggctgacatctaacattattgactcacctgtatgaaggcatagtaacagaccagtagataatagatgacttgtgagatgatagaccagacacagcccttctttgacatctgaagggaagtgaagctttccagtctcaaagaggtgaagaaagcacctgagaataacaaagaacacctg

SEQ ID NO: 111604 - DNA, 900 bp, Homo sapiens
ccatgggttttagggaagtaaggctctacctgcattgagcaggccaagacctcaggacactggaatttttatgagaggagagtaataagttattagtgactgattatgtgatgggaatagtgcaggggaaatggttgccactttctctactgaatggcaatagctgttttatagcagagattgatgaaaaataggcttatttttgaaattgaagaggtaacagttattagagtggagagcttggtcagaaaaaccagaataccatggttttttttgttttgttttgtttttagtagaattcacactaattgctggaattacattttgctacagttttattaagaatgtgtcacagacataatgttttgctaaaaaaaattcaacgttttcttataactataaacaaatcacattctttgtaccaacatcattttatcctacctcagtaggatacttcatagcagataataacaatacactcagtcttttaggttggaggatgtagaacaattttttttttctttgtgggaatcaacatacaattttgggaaaatgtaatcatactctgcacttgaattattctctctacactctgccttagaatatttatatggatataatgaaaatcccatagaaagtgcagttttcatactcttacactctgaaagctgccacagtgttggtgaatatataccatattatatttttacatgcttgtgtgctaaataactatggcatgcatctttatttacatgaagtgaaaatacaaatatagaaagtgtatgggctgggtgtggtggttcatgcctgtaatcctagcactttgagacccaaggcaggggggtcacttgagtccaggagtttgaaccagccaggacaacatggcaaaaccctgtctct

SEQ ID NO: 111605 - DNA, 403 bp, Homo sapiens
ggatcccccccgccgtaccagttgcgcacacacactggggttcagtgtcccttggattatgctgatcctgagatcagggttgtgggtaatggtttccaagagctagcgattggggggacttattcctttgattatactgttgaaacatgaggccatcaggatgttgtgatcaatatcctctgagctgcctctgcaatcatccttgcccttcactgtagaagaagtatctggccacacgcccctgtcacttggactttatcctctttgtcttggagctctgccttgtgctaacactgatcttggatattgatttgaatgagatgaacttggagttaatactctgtcatcaggagcgtctctgagcccgagagttggccgcaactggtacgacgggggatgagga

SEQ ID NO: 111606 - DNA, 274 bp, Homo sapiens
acctcggtaccggcatactggacttctctaccctcataggctgggcctgaaaggtagacagcagagagggtagagaaggtagacaggggtggtctagggacagcaaaggcagggcaggtgtcagcatgaaggagactgactcagtggcgtctggcgtgcgtggagggcagggttagacacgagagggaaagaggaaggtggttgggcagggacggtacttcaggaaggtcagtctgcagaccagaaaggaaggtggacagaaggtccaggtatg

SEQ ID NO: 111607 - DNA, 398 bp, Homo sapiens
tcaatgaatgaatgatgctgctagtgacttggggacctgcacaaccctgggagtagatgccagcactcctaacacaaaggggtcaggacaggatgccccgcagtcaggatggaaagccacagagcggggcagaacgggtcctcagtgccaaggcacagctggctggctgtcttcttctcccgcaactccacaggccaacggcagggctgctgctctctcatttacaggtgggggcaccgaagcctggagagaacaggggctcaacagtcacatagctgatgcgcagcccagcctggcagagccccgtgactctggagctgtgtccacagccctcctctgctctgcagctgggttgtggagacaccaaaccactatggaaactgtgagtttctccaccg

SEQ ID NO: 111608 - DNA, 711 bp, Homo sapiens
ggggaacatcacacaccagggcctgtcagggggtggggggctaggggagggatagcattaggagaaatacctaatgtagatgatgggttgatgggtgcagcaaaccaccatgtcacatgtatacctatataacaaacctgcacgttctgcacatgtatcccagaacttaaagtataataaaaaaaagtttcatgatctaaagaaattcagaaaataaacaatattaaaatgaggaaacattggaaattagttttttacttatttgcctaatattgagtagtgaattttcttattctaatctggaaaccaagacttttatcagctattttactagaaaatctatgtgagatattgtaacttagaaaaagtccaaagcaaggcttaatttgtctgtcatattgaataatcttcaaataatcttttagtcttcaaaaatggttatagaaaaactgttagatttgagaaattggatatgaattatgctgacattctaacattctcaagttaaattcccctaagcagtgttttatgggaaatgaattcatttgaacaacttaaagaaatattttaagaatgagatgtgcctttagttataaaacctcttactgctgcaaacatatgtaagaattttgcagtaggttgaatgaattagctatataaaagtctgcaagtaaacttccttcctatagaaaatataatagacaggaaata

SEQ ID NO: 111609 - DNA, 820 bp, Homo sapiens
ctggttctcacaaaatgtgcttctctgcgtggagcaggctggcacttcagttgaacccaggtacctttctgataggcttctttctttttctgatcattttcctcacgcgtttcaggaagctgtcttggctcttagagtgcttaatgtgctcaatatgcacattaattctcttggcaagaatcttgcccttaacttgtttgtttacaacaatgccaacagcatgctggggaacattgtagactcttcccgttttgccatggtgacacctgtggggcgttcctttttgaacagtacccattcccttgatgtctacaatatcacctttcttatagattcacatatacatggacaaaggaataactccatgttttcttaaaggcctggagaacatactgggtgtctctcctctttctctttgtgtttctcattttggcgaattactggaggatggcggttccactcattatatttttgaagcctcattttggtttacgttttaaagtatgttatcaaaaggaaaaacatttaaattataaaagcactactactgagttcagtaaggcataaagaagaaagtaaatattacttgtcatcccatcatccagtggtgggatattactaatatctggtctattttgtcctgaactttctctgtgcacatgtgtacacacacacacacacacacataaacacacacatctacaagaatgcgtgggctacacacatctgtgggtatgaacttaatgagtcctgattctaccacttaccaaatgtgtgaccttgggttatttcttaaccccactaagccaggctttcccta

SEQ ID NO: 111610 - DNA, 383 bp, Homo sapiens
ctggaggggaacccgtggtagctaaagggagtgcactagccagccccaggtgtgctacattcccgctctaggggctggtctggcggcatggctctctcctgagtgccttcagagcctgagtgccagcaggcaggcgtctcctgcccagtgggtttggtaagatatatttcagaaggcatccaccactctaaaacatgcttattgcaggaaccatgggggagaccaaagggcctagagccttgagaacctctgaccattagtgttaacaggaaggcagcctgttcccctagctggggagggggttgtgcgtggcaggaagcccgtgcgtctgtgtctctttggagctgtgggttggttgtgtggatgccagctgtgtggtcccc

SEQ ID NO: 111611 - DNA, 622 bp, Homo sapiens
cagcccaatacgaatttttttttttaagtgagatgacagaattggaagaataaaagtccctgatgttgttatgctttgtaaatacatacatattagggctactctagattctagaaaactagaggaaagattgagcctttactttggaaaacctgcacctctgcaagatgccacgtgtacggatgactacattctggtgattaggtaaagtgatcccagttttccatctgaaactcatctctaaagcaaagttcttgtattctgcagataactattcttatgaacattggattataatttcagctacaagtagcatcaagatcttttatcagaagaaaacacactccaccttcttgcatattctaatgatgtaaaacttcataagtgatcctacaatatgtctctgtaataggttatgaatagtcatctatcattcccagagcagtatataataaatggttcaggtatgaaaattctgaaaattttcagctcaagattgttgattttaggggagatgtgtttagaaatgtacttgtccatttcatgcctgaggccaactaggagcaagcatgcctgtatgggaaatgagataggattttttactaatttataatttgaaata

SEQ ID NO: 111612 - DNA, 623 bp, Homo sapiens
gttacctaaaatagtgatcctctctccttcactggctggaaggattaaatgagatagtgtttataggaaatgtactttgtgttccttagttgcctccccccgccactccccgtggtaggaactcttgagtacttgtcaaatctgaactctcggcatttttacctccttcagggaaaactattggacaggctcttactgaacacccgcttttgtgcagaatgcacttcctgatactctgggagtttcagaggctactaaggtgtccttctggccctcaaggagttcatctggagacagggagacgacacattttcttcaataactaagaaaagaaagggcaatgaagaccataaggaaataacagtgaagtttcttaggcatccaaacttgatggaggggacaaaggaggcttcaggaagttttaaactagaacaggacttcagcgctcttaacattttggtcagatacttctccgtggtgatagtttgtgggcagttaacagtggtggagggctgtcctgtgcattgtagcaagtttagcaggatccctggcctccgcccacttagatgccattagcaccactagttaacaacaatcgaaattatcttcacactgtcaaatgt

SEQ ID NO: 111613 - DNA, 370 bp, Homo sapiens
ccagggtaatactgtggtagagaagaaaaacaactatagagagaaaaaagcttcacttaatgaatttctactttaacacaaaggaaacaaccaaagtatcacccactaaaacaaactacttgttatgttgtggaacaagtttgagaatctgcttctaagacacaatgtaacttatcattaaaagaaaaagaaaagaaggagtccaggcaagtggctcacacctgtaatcccagcactttgggaggccgaggagggcagatcacttgaggtcaggagttcaagaccagcctgaccaacatggagaaaccccgtctctactaaaaatacaaaattagccgggcgtggtggcacatgtctgtaatctcagcta

SEQ ID NO: 111614 - DNA, 342 bp, Homo sapiens
ctctgggaataaacccttaagaaacttgacagataaatgcagcagtttcggttccagccctgaagctccactcatggccctcctagtgggttttgggtccagctgcctcctcggtgggagttctgtacccagcagtgcccggtcacccatgggattctcctccacgtcccttcccaggccaaggccctgctctcagacctctgtgaagtgctcaagctcccgctccctctcctccaatgtgaacctccagcctgcgacgctgctgtgccccctcgaggccccacagtctcacagaggcctgtcctctgcagctgaacttctggacaagtgggagaccctggc

SEQ ID NO: 111615 - DNA, 816 bp, Homo sapiens
gagattttgtaaatcgataatgggaaatatttcagactgaatccagccttgaaaacgtcggaagagtcaggacaaagcttaagtaggagtcctatgggaagaattttgggaagtcccttctaatgtagttttgtcattctagatattactgcagtactgtcacggtccaagaaagggtcctaggaggacttgaattccttcaggaatttgtgaccaattgaggagggaatagcttaacctcacctggggacctcaattcccaagtgaggttgggaaaccgaatacataagcaactagtcttttagcacgagaagatatatttataaatgcacaacagaaactaaagttgcaatcagaaaatgtgatttccgatgaggtaaagtaatttaagctattttttattttaattaaagattaaagataaaaaaattgaaactgtaaaagagaatttctgaaggagctgtgttataaggcagattatactgttgctatgtatattaatgctagtaattgtgcagctaataaagtagcatagctctcacaaacatctcgcatgtgtggtagttgtcattagtcctttttctcagacatggtcactctgtggagggtccctcctggtaaatgtgttgttctaagggaatagatattggaactatttataatgtagttgagacctatgaccaggtaaaccaaggaaataatttctaagttctcacctgaaaagcattttcaaattatatggatcatccccctgccccatggaatcccagccaccgtgagattccgatatgccccctaactcttctgagtgggaat

SEQ ID NO: 111616 - DNA, 453 bp, Homo sapiens
ggattcagatctcattcatgaaagctttaccctcatgagcttatctaattctaattacccccaaagaccctacctcctaataccatcacattagggggtagggtttaacatatgaattttgagggaaccgaagcattcagttcataacagtgggcaacggttattgcctggtgggtcttgaagcatatgacagaatgggactcctgcctgttattttattggggaacttccccagttatctgtaggtcctttaggtttgggcctctcaatttcttggaaaggaatcctccaggagtgtaagcctagatgtctgttttgaaagccatttaggggcagagggctagacctttcactgttaagtataacactttaactaaatcccctcttttcagctgtgcctggggttctggaatccagaaactctctagttgagcatctccagagaataaactt

SEQ ID NO: 111617 - DNA, 142 bp, Homo sapiens
tctaggtccagagggcagcatgcactgggtgagggcctctagggagagtaaagcaggatacattcttgtccttatacttccttccctgtttctgtacctgctcacttttgccctgcaacaaataaacctttaagcatctgtt

SEQ ID NO: 111618 - DNA, 691 bp, Homo sapiens
gttaaatatttattgcactatggtaggaagtgaagtgggatggaaagaccattacagcaggaaggccagttaggaagctactgaataatagggaaaagatgatgaggaccttagatacagagtgaatggagggagggtcaatgttaaggcacattccagatgtaagtaaaagaaaatattaaaccattgtaaagtcttagagaagtcatgatgaaaatgttcttactaaatcttacctactaacaccttaagaagtttcttttcagccaacattttcacttacttagataggagtttgagaatatggtgacattttgcccagttccctccaccgttagggtgtctgggttaggtactaaatattatttgagaacatagctgcaaaattagtgagatagccatccagaactgcacatttaccacagtaaacaaacacattacaggattagaatcatggaatagacttcacatttattctagcccaatcttcttgtttgatattgaatatatggaagctggaagctttaaatcacttgttctaggtcccattactatttcttgataaagccagatcttacgaagtcaggttttctgactcataatctacaactgtgtgtgtgtgtgtgtgtgtgtgtgtgtgtgtgcatgtgcatgtgtgtatagatgggagttggcatgtaactgtagatat

SEQ ID NO: 111619 - DNA, 383 bp, Homo sapiens
gtaaaaataaaatgtaagcaaaactaatggtacttctaatacttctttacaggcagtgttcaattctgaattatttttggacttgcagttgttgttacgcatgtttttccacccaatattctcatcaagattatcagtgatgaagtatttctgaaaagagtattacagtctctggggctttttcctaagccactgacatccattctgcaagttcagaggaacatgttcaggtaaagacagtgtgttcgggtagagaacatgtttgagtagtgtctcaactgccatctggtgacagcaagtttaaggtatattctgattgcagagatgttaaatgctgaaaaaattaaagaaaagaagaaaggacggaaggaaggaaaaaagaa

SEQ ID NO: 111620 - DNA, 276 bp, Homo sapiens
ccaaaacccactgcaaaaacattaacaatcgtcatttggaaccgtccattcccacttttctccaaagctatctatttaaccaaacaccttctgaaatttgcagcataaacaaaatatatcaatgtcaaattttaagttttgggaaagacccctgggtcaacttgatgcaagctgattcttctatcatcttaatagtttgtggtcattattaggaaaccaaatagccaggaaagaatggggacaagagggagaaacaagcaaatgtgtgaaggcagg

SEQ ID NO: 111621 - DNA, 123 bp, Homo sapiens
ttcctccacatggtccagcaaacacacacctgggctgaatggtagagctgatcgctcatacacaaaggtagaccggtgggcagggattttcagacttacacagtcaatgagttttccttggtg

SEQ ID NO: 111622 - DNA, 370 bp, Homo sapiens
cacccccttcccccttgtattgctttttgtttcctgttatcctgggaatttatataaacctctgtttcagtgtcgagttcagtattagcacaggttcacagtgagtaaccttccacgtacatatgtgtgtagtgtccccactacccgttcaaacagagcagccttttctagtgttaggaactaaggatttttgtgccacctaagaaataaaacgttagcattttttctaacaacacgtcctaaggctggaccctgcctatgggatatcaggtcagaatattcaggggagtatcctcacgtatgtttctgtagacttaatccagggtatgcctcagtgtggccacatttcatcttgtaaagacagcaatta

SEQ ID NO: 111623 - DNA, 148 bp, Homo sapiens
atgaggttgtgtcactgcactccagcctggccacagagcgagaccccatcttaaaagaaaaaaatattgtgtgaggtggagatctagtttgttttattccagatgcatggccaattgcatgcaccaattggggatatgtatacaatga

SEQ ID NO: 111624 - DNA, 284 bp, Homo sapiens
ccctaacccccacccgctgcgcgtcgtgggaaccggttttggcgtcccctcctggttccgctcatctccgcacctagccttgcccaccggagctgcgctcgggacttacctggggtcccgagacccaaagactttggctccctctcctatcccagctccagacatttctgtctaaattagtgcgcctggtgcggggaggacgcgggccagtgcgcgccctggctgcagcaggagcggctgggttggcgccctctgtttccttttctcagaatggagctgggacg

SEQ ID NO: 111625 - DNA, 383 bp, Homo sapiens
aaaacaaaaaacaaaacaaaaaacacaaaagcagatccccggccagagaggtgtgggaggggttttgacaagagctccaaggccatacccatggccccatactttagaaacatggtttcctgggttaactgcgttgattcacgtgttagttgcaaaataaacaagtctaatatggtctggatctgtgtccccaccaaatctcattccccagtgttggaggtggggtctggtgggaggcgacttggatcttgggggtggtttatcatgaatggctcagcaccatctcccttggcactgtcgttgggataacgagtgagttctcgtgagatctggctgtgtaaaggtgagtagcacctcctccctcccttcctcctgctcccacc

SEQ ID NO: 111626 - DNA, 390 bp, Homo sapiens
tgtctgtcattttgaagcaatttacatttttttcaaagaccattcatatacattctcttttgaaacatattggataaatattagtaccccaaagataaagaagttgaagcagagggagtttaagtaacttgctctcagggtgattcagtgataggtcaggacacatgactcctaatttagggcttcttaaagctgtttggttgaaaatgaaaaaagaaaaacctatatttagtgttttatttatttattttttttgagatggatttttgctctatcatccaggctggagtgcagtggcgcaatctccgctcactgcaacctctgcctcccgggttcaagcgattctctgtcttagccttctgagtggctggggttacaggtgcgcaccac

SEQ ID NO: 111627 - DNA, 205 bp, Homo sapiens
ctccacaggacaaagaggaaaggagagaaaacaaattggcatcagtcaatattattacctcccagtggctactgtcagagttgagaagtagaaaacgaaacctagcaaaaaatctgaaagatttaacgtgcatgtacatttcatttattcatgtttttactctctttaccaacaataactgaaaataaactgataacaaacactt

SEQ ID NO: 111628 - DNA, 736 bp, Homo sapiens
gatatcctttccccttaaactatgtgctccaaaagctacactcaggatgacagtgatctagaagtaaatccatgccaccttcctacctgtaagggactgagaaaagttgcgtccgtctgagtagagcagaatgggggaatcctgagatgttctttatgtggatttgtgtgaataaacatcacctgagaatgattcagaaaaactgaagccatgtatgtaaagtagactcagcctgaattatacccctaataggtggtaatagcttattcataccctttctggaggaatgcaccttcttcctacgcctcagagagtttccacaataatctttgaagggaaaggaacagatcagttgttaaaaataagcatataaggaaaccacatacatcagaaacagacctccaaagacttcagaaactagaatttagataagattagcttaataacacaggtgaagagagaattggagaactgaaggcatccagaatggagcttaaagagccaattagatggaaaatatgaaagggatatctgagacacaaattgatagtgtgaaaatgtgtctacttgaagttctagaagtagaggaactacatggggcggaagcacaatttgaagagagaaatactgaaatttccagaatgattgaaggcttcaacagattcaagatgctcattgaatcccaagcagtaattttaaaaattcacaactggacacatgaggatgaaactataga

SEQ ID NO: 111629 - DNA, 446 bp, Homo sapiens
atcattttgcaggtgagggaactagaactcagaaaaggtacttaatttccccaagattacatagttattaggtgacaccggcaagatttcaacaaagctaatgtcctttctactttactgtgctaccatgatgatggtaatcaaaaatggcagacaacccataaatcttccaactttggaataggtttttgcactgaagtctgaatatggatacgtattgaatgtttattctggatattcacagaatcaaaaaatatgtgtaatgaattatgttgctgaattaactgaaaggaaagtaaaaatgtagcgctttctcattttcttcacgaatttggaattcttttctgctttccactatgcagataacatcagttcagacaaatattaaatacctacctaaattagaatgccttctcctcatgggatttttttaaaatcttgtcatt

SEQ ID NO: 111630 - DNA, 817 bp, Homo sapiens
gggcctgagcccggggtgtgcctgtgtctgtgattctacagtcccagaactttacaaaattcttcagcctctaagtgctctttcccgccctcatccaaccatggagttatgaagtagattacagagccatgtagtctgagtctgttttttataactcgcactcagaactgaagaattttgtaaagttctgggactgtagaatcacagaacgacacccggtaatccacagggtcatggagtaggtactcaccgtcagctgtggcccagctcaccaccatgggtcagcagggtcaccagcctctttatgcctttcacagtaatgcagcggccagctatggctatgtgttcctcatgctttgtgtacatgccatcatctcctcacaactgcaccaggtgtttttgtcaccatacagatgaggaaaccagcataggccaggctttatctgtcaggtggcaattctcacattcttccttgtcctaccccaggggccgggccagctgtgtaaatcccatgaatcagagagggtagaggtgcactgataaaccaaaaagcactgggattccatttattttttattttcaaataagttgcagaagttatgcagttctacatagctccgatcagactgtggattctagatcttagagtataaaaagccaaaggtcaaagtcaaagtcctttctctcctggccccttttcacggatggggaatctgaggcccagagacgagtaagttcccatggtccatggccaggattctgtgcttcagaacggcctatgtaatttgtgggacccagtataaaatgaaaatgtggg

SEQ ID NO: 111631 - DNA, 307 bp, Homo sapiens
tcacctcttgtctcatactcaagcttctgtggtattctggtccccgctcccatcccccgaaggcaatgcttcatctccagtgaccacagttccctctttctgcaccatctcttcaccctgcactgggcatccctttcccatctccccaaagcatccctaacacaaaggatttgcaggtagtggttgttaccgaggtttggggaataatagagaaggactgcagtaaaggacaggcagcagctcaatacaacgttgttcttcttataagttccttaaccatctacattgctggtaaggccttctaagg

SEQ ID NO: 111632 - DNA, 866 bp, Homo sapiens
cccacctctccggatccagcagggtgtccactgaccttctgatccagcgaggtgcccatcgccactcccgatcgggctagaggctcgccattgttcctgcatggctaagtgctcaggttcagcctaatcgagctgaacactagttgctgggttccacggttctcttccatgacccacggcttctaatagagctataacactcaccgcatggcccaaggttccattccttggaatctgtgaggccaagaaccccaggtcagacaacaaaaggcttgccaccatcttgggagtggcccacgaccatcttgggagtggccaaccaccatcttgggagctctaagaacaaagacccacccgtaacagaaggagcaggccaatgtcatccaagaccttgcagttctataatcttatcagagaaatgagtaatgggtattattaacacgacctaccaaaacttcataaaaaagcaaaaagaggaagataatgcttttggtcagttaatactaactgcaagtcaaggaaataaagaaagcaagtgtgtttcttcaaatgtatgggttttttagccatttcattacagatggcacaatgccttgatatagctaactgcataagcactcgtgttgcatacaactggaaataaaactgaccacttgacaagtgctgtgggggtaaagagaacagaaagagttactttcgcagggtagtcaaggagagtttcagagaggtcatggtggaggaatagaattccaaggagagaagtgtggggcaggtcctcccagggagtaagaatagcatgcaagtgagggcccatgtcctgcgacatagaggttactatctctttgtatgttctaccctctccacta

SEQ ID NO: 111633 - DNA, 341 bp, Homo sapiens
tcccgggttcaggctatcctcccacctcagcctcccaggaccacaggcgtgtgccaccatgcccagctaattttttgtagagatggggttatgccatgttgcccaggctggtctcgagctgctgggcacaagcaatctacccatctcagtctcccaaagtgctggcattatagtcgtgagccactgtgcccagccaacagcgtctttcaaagagcagagagaggttaattttgatgatgtccaggcacctttgttgaaaattgaccatatatctgtgagtctgtttctagactctttgttctgctttattaaactacttgtctatttgtacaccaatgcca

SEQ ID NO: 111634 - DNA, 298 bp, Homo sapiens
gtaccggggattataggtgcgcaccactatgcccagctaatttttgtatttttagtagagacagcgttttaccatgttggccaggctgttctggaactcctgacctcaagtgatccacctgcctcggcctcccaagtgctgggattacaggtgtgagccatctcacccagcctagagacagtttctttaactgtaacaaaattgtgtcaaatgcaaaaggttgcattgacaggttcacatcttttaattttgtaaaaaattaaattaatacatacacatataatgtatgtttgtttca

SEQ ID NO: 111635 - DNA, 378 bp, Homo sapiens
agttattgaattctagaatatagtggttgctttgcattattactgtatatagtgtatttgtgcttattttatagtttatggagcaaaatttagtatattaagccatttttgcatcttaaccagctgctgcctaattattacaggaaaatagtgtggaagttcagctattctaaatctaaaataattggttttggtacatattctctaacctttagatggtctgtagctattgagccatatatgacattcttttaccttgcagtgaatttcatagcttgttcatattggggaagttgtacatggaagtcatattgcttgaaggtagataatttaatggctatggaggtcatttgactgtacctgctttaaaatttctct

SEQ ID NO: 111636 - DNA, 451 bp, Homo sapiens
aggctcatgtcttaatgttggcattatcagtgtggttgccagcacatgcacgtgcatacacatacacacacttaacactgtgaagcctttttgactgcttcaggaagcaataattattccctgctcttttatggaagccctttactcagatggcttgcataatagtatcacttgtcacactgtattttagctgattaaacaacctttttcctggctggaatgtgagtttattaggaaaagggattgtggatcatttttatttactcagaacctttacatgttcaacagacatttgtcaaacgagtaacaagagtttgtaagcaagagtttttagcttagtctagctattgattctgtgactgtgtactataataaacaaggcctctctggtgtttaccatatagctttaactcaagcttcacttcttgtggtaacctgaatgtattttgga

SEQ ID NO: 111637 - DNA, 178 bp, Homo sapiens
aggctggtcttgaactcctgacctcaaatgatccacccacgccttggcctcccaaagtgctgggattataggcgtgagccaccatgcccggccaagagtttatcccttttaagtctcatattttgtgatttttaagagtgcaattattttattttatatcatttaaaaatttttttga

SEQ ID NO: 111638 - DNA, 753 bp, Homo sapiens
caactctaaatgtttaaattcaagaagatcaaagaaccccagcgcacgagcacacacacacacatactcacacacacaatcacaccaaggtgtataataatcaaattgcttaaaaccagaggttaaaaaaatcttcaaagcactgacatgaaaaggattctatgtatataggaacaaagataagaatggcggcatacttcttttcgacaccaaaatatagtgctatgtatttttcagtgttaaacaacattttttaagtgctgaaagagaaaaagtagtaaacctagaattctatgttgaaagtgaaaatatacttcttttgtttttttttgaaagagtctcactctgtcacccaggctggagtgctgtggcacagtctcggctcactgtaacctctgtctcctgggttctagtgattctcctgcttcagcctctcgagtagcttgtattacaggcatatgccaccatgcccggctaatttttgtactctagtagggacagggtttcaccaggttagtcaggctggtctcgaactcctgaccgcaggtgatctgcttgtctctgcctctccaaagtgctgggattaaaggcttgacccaccatgccccctcccggaaaatatctttcaaaaattaaggtaaaattttaaaagttttcaaaaaccaaaagctgagagaatttattagcagtaaacctgcaccaaaaaagtccaagaaagttcttcagggaaaaaagtatcaggtgatgggtaac

SEQ ID NO: 111639 - DNA, 363 bp, Homo sapiens
ttatttaaaatattcttgtcaacatattttatctggaaaagctcaaagttacttttaagttttcaaatacatacacacatatacgtaaaacgtatatccagccgggcgaggtggctcatgcctataatcccagcactttgggaggccgaggtgggtggatcacctgaagttgggagttcgagaccagcctgaccaatgtggagaaaccccatctctactaaaaatacaaaattagccaggcatggtggtacatgcctgtaatcccagctacttgggaggctgaggcaggagaattgcttgaacctgggaagcggaggttgcggtgagctgaggtctgccattgcactccagcctgggcaacaa

SEQ ID NO: 111640 - DNA, 205 bp, Homo sapiens
gcatccactaagaaagtaacacacacacacaaaatcaaaacaggattataattctataaaaaatcaactaaatacataaaaaggcagcattagaggaacaaaaggcataaaaaacatatggaaaagaaagaggagaaggggaggagcagaactgagcaagcccctgctgattgtcccctaattttactaaattttactagttttt

SEQ ID NO: 111641 - DNA, 107 bp, Homo sapiens
ttttctttttggttggttttctgatctagaccaaacagcatctcaaaaaatgactccaaacagcatctcataaaataataacctttcacagttcagtggtttatact

SEQ ID NO: 111642 - DNA, 308 bp, Homo sapiens
gtcaaatgcactatacattattgcttctgcctgtgcagcagtgatccccgttttccctgttaaatgcgctgtgcttgtcctttagtggaacaacttcaccccagtactttacgtttttggagtggggctgttttatccttgactccagtcttgtcatttctattggaattcttagaaaactctcttcctgctaatattgctgggcgtaatttggagaagctgagagagtcactgagactgaagccaccacagacaaaggtcagcttggggatggagagagaaacctgtgctgttatcatcttctagat

SEQ ID NO: 111643 - DNA, 460 bp, Homo sapiens
gatgcaccccaaagctagagaattcctgctctgagccatctctgaaagcaccaagagccagctcacggaggagatgccagctcacggaggaaaatctggaaggtgttgaagcatagacgctggaacataaaatgactcatgatctcactgggagaagggctgggaacatcgtgggctctcttctccccgcgctcctctctccgggtctctgtttccctcattccacgatgtttagaaccatcggcgcactacatcagactagaggtctggggtcacccgaccatcccgccacaagcccctccgaggcatcactgtgtccagattttgcaaactgcacctcctgaaggggctggggtctgtccacttcgccccatctgccgtggcagcacttcctccgtggttcgcacccccacagcagcctcctgggaaggcacctccctggggcccctctcagtccacg

SEQ ID NO: 111644 - DNA, 283 bp, Homo sapiens
tttgacacatggtgttgtatttattttggagctccaatctccactaaattcaggtccatcatactgcctcatagtattaaactcatcagaacatgctgatttttctccagcccgagctacatgaaggaaatgaagcatggaaatggagaactaatagtaaagcaattgagccctgttgcaggtcacatctcaaagaggagcacagctacaaggacatataaattgttcttctgagccattagaatgtcaaaacattggaataaaatatttgtattttagaaag

SEQ ID NO: 111645 - DNA, 702 bp, Homo sapiens
cagtaaaagccttgtcatcaggtttatgggctggaaaacaacaagccaactccacagcagcagggaatgggaagtgtggatgccacacggcactgaaataagagagtaatttgaggagcataattatccaaggtggcagtttgatgaggggatggaggttgacactcctaagcttgagtcaagtgccctggaatctgagtggctgttgaaatggtccacatttcaagttcctgcctcacgccaaagtgctggcagttccctcataacaaggcccacctgagcacctgcaggcctgacccacagggcagagggcctcgtgctgagtcactgaaacctcccaaagttctgagccaagagctacaaggcaacactcccgtttcccttcgccaccacgaccaaaacaccatgctgggcagaggttagaagagagagccaccaccaaatgtttcaacaatatttttaatgttcatacagctttattaaaatgagcaataagctttacattccttggtttgtagaaatggactcaagaggtcatttgggttaactgctacatttaacagatgtggaaacacgcagggaggttacatgtcttgctaaagtcacccaggcagccaaaccaggattaaactcaggtctcttgatcacctgtcccaccagtatcccccagagtatcttgcttgttccatttcatgacactga

SEQ ID NO: 111646 - DNA, 150 bp, Homo sapiens
ggatgaggtccttggaacctgaatatttaccatcattttaagagtttttgatgtggttctggaaaggacactttgagaaagaaggagtggtggtagtgatggtagggcaggagtggggcaaggtggggaataggtctccatattctggat

SEQ ID NO: 111647 - DNA, 297 bp, Homo sapiens
atcctttttgagttaattttaggttttgaagatgtaaaaatcttaacatgatttaaagtaaaaattatacagtccctgttgccacccatcttatataggtaatacttttattaatttctggttgctcctatatttgtttctttttgcaaatttaaaattattataatattaaatataggccaggcatggtagctcatgcctgtaatcctagcattttgggaggctgaggtgggaggattgcttgagctcaggagtttgaaaccagcctgggaaatatagtgagacttcgtctctatg

SEQ ID NO: 111648 - DNA, 562 bp, Homo sapiens
ccctgcctggccctggtctttcttccatagctgtccagggctgccagccctgagcaaccagctcgccatcctgggaagagtgcccagccctgtcctccccggtgtctcctctcctgcttaccccatcccagccctccgaaccgctccccttcgcagagccacaggcatcatcctgccagcccggaggaatgtgctgcccagtcgaggggcatcttccacccggagggcccgccccctagagaggccagcgacccctgtgcctgtcgcccccagcagcagggctgccaggagcagccacatcgctcccctcctgcagtcttcctccccaacaccccctggtcctacagggtcggctgcttacgtggctgttcccacccccaactcatcctccccagggccagctgggaggccagcgggagccatgctctaccactcctgggtctctgaaatcactgaaatcggggctttctgagctgccccttcaccaccccgccccaaggaataaggaaggttcttttaccaggagcccaaaaaagggcactgccttttctgctttgcttca

SEQ ID NO: 111649 - DNA, 486 bp, Homo sapiens
aggaagtgtgatttttcatacgtgttctacggaaatagtaaataatggacttcacctagtctgcagtgtattatggggttcagaataaaatatgagttcaactggcaatttcaaatgcggctttggagagaaaacatttatttgactgaaagatttgcttctgacttgaggcccaggaacattcccagttttaactgtagtgttgcattcctgggaagttctgttccatagcttcctttgcaaattcatgtagatggatttctttagctctgacagtttcctccaaacctttcctacattcttccagggcctttgcttatagacaggggagttacaccaggatggttaggtttcaggttaacaaaaagaaacacttttattgtcaatattaatggcaaacctcgatttttacaaggcttgggtttagcagtgtgagcagatcaaaagcagcttggtttgatttctcaatattctctggagcttaga

SEQ ID NO: 111650 - DNA, 366 bp, Homo sapiens
aagacattaccttggacactaaaccatgaagcggggcctgaaaggactcccttttacagaagacctacaggcttctcccagaagatggaattaaggcaagcacgaaaacttggaggctacctatttaccaacctttttaaaaaaagttttaaaaaaattataatttctgcaggattcctatgtgaccacagtgctaagtgctttatatatattatttcattattgctcacaatagggctaggcatggtggctcactcctgtaatcccagcactttgggaggctaaggtgggtggctcacttgaggtcaggagtttgagaccagcctggccagcatggtgaaatcctgtctctgctaaaaatacaaa

SEQ ID NO: 111651 - DNA, 392 bp, Homo sapiens
cagatggactcagaggaggaagagctgtaaggcatgaaatacactgacacacttaagcataccgatagactgagtatatttgattaaatggcagaagatgaaggtagaaataaggaacttttttgtcatgttaaaaattatcctgaacataaatgggaatcactcaaggcttttaatttagtgaaaacctaacagccattaaagaatatttattgagtttttacccaagtacccagaattcttctaagaatattacattcttagaagcatttaattctcctaaccagccctcaaatcctatctgatttgcacttcggatagattatgctggtacagggaggatggccaaaaggctggaagtacagatcagactagaggaagtaaatctgctc

SEQ ID NO: 111652 - DNA, 499 bp, Homo sapiens
tttctcttgcacttagaggatccccggcactgcttcggatggggacggggtctttggaagatgcatcagcaggggaggacaaaagctagaggtgctttgtgggcaaagtgatgcacctaatgatggatttcagcaactcagcaggagcaagagagaaagggagcggtggaatctacaacacacccagctcattgcacagatcacagaaggtggctgtgaaagcctttctgccataaggggtgtagagctgcactctccatttgtgagccctgccatggacaaggtacagctcacatatgtgcagtgcctcagctaggttttcatttccgggttgttaaatgtttggccaagcacccaggatgtcctagaggaattcagaagagtcacagacccatgtgatgttagagctaggcaggacctcagagacccccactgtagcttgcttgttttactgatgggagccctaaaccccagaaagggaaagagacttatcctgagt

SEQ ID NO: 111653 - DNA, 491 bp, Homo sapiens
aggtgagtcagggagtggccagtgcttcggatggggacggggtctttggaagatgcatcagcaggggaggacaaaagctagaggtgctttgtgggcaaagtgatgcacctaatgatggatttcagcaactcagcaggagcaagagagaaagggagcggtggaatctacaacacacccagctcattgcacagatcacagaaggtggctgtgaaagcctttctgccataaggggtgtagagctgcactctccatttgtgagccctgccatggacaaggtacagctcacatatgtgcagtgcctcagctaggttttcatttccgggttgttaaatgtttggccaagcacccaggatgtcctagaggaattcagaagagtcacagacccatgtgatgttagagctaggcaggacctcagagacccccactgtagcttgcttgttttactgatgggagccctaaaccccagaaagggaaagagacttatcctgagt

SEQ ID NO: 111654 - DNA, 247 bp, Homo sapiens
ggtgaatggttctgcaggtgaagggctctgcaggtgaacggttctgcaggtgaagggctctgcaggtgaacggttctgcaggtgagcggctctgcaggtgagcggctctgcatgtgagtgcctctgtgactggctcgcaagcagcatttgtgcacacttgactggccacaacagaatgttcttctctgttgtcagcactgaggaggaagctcctgcctaagcgaccacagccaggcacccgctccat

SEQ ID NO: 111655 - DNA, 624 bp, Homo sapiens
gtgatcttaaaaaacagaaaagcagatcacagcgcttctctgctcagaatcctccaatcagccaaggagaacttgaagtcctctcctgggtgttataacgctcccatctgacccctgcctgtctcgctccctctgcttccgctaccccgcccctttcttgttgttctgttcttcagggactcctctgcctgtcaccatccaatcttcggggtctagaacaaagccacgcatagtaggatcaatagccattgttgaacgattgagtgactcttgcaaccaattcaaaattgaatgccttgccaagttaccatttgctcatggaaaatcaggctcattgtgtcgaaacgatttgcttcactagcattttatgttgttctttttcctgagcttatactcctcgctaattttagcatcccgtctaaactgatcagccttggagttgaccttttaaagatgttctcgtgtttctaatttcacctgtaatcattaatagcgtaaccagtatttatagatccatcgcagctaaagttttagtgtttgatttttttcgaatgatttcaattatttccatattactttcaaatttctttagaatatctacttttatttttcaaaaaataagag

SEQ ID NO: 111656 - DNA, 239 bp, Homo sapiens
tgctggggttacaggcgtgagccaccacaccaagaccttaattgtttttttagactgtcatgcccacctttgagtggctcttttgttttgagcttttttgcatactcacaaaccaatcagcatgcactcccccattctaagcccataaaagcccagaactcaggcacactttggggactgccccacctttggactgaagctacatgactttgggtgggggctgccctctctgggtcccc

SEQ ID NO: 111657 - DNA, 739 bp, Homo sapiens
cggcacgagattgagggtggctgatgtaacaatctatcccaatgagttgcagcttttatatggatatatagacaaatagtttcaacttttcaaaactattcctagtcaggggaggtaaggctaatgaaaataatttaatgaataattggatccattatatgtgataaatgataaacgttttggtagaaattaatctttggagaattttatcaatagtaaaggaatggtagaataatctacagtacctgacttcccaaaacacaaacacttgaatttgcaaaacatcattttatagtgaaacatgcagaattttttttggtcactggtggccatttgagctccattctgcttagcacgttgcaaaactggaatgagaagcttctgttatatttctctggcagtggccatgcttagacagtctcctccatatggaatttattttgtccccccaaaaatctatggtatctcattatagtatgttctgacctcaatgagtctttgatgttttgaattgttttttctccttttttcttttctctctctctgtttccttcctttttttcttttctttctctttcttcttttaacatggtagcccacatttacatataagaacattgactctcaagaattttgaatcacacttggaagaaagaatgtggattggaaacatgttgaatgtatgattgactgacatcattgtttcaagagcttaagggtgtcccctgtagaacaatct

SEQ ID NO: 111658 - DNA, 562 bp, Homo sapiens
cacctctatccccaccactctgctattacttcctgtaaccagagagaagtcactagaccaatttaaatagaaatctaggaaaatcctcatatgctagcatttcatggttcatgattcttccagaatttgagttattctgtttagtactcattgaggtaagaaaaaattagaaaagactgctccttacattatcttagagactaaggaatcacttttaaatccttttttcttttttctttttttttgcattttgaagttatctatgttcagtgtcagaaaaacaaagtctcctttttttgcagcattcatttgtgaattttagagcaagaaattaatcttagctgtaacattttaatgtcaagtaagcccctttctcataaccccatttgaagttacacattttgctaccatgaaacacacatgctggttaatacaaacaagttactctgaactgggaatacacccccaaaatgacctattacttctttctccttctcaggagaactttaattttgtggcctccaaaagcatttttaaaaaccaaaacggtttaaggaaggac

SEQ ID NO: 111659 - DNA, 318 bp, Homo sapiens
aataattacctatcacaattcaaaattataagaacaaattaaaacaatgtaatagcatttttcaaacatcaaattgtcaaagattaacatgataagatccaatttatccagagaatagagaaccaggaactctattacctattgttcctaggagtatagattgatataaccatgttggatttcaatttgggaatatttgccaaaattttaaatatgtgtaggctgtaatgtaagaattccaagtctggataaaagtctatcctataagagcacaaagatagatgtccaggattattgtttcagccattggttaccatt

SEQ ID NO: 111660 - DNA, 480 bp, Homo sapiens
taaatgtcatttcagaaaaagagccaattcataccatctttacaaaacacagataccctcaaataattgctgctattgcatattcgtcccttggaccccttcttgcacttcaaaatgattgcagcatctgatataacttttttcttctattccaacaacagcaacatcattaactgcatggatagcttagctgacttcaggacctcacagttttaagatctctatgattttatctccagagcaaccttgaaatagcagagctctaccttcactcttattactcacagatctcaaacttggaatcatgtatcattcatcaaagcctcctttaccttctatccactaatccaatgaactggttcttcaatcaattaacccttccaaagatgatctgtccattaacccctcctgaaaaatatttaaatccatatatagcctgtacttcattagcattaactgcaaaaggcttactatcctaca

SEQ ID NO: 111661 - DNA, 406 bp, Homo sapiens
ccaaggaattacaggatgtggccaaggacttatcaaagtcagtgcttccaggctgggtgcagtttgggctgttgtccacaggttccctgctgtagagtcaagtggaggtaccaggttccagatggggagcacatcagacatcctgtgataccactccctggtttggggggcactgctctaggctcctcgaaacttcagggtttgctgctgaccctggtgaaggcgagcacacctggaaagcctctggcactagtccggacttcagaccgcctctgcactcccagtgccccccagggtacggacgcaggccatgctaggtctccagcaggcggacttttctgtgttactgtgccattgcattcccggaagaagtgtccctgatacccgaaattggagagcaaagtga

SEQ ID NO: 111662 - DNA, 272 bp, Homo sapiens
gaacttaaaagagctaaatgttatatctcatattaactttgtctttaaaaattttatcagtctcaaaaaatgagttgaaaaggcagtacatagaggcttaatctaaaaagataagaagattttaattagaattgcttataacacaaaattcctaagattacaacatgataccaaagggaaaacggcaaagaagatttctaatcggcataagccaaaataacctaaggctatataacttttcttttttttctttttggtagacacaaagtctt

SEQ ID NO: 111663 - DNA, 788 bp, Homo sapiens
gaagagatttctgcctgaaaaggtgttttaagagggtaaaatgaactgcaattttcagtgaaaaaaatcccccaagggctttggaagtggtaggaattgatagaaattcaatgtagcgggaaagtccacactctgtagaacttgctttcctgaaaatcagtggacaatacatatcgttagaattctccctcgaactttggggtgctgttggagattatgaaatacatttgtcatgctggaattttaccaagatggaattgaagggaattatttttccatcttaactcttcatttgagagtgataatttttttctcaatgaaaagtttaagaaaatcttcatttccttcctcaaagtgttaggtgaaaaaatggaaatctttatccagagagagagaaaaaaggaggaacagctacagaatgaggaactctggtaagatgaaaacactactagttagaatcaatttaattactcagccagagtaatggagccagctgtaccccgacattatcacagggaaaaatgaactggcaggagggattcttgaaaacagttcaagaagggcgcatcaatatacagcctgttcttgtttcttctccatgtaattagatattgctcactggaaaatgaaagaatttgtgtgcaattccattagaatatgaaaagctgctgcccaagttagaattgtcctccccgttaagctgtacacaaaatagaggtcaagctcgggaggctgattctgtgtggccactgatccttgaatatccagtttaggggatattgaccctg

SEQ ID NO: 111664 - DNA, 224 bp, Homo sapiens
ttcattgtgttgtcttcctgctccaaatttctatgaatcctggcactgctgccaactagctcaggcaattcatagaatgtctcaaagtctcagttttctcatctgtacaataaaaaaaaaaaaaatacctgttgtgctgactcataggagcacatggaacagcatttgtagcaagtaagagcttaaataactttctggtccctttaagtatatgtgaagaaaga

SEQ ID NO: 111665 - DNA, 548 bp, Homo sapiens
ggtcaataaaattatcgcccaacacaactatctatgtccaaatgctaagcctgtccctcagaaagccctagatgaaggctacctttactgggacaaatacaatctggcatttcttctactgcagccaatattctaagctatactgctgtgaatgccacataagctactgacatcttgtttgtagtttcactggaaagtaaaataagaaaaaaaaatcaagaaagccacacagtgtgaataaatattacttttctgaaaaacacacagctctatttaatgctcagtgctcagctgcatctatatggtaatccattatagtacactcgaaatcgaaattaggtattactactgatcagcacatcagggaatctgtcattcttttaactgattatccatagttcttttttcttcagaacctactgcatgaccaggaataatgtgaaatgtaagctggagtctacacaagatgctatagtctactttataactgctggtcttctgatttgtgtgggaaatatttttaaattattatcagatgactgcaacat

SEQ ID NO: 111666 - DNA, 405 bp, Homo sapiens
tgatgtagcaggtctgatctaggaggatcccctcacattttccacaggagttcaagatcagcctgagcaatatagcgagaccccatctccacaaaaaaatatgccactgcctcaggagaaccttctatgatctctctcagaccaggatggaaccccatgttacatacatccatgagattatctcctcttagtactggtcatacttctaattatttgttcaaggccctactagactcaagcttcaaggaaacaggaccatggctgtcttattaccatgtcatcatcactgagccagggcccagcaccctggtgggcactcaacaaatgtctactgaaggcatgaatccctcacaaaaattaaggcagcaactgacaattcaaagttgctatccctgtgcaatatta

SEQ ID NO: 111667 - DNA, 255 bp, Homo sapiens
  misc_feature (213)..(213): n is a, c, g, or t
tgggtgttgagcagatgccagcatccctaccaggaagaaactgggcagggggctcgtgtgaaggtactgagggcacatgaggctggcaagcttgaagactagaaaggagatgagggaggctggtgtgtggtttgcagagagtgcaggaggtgaggttggaaggaggcggtggctgggccacctccagcttgtgagccagtgagaggatgtgtntgcagaggaggagttggatgaaatgtgtctgtagaggtggag

SEQ ID NO: 111668 - DNA, 298 bp, Homo sapiens
ctgggaggccattacttaagggagatggagatgggtttttggtcttaaaatatgcacacctgatgactacaggtgataccatagcaaggttgcaggctttttctctacagatatccaggtcgtaaagaattcaggtttcatggcctttgttgtatgttcttctttttacaaccctttaaaaatgttaaaaccattcatgctcgtgatggtgcagaaacaggcctcgggcaggatttctcccagaggccaggggggtgagatttctcccagaggccgtagtttgccaacccctgaccaa

SEQ ID NO: 111669 - DNA, 300 bp, Homo sapiens
caccactgcctgtgctgttttggatttataacttagctgcatttgtttccaaatctataatatggaggtaataatggtatccaccacttggagttctgaggaggaacacatagttaataaggagagcgtccagaacaaggccagtgcacaattagcatggaagcacttgttataaatagtagatgggcctgagtagactggccccacctcttcactctcctcccctcggccagcacaaaatagataccatgctagatgccgccttgatgccaagtttggtctagctgaggtaaagccagc

SEQ ID NO: 111670 - DNA, 267 bp, Homo sapiens
gcattcttgcccttccactgtactgcacacagcaggagcttcattcccggatgagccccaggtcagacactggctgggctggacccatgagtcagggctctgcggcagactgaatcaacagagaagacaggcctggcccagccagtggcccaaacagaaagggaaaggccaatgcctttgcttggtctgggctgggccggggctgtaacagttgtaggcagaagctgagttcaagctgggggtaaataaatacatctccagcaaagc

SEQ ID NO: 111671 - DNA, 249 bp, Homo sapiens
ctgaacatataaaccacattcccatgtttaacagataggttggttaattttatccaaggtctaggaatatagcaagttgattacaggacaagaaacagcaaaactgaaatccaacttctctgcttttgaaaataacctctctgaattcagaaaaggagtaatatcttgatagcctacttgctaaagccatggctacttttcaactggtttgtactgctattgttgcactcaatgttaaaatattaaaat

SEQ ID NO: 111672 - DNA, 377 bp, Homo sapiens
gcacttcggtgcttctgcctgccctgctgtttccattttccccagcatgccagtcaagagctgcagacatactccaactccccatgccacagttagggttaccagtactttctttcaaattagaggagtgaaatttgctactactggtcacttggattgtctctgtgaatttggacttaaaccctacaatcaggtaaataatcttgtgctccccatttattccaaaataatagaaagggaatgcttttaaacagtaattaggaatattaatgagatcctatctgacttagttccagtaagtgctaaaaaccacctaccaatccagaaggaaaatactctgcaaagcaaacaggagtgtatactcagctcctgagagt

SEQ ID NO: 111673 - DNA, 709 bp, Homo sapiens
acatttaagagcagtgttttaacagttttttccaaagccatgagatagaaactgtcatggaaactgaagctcctctgactggaacttacttaggccttgccagggtgggcaaaagatgacgttgaaaaagatcaggtagcaccctgcattttgccattggctaaagtggggtcagagctggttgccattttctctctgtcttgaggttcaggcctgtcatcttctcaaaatgcctccaggcctgttgggacagtgaacagtaatggccaaactaaaaactttaagaaggatatgatatgctaaatgcagggaaaaagacttcgctttaaccctcaacaaatgtataaagagggccgggtgtggtggctcacatctgtaatcccagcactttgggaggccaaggcaggaggatcgcttgagcccaggaattcgagaccagcctgggcaacatagcaagatcccatctcttaaaaaaaaaacctagctgggtgtagtggtgtatgcccatagtcccagttacctgggaggctgaggtggtaggattgcttgagcccaggaattccaggctgcagtgagccatgattgcactactgtgctccagctagcctgggtgacagagccagaccctgcctctcaaaaaaaaaaaaaaaaaaggccgggcgcggtggctcacgcctgtaatcccagcaccttgggaggccgaggcggg

SEQ ID NO: 111674 - DNA, 509 bp, Homo sapiens
tgaccatgctggtcctagaacaatggccggggctgccccacgttttccttcctaaggcaaagccacgacgtggcccttgctcctccccgtgcagttcctggagctcctgtgggaaccaagcttccttcgttttcttcctttctcgagtagctcaacacagacaccaccagccactgagggtggggagtcgggaagagcgggctgcagcctcagagcctgtactcccagcccgaagctgtctcatgacgcatgggcccatagtgtgcgtgcctgcgagcgtgtgtgcagctgggagggcgcggtatgcgtgactgtgagcatgtgcacgcacacatgtgtgccgtggctgtgggagcatgcagggcatgtaagggcagtgctgaggcctcaactgtctgcttccacataccctgcactccacatgggttattagctggaataaatcataaatacttcattatacatcatgctgttggacgcagaaaggccccatccatccacctcaccac

SEQ ID NO: 111675 - DNA, 196 bp, Homo sapiens
ggtcgacatgtcattcagatatgcagctcagtgagattaatatcactatatcactgtgtcatggacaaagataataaacaggagtgactgtcagtgaatacaactggttataactcagcaatctccatagcttcattattatttacttatcactgaatatgcagtaatttgtccagtaaaagatggactgtgaaat

SEQ ID NO: 111676 - DNA, 269 bp, Homo sapiens
gtgagtcactgcccctggcacctatttattgttttggtatttcatgttactcctaagcttgaaagctcttttttctatatacagaattcatagaatttttgaaatacttagttttctttacagctttttccatgcattcagcatttcatggttaactctagtcagactggaatggctttgttatgccctggcccacttgctgccgaattcccagaagtgcctctgctgtgctggcataaaataacctgaaaagattctgaaaagccagg

SEQ ID NO: 111677 - DNA, 406 bp, Homo sapiens
gaaggtacagaggagcactgtttataaaaaccctacactggccaagctgtgtgcctgggcatgacactgggctcacccaaagggcaactttttcccattcacacagtgggctaatagtggccatgattttctacttccaaggtcagtacatagtaccttaaaacaacacatatcaacatagtgttggaagttctggccagggcaattaggcaggagaaggaaataaagggtattcaattaggaaaagaggaagtcaaattgtctctgtttgcagatgacatgattgtataacgagaaaaccccactgtctcagcccaaaatctccttaagctgataagcaacttcagcaaattctcaggatacaaaaccaatgtacaaaaatcacaagcattcttatacaccaata

SEQ ID NO: 111678 - DNA, 380 bp, Homo sapiens
gggcaggtggactgcttgagtccaggagtttgataccagcctgggcaccatgccaatacctcgtctctataaaaagtacaaaaattagctgggtgtggtggcatgtgcctgtagtcccagctacttgggaggctgaggtaggaggatcatagtttcaaagtgtggcacttactggttctccactcactccctcctgccgtcttgtgaagaaggtgcctgcttccccttccccttctgccatgattgtaagtttccggaactgcaagtcaattaagcctgtttcctttataaattacccaatctcaggtatttctttacatcagtgtgaaaacaaatgaatacagtccccttccctgaggtgccttctccttaggcaacca

SEQ ID NO: 111679 - DNA, 324 bp, Homo sapiens
tttcactgtgttagccaagatgttctccatctaggagagtatttttcataggcttcagttggggaagaaaaaagccataaataaaaagactgatgcatttaactacatcaaaatggaaaaacttcagtatatagaaagacaacacagacaagattaaaacaagctacagactaggagaaaatatttacaacatataaaacagagaaacaagtactatctatactaaatacagcccttctgcaaaatcagtaagataaaggtaatatcttttgtgccaggaaaacaggcaaagcatgtgaacaggcaatttacagagctacaagt

SEQ ID NO: 111680 - DNA, 248 bp, Homo sapiens
agccatgtcccggggctaggggcgctgtgggcgccgcgcccgccgctgcccggcaccggaagccaagagggcgttcccgacgggctccgcagatgcccctccgcgtcctgccgcccatcctgcccggattgtcgcgggccgggggcgcgacaggaggccgaggcctgcccgggcgcagaggcctgcctgggcgcagcggcctgcagggcgcagccgtccctccgccggtcggggtcccctcgctccgc

SEQ ID NO: 111681 - DNA, 366 bp, Homo sapiens
gccacggacacctccccatcaaaagccacgaaacccccaccatggaccaccacgaacccccagtggctgaacacctcggaaccccgaccaccgacctcctcccggggccccaggtaggacagcctggatgctgggcaccgagccaggggcctcggggctgggggcagcttgggtgctagcgagaggaagttcctgggggcgggcatgcggggagacacagcacccctgtggggggggcttctttctccaggctgggccttggcctccagacgcctctctgcccaccaacccctttgtattgagaggggcctcgacccctcctcatcccctcagtgaaaacaataaagacaaatttttgttgcttca

SEQ ID NO: 111682 - DNA, 161 bp, Homo sapiens
aggaaaaataatcctgtgggtccacctaatctggtaagtgttgtatttggaaaatcaaaccccaaattaaacgcaggacgtggaaactgacgataatatttaactatgacttccacgtgcacatttatctgaattggctaataaatcaaactattcgtctt

SEQ ID NO: 111683 - DNA, 747 bp, Homo sapiens
tcacccattgtttctgcacctttcaggaggcaagggggaggacccgaagtccccatgggctgcaaggtgggtgcacaccgtttctgcttctgaagtccttccttggcttctgagaacaaccctcttccattccctccaacccttctggctgttcattctctatccctgttgcaggctcatcctcctcctcctgacctgggaacatcagggctgctcaaagctcagtcctgggccctcttcccttctcagctttagacctcctgtagtataataaaaatagacatttggtctttgtccttggttcctgaaatagaaaggctaaaactcttggaattttctgatagaacatttgttattacttacattgttagtgttattttgttgtaacataattgttttttataaagagtcccttttgatcacacctgaatttatgctaatgagatgactgagagtgggctctctagacagcctcaagatgggctgggtaccagaaacaccaagtgattagaggactggaacttttaactccacccactgacctccagaaaggggcaggggctgcagactgagcaaggctggtggggcttctgggtggggagcatgtggagaccctggaggctggtgcacccagaggggccctggaagtcccatgcccatagcacactctgtcttctatctcttccctttgccagttcctgagttttcttctttataataaactggtgaactcaagcaaaatgtttt

SEQ ID NO: 111684 - DNA, 441 bp, Homo sapiens
  misc_feature (100)..(100): n is a, c, g, or t
  misc_feature (441)..(441): n is a, c, g, or t
gcccgggagttcgagagcagcgtgggcaacatggcaaaaccctgtctttacaaaaaaatacaaaaaattagctgggcatggtggctgtcgcctgtagtcncagctacttgggaggctgaggtaggaggatagcttgagcccaggaggtgagctgtgatcttgccactgcacggacagagcaagactgtcgcagaagaaaatataaaattcaatattccaagggctgtctccctgatagtatttattagctctttatttgtgtaactaagtaatcaaaattttaaaataaataaaagaaaaggtcaaaatacatcgaactacacatggggcaatgaatgaatttaaaagacatacatgttcagttcgtagctaataaaaacatacaaaggaataactcacatgctctacaattttctatcctgagggtctctctctcactcn

SEQ ID NO: 111685 - DNA, 519 bp, Homo sapiens
ttaatgatggtgatactttctgaaaaatgcatcattagatgatttcatcatgctaacatcatagagtgtacttaacacaaacctagaagatggtatagcctactatacatctaggttatatggtatagcctattgctcctagtttacatacttgcacggcatgttactctactgaatactgcaggcaacttgacacaatagtccatcactgactgaaacaacgttatgtggcacatgaccataattttattcctaggaatatcctcaacaggagtaagcaataagggcacaaaaataacagaatgttaatagaaactgtattatttataatactaaaaattagaaattggccaggcacggtggctcacacctgtaattccagcgctttgggaggccgaggcaggtggatcacctgaggtcagaagtctgagaccagcctgaccaacatggtaaaacctcatctctactaaagatacaaaaagtagccaggcatggcggctaatgcccgtaaacccagct

SEQ ID NO: 111686 - DNA, 685 bp, Homo sapiens
ttaggcagaattagtgattcctgagtctttgctcttagagcttgtaggtcaagtgtgtactgtatttctgttctttcacagttttttattcgattgtctgtagaatagactttattattgtcaaggggaagacagccttagcaaaattttgaaataagtcattgtgtgcctaagcataaattagtttgtgagaacatactttttaaagagaaatgtagtagggtgtatagtatgtttgagtatctttttccaataagcattgcatgtataatcattcactcattgcatgtataattattatttaaatattctttattaattaaagacctctctggtctctccagaagtcttccatggctgccctcatccccaccctccagaggaatctgaagccacatgtgctccctggcacccacagcccctgcctctcccagagcagcagtacctgagcctcagtggattccaagaatcgaaacccttggtctgctgcccctccctcccagaatgtttctgtctcattcttacctactcaaggccctttcagtagccccttggggtattctcttcctatgcaccagggcaacttctgaactcaccactttcctggaaagacccccaacatcttcggggagcggtcccctacaggcctggctgcagatgcccgtgcacacaggaacactgttta

SEQ ID NO: 111687 - DNA, 695 bp, Homo sapiens
ggataatgtgggaggtggaagggtaggggtgggagaaatcctggtattctttaatgaggagactagaaagggaaaggaagaatataaaatccaacttttgttcctccattttgattgtcctaaagcatttccaaatagataagaccttttcaagaatacttctcagaaaaaaaatcactcagccttcaaatagaccttgacttcagatgacacaaaagctttgggaagactcttgggtagtggactttaatgaaaactgaagtgtagtaagttatctatggggtaggaatagaaattttcataaattcaatgatgtaagtattttttaggaaaattaaaaattccaatatttcaaatattctttttttttttttgagacagagtcctgctctgttgctgaggctggagtgcggtggcgcgatcggggctcactccaacctcaacctcccaggctcaggcgatccaaccccgtcagtcccgccaagtagctgggactacaggtacgagccaccacacctgccttttttttccttttatttttctttttaattttagtagagatgttatgttgctctgttacccaggccagtctcaaactcctgggctcaagtgatcctcctacctcggcatcgcaaagtactgggattatagacatcagccacaacacctggcctaaatattctttttttcgggaa

SEQ ID NO: 111688 - DNA, 674 bp, Homo sapiens
  misc_feature (390)..(390): n is a, c, g, or t
gaatttaatgaaataggttggcatggctatccagagggcagcccccaaggccagggacgctgggtgtggacaggaaaggtttgctacacacagtgtgatgtctcttgaggttagagaacctgtgcctctttgggaggatgtagtttgccctaggcctggatttcggtagaatgagcaagagttagccttgaagtcctgttcaggtgggccccctcttgccctgtacccagaatgagctgatgtgagatgccgagagtggcttcgttgggaagagagcccggaccttgcttcccgttggccttccaggatgctaactgctcgggccgaacatcctgtgggaagataatcccctgcttgtactgagaaattcagaagcaggaggccgggcgncggttgctcacgcctgtagtcccagcactttgggaggccgaggcgggcggatcacttgagatcagcctggccaacatggtgaaaccccgtctctactaaaaatacaaaaattagccaggcatggtggcgggcatctctaatctcgcgacttgggaggctgaggcaggagaatcacttgaaccagggaggcggaggttgcaacgagccgagctcacaccactgcgctccagcctggggaacaagagcaaaaccccatctcaaaacaaagaaaagaaattcagaag

SEQ ID NO: 111689 - DNA, 319 bp, Homo sapiens
aaagataagaatatgtacctccagaattcttccagctcttctgcactgcaagataaagtaatacttcatgaagacagaaaaaagataccagatcaaagtgtggattcacaaaaaataacgagcgatgctagaaatggtatatgtgtgagaaaacatagaaaaacatcttttattaatctaccatttaattttatcagcagtgtgaaaacgaactaatacaatacatcatgtttgaaagcagggcaaactcataggctcctggtacaatgaaagcaatctccaaaccgcatagatgcaacaataaaagctgaaaactttg

SEQ ID NO: 111690 - DNA, 146 bp, Homo sapiens
tgctgggattacaggtgtgagccaccgtgcccggccggaccggatagtcttatttcgcatttgtagaaacctagaacaaaaataagcatgtgggaaagtttattctgcaaatctgcatttttgaagggacagagctgctgagagcc

SEQ ID NO: 111691 - DNA, 681 bp, Homo sapiens
gacctcgtgatccacccgcctcagtctcccaaagtgctgggattacaggcataagccactgtgccccaccggcttaaaatttcttaaaacattgggggaaatacaattttaggtgatattctaaagctcattgtgcctattgttatttttttccttttctcttttggaacctggagaatgtaaaagaacttttcttatgaagctgtatgcttaaaatttgtgccgttttctgtagttacgttatacgttaatacataatttaatgaaaaaagcctgggctcagaatcatgctaccatttacaggagaaaaaatatgtactaatttttaagatgtattatttataaatactactttgtttcatgcagtggtccttattattcaaaggaaagaatcaggaaccaggatacagttgttaaaaggaagagccagaaacagggatataaagaaataattagaaaaaacttaatgatatatatttatgaaagaagatgcagcaaagggaatcagtcacagcatgaagaaaggagatgtcctagtgattcagggctaagttgttacatataaaatagatgtcatatatgttatatatagttgttataattacatacaatgcaatagatgtccccttagttatcttaagtaagtatctatggctttctttatttctctcccataaaata

SEQ ID NO: 111692 - DNA, 289 bp, Homo sapiens
cattttcattatgcatagcacagatatgatgttgtggccttctctgcattgtattaggaggcacaatcttaatttgtcccattattggtgatgctaaactaagtcatttggttaacatgttatctgccaggtttctcccctataagcttgtttttctgcttgtaatttagaagttacaattttccctttgtaattatcatatggttgtgctttaagaacacataaaatattggttctctttattctttttcccattaattttagcatctagtgatgattctttccttaa

SEQ ID NO: 111693 - DNA, 351 bp, Homo sapiens
gccttcatactttctattccaattcctgcatctagattatacattcttcattggtgtagaaaaaaaggaccagtttggctcaaatttgtgattttgattttaagttggactgcagcacttttgctaaattgtggttcatatgagctcgtaatggtatagtggacattttgattctgatctgtctccctccacaacttccctccccctcccaaactgatgcacgtataattttatcatataaacccatgacttagcttcaggggaccatgttgggaagacttaacatttgatgaactgtaaccgtgtaccttattcactcgttcatcttaataatttatatgtgttgtatta

SEQ ID NO: 111694 - DNA, 201 bp, Homo sapiens
tactagcaaaccgaattcagcagcctactagaagaatcatatatcaagtgagatttatccctgagatgcaaggatggtatgacatatgcaaatcaataaatgtgataccacacattgacaaaatgaaggataaaaatcatataaccagccaggtgcagtggctcacgcctgtaatcccagcagtttgggaggccaagatgg

SEQ ID NO: 111695 - DNA, 194 bp, Homo sapiens
taaaattttaacttattttagattcaaggagtatatgtgcaggtttgttacacgggcataaagtcagttttctttgacacctaagattaaaaagtgaaagatattttcattgaaactggtttcctttaacacagtctttggtttgtgagaattttcccatttttgaaaaggattcctagaatacctaaatattg

SEQ ID NO: 111696 - DNA, 316 bp, Homo sapiens
gcaaagagccaggaaaagaattctaagcagagggaacctaagcatgtgtaaaggtcttgagactggaataaatttgctaaatgaacagagaagactcctgtggctgacggaaatgaccaatagaataatttccaatgatctatggagaccaatagagatagatggctggaagggggaggcaggaaccggctcactcagggctctgaacgccatggtaaggaatttagattttattctaagggcagaggaaagtcactgagtgacatagtcagatttgtgttttttgggttttttgttttgttttgttttgtttttt

SEQ ID NO: 111697 - DNA, 751 bp, Homo sapiens
aacaaaagcgaaactccgtctcaaataataatcattataatttctaatgtttttatgtgtgatctaagtttcaaaacattacttgtcttgatatttggtaaattagtagtaatgtgaattagcaaagcttgagattttttttttatacttgaaccttggtttgagagttaaacaggaaaaacatcaaacattaatggaaacgtatttaatctgttaaattataccataatagtctatttaatatatttcgtttgtttttcattaccaataacaaaatatattagactattgtagcatatgattctattatcttctcagttaatgtgtatgcacatgtgtataagtgttaaggaaactcagaccatcttatttctacatatgcttttatatctgcaaagatgatacataattcttgtagagccttatttgttcaaaaggtaattacgtatttgatacatcatttccagatttagaaatttcgtatttgttataggatgcacaaacaaaagaaaagctttttaaaaaaaaatctgctttcaattgttcgatataggacaatcttgaaatctttttaactagggttttcaaaagcatttgctctcatgaagaacctacccattattcccccagaggatattttacaacccagttaaacaaacacctaaaaatgttggattattatggaaatacactaccttaaacctccattattatatagtaacttgaaagcagcaataaattatgtttgctt

SEQ ID NO: 111698 - DNA, 148 bp, Homo sapiens
gtcatctttgctctgatagcattataatgatgatgaagacaattgctaggttggtgagagaaggctatatacacaccagaactctccacgtatatggcaagttcatatattttgttaagtatgtctcattggagaccttcttttcccg

SEQ ID NO: 111699 - DNA, 516 bp, Homo sapiens
ctataatgaaatatgtaatttaatttaaataatatttagaaattatatccatatattcaacaagtaattattaagtgtatttatgtgccagataccattctaggtgcctgggatgcatcagtgaacagaatacatctagtgctgcatgagggagcttcttttttagtgaaggaggacattagacacagatgtataaatgagtcattgaacaagataattgcaggcagagatggattctatgaaagaaataaatcagggtgatgagagggaaagtgacagagagacagctttaggttggaggctaaagtgaggcctttgaagaaatgataattcatgtgtgacttgaatgacaagataaaatgtagagagttagaggctgaggattacaggccaaggaaatagccctgtgcatatgttgtgagacatagctccaagacatagacatgcatagtttaattcaacttgactcttccagaaatgaattgaaggtcgctaggcctggagtgtcaggaagca

SEQ ID NO: 111700 - DNA, 380 bp, Homo sapiens
taaaggtcacagagatcagaaggcaggtacttgtaggctcattagggacacagtaaaacagacttaggaagccgcaggtgttagaaccaagtaccgtggtgggagctgtgggaagacagggttggggttctgctgggggttatgttactcttggtctggtgctcagggaattctgcctagaagctggatgagctgttgaggatcctgtggctgagttggagccatctctcttgctctgctcaggtatggatgtgtttgtgcctctgtcagcctttgactttgacattttgtgtgtttcatcctgccaggctccttcatacgagtgtgggtagggaactcctctgtgctgttttcttagtttttttagtgcacccaggggc

SEQ ID NO: 111701 - DNA, 272 bp, Homo sapiens
gctacacacttaggctacatggtatgacctattgctcatatgctacaaatctgtacagcatgttgctatactgaatactgtaggtagttataacaaagataagtatttgtgttcatctgtgtaggccacttaccacaaatggagcttgcaggactagaatttgctctaggtgagtcattgagcgaatgccttgtaattaactaatttcctatttggtacctttcccttctttttccttctggaatccatttactatttggggtcacttgctt

SEQ ID NO: 111702 - DNA, 690 bp, Homo sapiens
gagagcactaaaagtattccaaaaggaaccaactaacatttgagtggattttaatatgatcaaaaattctcttttgaatttatattatgtgtcaggaagcctctggggatagagagtccattaaaatgagcagtgtgctcttttgcatagtgggataggcagagtttaaagatgacccccaatgacccattctttatatcattccgctcttctttagtgtcaacaggatttcactcccttgattgggttactaatcagttgactttgacgttatcaaaagagacataattctgggtggatcttacccaatcagaagaacgtttaaaagagatgaagcacttcctaaaagagattcaaagcataaaaaggtccatggaggaaccacatagtaagtgcctgagagtggcatgtcagagctaagagcagttctgggacaatagatagagaagaaatggggacctcagtcatgtcgctgcaaaaaaaaatgaattttcccaaagacatgaggatgtaaatgcacttggctgatattttgatttcagctgtgtgaaaaccttagcagagaacccaatatactatagccagactcttgatctatggaaactgtgagataataacttttttattttataagcctctaaaatggtggtagtttgttcacagaaataaaaatctaacacaaggagtcca

SEQ ID NO: 111703 - DNA, 606 bp, Homo sapiens
ccactaggttttgtttcctactttttaaattggtgttaagaaagggaaaaaaatcacaagtttgtctaactcagtagaaaaatcgacaaagcatttgcagacaacttggcaagggtacagagaaatggatgtactgtttttcagtattttgggagggtggtttgagcagcatttattgacaatttcattagtggggatgtttctattgaaaacagagttaggaagtcataaaatgttcttgcaatataaggtaataataccactggcgtttatcttactgttttcatgttctaagtgcatgcatctgagtaaaaggatctgggctgcagtccagtctgagagatgccagcaaaggcttcctaggccaattcagtccagtaaatccctcttcgatcttctcttccacacagacagcagtgatgagcatgcccatgaactcacatgattattttggggaaaatgaaagagttgtattctttttgaggtagtaattccactttcaggggcaaatacattttgattattttatcacccttcagtgagttgtttttgttctttaatcacggatgtatgtttgaagtaagaagtaaagcataaagtatatga

SEQ ID NO: 111704 - DNA, 402 bp, Homo sapiens
ccgggaaccagaggttgcagtgagttgagatcgtgccactgcactccagcctgggtgatagagcaagactctgtctcataaataaataaataaaataaataaatggttttgcatataataattcaataacccttacaataaccctgtgaggaagagataggtactactattatctcagtttaacttatgggaacaaactgaggccaagaattgttaagtaacttgtccaagggttactcagtttgcaaatggtaaagtcaagatgtgaacccaagcaatgtggcaccacagccctcttaaccagtatgttctactgcctctcacttgaagagtttagaattaggtgcataactttcaaacccctggaggaaaaaagaaaacaatctagcaaaacctaagaaa

SEQ ID NO: 111705 - DNA, 335 bp, Homo sapiens
gggtgtcccctggtgccttgggggccaccaggtgtgtgtgtctgagtgtggatggaggccggggggacgttcggcagaactgagcctatttctgtccttcaggcctgcctgagctgggccatgggcatcagcccagcgtcctcagcagtgccccctccctgaagtcccctctcctaccaaccagaggcagaatctcctaccagagttaggtaggagtttggtcttctctgctgttttgacacggtgggacagacccattggtcaagaggagggtctgtccatctgtccagctgttccagttccagacatgtgcccacctcccccaaccccaaggt

SEQ ID NO: 111706 - DNA, 1082 bp, Homo sapiens
tccgggtcagaccggcgcggggcgctgcggcccaactccttagtaggacgacgtgactcgaggggccggaggacggagggctcctcctcatccctggaggttccagggatctggcagagaaagaagcccagtctcacagcaatgactcctgaacatcctttgcaaacactatttaggacagatggactgaagtaggccctggggagagttgggggcatttccggaggccagaccaaaggtgatctccaggagatttggatgttagtgcaggatagctcagagccaagtggcagataagtctttgggagccagaagggctctttcttctctaaggaacaagtgtagacctataggggcaagaacctgtggcaaccctgggagaggtctgcagattcaggagggaacatcccaaaactcagcagaggaggagagggagcttttgttggtcacctggaaccactaccaatccatgttcatgtcaaattaaatgatcactttgaagtcaaaacaaaaaaacacaaaaaaaaaaaaaaaatttttgggggcgccccatgaccccaggaaaaagttttcgaaaccacatcgctggggcggcgagcgcccccagcgaagtatcggtgaccctgtgctaacacaggttgtacacaaggagacccgcgacagacatcgcgtgggggactccacaccaataaaaaaagccgggggacccgcaacgtttgtgaacatcccacaagagtacgaaggacatagggactacacaaggggccaagggacgcaaataaataccggcgcggggggaaacaaggaaacaacatagagcagaaataccagaagaaacgaaaaagacgcgagaacgccgatacgaccaaggagcgagcgaacgcgacagccacaggaggacgaagaaagaagaaaccaaggacgaagcaaagaagagagagagaggagagacaacacaaagaagagaacgaaacgcaacgagaggtgagaacacaacaaaaaagcaggacaacaagaagaacacaacagagcgaaacgagaaggcaaaggaaaagtaggacgaagccacggcaccgacggat

SEQ ID NO: 111707 - DNA, 873 bp, Homo sapiens
caaccgggaaaccacataccatggacagtgctcggggaatttcggctcctcctcatccctggaggttccagggatctggcagagaaagaagcccagtctcacagcaatgactcctgaacatcctttgcaaacactatttaggacagatggactgaagtaggccctggggagagttgggggcatttccggagggaacatcccaaaactcagcagaggaggagagggagcttttgttggtcacctggaaccactaccaatccatgttcatgtcaaattaaatgatcactttgaagtcaaaacaaaaaaacacaaaaaaaaaaaaaaaatttttgggggcgccccatgaccccaggaaaaagttttcgaaaccacatcgctggggcggcgagcgcccccagcgaagtatcggtgaccctgtgctaacacaggttgtacacaaggagacccgcgacagacatcgcgtgggggactccacaccaataaaaaaagccgggggacccgcaacgtttgtgaacatcccacaagagtacgaaggacatagggactacacaaggggccaagggacgcaaataaataccggcgcggggggaaacaaggaaacaacatagagcagaaataccagaagaaacgaaaaagacgcgagaacgccgatacgaccaaggagcgagcgaacgcgacagccacaggaggacgaagaaagaagaaaccaaggacgaagcaaagaagagagagagaggagagacaacacaaagaagagaacgaaacgcaacgagaggtgagaacacaacaaaaaagcaggacaacaagaagaacacaacagagcgaaacgagaaggcaaaggaaaagtaggacgaagccacggcaccgacggat

SEQ ID NO: 111708 - DNA, 403 bp, Homo sapiens
  misc_feature (377)..(377): n is a, c, g, or t
cttctctctactcatgcttctcacaattacaggaatatgctcttctcatcccttcatctgttaattctcattagtcttcaaagtcttagcctaggcatgaattcctgtaggaagcgtcctctgactcaaggctgggttagagtccctcctggagttgacacctttggaagtatctaattagcccatgagccacacctccttctttaagaactgagcctcacttgcccactcccccaatttacagtcactggccccagagccatgtttttactatcctaagttcagagccaggcctggctctgaacttaggataacctacattaatgtataattccagggctgggcatcgtggctcacgcctgtaatcccagcacttngggaggccgaggtggggtaccgagct

SEQ ID NO: 111709 - DNA, 377 bp, Homo sapiens
aggctctgtcagaaggaaggtctagggctgaaggctgtttttcagattcttttgttccctttatttggtattctacccttttcctgtggatgtggcttcctgagagccgagctgtattgattgttatctcccttctaggtatagccacccagcaaatctaccaaactttgggctggaactaagggttgtctgcccggagttctgtgttgtgaactgtttatgggtttctcagctgtggataccagcacctgtttcagtggaggtggtagcgggggtgaaatggactcttccagtgttcttagcactggtgatttaatgctctcttattgtgctgatttgcctccttctgggaagtggtgctttccagagagcatcag

SEQ ID NO: 111710 - DNA, 589 bp, Homo sapiens
cacagagccctgctctgggctgacgggtgaccgtttgtcagaactctccagatggagcaattagggcctgtgcatctcactttaagccaactttaccttcagaggagaaaaagacccaggaacgatgctcacccccattgagctgatggtctgcctgctgaaggactgtgtgcagtacacagacgtctgcaacttgccttgaaatgtgccaaaaaataagatggtgagggcagcatagctttggggagcggaccacaggtgtgagcgaggggactccacaattcacttcaactttgcaggtgttcgaattttttttttttcccgagatgaagtcttgccctgtcgcccaggctggagtgcaatggtacaatcttggatcactacaacctctgcctaccaggttcaagcgattctcctgcctcagcctcccaagtagcttggactacaggcatgcaccaccatgcctggctaatttttttttgtatttttagtagagatggggtttcaccatgttggccgagctggtctcaaactcctgacctcaggtgatctgctcacctcagcctcccaaagtgctgggattacagac

SEQ ID NO: 111711 - DNA, 462 bp, Homo sapiens
tattatttcatgtacttttcccgggtaagcaatttatttaacttcaggcctcagtttccttatctgtaaaatggacataatcgtaaggcctacttcatgagactaatgtaaggattaaatgaaataagggaagcaggttgcttaacatagtgcctgacacatagaaagctttttttaaaatgttagaaagtagagataatatttttcatcttcataccaattctatggcgcagagaggttaaactgcgagcccaaatgtgcacaacaaggagcactggtcagcccagagcccccatcagcgcaccgatgcttccccttccctcccagaagcacagaaagggcggctggcctgcaggatttggcagagcttggctgaggagccacagcagacgggtagcaaaaaggcaccaacatgggtggaaagagaatgtccagtttctatgagatccctaacgccgtcct

SEQ ID NO: 111712 - DNA, 279 bp, Homo sapiens
gaagtccacgtgataaatgtttgacacataaaaaggaagcagttttcctagtgtctggcattacacagaaagctgctctctatatttgtgagtactctatttcacaaaggcctctgaccttctgtcaatattagatttcatttagttaagttaaattagtatttacagtcaaaattgggaattataccaacatgttatgattaatgaagttatggaattattctgtactggaattcgaacaggggaaggctttaaaaaggagaacttaggctgggtgca

SEQ ID NO: 111713 - DNA, 109 bp, Homo sapiens
catcattcttgaaggatcatctcaatttactcttacagctatccaatggcattacgtgttataattttcatttcacagatgagcaaactgaggcacagagattaagtaa

SEQ ID NO: 111714 - DNA, 847 bp, Homo sapiens
atcataagaaagttaaaaaacaaaattcaaagttaaaaaaaagaaattctaagaaacaaatgatttccaaagaagactcctataaccaggcatggtgttaattaattgaaaggtaagagtaaagagtaattagatatacaaaacctctaaaaatgtaattcacaagaagccactggagtatgtgctctaccaaaacaagaacataaactaaaaaatatgaagacctaggattcagtaacagagaattcagcaatagagaggaacaaagggaatttctagtttaatgtgaagggaaatctgtgaaggaaatcttttaaaaggatcttaaagtattacattgaaaaatactagaccacacactgaaccaattaatcacaaaatctggggatgggccccaggcatcagttttttctaagctctttaggtggtatcaatgcatagataagtttgataaccattggtgtacaagcttgttgtacaaaatgtgctccctgaggcagtagcattggcatcactggggaacttgttagaaatgcagtatctcaggaatggcagggacatggaaatatgttttaaagacttgctacagcctgagtgtggactactgtgagagtgagaaaattctaggggctgcagtcttagaggaaagccccacactctcatgggctttacctccagtacctccactaaaatcttatggtgaagaaccaagaaagttgatgtccttgtgcccccagcagaggaaagggaagaataatcattgtaaaaacaccagtgccttctccacaaggagggccagctctccaggggaagactgtcagaggcttatcccagtggaggaagggta

SEQ ID NO: 111715 - DNA, 750 bp, Homo sapiens
agaaagcttttctcacaacaattcaaaggaacatccctaaatggagtcttaccagctggacttggatcacctacaggaatctggaccaactgctgtgacctggggaatccatgtgtccagtcctagctcaggtgcccacccctgaaccaacaagcaaggttatggagaatccatcctctgactggccaggcctgggtcaggtgtccaccatgaaccaatcactgaggctatgaagagtccatgctatgataggccaaactggagtcaggtgtccaccaaaaaccagtcactgaggccatgaagagtccatgctatgattggccaggctgaagtcaggtgtctaccggagtggaccgatgaaccactcactgaggccaagaagagtcctacaggattgaccaggctggagtcaagtgtccaccatgaaccaatcactgaggccatgaagagtccaagctatgattggccaggctggagtcaggtgcctagccctggcccaaatgttgttagaggttcaggagcacagaagtaaaggctcttctagaaaaatatacattctattactaacagaagagtagtaaagtctaggcaggaaaaagaataagtgtccaattcagtatataattatcaacagactaatattcacaaatggtctgttttgaacttcataattaaggttgattagcattgccaatgcttcccagccttcctgggtcacatagaaaggtataatgtgtgtaggcagcctag

SEQ ID NO: 111716 - DNA, 454 bp, Homo sapiens
acaggaggcaggtagacctgggtttgaatcccagctgtcccacccctggtgtaattacgcatctcggtcagctctcgaaagcgggaaggatggtagcctcatccttgggctccatgagtgtgtgtgctcatgggtgtcttgtgctcagatggtagcgctggagtgggtgtgttgtcggtggctgttactccagcattgaaacgctgccagctgccgcttcatagcttagggccctgggaagtcgcttagtctctgagctggagccttgtcagctgtgaaaagggctgttaacaaatgttaacctcacagagttactgaggactcgaatgaactcacatttgggaaggtcacgggagggttgagtgctgagtgctgtgaccaccgcgtcctcacagcgagggctgagtgccactcgccagccccagaatctgcctcccgtgctcagcgcctgctt

SEQ ID NO: 111717 - DNA, 314 bp, Homo sapiens
tcacagctcactgaagccttgatctgagatcaagcaaccctccctcctcaatcccctgagtagctgggactgcagtgcgtgccactacacttggttaatttgtttgtttgttttgttttgtttttgtaaagacaatcttactatgttcctctggctggtctcaaactcctgggctcaagcaatcctcccgcctccaccttccaaagtgctaggattacagggataagccatagcacccatcctaaatgcttcctgatgaaataatatgccactgtctatagtctttcttaaggattaatcaagcctctggatcc

SEQ ID NO: 111718 - DNA, 722 bp, Homo sapiens
gttccagctgggacattgggatactgggatgccaagaacgtgtctgcctgatgtcagcagtgggctcgaggcaaatgtccctgcgcacccactagtcacttagtcggtgcatcttcacagaagatgacatctctgtgggcccctctcctcccctgctgtacagtggctcttctgcgaccaagtggcccccttggaggtggaagcaaaaggaaaggctctggacggaggttccccagctccttgataacgtgtaaaaatctctggcaagtcagaggagttcattgctcacattaagagctgcttctcattgctctcttattcattcagccattagttaattaattctctcaacatgaatctattcggtcccggctgtgtgccagggtctgtgctagatgccgggggcatcatgtcagccaaacatggttgccagcctccataaaactgttttagtggggaaattagatattaaacgagcagtgtcacaactccataattaaaaacagtggatgagctttcagggaaaatcatagtgtgctgtgaaagagtaaaaatgaggggatccgatcaaagctgagggagctgcatttgggctgaattctgcaagatccatgtgccaaggccccagggtggagccattgaaagaaggaacctaagagctgtggtgatagtgccatatgtgttcatgctgcttttgtttttacaaagacttaactttttag

SEQ ID NO: 111719 - DNA, 504 bp, Homo sapiens
gtccacactgtgaaactgaaggatttcacacgagggaatctgtggtggtttggatggtcttggactcgtttctctctaagatacatgatggaaatgccacctgaggttcacaggccattgtgagtttgttgcaaatgagctgggagtgtttagccttccctgtgagcggtttccggctgcatgtcttattcaagtgtttctctaaaaggccgcagctccccgtggtgacttgcctggtggacatgcattcacaaggatacccaaatgagcagcaccttcaccagctgtgtgcaggcagacattcagcagggatgagctgccgaggtggcggccctgagggccggcgtccacctctgcgaaaatagtgacttggtctagttgtgggctggccattattggacctttgggaaaaagggaaggggaagaggtaaagggtctcaccttttcaggccctggcagaagggtgaaggcaaaggccccagacacagggatagaagagatggt

SEQ ID NO: 111720 - DNA, 409 bp, Homo sapiens
ccaatctagcagatcccaatgattttccctacaaagtatatcctgaatccattttcttctcttatctctacagccaccaactgacgacaagctgcttgctctgcaatagtctccaaactctggaactggttaggacgaagaacagtatctggtgcaaaggctctccctcactcccctctaacttccacacagcagcctgagtgatcttgcttaaaatcctttggtggcttcccaaggcagtcagagaaaccccaaacttctcaacatgggctacaaggcctggcagtcacaggctgctgcctgcctcttccacctcagttctccctcactcactcctccaccctggcctggatcacgttttctgaccagcagtaagtttttttccaactttgcacatggtgctcattct

SEQ ID NO: 111721 - DNA, 459 bp, Homo sapiens
ttactggtgaaactggtacaggcaacatgttggcttttttgtcaatcagtttttttttttgagaaattttgcttttgtgaaaaatctgccttttcaaagttttctttccttctattatactccccatatttttggtgtatctgagatgctaatggcctttcattttcaagtttttatttcccagttggcagtaccacttttacactttgaagatggaaacttggcaggaaaattgtatgtcagggtgtatttctgtgtggggttgcaagggcaggaaagaaaaaaaactcaaataagaggtattttcattgagtatgatcttagctggtggcatatataattacccagttatttctctcatgaaatgaatgtttatatttgttgtcatgaccaggatcagctacacagtttgtggggcccagttcaaaatgaaaatgtgggtgtattaccagatttagc

SEQ ID NO: 111722 - DNA, 419 bp, Homo sapiens
gagggccaggttttcacctttggcgggataacacagatcctcaccctgctcatcatgacctttccaatcatgcttgccacaattgtttatctatatttatcatcatgcatgacagaatgaagaggaatctcggtaaatccctgagtttcagacacattcctccctaccccaataatacaggagcaatcctatggcctccatataatgagtcaattacttctgctagaatataaatgtttctctttgcctgcctaagagtagcataagagtgcacaaaatggtctatggtagatagacctgtaggcttcatggagccactttgtgtctgctggtagagtcaccctttccctaaaactaggagtctattcatgcagagccagatcgtcagaagaaagaaagtattacccaagtgggtcagt

SEQ ID NO: 111723 - DNA, 566 bp, Homo sapiens
ggggaagtgggcgctgactgtccccagggggtacaagaggcttaacagcacccactgccagtgacatcaacgagtgcgcaatgcctgggcgtgtgtcgccatggtgactgcctcaacaaccctggctcctatcgctgtgtctgcccacctggccatagtttaggcccctcccgtacacagtgcattgcagacaaaccggaggagaagagcctgtgtttccgcctggtgagccctgagcaccagtgccagcacccactgaccacccgcctgacccgccagctctgctgctgcagtgtcggcaaggcctggggcgcgcggtgtcagcgctgcccaacagatggcaccgctgcgttcaaggagatctgcccagctgggaagggataccacattctcacctcccaccagacgctcaccattcagggcgagagtgacttttcccttttcctgcaccctgacgggccacccaagccccagcagcttccggagagccctagccaggctccaccacctgaggacacagaggaagagagaggggtgaccacggactcaccggtgagtgacggaga

SEQ ID NO: 111724 - DNA, 444 bp, Homo sapiens
cctgcctcggcctcccaaaatgctggaattacaggcatgagccatggcccctggccaatcatctctgtttttacaaatgaggaactagaaacttaggtgagtaacttgctcaaaggtacacagcaggaaagtgctgggagctggatttgaaccagactggcttactgttaagcctcttccattaataccagttcctgttctatcatgcggactgttaaaaggggcactctgaaatctagggttctaattgataattccccccgccccgcctcacttttcattctccttttcagctcctgcattgcatattaagaaatcaatagtcagttggcatcttgcagagtctctggcattgctcacaggccctcgaactactacacagtttttgcagtaaatcctattgggctcatttctgttgtcacagggcactggcggctgtatctc

SEQ ID NO: 111725 - DNA, 102 bp, Homo sapiens
  misc_feature (1)..(1): n is a, c, g, or t
  misc_feature (92)..(92): n is a, c, g, or t
  misc_feature (95)..(95): n is a, c, g, or t
  misc_feature (98)..(98): n is a, c, g, or t
  misc_feature (100)..(100): n is a, c, g, or t
ngaaccaatcctaaagaatattcttacatataataaagaattcccatttgatgttcagcctgtcccattaagaagaattttggcacctggtnaanaananaa

SEQ ID NO: 111726 - DNA, 632 bp, Homo sapiens
gccacacactccttatatcctcccacctgagcccaaatcctggccccaggtgcaagcagcacccctcgagggctctgccccagtatccccagagaattcacacccctcccgctcccacccccgagcctaccctttgtctcgcatgagtgcaatatttcattcccggtggttgtctggggaggtggttggacgaggtcctgcttgaggctcggggatcagaacgatgtcaagtgaagaaaaatgcacgggggcatgctgagccactggagttccagagagggccgaggagggtgcagccacggaggttggatcctctgctccgccgcctcgtcctcgtcccgcttctgctgggttccgctttgtccctggttttttcctttttttttctgtgtgcgtgcgaatggtgcggcccctcccctctcaccgtggttaacgtgacgaaggcacgattcctgtaaatgtgtaaactaaggggatggttggattttttttcaatgtaaacactaaaaacaaaatggacaaaaaaacacacaaaggttttatgaacagcagactctatgtaaaggcattttagtatcaaattttttattgataacttgcttaagaataaatatatggactattgtacaggt

SEQ ID NO: 111727 - DNA, 8199 bp, Homo sapiens
  misc_feature (118)..(118): n is a, c, g, or t
  misc_feature (1860)..(1860): n is a, c, g, or t
  misc_feature (1916)..(1916): n is a, c, g, or t
  misc_feature (2071)..(2071): n is a, c, g, or t
  misc_feature (3597)..(3597): n is a, c, g, or t
  misc_feature (3599)..(3600): n is a, c, g, or t
  misc_feature (3604)..(3604): n is a, c, g, or t
  misc_feature (3634)..(3634): n is a, c, g, or t
  misc_feature (3637)..(3637): n is a, c, g, or t
  misc_feature (3639)..(3639): n is a, c, g, or t
  misc_feature (4421)..(4421): n is a, c, g, or t
gttccacacacgcgctggacctggaggctgaggaggagaggacgaggctatgtgatgaccgcctggggcttgccagccgcgagctgctgctgcaggacagcaaagaccgcgtagagtncgcccggatccacccaccgagcagctgccctggggacctggccccccacctcatgatgcagagcggccagctgggcggggacccagccccccacacccacccccatcccccctggctgccccgcacccgcagcccctccctgtggatgggggggcactcctacggcctggggcaccctgccctgcaccagaacctgccccccggcttccccgcctccgtggctggccctgtgccctctgtcttccccctcccacaggacgcccccacacagctggtcatcctgccctcagagcccacaccccacagcgccccccacgcacttgcggatgtcatggaccaggcgtcactgtggccccccatgtacgggggccggggccccgcctctcacatgcagcacccgggccagctccctgtgtactcgaggccgcagctcctccggcagcaggagctctatgctttgcagcagcagagggccgcccagttccagcggaagcccgaagaccagcacctggatctggaggagcccgcccaggagaaggccccaaagtccacccacaagccagttgccttaacccccacggccccgggcgccccctcacccgctgcaggccccaccaagctgccaccttgctgccatccgcccgacccaaagccccccgccagctcccccaccccaccacctcggcccagcgccccgtgcactttaaatgtctgccctgccagcagccccgggcctggctcccgggtgcgcagcgccgaggaaaagaatggggagggtcagcagtccacggccgacatcatcacatccgaaccagtggcacgtgctcactctgttgcccacgctggtctcgaattcctggcctcaaatgatccatccacctcagcctcccaaagttttgggattacagacctgcctcccggatacctgcgccccatggctggcctgggcttctccctaccctcagacgtgcactcttctaacctcgaggaccctgaaactatgcaaaccaccgccccgggggcccagcctgagcccacaaggacattcctgcctggggagccgcctccctgcagccccaggagcctggaggagcccgggctgctctcaggggccagggaggccacccaggaccttgccgccaccccctaccctgccgagcggggaccccaggggaaggcagcggaccccagcccactagaggggctacaagaactgcaatgtgcggccctcctggaggcagggggccccgaggccaccggccaggctcattctactcagggaggggcacgagaagagaggagcagggaggagggggagcaggggccctcgtcaggggcctcctcccaagtcctggagcagcgagcagggagtccgggtgcccttgaggacgagggggagcagccggcccctgaggaggacgagctggaggaagacgagctggggcagcagagcatggaggactcagaggaggactgtggcggagctcccgacaacagccacccacccagggcgctaccaggcctggatgccttggtggccgccaccatcaacctgggggacctgcccagcgacagcccaccggaccctcagcccccagcggcctctgggccccccagcacagtccccctgcctcatagctcagggattcatgggatcgctctgctcagcgagctggctgacctggcaatccagcggcagaggagtgagaggactgtgccagaggaggaagaggacgtgctanccttcaacctgcagcacctggccacgctggccacagcctggtccctggtggaggcngctggcctggacagctccactgccccagcgcagccgcccacagccaacccctgcagcggccccaggctcaccccccgcatgcagatcctgcagcgcaaggacacctggacccccaagaccaagcctgtgtgccccctgaaggccgccatcgaccngctggacacgcaggaggtggggatgcgcgtgcggctggcggagctgcagcggcgctacaaggagaagcagcgggagctggcccgcctgcagcgcaagcacgaccatgagagagacgagagttcacggagccctgcacggcgggggcctggccggccgaggaagcgcaaacactcaagctcgctgcctgccccacgtcccacggggccgctccccaggagcgatggcaagaaagtcaaggcggtgcggacaagcctgggtctgctgtgtgcggagctgcgaggaggcagtgggggcgagcctgcgaagaagcgaagcaagctggagaggagcgtctatgcgggcctgcagactgcctccgtggagaaggcgcagtgtaagaagagcagctgtcagggcgggctggcgccctccgtggcccacagggtggcccagctgaaacccaaggtcaagagcaaagggctgcccacaggcctcagctctttccagcagaaggaggctacccccggggggcgcatccgggagaagctgtcccgagccaagagtgccaaggtgtctggggccacacggcacccacagcccaagggccacggcagccgggagacacccaggtgcccagcccagccctccgtggctgcgtcccaggaggcaggcagtggctatgacagtgaggactgcgagggtctcctggggacagaggcaccacccagggaagcagggctgctgctgcacgccggggccagtgtggccgtgctggggccctcaccctcctctgtggtcaagatggaggccaaccagaaggccaagaagaagaaggagaggcaggggttgctaggggcctgccgcctgtccagccctgagagtgaggtcaagatcaagaggcggtcggtgaaggccaaggtgggcaccaccctggagcgggccccagggcagaggcccccaggtgcgctgggcaagaagaaagccaagggcaaggccaagggcagcctgcgggcagagccgggggccacccccagcagggacgccctcttcaacccctctcgggccttcgcctgccgtgaggagggcagccagctggccagtgagcgcctcaagagggccacgcgcaagggcacagtgctgcagccagtgctgcggcggaagaacggggccctgtccatcacgctggccacacgcaacgccaaggccatcctggggaagggccggaagctgagcaaggtgaagcacaaggccggcaagcagggcaagggccgggccgtgagccgcctgctggaaagcttcgccgtggaggaagactttgagttcgacgacaacagcagcttctcggaagaggaggaggacgaggaggaagaggaggaggacagcggccctctgagcgcagagcagagcgccgccctagcgcgctcgtgtgccatccacaaggaggacctgcgggacgggctgcccgtgctcatccccaaggaggatagcctgctgtacgcgggcagcgtcaggaccctgcagccacccgacatctatagcatcgtcntnnaggncgagagggcaccggcagaggatctactcantgnancagctgctgcaggaagcgttctcgatgtgcggccacagtccagccggtacctcccgcccggcacgcgggtctgcgcctactggagtcagaagtctcgatgtctgtacccgggcaacgtggtccggggggcctccggtgacgaagatgaggacctggactcagtagtggtggaatttgacgatggggatacaggccacatcgccgtctccaacgtcaggctgctgccccctgacttcaagatccagtgcacagagccctctccagccctgctagtgtctagcagctgccggaggaccaagaaggtatccagtgaggcacccccgcctagtgaagccgccacccccagcctgtcccccaaagcacaggacggccccgaagctttgaagacacctgggaaaaaatccattagcaaagacaaagctggtaaagccgaactcctaacctcaggtgccaaatcccccacgggggcctccgaccacttcctgggccgccgtggcagccccttgctgagctggtccgcggtggcgcagaccaagcggaaggcggtggcagcggccagcaaggggccgggggtgctgcagaacctcttccagctcaacggcagcagcaagaagctgcgggcccgcgaggccctgttccccgtgcacagcgtggccacacccatatttggcaacggcttccgcgccgactccttcagcagcctggccagctcctacgcgcccttcgtcggggggaccgggccgggcctccccaggggagcccacaagctgctgcgggctaanaaggccgagagggtggaggccgagaagggtgggcggcggcgggcgggcggtgagttcctggtcaagctggaccacgagggtgtgacctcccccaagaacaagacctgcaaggcgttgctcatgggggacaaggacttcagccccaagctcgggcggcccctgcccagccccagctatgtgcacccggcccttgtgggcaaggacaagaaggggcgggcacccatccccccgctgcccatggggctggcgctgcgcaagtacgcgggccaggcagagttcccgctgccctacgacagcgactgccacagctccttctcggacgaggacgaggacgggccggggctggcggccggcgtgccctcccgcttcctcgcccgcctgtccgtgtcctcttcctcctctggctcgtccacctcctcctcctcaggctccgtgtccacctccagcctctgctcctccgacaacgaggactcgtcctacagctcagacgacgaggacccggctctgctgctgcagacctgcctcacccaccccgtgcccaccctcctggcccagcccgaggccctgcgctccaagggcagcggccctcacgcgcatgcccagcgctgcttcctgtccagggccacggtggctggcaccggtgcgggctcaggccccagcagcagcagcaaatccaagctcaagcgcaaagaggccctgagcttctccaaagccaaagagctctcccggaggcagcggccgccctccgtggaaaaccggccaaagatctcagccttcctgcccgcccggcagctctggaagtggtcggggaatcccacacagcggcgtggcatgaaggggaaggcccggaagctgttctacaaggccatcgtgcggggcgaggagaccctgcgtgtcggggactgtgccgtcttcctgtcagctgggcggcccaacctcccctacatcggccgcatcgagagcatgtgggagtcgtggggcagcaacatggtggtcaaggtcaagtggttctaccaccctgaggagaccaagctgggcaagaggcagtgcgacggcaagaatgcgctgtaccagtcctgccacgaggatgagaacgacgtgcagaccatctcccacaagtgccaggtcgtggcgcgcgagcagtatgagcagatggcccggagccgcaagtgccaggaccggcaggacctctactacctggcgggcacctacgaccccaccaccgggcgcctggtgacggctgatggcgtgcccatcctatgctgagccgccaccgcagatgcctcccacgtgcgccagggaccctgtgtgcggagcctggcgtcggccaagccaccgggcaggaggcagccccggcctcccaagggcgcatctgagcaaatatgcaaaagcccacagggcaagacccaggctttcttacggttttccctggaaagagcgctccaggtgtcggaatccagtcccgtcccatcctctgcggagggtcgggctgtggccctcatgggtccccggcccgcccacccacagcgccctccgtttcccgcaccggcagttcacgggagatttgaatccaagccatattccctagtacctccgactgtctcccaccagggaaagcagaaatcaggtgtgttgtctatttatttctctatgtaaatattgtatttctgcggggaaattttatggtaaaaagtggaaaagggtttttccccatccgcgtgacaaggtgtgtgtgagcgtgtatgtgtgtgcgcgtgtgtggcgatttttgtcctggggtttcctttggaaatgcactgttctcagcccagctgggttccaacgggggcacctgggacgacagaggcatctcggggcagggggcagaggccacgggagggtcaggtgggacccttgacggcaccctctgatctcttggggggacgaccgtgtaagatgaaagtcggtcaagtttatttgctttcagtgcatctcctagaaaagaagtgttggagcagggggtggtgatgaggggcccgtggggaaaggattcaagaggcaaagcccagaccagggagtgtgacaacagccgtgagcatctcacctgtgttcaaaacaagacaaagacgaacaaatattttaaagtattgataagaaaaagcaatgtttggattgtatctgctgaatcatattccaacctatatctgatttctgtttccggggccagttggtctgaggccaaggagtctggcctccacccagagcagggaggggctggcccctcgcccccctcaccctcgccgccctggcacactcgggaagcagggcccagctctgagcccctcctcacccctggggtcctaactttcctgaaagtagtaggtgccgtgagaaggggcagtttggccaggttcctgaactgggcagggctcggggcctatgagggcaggttcacagtcccaccagattctctcctcacccccaagcagaatgcatgcaaaagacaccccttttcccacccaccttattggtgcccccaaacccctggcctgctgcgtagatggtggtgaggccaggccagcagtgctgtggccaggggagaagaaaataaaacgcaggccctgcccttggggaaggcccctttctgggcccccttttccaccagccaaatctgcctggccctcggacccctctgcctgccccaacccctttggaggtttctcggccttttctgtgccacttggtggggcagatggcctgatgggctagtgcttggggcatagaatgagggtccccctgaccacctgagcccaaatcctggccccaggtgcaagcagcacccctcgagggctctgccccagtatccccagagaattcacacccctccccttctcccacagccaaggacagacaggctgcctggacctgagcccaacagccttcagcctcagaaacgcatggggggccacacactccttatatcctcccacactaaggttcccctggccccacgggagcttcaggaaagccccccaagttagccactgctctaggacgagctctgtgtcccccacaccacaggcctcgaagcagggtgctggtgggtgccctgcaccccaatcccaggtccccttggccccctatttttctcgggcccattggggcctgtttctcacctgctggctggaccccctgaagggccgttcccagaggctccccaggaggctcaaggctgggggcttatgttgtggtcgggggtccccgcctccagccccccgctcccacccccgagcctaccctttgtctcgcatgagtgcaatatttcattcccggtggttgtctggggaggtggttggacgaggtcctgcttgaggctcggggatcagaacgatgtcaagtgaagaaaaatgcacgggggcatgctgagccactggagttccagagagggccgaggagggtgcagccacggaggttggatcctctgctccgccgcctcgtcctcgtcccgcttctgctgggttccgctttgtccctggttttttcctttttttttctgtgtgcgtgcgaatggtgcggcccctcccctctcaccgtggttaacgtgacgaaggcacgattcctgtaaatgtgtaaactaaggggatggttggattttttttcaatgtaaacactaaaaacaaaatggacaaaaaaacacacaaaggttttatgaacagcagactctatgtaaaggcattttagtatcaaattttttattgataacttgcttaagaataaatatatggactattgtacaggt

SEQ ID NO: 111728 - DNA, 8146 bp, Homo sapiens
  misc_feature (118)..(118): n is a, c, g, or t
  misc_feature (1860)..(1860): n is a, c, g, or t
  misc_feature (1916)..(1916): n is a, c, g, or t
  misc_feature (2071)..(2071): n is a, c, g, or t
  misc_feature (3597)..(3597): n is a, c, g, or t
  misc_feature (3599)..(3600): n is a, c, g, or t
  misc_feature (3604)..(3604): n is a, c, g, or t
  misc_feature (3634)..(3634): n is a, c, g, or t
  misc_feature (3637)..(3637): n is a, c, g, or t
  misc_feature (3639)..(3639): n is a, c, g, or t
  misc_feature (4421)..(4421): n is a, c, g, or t
gttccacacacgcgctggacctggaggctgaggaggagaggacgaggctatgtgatgaccgcctggggcttgccagccgcgagctgctgctgcaggacagcaaagaccgcgtagagtncgcccggatccacccaccgagcagctgccctggggacctggccccccacctcatgatgcagagcggccagctgggcggggacccagccccccacacccacccccatcccccctggctgccccgcacccgcagcccctccctgtggatgggggggcactcctacggcctggggcaccctgccctgcaccagaacctgccccccggcttccccgcctccgtggctggccctgtgccctctgtcttccccctcccacaggacgcccccacacagctggtcatcctgccctcagagcccacaccccacagcgccccccacgcacttgcggatgtcatggaccaggcgtcactgtggccccccatgtacgggggccggggccccgcctctcacatgcagcacccgggccagctccctgtgtactcgaggccgcagctcctccggcagcaggagctctatgctttgcagcagcagagggccgcccagttccagcggaagcccgaagaccagcacctggatctggaggagcccgcccaggagaaggccccaaagtccacccacaagccagttgccttaacccccacggccccgggcgccccctcacccgctgcaggccccaccaagctgccaccttgctgccatccgcccgacccaaagccccccgccagctcccccaccccaccacctcggcccagcgccccgtgcactttaaatgtctgccctgccagcagccccgggcctggctcccgggtgcgcagcgccgaggaaaagaatggggagggtcagcagtccacggccgacatcatcacatccgaaccagtggcacgtgctcactctgttgcccacgctggtctcgaattcctggcctcaaatgatccatccacctcagcctcccaaagttttgggattacagacctgcctcccggatacctgcgccccatggctggcctgggcttctccctaccctcagacgtgcactcttctaacctcgaggaccctgaaactatgcaaaccaccgccccgggggcccagcctgagcccacaaggacattcctgcctggggagccgcctccctgcagccccaggagcctggaggagcccgggctgctctcaggggccagggaggccacccaggaccttgccgccaccccctaccctgccgagcggggaccccaggggaaggcagcggaccccagcccactagaggggctacaagaactgcaatgtgcggccctcctggaggcagggggccccgaggccaccggccaggctcattctactcagggaggggcacgagaagagaggagcagggaggagggggagcaggggccctcgtcaggggcctcctcccaagtcctggagcagcgagcagggagtccgggtgcccttgaggacgagggggagcagccggcccctgaggaggacgagctggaggaagacgagctggggcagcagagcatggaggactcagaggaggactgtggcggagctcccgacaacagccacccacccagggcgctaccaggcctggatgccttggtggccgccaccatcaacctgggggacctgcccagcgacagcccaccggaccctcagcccccagcggcctctgggccccccagcacagtccccctgcctcatagctcagggattcatgggatcgctctgctcagcgagctggctgacctggcaatccagcggcagaggagtgagaggactgtgccagaggaggaagaggacgtgctanccttcaacctgcagcacctggccacgctggccacagcctggtccctggtggaggcngctggcctggacagctccactgccccagcgcagccgcccacagccaacccctgcagcggccccaggctcaccccccgcatgcagatcctgcagcgcaaggacacctggacccccaagaccaagcctgtgtgccccctgaaggccgccatcgaccngctggacacgcaggaggtggggatgcgcgtgcggctggcggagctgcagcggcgctacaaggagaagcagcgggagctggcccgcctgcagcgcaagcacgaccatgagagagacgagagttcacggagccctgcacggcgggggcctggccggccgaggaagcgcaaacactcaagctcgctgcctgccccacgtcccacggggccgctccccaggagcgatggcaagaaagtcaaggcggtgcggacaagcctgggtctgctgtgtgcggagctgcgaggaggcagtgggggcgagcctgcgaagaagcgaagcaagctggagaggagcgtctatgcgggcctgcagactgcctccgtggagaaggcgcagtgtaagaagagcagctgtcagggcgggctggcgccctccgtggcccacagggtggcccagctgaaacccaaggtcaagagcaaagggctgcccacaggcctcagctctttccagcagaaggaggctacccccggggggcgcatccgggagaagctgtcccgagccaagagtgccaaggtgtctggggccacacggcacccacagcccaagggccacggcagccgggagacacccaggtgcccagcccagccctccgtggctgcgtcccaggaggcaggcagtggctatgacagtgaggactgcgagggtctcctggggacagaggcaccacccagggaagcagggctgctgctgcacgccggggccagtgtggccgtgctggggccctcaccctcctctgtggtcaagatggaggccaaccagaaggccaagaagaagaaggagaggcaggggttgctaggggcctgccgcctgtccagccctgagagtgaggtcaagatcaagaggcggtcggtgaaggccaaggtgggcaccaccctggagcgggccccagggcagaggcccccaggtgcgctgggcaagaagaaagccaagggcaaggccaagggcagcctgcgggcagagccgggggccacccccagcagggacgccctcttcaacccctctcgggccttcgcctgccgtgaggagggcagccagctggccagtgagcgcctcaagagggccacgcgcaagggcacagtgctgcagccagtgctgcggcggaagaacggggccctgtccatcacgctggccacacgcaacgccaaggccatcctggggaagggccggaagctgagcaaggtgaagcacaaggccggcaagcagggcaagggccgggccgtgagccgcctgctggaaagcttcgccgtggaggaagactttgagttcgacgacaacagcagcttctcggaagaggaggaggacgaggaggaagaggaggaggacagcggccctctgagcgcagagcagagcgccgccctagcgcgctcgtgtgccatccacaaggaggacctgcgggacgggctgcccgtgctcatccccaaggaggatagcctgctgtacgcgggcagcgtcaggaccctgcagccacccgacatctatagcatcgtcntnnaggncgagagggcaccggcagaggatctactcantgnancagctgctgcaggaagcgttctcgatgtgcggccacagtccagccggtacctcccgcccggcacgcgggtctgcgcctactggagtcagaagtctcgatgtctgtacccgggcaacgtggtccggggggcctccggtgacgaagatgaggacctggactcagtagtggtggaatttgacgatggggatacaggccacatcgccgtctccaacgtcaggctgctgccccctgacttcaagatccagtgcacagagccctctccagccctgctagtgtctagcagctgccggaggaccaagaaggtatccagtgaggcacccccgcctagtgaagccgccacccccagcctgtcccccaaagcacaggacggccccgaagctttgaagacacctgggaaaaaatccattagcaaagacaaagctggtaaagccgaactcctaacctcaggtgccaaatcccccacgggggcctccgaccacttcctgggccgccgtggcagccccttgctgagctggtccgcggtggcgcagaccaagcggaaggcggtggcagcggccagcaaggggccgggggtgctgcagaacctcttccagctcaacggcagcagcaagaagctgcgggcccgcgaggccctgttccccgtgcacagcgtggccacacccatatttggcaacggcttccgcgccgactccttcagcagcctggccagctcctacgcgcccttcgtcggggggaccgggccgggcctccccaggggagcccacaagctgctgcgggctaanaaggccgagagggtggaggccgagaagggtgggcggcggcgggcgggcggtgagttcctggtcaagctggaccacgagggtgtgacctcccccaagaacaagacctgcaaggcgttgctcatgggggacaaggacttcagccccaagctcgggcggcccctgcccagccccagctatgtgcacccggcccttgtgggcaaggacaagaaggggcgggcacccatccccccgctgcccatggggctggcgctgcgcaagtacgcgggccaggcagagttcccgctgccctacgacagcgactgccacagctccttctcggacgaggacgaggacgggccggggctggcggccggcgtgccctcccgcttcctcgcccgcctgtccgtgtcctcttcctcctctggctcgtccacctcctcctcctcaggctccgtgtccacctccagcctctgctcctccgacaacgaggactcgtcctacagctcagacgacgaggacccggctctgctgctgcagacctgcctcacccaccccgtgcccaccctcctggcccagcccgaggccctgcgctccaagggcagcggccctcacgcgcatgcccagcgctgcttcctgtccagggccacggtggctggcaccggtgcgggctcaggccccagcagcagcagcaaatccaagctcaagcgcaaagaggccctgagcttctccaaagccaaagagctctcccggaggcagcggccgccctccgtggaaaaccggccaaagatctcagccttcctgcccgcccggcagctctggaagtggtcggggaatcccacacagcggcgtggcatgaaggggaaggcccggaagctgttctacaaggccatcgtgcggggcgaggagaccctgcgtgtcggggactgtgccgtcttcctgtcagctgggcggcccaacctcccctacatcggccgcatcgagagcatgtgggagtcgtggggcagcaacatggtggtcaaggtcaagtggttctaccaccctgaggagaccaagctgggcaagaggcagtgcgacggcaagaatgcgctgtaccagtcctgccacgaggatgagaacgacgtgcagaccatctcccacaagtgccaggtcgtggcgcgcgagcagtatgagcagatggcccggagccgcaagtgccaggaccggcaggacctctactacctggcgggcacctacgaccccaccaccgggcgcctggtgacggctgatggcgtgcccatcctatgctgagccgccaccgcagatgcctcccacgtgcgccagggaccctgtgtgcggagcctggcgtcggccaagccaccgggcaggaggcagccccggcctcccaagggcgcatctgagcaaatatgcaaaagcccacagggcaagacccaggctttcttacggttttccctggaaagagcgctccaggtgtcggaatccagtcccgtcccatcctctgcggagggtcgggctgtggccctcatgggtccccggcccgcccacccacagcgccctccgtttcccgcaccggcagttcacgggagatttgaatccaagccatattccctagtacctccgactgtctcccaccagggaaagcagaaatcaggtgtgttgtctatttatttctctatgtaaatattgtatttctgcggggaaattttatggtaaaaagtggaaaagggtttttccccatccgcgtgacaaggtgtgtgtgagcgtgtatgtgtgtgcgcgtgtgtggcgatttttgtcctggggtttcctttggaaatgcactgttctcagcccagctgggttccaacgggggcacctgggacgacagaggcatctcggggcagggggcagaggccacgggagggtcaggtgggacccttgacggcaccctctgatctcttggggggacgaccgtgtaagatgaaagtcggtcaagtttatttgctttcagtgcatctcctagaaaagaagtgttggagcagggggtggtgatgaggggcccgtggggaaaggattcaagaggcaaagcccagaccagggagtgtgacaacagccgtgagcatctcacctgtgttcaaaacaagacaaagacgaacaaatattttaaagtattgataagaaaaagcaatgtttggattgtatctgctgaatcatattccaacctatatctgatttctgtttccggggccagttggtctgaggccaaggagtctggcctccacccagagcagggaggggctggcccctcgcccccctcaccctcgccgccctggcacactcgggaagcagggcccagctctgagcccctcctcacccctggggtcctaactttcctgaaagtagtaggtgccgtgagaaggggcagtttggccaggttcctgaactgggcagggctcggggcctatgagggcaggttcacagtcccaccagattctctcctcacccccaagcagaatgcatgcaaaagacaccccttttcccacccaccttattggtgcccccaaacccctggcctgctgcgtagatggtggtgaggccaggccagcagtgctgtggccaggggagaagaaaataaaacgcaggccctgcccttggggaaggcccctttctgggcccccttttccaccagccaaatctgcctggccctcggacccctctgcctgccccaacccctttggaggtttctcggccttttctgtgccacttggtggggcagatggcccaaatcctggccccaggtgcaagcagcacccctcgagggctctgccccagtatccccagagaattcacacccctccccttctcccacagccaaggacagacaggctgcctggacctgagcccaacagccttcagcctcagaaacgcatggggggccacacactccttatatcctcccacactaaggttcccctggccccacgggagcttcaggaaagccccccaagttagccactgctctaggacgagctctgtgtcccccacaccacaggcctcgaagcagggtgctggtgggtgccctgcaccccaatcccaggtccccttggccccctatttttctcgggcccattggggcctgtttctcacctgctggctggaccccctgaagggccgttcccagaggctccccaggaggctcaaggctgggggcttatgttgtggtcgggggtccccgcctccagccccccgctcccacccccgagcctaccctttgtctcgcatgagtgcaatatttcattcccggtggttgtctggggaggtggttggacgaggtcctgcttgaggctcggggatcagaacgatgtcaagtgaagaaaaatgcacgggggcatgctgagccactggagttccagagagggccgaggagggtgcagccacggaggttggatcctctgctccgccgcctcgtcctcgtcccgcttctgctgggttccgctttgtccctggttttttcctttttttttctgtgtgcgtgcgaatggtgcggcccctcccctctcaccgtggttaacgtgacgaaggcacgattcctgtaaatgtgtaaactaaggggatggttggattttttttcaatgtaaacactaaaaacaaaatggacaaaaaaacacacaaaggttttatgaacagcagactctatgtaaaggcattttagtatcaaattttttattgataacttgcttaagaataaatatatggactattgtacaggt

SEQ ID NO: 111729 - DNA, 4623 bp, Homo sapiens
  misc_feature (845)..(845): n is a, c, g, or t
ggcttggctggggcagcagccactcccaggcccagggaccagactctcaggcagccctgggccgggccccacctgctcatgggtcgtcgcccgcgttcctgcaggttctcgatgtgcggccacagtccagccggtacctcccgcccggcacgcgggtctgcgcctactggagtcagaagtctcgatgtctgtacccgggcaacgtggtccggggggcctccggtgacgaagatgaggacctggactcagtagtggtggaatttgacgatggggatacaggccacatcgccgtctccaacgtcaggctgctgccccctgacttcaagatccagtgcacagagccctctccagccctgctagtgtctagcagctgccggaggaccaagaaggtatccagtgaggcacccccgcctagtgaagccgccacccccagcctgtcccccaaagcacaggacggccccgaagctttgaagacacctgggaaaaaatccattagcaaagacaaagctggtgccaaatcccccacgggggcctccgaccacttcctgggccgccgtggcagccccttgctgagctggtccgcggtggcgcagaccaagcggaaggcggtggcagcggccagcaaggggccgggggtgctgcagaacctcttccagctcaacggcagcagcaagaagctgcgggcccgcgaggccctgttccccgtgcacagcgtggccacacccatatttggcaacggcttccgcgccgactccttcagcagcctggccagctcctacgcgcccttcgtcggggggaccgggccgggcctccccaggggagcccacaagctgctgcgggctaanaaggccgagagggtggaggccgagaagggtgggcggcggcgggcgggcggtgagttcctggtcaagctggaccacgagggtgtgacctcccccaagaacaagacctgcaaggcgttgctcatgggggacaaggacttcagccccaagctcgggcggcccctgcccagccccagctatgtgcacccggcccttgtgggcaaggacaagaaggggcgggcacccatccccccgctgcccatggggctggcgctgcgcaagtacgcgggccaggcagagttcccgctgccctacgacagcgactgccacagctccttctcggacgaggacgaggacgggccggggctggcggccggcgtgccctcccgcttcctcgcccgcctgtccgtgtcctcttcctcctctggctcgtccacctcctcctcctcaggctccgtgtccacctccagcctctgctcctccgacaacgaggactcgtcctacagctcagacgacgaggacccggctctgctgctgcagacctgcctcacccaccccgtgcccaccctcctggcccagcccgaggccctgcgctccaagggcagcggccctcacgcgcatgcccagcgctgcttcctgtccagggccacggtggctggcaccggtgcgggctcaggccccagcagcagcagcaaatccaagctcaagcgcaaagaggccctgagcttctccaaagccaaagagctctcccggaggcagcggccgccctccgtggaaaaccggccaaagatctcagccttcctgcccgcccggcagctctggaagtggtcggggaatcccacacagcggcgtggcatgaaggggaaggcccggaagctgttctacaaggccatcgtgcggggcgaggagaccctgcgtgtcggggactgtgccgtcttcctgtcagctgggcggcccaacctcccctacatcggccgcatcgagagcatgtgggagtcgtggggcagcaacatggtggtcaaggtcaagtggttctaccaccctgaggagaccaagctgggcaagaggcagtgcgacggcaagaatgcgctgtaccagtcctgccacgaggatgagaacgacgtgcagaccatctcccacaagtgccaggtcgtggcgcgcgagcagtatgagcagatggcccggagccgcaagtgccaggaccggcaggacctctactacctggcgggcacctacgaccccaccaccgggcgcctggtgacggctgatggcgtgcccatcctatgctgagccgccaccgcagatgcctcccacgtgcgccagggaccctgtgtgcggagcctggcgtcggccaagccaccgggcaggaggcagccccggcctcccaagggcgcatctgagcaaatatgcaaaagcccacagggcaagacccaggctttcttacggttttccctggaaagagcgctccaggtgtcggaatccagtcccgtcccatcctctgcggagggtcgggctgtggccctcatgggtccccggcccgcccacccacagcgccctccgtttcccgcaccggcagttcacgggagatttgaatccaagccatattccctagtacctccgactgtctcccaccagggaaagcagaaatcaggtgtgttgtctatttatttctctatgtaaatattgtatttctgcggggaaattttatggtaaaaagtggaaaagggtttttccccatccgcgtgacaaggtgtgtgtgagcgtgtatgtgtgtgcgcgtgtgtggcgatttttgtcctggggtttcctttggaaatgcactgttctcagcccagctgggttccaacgggggcacctgggacgacagaggcatctcggggcagggggcagaggccacgggagggtcaggtgggacccttgacggcaccctctgatctcttggggggacgaccgtgtaagatgaaagtcggtcaagtttatttgctttcagtgcatctcctagaaaagaagtgttggagcagggggtggtgatgaggggcccgtggggaaaggattcaagaggcaaagcccagaccagggagtgtgacaacagccgtgagcatctcacctgtgttcaaaacaagacaaagacgaacaaatattttaaagtattgataagaaaaagcaatgtttggattgtatctgctgaatcatattccaacctatatctgatttctgtttccggggccagttggtctgaggccaaggagtctggcctccacccagagcagggaggggctggcccctcgcccccctcaccctcgccgccctggcacactcgggaagcagggcccagctctgagcccctcctcacccctggggtcctaactttcctgaaagtagtaggtgccgtgagaaggggcagtttggccaggttcctgaactgggcagggctcggggcctatgagggcaggttcacagtcccaccagattctctcctcacccccaagcagaatgcatgcaaaagacaccccttttcccacccaccttattggtgcccccaaacccctggcctgctgcgtagatggtggtgaggccaggccagcagtgctgtggccaggggagaagaaaataaaacgcaggccctgcccttggggaaggcccctttctgggcccccttttccaccagccaaatctgcctggccctcggacccctctgcctgccccaacccctttggaggtttctcggccttttctgtgccacttggtggggcagatggcctgatgggctagtgcttggggcatagaatgagggtccccctgaccacctgagcccaaatcctggccccaggtgcaagcagcacccctcgagggctctgccccagtatccccagagaattcacacccctccccttctcccacagccaaggacagacaggctgcctggacctgagcccaacagccttcagcctcagaaacgcatggggggccacacactccttatatcctcccacactaaggttcccctggccccacgggagcttcaggaaagccccccaagttagccactgctctaggacgagctctgtgtcccccacaccacaggcctcgaagcagggtgctggtgggtgccctgcaccccaatcccaggtccccttggccccctatttttctcgggcccattggggcctgtttctcacctgctggctggaccccctgaagggccgttcccagaggctccccaggaggctcaaggctgggggcttatgttgtggtcgggggtccccgcctccagccccccgctcccacccccgagcctaccctttgtctcgcatgagtgcaatatttcattcccggtggttgtctggggaggtggttggacgaggtcctgcttgaggctcggggatcagaacgatgtcaagtgaagaaaaatgcacgggggcatgctgagccactggagttccagagagggccgaggagggtgcagccacggaggttggatcctctgctccgccgcctcgtcctcgtcccgcttctgctgggttccgctttgtccctggttttttcctttttttttctgtgtgcgtgcgaatggtgcggcccctcccctctcaccgtggttaacgtgacgaaggcacgattcctgtaaatgtgtaaactaaggggatggttggattttttttcaatgtaaacactaaaaacaaaatggacaaaaaaacacacaaaggttttatgaacagcagactctatgtaaaggcattttagtatcaaattttttattgataacttgcttaagaataaatatatggactattgtacaggt

SEQ ID NO: 111730 - DNA, 8129 bp, Homo sapiens
  misc_feature (118)..(118): n is a, c, g, or t
  misc_feature (1860)..(1860): n is a, c, g, or t
  misc_feature (1916)..(1916): n is a, c, g, or t
  misc_feature (2071)..(2071): n is a, c, g, or t
  misc_feature (3597)..(3597): n is a, c, g, or t
  misc_feature (3599)..(3600): n is a, c, g, or t
  misc_feature (3604)..(3604): n is a, c, g, or t
  misc_feature (3634)..(3634): n is a, c, g, or t
  misc_feature (3637)..(3637): n is a, c, g, or t
  misc_feature (3639)..(3639): n is a, c, g, or t
  misc_feature (4421)..(4421): n is a, c, g, or t
  misc_feature (8096)..(8096): n is a, c, g, or t
gttccacacacgcgctggacctggaggctgaggaggagaggacgaggctatgtgatgaccgcctggggcttgccagccgcgagctgctgctgcaggacagcaaagaccgcgtagagtncgcccggatccacccaccgagcagctgccctggggacctggccccccacctcatgatgcagagcggccagctgggcggggacccagccccccacacccacccccatcccccctggctgccccgcacccgcagcccctccctgtggatgggggggcactcctacggcctggggcaccctgccctgcaccagaacctgccccccggcttccccgcctccgtggctggccctgtgccctctgtcttccccctcccacaggacgcccccacacagctggtcatcctgccctcagagcccacaccccacagcgccccccacgcacttgcggatgtcatggaccaggcgtcactgtggccccccatgtacgggggccggggccccgcctctcacatgcagcacccgggccagctccctgtgtactcgaggccgcagctcctccggcagcaggagctctatgctttgcagcagcagagggccgcccagttccagcggaagcccgaagaccagcacctggatctggaggagcccgcccaggagaaggccccaaagtccacccacaagccagttgccttaacccccacggccccgggcgccccctcacccgctgcaggccccaccaagctgccaccttgctgccatccgcccgacccaaagccccccgccagctcccccaccccaccacctcggcccagcgccccgtgcactttaaatgtctgccctgccagcagccccgggcctggctcccgggtgcgcagcgccgaggaaaagaatggggagggtcagcagtccacggccgacatcatcacatccgaaccagtggcacgtgctcactctgttgcccacgctggtctcgaattcctggcctcaaatgatccatccacctcagcctcccaaagttttgggattacagacctgcctcccggatacctgcgccccatggctggcctgggcttctccctaccctcagacgtgcactcttctaacctcgaggaccctgaaactatgcaaaccaccgccccgggggcccagcctgagcccacaaggacattcctgcctggggagccgcctccctgcagccccaggagcctggaggagcccgggctgctctcaggggccagggaggccacccaggaccttgccgccaccccctaccctgccgagcggggaccccaggggaaggcagcggaccccagcccactagaggggctacaagaactgcaatgtgcggccctcctggaggcagggggccccgaggccaccggccaggctcattctactcagggaggggcacgagaagagaggagcagggaggagggggagcaggggccctcgtcaggggcctcctcccaagtcctggagcagcgagcagggagtccgggtgcccttgaggacgagggggagcagccggcccctgaggaggacgagctggaggaagacgagctggggcagcagagcatggaggactcagaggaggactgtggcggagctcccgacaacagccacccacccagggcgctaccaggcctggatgccttggtggccgccaccatcaacctgggggacctgcccagcgacagcccaccggaccctcagcccccagcggcctctgggccccccagcacagtccccctgcctcatagctcagggattcatgggatcgctctgctcagcgagctggctgacctggcaatccagcggcagaggagtgagaggactgtgccagaggaggaagaggacgtgctanccttcaacctgcagcacctggccacgctggccacagcctggtccctggtggaggcngctggcctggacagctccactgccccagcgcagccgcccacagccaacccctgcagcggccccaggctcaccccccgcatgcagatcctgcagcgcaaggacacctggacccccaagaccaagcctgtgtgccccctgaaggccgccatcgaccngctggacacgcaggaggtggggatgcgcgtgcggctggcggagctgcagcggcgctacaaggagaagcagcgggagctggcccgcctgcagcgcaagcacgaccatgagagagacgagagttcacggagccctgcacggcgggggcctggccggccgaggaagcgcaaacactcaagctcgctgcctgccccacgtcccacggggccgctccccaggagcgatggcaagaaagtcaaggcggtgcggacaagcctgggtctgctgtgtgcggagctgcgaggaggcagtgggggcgagcctgcgaagaagcgaagcaagctggagaggagcgtctatgcgggcctgcagactgcctccgtggagaaggcgcagtgtaagaagagcagctgtcagggcgggctggcgccctccgtggcccacagggtggcccagctgaaacccaaggtcaagagcaaagggctgcccacaggcctcagctctttccagcagaaggaggctacccccggggggcgcatccgggagaagctgtcccgagccaagagtgccaaggtgtctggggccacacggcacccacagcccaagggccacggcagccgggagacacccaggtgcccagcccagccctccgtggctgcgtcccaggaggcaggcagtggctatgacagtgaggactgcgagggtctcctggggacagaggcaccacccagggaagcagggctgctgctgcacgccggggccagtgtggccgtgctggggccctcaccctcctctgtggtcaagatggaggccaaccagaaggccaagaagaagaaggagaggcaggggttgctaggggcctgccgcctgtccagccctgagagtgaggtcaagatcaagaggcggtcggtgaaggccaaggtgggcaccaccctggagcgggccccagggcagaggcccccaggtgcgctgggcaagaagaaagccaagggcaaggccaagggcagcctgcgggcagagccgggggccacccccagcagggacgccctcttcaacccctctcgggccttcgcctgccgtgaggagggcagccagctggccagtgagcgcctcaagagggccacgcgcaagggcacagtgctgcagccagtgctgcggcggaagaacggggccctgtccatcacgctggccacacgcaacgccaaggccatcctggggaagggccggaagctgagcaaggtgaagcacaaggccggcaagcagggcaagggccgggccgtgagccgcctgctggaaagcttcgccgtggaggaagactttgagttcgacgacaacagcagcttctcggaagaggaggaggacgaggaggaagaggaggaggacagcggccctctgagcgcagagcagagcgccgccctagcgcgctcgtgtgccatccacaaggaggacctgcgggacgggctgcccgtgctcatccccaaggaggatagcctgctgtacgcgggcagcgtcaggaccctgcagccacccgacatctatagcatcgtcntnnaggncgagagggcaccggcagaggatctactcantgnancagctgctgcaggaagcgttctcgatgtgcggccacagtccagccggtacctcccgcccggcacgcgggtctgcgcctactggagtcagaagtctcgatgtctgtacccgggcaacgtggtccggggggcctccggtgacgaagatgaggacctggactcagtagtggtggaatttgacgatggggatacaggccacatcgccgtctccaacgtcaggctgctgccccctgacttcaagatccagtgcacagagccctctccagccctgctagtgtctagcagctgccggaggaccaagaaggtatccagtgaggcacccccgcctagtgaagccgccacccccagcctgtcccccaaagcacaggacggccccgaagctttgaagacacctgggaaaaaatccattagcaaagacaaagctggtaaagccgaactcctaacctcaggtgccaaatcccccacgggggcctccgaccacttcctgggccgccgtggcagccccttgctgagctggtccgcggtggcgcagaccaagcggaaggcggtggcagcggccagcaaggggccgggggtgctgcagaacctcttccagctcaacggcagcagcaagaagctgcgggcccgcgaggccctgttccccgtgcacagcgtggccacacccatatttggcaacggcttccgcgccgactccttcagcagcctggccagctcctacgcgcccttcgtcggggggaccgggccgggcctccccaggggagcccacaagctgctgcgggctaanaaggccgagagggtggaggccgagaagggtgggcggcggcgggcgggcggtgagttcctggtcaagctggaccacgagggtgtgacctcccccaagaacaagacctgcaaggcgttgctcatgggggacaaggacttcagccccaagctcgggcggcccctgcccagccccagctatgtgcacccggcccttgtgggcaaggacaagaaggggcgggcacccatccccccgctgcccatggggctggcgctgcgcaagtacgcgggccaggcagagttcccgctgccctacgacagcgactgccacagctccttctcggacgaggacgaggacgggccggggctggcggccggcgtgccctcccgcttcctcgcccgcctgtccgtgtcctcttcctcctctggctcgtccacctcctcctcctcaggctccgtgtccacctccagcctctgctcctccgacaacgaggactcgtcctacagctcagacgacgaggacccggctctgctgctgcagacctgcctcacccaccccgtgcccaccctcctggcccagcccgaggccctgcgctccaagggcagcggccctcacgcgcatgcccagcgctgcttcctgtccagggccacggtggctggcaccggtgcgggctcaggccccagcagcagcagcaaatccaagctcaagcgcaaagaggccctgagcttctccaaagccaaagagctctcccggaggcagcggccgccctccgtggaaaaccggccaaagatctcagccttcctgcccgcccggcagctctggaagtggtcggggaatcccacacagcggcgtggcatgaaggggaaggcccggaagctgttctacaaggccatcgtgcggggcgaggagaccctgcgtgtcggggactgtgccgtcttcctgtcagctgggcggcccaacctcccctacatcggccgcatcgagagcatgtgggagtcgtggggcagcaacatggtggtcaaggtcaagtggttctaccaccctgaggagaccaagctgggcaagaggcagtgcgacggcaagaatgcgctgtaccagtcctgccacgaggatgagaacgacgtgcagaccatctcccacaagtgccaggtcgtggcgcgcgagcagtatgagcagatggcccggagccgcaagtgccaggaccggcaggacctctactacctggcgggcacctacgaccccaccaccgggcgcctggtgacggctgatggcgtgcccatcctatgctgagccgccaccgcagatgcctcccacgtgcgccagggaccctgtgtgcggagcctggcgtcggccaagccaccgggcaggaggcagccccggcctcccaagggcgcatctgagcaaatatgcaaaagcccacagggcaagacccaggctttcttacggttttccctggaaagagcgctccaggtgtcggaatccagtcccgtcccatcctctgcggagggtcgggctgtggccctcatgggtccccggcccgcccacccacagcgccctccgtttcccgcaccggcagttcacgggagatttgaatccaagccatattccctagtacctccgactgtctcccaccagggaaagcagaaatcaggtgtgttgtctatttatttctctatgtaaatattgtatttctgcggggaaattttatggtaaaaagtggaaaagggtttttccccatccgcgtgacaaggtgtgtgtgagcgtgtatgtgtgtgcgcgtgtgtggcgatttttgtcctggggtttcctttggaaatgcactgttctcagcccagctgggttccaacgggggcacctgggacgacagaggcatctcggggcagggggcagaggccacgggagggtcaggtgggacccttgacggcaccctctgatctcttggggggacgaccgtgtaagatgaaagtcggtcaagtttatttgctttcagtgcatctcctagaaaagaagtgttggagcagggggtggtgatgaggggcccgtggggaaaggattcaagaggcaaagcccagaccagggagtgtgacaacagccgtgagcatctcacctgtgttcaaaacaagacaaagacgaacaaatattttaaagtattgataagaaaaagcaatgtttggattgtatctgctgaatcatattccaacctatatctgatttctgtttccggggccagttggtctgaggccaaggagtctggcctccacccagagcagggaggggctggcccctcgcccccctcaccctcgccgccctggcacactcgggaagcagggcccagctctgagcccctcctcacccctggggtcctaactttcctgaaagtagtaggtgccgtgagaaggggcagtttggccaggttcctgaactgggcagggctcggggcctatgagggcaggttcacagtcccaccagattctctcctcacccccaagcagaatgcatgcaaaagacaccccttttcccacccaccttattggtgcccccaaacccctggcctgctgcgtagatggtggtgaggccaggccagcagtgctgtggccaggggagaagaaaataaaacgcaggccctgcccttggggaaggcccctttctgggcccccttttccaccagccaaatctgcctggccctcggacccctctgcctgccccaacccctttggaggtttctcggccttttctgtgccacttggtggggcagatggcctgatgggctagtgcttggggcatagaatgagggtccccctgaccacctgagcccaaatcctggccccaggtgcaagcagcacccctcgagggctctgccccagtatccccagagaattcacacccctccccttctcccacagccaaggacagacaggctgcctggacctgagcccaacagccttcagcctcagaaacgcatggggggccacacactccttatatcctcccacactaaggttcccctggccccacgggagcttcaggaaagccccccaagttagccactgctctaggacgagctctgtgtcccccacaccacaggcctcgaagcagggtgctggtgggtgccctgcaccccaatcccaggtccccttggccccctatttttctcgggcccattggggcctgtttctcacctgctggctggaccccctgaagggccgttcccagaggctccccaggaggctcaaggctgggggcttatgttgtggtcgggggtccccgcctccagccccccgctcccacccccgagcctaccctttgtctcgcatgagtgcaatatttcattcccggtggttgtctggggaggtggttggacgaggtcctgcttgaggctcggggatcagaacgatgtcaagtgaagaaaaatgcacgggggcatgctgagccactggagttccagagagggccgaggagggtgcagccacggaggttggatcctctgctccgccgcctcgtcctcgtcccgcttctgctgggttccgctttgtccctggttttttcctttttttttctgtgtgcgtgcgaatggtgcggcccctcccctctcaccgtggttaacgtgacgaaggcacgattcctgtaaatgtgtaaactaaggggatggttggattttttttcaatgtaaacactaaaaacaaaatggacaaagggaancacaggatcctgtagagtcacccgcacgctcgt

SEQ ID NO: 111731 - DNA, 7532 bp, Homo sapiens
  misc_feature (118)..(118): n is a, c, g, or t
  misc_feature (1860)..(1860): n is a, c, g, or t
  misc_feature (1916)..(1916): n is a, c, g, or t
  misc_feature (2071)..(2071): n is a, c, g, or t
  misc_feature (3597)..(3597): n is a, c, g, or t
  misc_feature (3599)..(3600): n is a, c, g, or t
  misc_feature (3604)..(3604): n is a, c, g, or t
  misc_feature (3634)..(3634): n is a, c, g, or t
  misc_feature (3637)..(3637): n is a, c, g, or t
  misc_feature (3639)..(3639): n is a, c, g, or t
  misc_feature (4421)..(4421): n is a, c, g, or t
gttccacacacgcgctggacctggaggctgaggaggagaggacgaggctatgtgatgaccgcctggggcttgccagccgcgagctgctgctgcaggacagcaaagaccgcgtagagtncgcccggatccacccaccgagcagctgccctggggacctggccccccacctcatgatgcagagcggccagctgggcggggacccagccccccacacccacccccatcccccctggctgccccgcacccgcagcccctccctgtggatgggggggcactcctacggcctggggcaccctgccctgcaccagaacctgccccccggcttccccgcctccgtggctggccctgtgccctctgtcttccccctcccacaggacgcccccacacagctggtcatcctgccctcagagcccacaccccacagcgccccccacgcacttgcggatgtcatggaccaggcgtcactgtggccccccatgtacgggggccggggccccgcctctcacatgcagcacccgggccagctccctgtgtactcgaggccgcagctcctccggcagcaggagctctatgctttgcagcagcagagggccgcccagttccagcggaagcccgaagaccagcacctggatctggaggagcccgcccaggagaaggccccaaagtccacccacaagccagttgccttaacccccacggccccgggcgccccctcacccgctgcaggccccaccaagctgccaccttgctgccatccgcccgacccaaagccccccgccagctcccccaccccaccacctcggcccagcgccccgtgcactttaaatgtctgccctgccagcagccccgggcctggctcccgggtgcgcagcgccgaggaaaagaatggggagggtcagcagtccacggccgacatcatcacatccgaaccagtggcacgtgctcactctgttgcccacgctggtctcgaattcctggcctcaaatgatccatccacctcagcctcccaaagttttgggattacagacctgcctcccggatacctgcgccccatggctggcctgggcttctccctaccctcagacgtgcactcttctaacctcgaggaccctgaaactatgcaaaccaccgccccgggggcccagcctgagcccacaaggacattcctgcctggggagccgcctccctgcagccccaggagcctggaggagcccgggctgctctcaggggccagggaggccacccaggaccttgccgccaccccctaccctgccgagcggggaccccaggggaaggcagcggaccccagcccactagaggggctacaagaactgcaatgtgcggccctcctggaggcagggggccccgaggccaccggccaggctcattctactcagggaggggcacgagaagagaggagcagggaggagggggagcaggggccctcgtcaggggcctcctcccaagtcctggagcagcgagcagggagtccgggtgcccttgaggacgagggggagcagccggcccctgaggaggacgagctggaggaagacgagctggggcagcagagcatggaggactcagaggaggactgtggcggagctcccgacaacagccacccacccagggcgctaccaggcctggatgccttggtggccgccaccatcaacctgggggacctgcccagcgacagcccaccggaccctcagcccccagcggcctctgggccccccagcacagtccccctgcctcatagctcagggattcatgggatcgctctgctcagcgagctggctgacctggcaatccagcggcagaggagtgagaggactgtgccagaggaggaagaggacgtgctanccttcaacctgcagcacctggccacgctggccacagcctggtccctggtggaggcngctggcctggacagctccactgccccagcgcagccgcccacagccaacccctgcagcggccccaggctcaccccccgcatgcagatcctgcagcgcaaggacacctggacccccaagaccaagcctgtgtgccccctgaaggccgccatcgaccngctggacacgcaggaggtggggatgcgcgtgcggctggcggagctgcagcggcgctacaaggagaagcagcgggagctggcccgcctgcagcgcaagcacgaccatgagagagacgagagttcacggagccctgcacggcgggggcctggccggccgaggaagcgcaaacactcaagctcgctgcctgccccacgtcccacggggccgctccccaggagcgatggcaagaaagtcaaggcggtgcggacaagcctgggtctgctgtgtgcggagctgcgaggaggcagtgggggcgagcctgcgaagaagcgaagcaagctggagaggagcgtctatgcgggcctgcagactgcctccgtggagaaggcgcagtgtaagaagagcagctgtcagggcgggctggcgccctccgtggcccacagggtggcccagctgaaacccaaggtcaagagcaaagggctgcccacaggcctcagctctttccagcagaaggaggctacccccggggggcgcatccgggagaagctgtcccgagccaagagtgccaaggtgtctggggccacacggcacccacagcccaagggccacggcagccgggagacacccaggtgcccagcccagccctccgtggctgcgtcccaggaggcaggcagtggctatgacagtgaggactgcgagggtctcctggggacagaggcaccacccagggaagcagggctgctgctgcacgccggggccagtgtggccgtgctggggccctcaccctcctctgtggtcaagatggaggccaaccagaaggccaagaagaagaaggagaggcaggggttgctaggggcctgccgcctgtccagccctgagagtgaggtcaagatcaagaggcggtcggtgaaggccaaggtgggcaccaccctggagcgggccccagggcagaggcccccaggtgcgctgggcaagaagaaagccaagggcaaggccaagggcagcctgcgggcagagccgggggccacccccagcagggacgccctcttcaacccctctcgggccttcgcctgccgtgaggagggcagccagctggccagtgagcgcctcaagagggccacgcgcaagggcacagtgctgcagccagtgctgcggcggaagaacggggccctgtccatcacgctggccacacgcaacgccaaggccatcctggggaagggccggaagctgagcaaggtgaagcacaaggccggcaagcagggcaagggccgggccgtgagccgcctgctggaaagcttcgccgtggaggaagactttgagttcgacgacaacagcagcttctcggaagaggaggaggacgaggaggaagaggaggaggacagcggccctctgagcgcagagcagagcgccgccctagcgcgctcgtgtgccatccacaaggaggacctgcgggacgggctgcccgtgctcatccccaaggaggatagcctgctgtacgcgggcagcgtcaggaccctgcagccacccgacatctatagcatcgtcntnnaggncgagagggcaccggcagaggatctactcantgnancagctgctgcaggaagcgttctcgatgtgcggccacagtccagccggtacctcccgcccggcacgcgggtctgcgcctactggagtcagaagtctcgatgtctgtacccgggcaacgtggtccggggggcctccggtgacgaagatgaggacctggactcagtagtggtggaatttgacgatggggatacaggccacatcgccgtctccaacgtcaggctgctgccccctgacttcaagatccagtgcacagagccctctccagccctgctagtgtctagcagctgccggaggaccaagaaggtatccagtgaggcacccccgcctagtgaagccgccacccccagcctgtcccccaaagcacaggacggccccgaagctttgaagacacctgggaaaaaatccattagcaaagacaaagctggtaaagccgaactcctaacctcaggtgccaaatcccccacgggggcctccgaccacttcctgggccgccgtggcagccccttgctgagctggtccgcggtggcgcagaccaagcggaaggcggtggcagcggccagcaaggggccgggggtgctgcagaacctcttccagctcaacggcagcagcaagaagctgcgggcccgcgaggccctgttccccgtgcacagcgtggccacacccatatttggcaacggcttccgcgccgactccttcagcagcctggccagctcctacgcgcccttcgtcggggggaccgggccgggcctccccaggggagcccacaagctgctgcgggctaanaaggccgagagggtggaggccgagaagggtgggcggcggcgggcgggcggtgagttcctggtcaagctggaccacgagggtgtgacctcccccaagaacaagacctgcaaggcgttgctcatgggggacaaggacttcagccccaagctcgggcggcccctgcccagccccagctatgtgcacccggcccttgtgggcaaggacaagaaggggcgggcacccatccccccgctgcccatggggctggcgctgcgcaagtacgcgggccaggcagagttcccgctgccctacgacagcgactgccacagctccttctcggacgaggacgaggacgggccggggctggcggccggcgtgccctcccgcttcctcgcccgcctgtccgtgtcctcttcctcctctggctcgtccacctcctcctcctcaggctccgtgtccacctccagcctctgctcctccgacaacgaggactcgtcctacagctcagacgacgaggacccggctctgctgctgcagacctgcctcacccaccccgtgcccaccctcctggcccagcccgaggccctgcgctccaagggcagcggccctcacgcgcatgcccagcgctgcttcctgtccagggccacggtggctggcaccggtgcgggctcaggccccagcagcagcagcaaatccaagctcaagcgcaaagaggccctgagcttctccaaagccaaagagctctcccggaggcagcggccgccctccgtggaaaaccggccaaagatctcagccttcctgcccgcccggcagctctggaagtggtcggggaatcccacacagcggcgtggcatgaaggggaaggcccggaagctgttctacaaggccatcgtgcggggcgaggagaccctgcgtgtcggggactgtgccgtcttcctgtcagctgggcggcccaacctcccctacatcggccgcatcgagagcatgtgggagtcgtggggcagcaacatggtggtcaaggtcaagtggttctaccaccctgaggagaccaagctgggcaagaggcagtgcgacggcaagaatgcgctgtaccagtcctgccacgaggatgagaacgacgtgcagaccatctcccacaagtgccaggtcgtggcgcgcgagcagtatgagcagatggcccggagccgcaagtgccaggaccggcaggacctctactacctggcgggcacctacgaccccaccaccgggcgcctggtgacggctgatggcgtgcccatcctatgctgagccgccaccgcagatgcctcccacgtgcgccagggaccctgtgtgcggagcctggcgtcggccaagccaccgggcaggaggcagccccggcctcccaagggcgcatctgagcaaatatgcaaaagcccacagggcaagacccaggctttcttacggttttccctggaaagagcgctccaggtgtcggaatccagtcccgtcccatcctctgcggagggtcgggctgtggccctcatgggtccccggcccgcccacccacagcgccctccgtttcccgcaccggcagttcacgggagatttgaatccaagccatattccctagtacctccgactgtctcccaccagggaaagcagaaatcaggtgtgttgtctatttatttctctatgtaaatattgtatttctgcggggaaattttatggtaaaaagtggaaaagggtttttccccatccgcgtgacaaggtgtgtgtgagcgtgtatgtgtgtgcgcgtgtgtggcgatttttgtcctggggtttcctttggaaatgcactgttctcagcccagctgggttccaacgggggcacctgggacgacagaggcatctcggggcagggggcagaggccacgggagggtcaggtgggacccttgacggcaccctctgatctcttggggggacgaccgtgtaagatgaaagtcggtcaagtttatttgctttcagtgcatctcctagaaaagaagtgttggagcagggggtggtgatgaggggcccgtggggaaaggattcaagaggcaaagcccagaccagggagtgtgacaacagccgtgagcatctcacctgtgttcaaaacaagacaaagacgaacaaatattttaaagtattgataagaaaaagcaatgtttggattgtatctgctgaatcatattccaacctatatctgatttctgtttccggggccagttggtctgaggccaaggagtctggcctccacccagagcagggaggggctggcccctcgcccccctcaccctcgccgccctggcacactcgggaagcagggcccagctctgagcccctcctcacccctggggtcctaactttcctgaaagtagtaggtgccgtgagaaggggcagtttggccaggttcctgaactgggcagggctcggggcctatgagggcaggttcacagtcccaccagattctctcctcacccccaagcagaatgcatgcaaaagacaccccttttcccacccaccttattggtgcccccaaacccctggcctgctgcgtagatggtggtgaggccaggccagcagtgctgtggccaggggagaagaaaataaaacgcaggccctgcccttggggaaggcccctttctgggcccccttttccaccagccaaatctgcctggccctcggacccctctgcctgccccaacccctttggaggtttctcggccttttctgtgccacttggtggggcagatggcctgatgggctagtgcttggggcatagaatgagggtccccctgaccacctgagcccaaatcctggccccaggtgcaagcagcacccctcgagggctctgccccagtatccccagagaattcacacccctccccttctcccacagccaaggacagacaggctgcctggacctgagcccaacagccttcagcctcagaaacgcatggggggccacacactccttatatcctcccacactaaggttcccctggccccacgggagcttcaggaaagccccccaagttagccactgctctaggacgagctctgtgtcccccacaccacaggcctcgaagcagggtgcagaagtgcgcctgggtgcagaagtgcgctggtgc

SEQ ID NO: 111732 - DNA, 7603 bp, Homo sapiens
  misc_feature (118)..(118): n is a, c, g, or t
  misc_feature (1860)..(1860): n is a, c, g, or t
  misc_feature (1916)..(1916): n is a, c, g, or t
  misc_feature (2071)..(2071): n is a, c, g, or t
  misc_feature (3597)..(3597): n is a, c, g, or t
  misc_feature (3599)..(3600): n is a, c, g, or t
  misc_feature (3604)..(3604): n is a, c, g, or t
  misc_feature (3634)..(3634): n is a, c, g, or t
  misc_feature (3637)..(3637): n is a, c, g, or t
  misc_feature (3639)..(3639): n is a, c, g, or t
  misc_feature (4421)..(4421): n is a, c, g, or t
gttccacacacgcgctggacctggaggctgaggaggagaggacgaggctatgtgatgaccgcctggggcttgccagccgcgagctgctgctgcaggacagcaaagaccgcgtagagtncgcccggatccacccaccgagcagctgccctggggacctggccccccacctcatgatgcagagcggccagctgggcggggacccagccccccacacccacccccatcccccctggctgccccgcacccgcagcccctccctgtggatgggggggcactcctacggcctggggcaccctgccctgcaccagaacctgccccccggcttccccgcctccgtggctggccctgtgccctctgtcttccccctcccacaggacgcccccacacagctggtcatcctgccctcagagcccacaccccacagcgccccccacgcacttgcggatgtcatggaccaggcgtcactgtggccccccatgtacgggggccggggccccgcctctcacatgcagcacccgggccagctccctgtgtactcgaggccgcagctcctccggcagcaggagctctatgctttgcagcagcagagggccgcccagttccagcggaagcccgaagaccagcacctggatctggaggagcccgcccaggagaaggccccaaagtccacccacaagccagttgccttaacccccacggccccgggcgccccctcacccgctgcaggccccaccaagctgccaccttgctgccatccgcccgacccaaagccccccgccagctcccccaccccaccacctcggcccagcgccccgtgcactttaaatgtctgccctgccagcagccccgggcctggctcccgggtgcgcagcgccgaggaaaagaatggggagggtcagcagtccacggccgacatcatcacatccgaaccagtggcacgtgctcactctgttgcccacgctggtctcgaattcctggcctcaaatgatccatccacctcagcctcccaaagttttgggattacagacctgcctcccggatacctgcgccccatggctggcctgggcttctccctaccctcagacgtgcactcttctaacctcgaggaccctgaaactatgcaaaccaccgccccgggggcccagcctgagcccacaaggacattcctgcctggggagccgcctccctgcagccccaggagcctggaggagcccgggctgctctcaggggccagggaggccacccaggaccttgccgccaccccctaccctgccgagcggggaccccaggggaaggcagcggaccccagcccactagaggggctacaagaactgcaatgtgcggccctcctggaggcagggggccccgaggccaccggccaggctcattctactcagggaggggcacgagaagagaggagcagggaggagggggagcaggggccctcgtcaggggcctcctcccaagtcctggagcagcgagcagggagtccgggtgcccttgaggacgagggggagcagccggcccctgaggaggacgagctggaggaagacgagctggggcagcagagcatggaggactcagaggaggactgtggcggagctcccgacaacagccacccacccagggcgctaccaggcctggatgccttggtggccgccaccatcaacctgggggacctgcccagcgacagcccaccggaccctcagcccccagcggcctctgggccccccagcacagtccccctgcctcatagctcagggattcatgggatcgctctgctcagcgagctggctgacctggcaatccagcggcagaggagtgagaggactgtgccagaggaggaagaggacgtgctanccttcaacctgcagcacctggccacgctggccacagcctggtccctggtggaggcngctggcctggacagctccactgccccagcgcagccgcccacagccaacccctgcagcggccccaggctcaccccccgcatgcagatcctgcagcgcaaggacacctggacccccaagaccaagcctgtgtgccccctgaaggccgccatcgaccngctggacacgcaggaggtggggatgcgcgtgcggctggcggagctgcagcggcgctacaaggagaagcagcgggagctggcccgcctgcagcgcaagcacgaccatgagagagacgagagttcacggagccctgcacggcgggggcctggccggccgaggaagcgcaaacactcaagctcgctgcctgccccacgtcccacggggccgctccccaggagcgatggcaagaaagtcaaggcggtgcggacaagcctgggtctgctgtgtgcggagctgcgaggaggcagtgggggcgagcctgcgaagaagcgaagcaagctggagaggagcgtctatgcgggcctgcagactgcctccgtggagaaggcgcagtgtaagaagagcagctgtcagggcgggctggcgccctccgtggcccacagggtggcccagctgaaacccaaggtcaagagcaaagggctgcccacaggcctcagctctttccagcagaaggaggctacccccggggggcgcatccgggagaagctgtcccgagccaagagtgccaaggtgtctggggccacacggcacccacagcccaagggccacggcagccgggagacacccaggtgcccagcccagccctccgtggctgcgtcccaggaggcaggcagtggctatgacagtgaggactgcgagggtctcctggggacagaggcaccacccagggaagcagggctgctgctgcacgccggggccagtgtggccgtgctggggccctcaccctcctctgtggtcaagatggaggccaaccagaaggccaagaagaagaaggagaggcaggggttgctaggggcctgccgcctgtccagccctgagagtgaggtcaagatcaagaggcggtcggtgaaggccaaggtgggcaccaccctggagcgggccccagggcagaggcccccaggtgcgctgggcaagaagaaagccaagggcaaggccaagggcagcctgcgggcagagccgggggccacccccagcagggacgccctcttcaacccctctcgggccttcgcctgccgtgaggagggcagccagctggccagtgagcgcctcaagagggccacgcgcaagggcacagtgctgcagccagtgctgcggcggaagaacggggccctgtccatcacgctggccacacgcaacgccaaggccatcctggggaagggccggaagctgagcaaggtgaagcacaaggccggcaagcagggcaagggccgggccgtgagccgcctgctggaaagcttcgccgtggaggaagactttgagttcgacgacaacagcagcttctcggaagaggaggaggacgaggaggaagaggaggaggacagcggccctctgagcgcagagcagagcgccgccctagcgcgctcgtgtgccatccacaaggaggacctgcgggacgggctgcccgtgctcatccccaaggaggatagcctgctgtacgcgggcagcgtcaggaccctgcagccacccgacatctatagcatcgtcntnnaggncgagagggcaccggcagaggatctactcantgnancagctgctgcaggaagcgttctcgatgtgcggccacagtccagccggtacctcccgcccggcacgcgggtctgcgcctactggagtcagaagtctcgatgtctgtacccgggcaacgtggtccggggggcctccggtgacgaagatgaggacctggactcagtagtggtggaatttgacgatggggatacaggccacatcgccgtctccaacgtcaggctgctgccccctgacttcaagatccagtgcacagagccctctccagccctgctagtgtctagcagctgccggaggaccaagaaggtatccagtgaggcacccccgcctagtgaagccgccacccccagcctgtcccccaaagcacaggacggccccgaagctttgaagacacctgggaaaaaatccattagcaaagacaaagctggtaaagccgaactcctaacctcaggtgccaaatcccccacgggggcctccgaccacttcctgggccgccgtggcagccccttgctgagctggtccgcggtggcgcagaccaagcggaaggcggtggcagcggccagcaaggggccgggggtgctgcagaacctcttccagctcaacggcagcagcaagaagctgcgggcccgcgaggccctgttccccgtgcacagcgtggccacacccatatttggcaacggcttccgcgccgactccttcagcagcctggccagctcctacgcgcccttcgtcggggggaccgggccgggcctccccaggggagcccacaagctgctgcgggctaanaaggccgagagggtggaggccgagaagggtgggcggcggcgggcgggcggtgagttcctggtcaagctggaccacgagggtgtgacctcccccaagaacaagacctgcaaggcgttgctcatgggggacaaggacttcagccccaagctcgggcggcccctgcccagccccagctatgtgcacccggcccttgtgggcaaggacaagaaggggcgggcacccatccccccgctgcccatggggctggcgctgcgcaagtacgcgggccaggcagagttcccgctgccctacgacagcgactgccacagctccttctcggacgaggacgaggacgggccggggctggcggccggcgtgccctcccgcttcctcgcccgcctgtccgtgtcctcttcctcctctggctcgtccacctcctcctcctcaggctccgtgtccacctccagcctctgctcctccgacaacgaggactcgtcctacagctcagacgacgaggacccggctctgctgctgcagacctgcctcacccaccccgtgcccaccctcctggcccagcccgaggccctgcgctccaagggcagcggccctcacgcgcatgcccagcgctgcttcctgtccagggccacggtggctggcaccggtgcgggctcaggccccagcagcagcagcaaatccaagctcaagcgcaaagaggccctgagcttctccaaagccaaagagctctcccggaggcagcggccgccctccgtggaaaaccggccaaagatctcagccttcctgcccgcccggcagctctggaagtggtcggggaatcccacacagcggcgtggcatgaaggggaaggcccggaagctgttctacaaggccatcgtgcggggcgaggagaccctgcgtgtcggggactgtgccgtcttcctgtcagctgggcggcccaacctcccctacatcggccgcatcgagagcatgtgggagtcgtggggcagcaacatggtggtcaaggtcaagtggttctaccaccctgaggagaccaagctgggcaagaggcagtgcgacggcaagaatgcgctgtaccagtcctgccacgaggatgagaacgacgtgcagaccatctcccacaagtgccaggtcgtggcgcgcgagcagtatgagcagatggcccggagccgcaagtgccaggaccggcaggacctctactacctggcgggcacctacgaccccaccaccgggcgcctggtgacggctgatggcgtgcccatcctatgctgagccgccaccgcagatgcctcccacgtgcgccagggaccctgtgtgcggagcctggcgtcggccaagccaccgggcaggaggcagccccggcctcccaagggcgcatctgagcaaatatgcaaaagcccacagggcaagacccaggctttcttacggttttccctggaaagagcgctccaggtgtcggaatccagtcccgtcccatcctctgcggagggtcgggctgtggccctcatgggtccccggcccgcccacccacagcgccctccgtttcccgcaccggcagttcacgggagatttgaatccaagccatattccctagtacctccgactgtctcccaccagggaaagcagaaatcaggtgtgttgtctatttatttctctatgtaaatattgtatttctgcggggaaattttatggtaaaaagtggaaaagggtttttccccatccgcgtgacaaggtgtgtgtgagcgtgtatgtgtgtgcgcgtgtgtggcgatttttgtcctggggtttcctttggaaatgcactgttctcagcccagctgggttccaacgggggcacctgggacgacagaggcatctcggggcagggggcagaggccacgggagggtcaggtgggacccttgacggcaccctctgatctcttggggggacgaccgtgtaagatgaaagtcggtcaagtttatttgctttcagtgcatctcctagaaaagaagtgttggagcagggggtggtgatgaggggcccgtggggaaaggattcaagaggcaaagcccagaccagggagtgtgacaacagccgtgagcatctcacctgtgttcaaaacaagacaaagacgaacaaatattttaaagtattgataagaaaaagcaatgtttggattgtatctgctgaatcatattccaacctatatctgatttctgtttccggggccagttggtctgaggccaaggagtctggcctccacccagagcagggaggggctggcccctcgcccccctcaccctcgccgccctggcacactcgggaagcagggcccagctctgagcccctcctcacccctggggtcctaactttcctgaaagtagtaggtgccgtgagaaggggcagtttggccaggttcctgaactgggcagggctcggggcctatgagggcaggttcacagtcccaccagattctctcctcacccccaagcagaatgcatgcaaaagacaccccttttcccacccaccttattggtgcccccaaacccctggcctgctgcgtagatggtggtgaggccaggccagcagtgctgtggccaggggagaagaaaataaaacgcaggccctgcccttggggaaggcccctttctgggcccccttttccaccagccaaatctgcctggccctcggacccctctgcctgccccaacccctttggaggtttctcggccttttctgtgccacttggtggggcagatggcctgatgggctagtgcttggggcatagaatgagggtccccctgaccacctgagcccaaatcctggccccaggtgcaagcagcacccctcgagggctctgccccagtatccccagagaattcacacccctccccttctcccacagccaaggacagacaggctgcctggacctgagcccaacagccttcagcctcagaaacgcatggggggccacacactccttatatcctcccctctcaccgtggttaacgtgacgaaggcacgattcctgtaaatgtgtaaactaaggggatggttggattttttttcaatgtaaacactaaaaacaaaatggacaaaaaaacacacaaaggttttatgaacagcagactctatgtaaaggcattttagtatcaaattttttattgataacttgcttaagaataaatatatggactattgtacaggt

SEQ ID NO: 111733 - DNA, 7507 bp, Homo sapiens
  misc_feature (118)..(118): n is a, c, g, or t
  misc_feature (1860)..(1860): n is a, c, g, or t
  misc_feature (1916)..(1916): n is a, c, g, or t
  misc_feature (2071)..(2071): n is a, c, g, or t
  misc_feature (3597)..(3597): n is a, c, g, or t
  misc_feature (3599)..(3600): n is a, c, g, or t
  misc_feature (3604)..(3604): n is a, c, g, or t
  misc_feature (3634)..(3634): n is a, c, g, or t
  misc_feature (3637)..(3637): n is a, c, g, or t
  misc_feature (3639)..(3639): n is a, c, g, or t
  misc_feature (4421)..(4421): n is a, c, g, or t
gttccacacacgcgctggacctggaggctgaggaggagaggacgaggctatgtgatgaccgcctggggcttgccagccgcgagctgctgctgcaggacagcaaagaccgcgtagagtncgcccggatccacccaccgagcagctgccctggggacctggccccccacctcatgatgcagagcggccagctgggcggggacccagccccccacacccacccccatcccccctggctgccccgcacccgcagcccctccctgtggatgggggggcactcctacggcctggggcaccctgccctgcaccagaacctgccccccggcttccccgcctccgtggctggccctgtgccctctgtcttccccctcccacaggacgcccccacacagctggtcatcctgccctcagagcccacaccccacagcgccccccacgcacttgcggatgtcatggaccaggcgtcactgtggccccccatgtacgggggccggggccccgcctctcacatgcagcacccgggccagctccctgtgtactcgaggccgcagctcctccggcagcaggagctctatgctttgcagcagcagagggccgcccagttccagcggaagcccgaagaccagcacctggatctggaggagcccgcccaggagaaggccccaaagtccacccacaagccagttgccttaacccccacggccccgggcgccccctcacccgctgcaggccccaccaagctgccaccttgctgccatccgcccgacccaaagccccccgccagctcccccaccccaccacctcggcccagcgccccgtgcactttaaatgtctgccctgccagcagccccgggcctggctcccgggtgcgcagcgccgaggaaaagaatggggagggtcagcagtccacggccgacatcatcacatccgaaccagtggcacgtgctcactctgttgcccacgctggtctcgaattcctggcctcaaatgatccatccacctcagcctcccaaagttttgggattacagacctgcctcccggatacctgcgccccatggctggcctgggcttctccctaccctcagacgtgcactcttctaacctcgaggaccctgaaactatgcaaaccaccgccccgggggcccagcctgagcccacaaggacattcctgcctggggagccgcctccctgcagccccaggagcctggaggagcccgggctgctctcaggggccagggaggccacccaggaccttgccgccaccccctaccctgccgagcggggaccccaggggaaggcagcggaccccagcccactagaggggctacaagaactgcaatgtgcggccctcctggaggcagggggccccgaggccaccggccaggctcattctactcagggaggggcacgagaagagaggagcagggaggagggggagcaggggccctcgtcaggggcctcctcccaagtcctggagcagcgagcagggagtccgggtgcccttgaggacgagggggagcagccggcccctgaggaggacgagctggaggaagacgagctggggcagcagagcatggaggactcagaggaggactgtggcggagctcccgacaacagccacccacccagggcgctaccaggcctggatgccttggtggccgccaccatcaacctgggggacctgcccagcgacagcccaccggaccctcagcccccagcggcctctgggccccccagcacagtccccctgcctcatagctcagggattcatgggatcgctctgctcagcgagctggctgacctggcaatccagcggcagaggagtgagaggactgtgccagaggaggaagaggacgtgctanccttcaacctgcagcacctggccacgctggccacagcctggtccctggtggaggcngctggcctggacagctccactgccccagcgcagccgcccacagccaacccctgcagcggccccaggctcaccccccgcatgcagatcctgcagcgcaaggacacctggacccccaagaccaagcctgtgtgccccctgaaggccgccatcgaccngctggacacgcaggaggtggggatgcgcgtgcggctggcggagctgcagcggcgctacaaggagaagcagcgggagctggcccgcctgcagcgcaagcacgaccatgagagagacgagagttcacggagccctgcacggcgggggcctggccggccgaggaagcgcaaacactcaagctcgctgcctgccccacgtcccacggggccgctccccaggagcgatggcaagaaagtcaaggcggtgcggacaagcctgggtctgctgtgtgcggagctgcgaggaggcagtgggggcgagcctgcgaagaagcgaagcaagctggagaggagcgtctatgcgggcctgcagactgcctccgtggagaaggcgcagtgtaagaagagcagctgtcagggcgggctggcgccctccgtggcccacagggtggcccagctgaaacccaaggtcaagagcaaagggctgcccacaggcctcagctctttccagcagaaggaggctacccccggggggcgcatccgggagaagctgtcccgagccaagagtgccaaggtgtctggggccacacggcacccacagcccaagggccacggcagccgggagacacccaggtgcccagcccagccctccgtggctgcgtcccaggaggcaggcagtggctatgacagtgaggactgcgagggtctcctggggacagaggcaccacccagggaagcagggctgctgctgcacgccggggccagtgtggccgtgctggggccctcaccctcctctgtggtcaagatggaggccaaccagaaggccaagaagaagaaggagaggcaggggttgctaggggcctgccgcctgtccagccctgagagtgaggtcaagatcaagaggcggtcggtgaaggccaaggtgggcaccaccctggagcgggccccagggcagaggcccccaggtgcgctgggcaagaagaaagccaagggcaaggccaagggcagcctgcgggcagagccgggggccacccccagcagggacgccctcttcaacccctctcgggccttcgcctgccgtgaggagggcagccagctggccagtgagcgcctcaagagggccacgcgcaagggcacagtgctgcagccagtgctgcggcggaagaacggggccctgtccatcacgctggccacacgcaacgccaaggccatcctggggaagggccggaagctgagcaaggtgaagcacaaggccggcaagcagggcaagggccgggccgtgagccgcctgctggaaagcttcgccgtggaggaagactttgagttcgacgacaacagcagcttctcggaagaggaggaggacgaggaggaagaggaggaggacagcggccctctgagcgcagagcagagcgccgccctagcgcgctcgtgtgccatccacaaggaggacctgcgggacgggctgcccgtgctcatccccaaggaggatagcctgctgtacgcgggcagcgtcaggaccctgcagccacccgacatctatagcatcgtcntnnaggncgagagggcaccggcagaggatctactcantgnancagctgctgcaggaagcgttctcgatgtgcggccacagtccagccggtacctcccgcccggcacgcgggtctgcgcctactggagtcagaagtctcgatgtctgtacccgggcaacgtggtccggggggcctccggtgacgaagatgaggacctggactcagtagtggtggaatttgacgatggggatacaggccacatcgccgtctccaacgtcaggctgctgccccctgacttcaagatccagtgcacagagccctctccagccctgctagtgtctagcagctgccggaggaccaagaaggtatccagtgaggcacccccgcctagtgaagccgccacccccagcctgtcccccaaagcacaggacggccccgaagctttgaagacacctgggaaaaaatccattagcaaagacaaagctggtaaagccgaactcctaacctcaggtgccaaatcccccacgggggcctccgaccacttcctgggccgccgtggcagccccttgctgagctggtccgcggtggcgcagaccaagcggaaggcggtggcagcggccagcaaggggccgggggtgctgcagaacctcttccagctcaacggcagcagcaagaagctgcgggcccgcgaggccctgttccccgtgcacagcgtggccacacccatatttggcaacggcttccgcgccgactccttcagcagcctggccagctcctacgcgcccttcgtcggggggaccgggccgggcctccccaggggagcccacaagctgctgcgggctaanaaggccgagagggtggaggccgagaagggtgggcggcggcgggcgggcggtgagttcctggtcaagctggaccacgagggtgtgacctcccccaagaacaagacctgcaaggcgttgctcatgggggacaaggacttcagccccaagctcgggcggcccctgcccagccccagctatgtgcacccggcccttgtgggcaaggacaagaaggggcgggcacccatccccccgctgcccatggggctggcgctgcgcaagtacgcgggccaggcagagttcccgctgccctacgacagcgactgccacagctccttctcggacgaggacgaggacgggccggggctggcggccggcgtgccctcccgcttcctcgcccgcctgtccgtgtcctcttcctcctctggctcgtccacctcctcctcctcaggctccgtgtccacctccagcctctgctcctccgacaacgaggactcgtcctacagctcagacgacgaggacccggctctgctgctgcagacctgcctcacccaccccgtgcccaccctcctggcccagcccgaggccctgcgctccaagggcagcggccctcacgcgcatgcccagcgctgcttcctgtccagggccacggtggctggcaccggtgcgggctcaggccccagcagcagcagcaaatccaagctcaagcgcaaagaggccctgagcttctccaaagccaaagagctctcccggaggcagcggccgccctccgtggaaaaccggccaaagatctcagccttcctgcccgcccggcagctctggaagtggtcggggaatcccacacagcggcgtggcatgaaggggaaggcccggaagctgttctacaaggccatcgtgcggggcgaggagaccctgcgtgtcggggactgtgccgtcttcctgtcagctgggcggcccaacctcccctacatcggccgcatcgagagcatgtgggagtcgtggggcagcaacatggtggtcaaggtcaagtggttctaccaccctgaggagaccaagctgggcaagaggcagtgcgacggcaagaatgcgctgtaccagtcctgccacgaggatgagaacgacgtgcagaccatctcccacaagtgccaggtcgtggcgcgcgagcagtatgagcagatggcccggagccgcaagtgccaggaccggcaggacctctactacctggcgggcacctacgaccccaccaccgggcgcctggtgacggctgatggcgtgcccatcctatgctgagccgccaccgcagatgcctcccacgtgcgccagggaccctgtgtgcggagcctggcgtcggccaagccaccgggcaggaggcagccccggcctcccaagggcgcatctgagcaaatatgcaaaagcccacagggcaagacccaggctttcttacggttttccctggaaagagcgctccaggtgtcggaatccagtcccgtcccatcctctgcggagggtcgggctgtggccctcatgggtccccggcccgcccacccacagcgccctccgtttcccgcaccggcagttcacgggagatttgaatccaagccatattccctagtacctccgactgtctcccaccagggaaagcagaaatcaggtgtgttgtctatttatttctctatgtaaatattgtatttctgcggggaaattttatggtaaaaagtggaaaagggtttttccccatccgcgtgacaaggtgtgtgtgagcgtgtatgtgtgtgcgcgtgtgtggcgatttttgtcctggggtttcctttggaaatgcactgttctcagcccagctgggttccaacgggggcacctgggacgacagaggcatctcggggcagggggcagaggccacgggagggtcaggtgggacccttgacggcaccctctgatctcttggggggacgaccgtgtaagatgaaagtcggtcaagtttatttgctttcagtgcatctcctagaaaagaagtgttggagcagggggtggtgatgaggggcccgtggggaaaggattcaagaggcaaagcccagaccagggagtgtgacaacagccgtgagcatctcacctgtgttcaaaacaagacaaagacgaacaaatattttaaagtattgataagaaaaagcaatgtttggattgtatctgctgaatcatattccaacctatatctgatttctgtttccggggccagttggtctgaggccaaggagtctggcctccacccagagcagggaggggctggcccctcgcccccctcaccctcgccgccctggcacactcgggaagcagggcccagctctgagcccctcctcacccctggggtcctaactttcctgaaagtagtaggtgccgtgagaaggggcagtttggccaggttcctgaactgggcagggctcggggcctatgagggcaggttcacagtcccaccagattctctcctcacccccaagcagaatgcatgcaaaagacaccccttttcccacccaccttattggtgcccccaaacccctggcctgctgcgtagatggtggtgaggccaggccagcagtgctgtggccaggggagaagaaaataaaacgcaggccctgcccttggggaaggcccctttctgggcccccttttccaccagccaaatctgcctggccctcggacccctctgcctgccccaacccctttggaggtttctcggccttttctgtgccacttggtggggcagatggcctgatgggctagtgcttggggcatagaatgagggtccccctgaccacctgagcccaaatcctggccccaggtgcaagcagcacccctcgagggctctgccccagtatccccagagaattcacacccctccctcccctctcaccgtggttaacgtgacgaaggcacgattcctgtaaatgtgtaaactaaggggatggttggattttttttcaatgtaaacactaaaaacaaaatggacaaaaaaacacacaaaggttttatgaacagcagactctatgtaaaggcattttagtatcaaattttttattgataacttgcttaagaataaatatatggactattgtacaggt

SEQ ID NO: 111734 - DNA, 491 bp, Homo sapiens
gcggccgccctccgtggaaaaccggccaaagatctcagccttcctgcccgcccggcagctctggaagtggtcggggaatcccacacaggtaggtccagcgggaggcgggaggagctcctggttcccaaggaaaccggggcgggctcatgcgcccctgctgcccttccctctcctttttcatcttcctacttgatttcaagttaaaaaatgtggaaaactcaagggaagaacaaagacccatccatgacccagtgaggcagccgcttccgctggcccctcgctggagcccgtggcctgcgtgacagtagaaatggcttcatgtcgggccgggcccgagctgcactccgcatggtgtggcctcacttttccacgtcgataagtggcgtggccagctggagagctgtgtatccccgcactcagatgcctgcgtctgtcctcaccagggcactgctcgggggcgcatgtggggccactcgtgggtcttttgcctt

SEQ ID NO: 111735 - DNA, 5846 bp, Homo sapiens
  misc_feature (1244)..(1244): n is a, c, g, or t
  misc_feature (1246)..(1247): n is a, c, g, or t
  misc_feature (1251)..(1251): n is a, c, g, or t
  misc_feature (1281)..(1281): n is a, c, g, or t
  misc_feature (1284)..(1284): n is a, c, g, or t
  misc_feature (1286)..(1286): n is a, c, g, or t
  misc_feature (2068)..(2068): n is a, c, g, or t
ttcagcccctgtggatcgagggcaggggcctcgaggtaccagttctgagccgggcatcaacagagaggcacctaaccgcccaggggctgtggtttgcagagggcgccctgagagtgcagctgcccctccctgttcacaggagaaggcgcagtgtaagaagagcagctgtcagggcgggctggcgccctccgtggcccacagggtggcccagctgaaacccaaggtcaagagcaaagggctgcccacaggcctcagctctttccagcagaaggaggctacccccggggggcgcatccgggagaagctgtcccgagccaagagtgccaaggtgtctggggccacacggcacccacagcccaagggccacggcagccgggagacacccaggtgcccagcccagccctccgtggctgcgtcccaggaggcaggcagtggctatgacagtgaggactgcgagggtctcctggggacagaggcaccacccagggaagcagggctgctgctgcacgccggggccagtgtggccgtgctggggccctcaccctcctctgtggtcaagatggaggccaaccagaaggccaagaagaagaaggagaggcaggggttgctaggggcctgccgcctgtccagccctgagagtgaggtcaagatcaagaggcggtcggtgaaggccaaggtgggcaccaccctggagcgggccccagggcagaggcccccaggtgcgctgggcaagaagaaagccaagggcaaggccaagggcagcctgcgggcagagccgggggccacccccagcagggacgccctcttcaacccctctcgggccttcgcctgccgtgaggagggcagccagctggccagtgagcgcctcaagagggccacgcgcaagggcacagtgctgcagccagtgctgcggcggaagaacggggccctgtccatcacgctggccacacgcaacgccaaggccatcctggggaagggccggaagctgagcaaggtgaagcacaaggccggcaagcagggcaagggccgggccgtgagccgcctgctggaaagcttcgccgtggaggaagactttgagttcgacgacaacagcagcttctcggaagaggaggaggacgaggaggaagaggaggaggacagcggccctctgagcgcagagcagagcgccgccctagcgcgctcgtgtgccatccacaaggaggacctgcgggacgggctgcccgtgctcatccccagcatcgtcntnnaggncgagagggcaccggcagaggatctactcantgnancagctgctgcaggaagcgttctcgatgtgcggccacagtccagccggtacctcccgcccggcacgcgggtctgcgcctactggagtcagaagtctcgatgtctgtacccgggcaacgtggtccggggggcctccggtgacgaagatgaggacctggactcagtagtggtggaatttgacgatggggatacaggccacatcgccgtctccaacgtcaggctgctgccccctgacttcaagatccagtgcacagagccctctccagccctgctagtgtctagcagctgccggaggaccaagaaggtatccagtgaggcacccccgcctagtgaagccgccacccccagcctgtcccccaaagcacaggacggccccgaagctttgaagacacctgggaaaaaatccattagcaaagacaaagctggtaaagccgaactcctaacctcaggtgccaaatcccccacgggggcctccgaccacttcctgggccgccgtggcagccccttgctgagctggtccgcggtggcgcagaccaagcggaaggcggtggcagcggccagcaaggggccgggggtgctgcagaacctcttccagctcaacggcagcagcaagaagctgcgggcccgcgaggccctgttccccgtgcacagcgtggccacacccatatttggcaacggcttccgcgccgactccttcagcagcctggccagctcctacgcgcccttcgtcggggggaccgggccgggcctccccaggggagcccacaagctgctgcgggctaanaaggccgagagggtggaggccgagaagggtgggcggcggcgggcgggcggtgagttcctggtcaagctggaccacgagggtgtgacctcccccaagaacaagacctgcaaggcgttgctcatgggggacaaggacttcagccccaagctcgggcggcccctgcccagccccagctatgtgcacccggcccttgtgggcaaggacaagaaggggcgggcacccatccccccgctgcccatggggctggcgctgcgcaagtacgcgggccaggcagagttcccgctgccctacgacagcgactgccacagctccttctcggacgaggacgaggacgggccggggctggcggccggcgtgccctcccgcttcctcgcccgcctgtccgtgtcctcttcctcctctggctcgtccacctcctcctcctcaggctccgtgtccacctccagcctctgctcctccgacaacgaggactcgtcctacagctcagacgacgaggacccggctctgctgctgcagacctgcctcacccaccccgtgcccaccctcctggcccagcccgaggccctgcgctccaagggcagcggccctcacgcgcatgcccagcgctgcttcctgtccagggccacggtggctggcaccggtgcgggctcaggccccagcagcagcagcaaatccaagctcaagcgcaaagaggccctgagcttctccaaagccaaagagctctcccggaggcagcggccgccctccgtggaaaaccggccaaagatctcagccttcctgcccgcccggcagctctggaagtggtcggggaatcccacacagcggcgtggcatgaaggggaaggcccggaagctgttctacaaggccatcgtgcggggcgaggagaccctgcgtgtcggggactgtgccgtcttcctgtcagctgggcggcccaacctcccctacatcggccgcatcgagagcatgtgggagtcgtggggcagcaacatggtggtcaaggtcaagtggttctaccaccctgaggagaccaagctgggcaagaggcagtgcgacggcaagaatgcgctgtaccagtcctgccacgaggatgagaacgacgtgcagaccatctcccacaagtgccaggtcgtggcgcgcgagcagtatgagcagatggcccggagccgcaagtgccaggaccggcaggacctctactacctggcgggcacctacgaccccaccaccgggcgcctggtgacggctgatggcgtgcccatcctatgctgagccgccaccgcagatgcctcccacgtgcgccagggaccctgtgtgcggagcctggcgtcggccaagccaccgggcaggaggcagccccggcctcccaagggcgcatctgagcaaatatgcaaaagcccacagggcaagacccaggctttcttacggttttccctggaaagagcgctccaggtgtcggaatccagtcccgtcccatcctctgcggagggtcgggctgtggccctcatgggtccccggcccgcccacccacagcgccctccgtttcccgcaccggcagttcacgggagatttgaatccaagccatattccctagtacctccgactgtctcccaccagggaaagcagaaatcaggtgtgttgtctatttatttctctatgtaaatattgtatttctgcggggaaattttatggtaaaaagtggaaaagggtttttccccatccgcgtgacaaggtgtgtgtgagcgtgtatgtgtgtgcgcgtgtgtggcgatttttgtcctggggtttcctttggaaatgcactgttctcagcccagctgggttccaacgggggcacctgggacgacagaggcatctcggggcagggggcagaggccacgggagggtcaggtgggacccttgacggcaccctctgatctcttggggggacgaccgtgtaagatgaaagtcggtcaagtttatttgctttcagtgcatctcctagaaaagaagtgttggagcagggggtggtgatgaggggcccgtggggaaaggattcaagaggcaaagcccagaccagggagtgtgacaacagccgtgagcatctcacctgtgttcaaaacaagacaaagacgaacaaatattttaaagtattgataagaaaaagcaatgtttggattgtatctgctgaatcatattccaacctatatctgatttctgtttccggggccagttggtctgaggccaaggagtctggcctccacccagagcagggaggggctggcccctcgcccccctcaccctcgccgccctggcacactcgggaagcagggcccagctctgagcccctcctcacccctggggtcctaactttcctgaaagtagtaggtgccgtgagaaggggcagtttggccaggttcctgaactgggcagggctcggggcctatgagggcaggttcacagtcccaccagattctctcctcacccccaagcagaatgcatgcaaaagacaccccttttcccacccaccttattggtgcccccaaacccctggcctgctgcgtagatggtggtgaggccaggccagcagtgctgtggccaggggagaagaaaataaaacgcaggccctgcccttggggaaggcccctttctgggcccccttttccaccagccaaatctgcctggccctcggacccctctgcctgccccaacccctttggaggtttctcggccttttctgtgccacttggtggggcagatggcctgatgggctagtgcttggggcatagaatgagggtccccctgaccacctgagcccaaatcctggccccaggtgcaagcagcacccctcgagggctctgccccagtatccccagagaattcacacccctccccttctcccacagccaaggacagacaggctgcctggacctgagcccaacagccttcagcctcagaaacgcatggggggccacacactccttatatcctcccacactaaggttcccctggccccacgggagcttcaggaaagccccccaagttagccactgctctaggacgagctctgtgtcccccacaccacaggcctcgaagcagggtgctggtgggtgccctgcaccccaatcccaggtccccttggccccctatttttctcgggcccattggggcctgtttctcacctgctggctggaccccctgaagggccgttcccagaggctccccaggaggctcaaggctgggggcttatgttgtggtcgggggtccccgcctccagccccccgctcccacccccgagcctaccctttgtctcgcatgagtgcaatatttcattcccggtggttgtctggggaggtggttggacgaggtcctgcttgaggctcggggatcagaacgatgtcaagtgaagaaaaatgcacgggggcatgctgagccactggagttccagagagggccgaggagggtgcagccacggaggttggatcctctgctccgccgcctcgtcctcgtcccgcttctgctgggttccgctttgtccctggttttttcctttttttttctgtgtgcgtgcgaatggtgcggcccctcccctctcaccgtggttaacgtgacgaaggcacgattcctgtaaatgtgtaaactaaggggatggttggattttttttcaatgtaaacactaaaaacaaaatggacaaaaaaacacacaaaggttttatgaacagcagactctatgtaaaggcattttagtatcaaattttttattgataacttgcttaagaataaatatatggactattgtacaggt

SEQ ID NO: 111736 - DNA, 5345 bp, Homo sapiens
  misc_feature (1244)..(1244): n is a, c, g, or t
  misc_feature (1246)..(1247): n is a, c, g, or t
  misc_feature (1251)..(1251): n is a, c, g, or t
  misc_feature (1281)..(1281): n is a, c, g, or t
  misc_feature (1284)..(1284): n is a, c, g, or t
  misc_feature (1286)..(1286): n is a, c, g, or t
ttcagcccctgtggatcgagggcaggggcctcgaggtaccagttctgagccgggcatcaacagagaggcacctaaccgcccaggggctgtggtttgcagagggcgccctgagagtgcagctgcccctccctgttcacaggagaaggcgcagtgtaagaagagcagctgtcagggcgggctggcgccctccgtggcccacagggtggcccagctgaaacccaaggtcaagagcaaagggctgcccacaggcctcagctctttccagcagaaggaggctacccccggggggcgcatccgggagaagctgtcccgagccaagagtgccaaggtgtctggggccacacggcacccacagcccaagggccacggcagccgggagacacccaggtgcccagcccagccctccgtggctgcgtcccaggaggcaggcagtggctatgacagtgaggactgcgagggtctcctggggacagaggcaccacccagggaagcagggctgctgctgcacgccggggccagtgtggccgtgctggggccctcaccctcctctgtggtcaagatggaggccaaccagaaggccaagaagaagaaggagaggcaggggttgctaggggcctgccgcctgtccagccctgagagtgaggtcaagatcaagaggcggtcggtgaaggccaaggtgggcaccaccctggagcgggccccagggcagaggcccccaggtgcgctgggcaagaagaaagccaagggcaaggccaagggcagcctgcgggcagagccgggggccacccccagcagggacgccctcttcaacccctctcgggccttcgcctgccgtgaggagggcagccagctggccagtgagcgcctcaagagggccacgcgcaagggcacagtgctgcagccagtgctgcggcggaagaacggggccctgtccatcacgctggccacacgcaacgccaaggccatcctggggaagggccggaagctgagcaaggtgaagcacaaggccggcaagcagggcaagggccgggccgtgagccgcctgctggaaagcttcgccgtggaggaagactttgagttcgacgacaacagcagcttctcggaagaggaggaggacgaggaggaagaggaggaggacagcggccctctgagcgcagagcagagcgccgccctagcgcgctcgtgtgccatccacaaggaggacctgcgggacgggctgcccgtgctcatccccagcatcgtcntnnaggncgagagggcaccggcagaggatctactcantgnancagctgctgcaggaagcgttctcgatgtgcggccacagtccagccggtacctcccgcccggcacgcgggtctgcgcctactggagtcagaagtctcgatgtctgtacccgggcaacgtggtccggggggcctccggtgacgaagatgaggacctggactcagtagtggtggaatttgacgatggggatacaggccacatcgccgtctccaacgtcaggctgctgccccctgacttcaagatccagtgcacagagccctctccagccctgctagtgtctagcagctgccggaggaccaagaaggtatccagtgaggcacccccgcctagtgaagccgccacccccagcctgtcccccaaagcacaggacggccccgaagctttgaagacacctgggaaaaaatccattagcaaagacaaagctggtaaagccgaactcctaacctcaggtgccaaatcccccacgggggcctccgaccacttcctgggccgccgtggcagccccttgctgagctggtccgcggtggcgcagaccaagcggaaggcggtggcagcggccagcaaggggccgggggtgctgcagaacctcttccagctcaacggcagcagcaagaagctgcgggcccgcgaggccctgttccccgtgcacagcgtggccacacccatatttggcaacggcttccgcgccgactccttcagcagcctggccagctcctacgcgccctccagcctctgctcctccgacaacgaggactcgtcctacagctcagacgacgaggacccggctctgctgctgcagacctgcctcacccaccccgtgcccaccctcctggcccagcccgaggccctgcgctccaagggcagcggccctcacgcgcatgcccagcgctgcttcctgtccagggccacggtggctggcaccggtgcgggctcaggccccagcagcagcagcaaatccaagctcaagcgcaaagaggccctgagcttctccaaagccaaagagctctcccggaggcagcggccgccctccgtggaaaaccggccaaagatctcagccttcctgcccgcccggcagctctggaagtggtcggggaatcccacacagcggcgtggcatgaaggggaaggcccggaagctgttctacaaggccatcgtgcggggcgaggagaccctgcgtgtcggggactgtgccgtcttcctgtcagctgggcggcccaacctcccctacatcggccgcatcgagagcatgtgggagtcgtggggcagcaacatggtggtcaaggtcaagtggttctaccaccctgaggagaccaagctgggcaagaggcagtgcgacggcaagaatgcgctgtaccagtcctgccacgaggatgagaacgacgtgcagaccatctcccacaagtgccaggtcgtggcgcgcgagcagtatgagcagatggcccggagccgcaagtgccaggaccggcaggacctctactacctggcgggcacctacgaccccaccaccgggcgcctggtgacggctgatggcgtgcccatcctatgctgagccgccaccgcagatgcctcccacgtgcgccagggaccctgtgtgcggagcctggcgtcggccaagccaccgggcaggaggcagccccggcctcccaagggcgcatctgagcaaatatgcaaaagcccacagggcaagacccaggctttcttacggttttccctggaaagagcgctccaggtgtcggaatccagtcccgtcccatcctctgcggagggtcgggctgtggccctcatgggtccccggcccgcccacccacagcgccctccgtttcccgcaccggcagttcacgggagatttgaatccaagccatattccctagtacctccgactgtctcccaccagggaaagcagaaatcaggtgtgttgtctatttatttctctatgtaaatattgtatttctgcggggaaattttatggtaaaaagtggaaaagggtttttccccatccgcgtgacaaggtgtgtgtgagcgtgtatgtgtgtgcgcgtgtgtggcgatttttgtcctggggtttcctttggaaatgcactgttctcagcccagctgggttccaacgggggcacctgggacgacagaggcatctcggggcagggggcagaggccacgggagggtcaggtgggacccttgacggcaccctctgatctcttggggggacgaccgtgtaagatgaaagtcggtcaagtttatttgctttcagtgcatctcctagaaaagaagtgttggagcagggggtggtgatgaggggcccgtggggaaaggattcaagaggcaaagcccagaccagggagtgtgacaacagccgtgagcatctcacctgtgttcaaaacaagacaaagacgaacaaatattttaaagtattgataagaaaaagcaatgtttggattgtatctgctgaatcatattccaacctatatctgatttctgtttccggggccagttggtctgaggccaaggagtctggcctccacccagagcagggaggggctggcccctcgcccccctcaccctcgccgccctggcacactcgggaagcagggcccagctctgagcccctcctcacccctggggtcctaactttcctgaaagtagtaggtgccgtgagaaggggcagtttggccaggttcctgaactgggcagggctcggggcctatgagggcaggttcacagtcccaccagattctctcctcacccccaagcagaatgcatgcaaaagacaccccttttcccacccaccttattggtgcccccaaacccctggcctgctgcgtagatggtggtgaggccaggccagcagtgctgtggccaggggagaagaaaataaaacgcaggccctgcccttggggaaggcccctttctgggcccccttttccaccagccaaatctgcctggccctcggacccctctgcctgccccaacccctttggaggtttctcggccttttctgtgccacttggtggggcagatggcctgatgggctagtgcttggggcatagaatgagggtccccctgaccacctgagcccaaatcctggccccaggtgcaagcagcacccctcgagggctctgccccagtatccccagagaattcacacccctccccttctcccacagccaaggacagacaggctgcctggacctgagcccaacagccttcagcctcagaaacgcatggggggccacacactccttatatcctcccacactaaggttcccctggccccacgggagcttcaggaaagccccccaagttagccactgctctaggacgagctctgtgtcccccacaccacaggcctcgaagcagggtgctggtgggtgccctgcaccccaatcccaggtccccttggccccctatttttctcgggcccattggggcctgtttctcacctgctggctggaccccctgaagggccgttcccagaggctccccaggaggctcaaggctgggggcttatgttgtggtcgggggtccccgcctccagccccccgctcccacccccgagcctaccctttgtctcgcatgagtgcaatatttcattcccggtggttgtctggggaggtggttggacgaggtcctgcttgaggctcggggatcagaacgatgtcaagtgaagaaaaatgcacgggggcatgctgagccactggagttccagagagggccgaggagggtgcagccacggaggttggatcctctgctccgccgcctcgtcctcgtcccgcttctgctgggttccgctttgtccctggttttttcctttttttttctgtgtgcgtgcgaatggtgcggcccctcccctctcaccgtggttaacgtgacgaaggcacgattcctgtaaatgtgtaaactaaggggatggttggattttttttcaatgtaaacactaaaaacaaaatggacaaaaaaacacacaaaggttttatgaacagcagactctatgtaaaggcattttagtatcaaattttttattgataacttgcttaagaataaatatatggactattgtacaggt

SEQ ID NO: 111737 - DNA, 8930 bp, Homo sapiens
  misc_feature (118)..(118): n is a, c, g, or t
  misc_feature (1860)..(1860): n is a, c, g, or t
  misc_feature (1916)..(1916): n is a, c, g, or t
  misc_feature (2071)..(2071): n is a, c, g, or t
  misc_feature (3597)..(3597): n is a, c, g, or t
  misc_feature (3599)..(3600): n is a, c, g, or t
  misc_feature (3604)..(3604): n is a, c, g, or t
  misc_feature (3634)..(3634): n is a, c, g, or t
  misc_feature (3637)..(3637): n is a, c, g, or t
  misc_feature (3639)..(3639): n is a, c, g, or t
  misc_feature (4421)..(4421): n is a, c, g, or t
gttccacacacgcgctggacctggaggctgaggaggagaggacgaggctatgtgatgaccgcctggggcttgccagccgcgagctgctgctgcaggacagcaaagaccgcgtagagtncgcccggatccacccaccgagcagctgccctggggacctggccccccacctcatgatgcagagcggccagctgggcggggacccagccccccacacccacccccatcccccctggctgccccgcacccgcagcccctccctgtggatgggggggcactcctacggcctggggcaccctgccctgcaccagaacctgccccccggcttccccgcctccgtggctggccctgtgccctctgtcttccccctcccacaggacgcccccacacagctggtcatcctgccctcagagcccacaccccacagcgccccccacgcacttgcggatgtcatggaccaggcgtcactgtggccccccatgtacgggggccggggccccgcctctcacatgcagcacccgggccagctccctgtgtactcgaggccgcagctcctccggcagcaggagctctatgctttgcagcagcagagggccgcccagttccagcggaagcccgaagaccagcacctggatctggaggagcccgcccaggagaaggccccaaagtccacccacaagccagttgccttaacccccacggccccgggcgccccctcacccgctgcaggccccaccaagctgccaccttgctgccatccgcccgacccaaagccccccgccagctcccccaccccaccacctcggcccagcgccccgtgcactttaaatgtctgccctgccagcagccccgggcctggctcccgggtgcgcagcgccgaggaaaagaatggggagggtcagcagtccacggccgacatcatcacatccgaaccagtggcacgtgctcactctgttgcccacgctggtctcgaattcctggcctcaaatgatccatccacctcagcctcccaaagttttgggattacagacctgcctcccggatacctgcgccccatggctggcctgggcttctccctaccctcagacgtgcactcttctaacctcgaggaccctgaaactatgcaaaccaccgccccgggggcccagcctgagcccacaaggacattcctgcctggggagccgcctccctgcagccccaggagcctggaggagcccgggctgctctcaggggccagggaggccacccaggaccttgccgccaccccctaccctgccgagcggggaccccaggggaaggcagcggaccccagcccactagaggggctacaagaactgcaatgtgcggccctcctggaggcagggggccccgaggccaccggccaggctcattctactcagggaggggcacgagaagagaggagcagggaggagggggagcaggggccctcgtcaggggcctcctcccaagtcctggagcagcgagcagggagtccgggtgcccttgaggacgagggggagcagccggcccctgaggaggacgagctggaggaagacgagctggggcagcagagcatggaggactcagaggaggactgtggcggagctcccgacaacagccacccacccagggcgctaccaggcctggatgccttggtggccgccaccatcaacctgggggacctgcccagcgacagcccaccggaccctcagcccccagcggcctctgggccccccagcacagtccccctgcctcatagctcagggattcatgggatcgctctgctcagcgagctggctgacctggcaatccagcggcagaggagtgagaggactgtgccagaggaggaagaggacgtgctanccttcaacctgcagcacctggccacgctggccacagcctggtccctggtggaggcngctggcctggacagctccactgccccagcgcagccgcccacagccaacccctgcagcggccccaggctcaccccccgcatgcagatcctgcagcgcaaggacacctggacccccaagaccaagcctgtgtgccccctgaaggccgccatcgaccngctggacacgcaggaggtggggatgcgcgtgcggctggcggagctgcagcggcgctacaaggagaagcagcgggagctggcccgcctgcagcgcaagcacgaccatgagagagacgagagttcacggagccctgcacggcgggggcctggccggccgaggaagcgcaaacactcaagctcgctgcctgccccacgtcccacggggccgctccccaggagcgatggcaagaaagtcaaggcggtgcggacaagcctgggtctgctgtgtgcggagctgcgaggaggcagtgggggcgagcctgcgaagaagcgaagcaagctggagaggagcgtctatgcgggcctgcagactgcctccgtggagaaggcgcagtgtaagaagagcagctgtcagggcgggctggcgccctccgtggcccacagggtggcccagctgaaacccaaggtcaagagcaaagggctgcccacaggcctcagctctttccagcagaaggaggctacccccggggggcgcatccgggagaagctgtcccgagccaagagtgccaaggtgtctggggccacacggcacccacagcccaagggccacggcagccgggagacacccaggtgcccagcccagccctccgtggctgcgtcccaggaggcaggcagtggctatgacagtgaggactgcgagggtctcctggggacagaggcaccacccagggaagcagggctgctgctgcacgccggggccagtgtggccgtgctggggccctcaccctcctctgtggtcaagatggaggccaaccagaaggccaagaagaagaaggagaggcaggggttgctaggggcctgccgcctgtccagccctgagagtgaggtcaagatcaagaggcggtcggtgaaggccaaggtgggcaccaccctggagcgggccccagggcagaggcccccaggtgcgctgggcaagaagaaagccaagggcaaggccaagggcagcctgcgggcagagccgggggccacccccagcagggacgccctcttcaacccctctcgggccttcgcctgccgtgaggagggcagccagctggccagtgagcgcctcaagagggccacgcgcaagggcacagtgctgcagccagtgctgcggcggaagaacggggccctgtccatcacgctggccacacgcaacgccaaggccatcctggggaagggccggaagctgagcaaggtgaagcacaaggccggcaagcagggcaagggccgggccgtgagccgcctgctggaaagcttcgccgtggaggaagactttgagttcgacgacaacagcagcttctcggaagaggaggaggacgaggaggaagaggaggaggacagcggccctctgagcgcagagcagagcgccgccctagcgcgctcgtgtgccatccacaaggaggacctgcgggacgggctgcccgtgctcatccccaaggaggatagcctgctgtacgcgggcagcgtcaggaccctgcagccacccgacatctatagcatcgtcntnnaggncgagagggcaccggcagaggatctactcantgnancagctgctgcaggaagcgttctcgatgtgcggccacagtccagccggtacctcccgcccggcacgcgggtctgcgcctactggagtcagaagtctcgatgtctgtacccgggcaacgtggtccggggggcctccggtgacgaagatgaggacctggactcagtagtggtggaatttgacgatggggatacaggccacatcgccgtctccaacgtcaggctgctgccccctgacttcaagatccagtgcacagagccctctccagccctgctagtgtctagcagctgccggaggaccaagaaggtatccagtgaggcacccccgcctagtgaagccgccacccccagcctgtcccccaaagcacaggacggccccgaagctttgaagacacctgggaaaaaatccattagcaaagacaaagctggtaaagccgaactcctaacctcaggtgccaaatcccccacgggggcctccgaccacttcctgggccgccgtggcagccccttgctgagctggtccgcggtggcgcagaccaagcggaaggcggtggcagcggccagcaaggggccgggggtgctgcagaacctcttccagctcaacggcagcagcaagaagctgcgggcccgcgaggccctgttccccgtgcacagcgtggccacacccatatttggcaacggcttccgcgccgactccttcagcagcctggccagctcctacgcgcccttcgtcggggggaccgggccgggcctccccaggggagcccacaagctgctgcgggctaanaaggccgagagggtggaggccgagaagggtgggcggcggcgggcgggcggtgagttcctggtcaagctggaccacgagggtgtgacctcccccaagaacaagacctgcaaggcgttgctcatgggggacaaggacttcagccccaagctcgggcggcccctgcccagccccagctatgtgcacccggcccttgtgggcaaggacaagaaggggcgggcacccatccccccgctgcccatggggctggcgctgcgcaagtacgcgggccaggcagagttcccgctgccctacgacagcgactgccacagctccttctcggacgaggacgaggacgggccggggctggcggccggcgtgccctcccgcttcctcgcccgcctgtccgtgtcctcttcctcctctggctcgtccacctcctcctcctcaggctccgtgtccacctccagcctctgctcctccgacaacgaggactcgtcctacagctcagacgacgaggacccggctctgctgctgcagacctgcctcacccaccccgtgcccaccctcctggcccagcccgaggccctgcgctccaagggcagcggccctcacgcgcatgcccagcgctgcttcctgtccagggccacggtggctggcaccggtgcgggctcaggccccagcagcagcagcaaatccaagctcaagcgcaaagaggccctgagcttctccaaagccaaagagctctcccggaggcagcggccgccctccgtggaaaaccggccaaagatctcagccttcctgcccgcccggcagctctggaagtggtcggggaatcccacacagcggcgtggcatgaaggggaaggcccggaagctgttctacaaggccatcgtgcggggcgaggagaccctgcgtgtcggggactgtgccgtcttcctgtcagctgggcggcccaacctcccctacatcggccgcatcgagagcatgtgggagtcgtggggcagcaacatggtggtcaaggtcaagtggttctaccaccctgaggagaccaagctgggcaagaggcagtgcgacggcaagaatgcgctgtaccagtcctgccacgaggatgagaacgacgtgcagaccatctcccacaagtgccaggtcgtggcgcgcgagcagtatgagcagatggcccggagccgcaagtgccaggaccggcaggacctctactacctggcgggcacctacgaccccaccaccgggcgcctggtgacggctgatggcgtgcccatcctatgctgagccgccaccgcagatgcctcccacgtgcgccagggaccctgtgtgcggagcctggcgtcggccaagccaccgggcaggaggcagccccggcctcccaagggcgcatctgagcaaatatgcaaaagcccacagggcaagacccaggctttcttacggttttccctggaaagagcgctccaggtgtcggaatccagtcccgtcccatcctctgcggagggtcgggctgtggccctcatgggtccccggcccgcccacccacagcgccctccgtttcccgcaccggcagttcacgggagatttgaatccaagccatattccctagtacctccgactgtctcccaccagggaaagcagaaatcaggtgtgttgtctatttatttctctatgtaaatattgtatttctgcggggaaattttatggtaaaaagtggaaaagggtttttccccatccgcgtgacaaggtgtgtgtgagcgtgtatgtgtgtgcgcgtgtgtggcgatttttgtcctggggtttcctttggaaatgcactgttctcagcccagctgggttccaacgggggcacctgggacgacagaggcatctcggggcagggggcagaggccacgggagggtcaggtgggacccttgacggcaccctctgatctcttggggggacgaccgtgtaagatgaaagtcggtcaagtttatttgctttcagtgcatctcctagaaaagaagtgttggagcagggggtggtgatgaggggcccgtggggaaaggattcaagaggcaaagcccagaccagggagtgtgacaacagccgtgagcatctcacctgtgttcaaaacaagacaaagacgaacaaatattttaaagtattgataagaaaaagcaatgtttggattgtatctgctgaatcatattccaacctatatctgatttctgtttccggggccagttggtctgaggccaaggagtctggcctccacccagagcagggaggggctggcccctcgcccccctcaccctcgccgccctggcacactcgggaagcagggcccagctctgagcccctcctcacccctggggtcctaactttcctgaaagtagtaggtgccgtgagaaggggcagtttggccaggttcctgaactgggcagggctcggggcctatgagggcaggttcacagtcccaccagattctctcctcacccccaagcagaatgcatgcaaaagacaccccttttcccacccaccttattggtgcccccaaacccctggcctgctgcgtagatggtggtgaggccaggccagcagtgctgtggccaggggagaagaaaataaaacgcaggccctgcccttggggaaggcccctttctgggcccccttttccaccagccaaatctgcctggccctcggacccctctgcctgccccaacccctttggaggtttctcggccttttctgtgccacttggtggggcagatggcctgatgggctagtgcttggggcatagaatgagggtccccctgaccacctgagcccaaatcctggccccaggtgcaagcagcacccctcgagggctctgccccagtatccccagagaattcacacccctccccttctcccacagccaaggacagacaggctgcctggacctgagcccaacagccttcagcctcagaaacgcatggggggccacacactccttatatcctcccacactaaggttcccctggccccacgggagcttcaggaaagccccccaagttagccactgctctaggacgagctctgtgtcccccacaccacaggcctcgaagcagggtgctggtgggtgccctgcaccccaatcccaggtccccttggccccctatttttctcgggcccattggggcctgtttctcacctgctggctggaccccctgaagggccgttcccagaggctccccaggaggctcaaggctgggggcttatgttgtggtcgggggtccccgcctccagccccccgctcccacccccgagcctaccctttgtctcgcatgagtgcaatatttcattcccggtggttgtctggggaggtggttggacgaggtcctgcttgaggctcggggatcagaacgatgtcaagtgaagaaaaatgcacgggggcatgctgagccactggagttccagagagggccgaggagggtgcagccacggaggttggatcctctgctccgccgcctcgtcctcgtcccgcttctgctgggttccgctttgtccctggttttttcctttttttttctgtgtgcgtgcgaatggtgcggcccctcccctctcaccgtggttaacgtgacgaaggcacgattcctgtaaatgtgtaaactaaggggatggttggattttttttcaatgtaaacactaaaaacaaaatggacaaaaaaacacacaaaggttttatgaacagcagactctatgtaaaggcattttagtatcaaattttttattgataacttgcttaagaataaatatatggactattgtacaggtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaagaagaaacaacgaccaacgcaggagatgaaccataaaaacacaaaccaaaatacaagacagacaaagaagaaaagtagagaaaagaatgaaataaatgagagagagcgaagaaatcaaaaaacagagcacaaaaacttgaaaacagaaagaggaatgcaaaacgattgcgctgagaacaacacacagacaagcatagagaaagacagcaagcatgaaagcaagcaccaaacacgccgacaggaaacgagacactaaggaaaacagaaagagccaaaaacagagagcaagacgagaagacaaacaggagaacgtgaagaggatttgaaaccaacatcactaatcagagcaagagaaagaggagaggacagaaaacggaagaaaaaaattacaaatgagaaagaagaaaggcaaagagagtaaagcgacagcaacagagaagcagagaagagcagagaggagagagaaaagacagagagagaaagaagaagaagacaagagagagacaagataagagaagaaagcggaagcgggaagagcgatagaaggaaaggtgagagtgagagaaaggacaacaatatataaagaaggcaccgaagcaacgcagaaca

SEQ ID NO: 111738 - DNA, 6895 bp, Homo sapiens
  misc_feature (118)..(118): n is a, c, g, or t
  misc_feature (1860)..(1860): n is a, c, g, or t
  misc_feature (1916)..(1916): n is a, c, g, or t
  misc_feature (2071)..(2071): n is a, c, g, or t
  misc_feature (3597)..(3597): n is a, c, g, or t
  misc_feature (3599)..(3600): n is a, c, g, or t
  misc_feature (3604)..(3604): n is a, c, g, or t
  misc_feature (3634)..(3634): n is a, c, g, or t
  misc_feature (3637)..(3637): n is a, c, g, or t
  misc_feature (3639)..(3639): n is a, c, g, or t
  misc_feature (4421)..(4421): n is a, c, g, or t
gttccacacacgcgctggacctggaggctgaggaggagaggacgaggctatgtgatgaccgcctggggcttgccagccgcgagctgctgctgcaggacagcaaagaccgcgtagagtncgcccggatccacccaccgagcagctgccctggggacctggccccccacctcatgatgcagagcggccagctgggcggggacccagccccccacacccacccccatcccccctggctgccccgcacccgcagcccctccctgtggatgggggggcactcctacggcctggggcaccctgccctgcaccagaacctgccccccggcttccccgcctccgtggctggccctgtgccctctgtcttccccctcccacaggacgcccccacacagctggtcatcctgccctcagagcccacaccccacagcgccccccacgcacttgcggatgtcatggaccaggcgtcactgtggccccccatgtacgggggccggggccccgcctctcacatgcagcacccgggccagctccctgtgtactcgaggccgcagctcctccggcagcaggagctctatgctttgcagcagcagagggccgcccagttccagcggaagcccgaagaccagcacctggatctggaggagcccgcccaggagaaggccccaaagtccacccacaagccagttgccttaacccccacggccccgggcgccccctcacccgctgcaggccccaccaagctgccaccttgctgccatccgcccgacccaaagccccccgccagctcccccaccccaccacctcggcccagcgccccgtgcactttaaatgtctgccctgccagcagccccgggcctggctcccgggtgcgcagcgccgaggaaaagaatggggagggtcagcagtccacggccgacatcatcacatccgaaccagtggcacgtgctcactctgttgcccacgctggtctcgaattcctggcctcaaatgatccatccacctcagcctcccaaagttttgggattacagacctgcctcccggatacctgcgccccatggctggcctgggcttctccctaccctcagacgtgcactcttctaacctcgaggaccctgaaactatgcaaaccaccgccccgggggcccagcctgagcccacaaggacattcctgcctggggagccgcctccctgcagccccaggagcctggaggagcccgggctgctctcaggggccagggaggccacccaggaccttgccgccaccccctaccctgccgagcggggaccccaggggaaggcagcggaccccagcccactagaggggctacaagaactgcaatgtgcggccctcctggaggcagggggccccgaggccaccggccaggctcattctactcagggaggggcacgagaagagaggagcagggaggagggggagcaggggccctcgtcaggggcctcctcccaagtcctggagcagcgagcagggagtccgggtgcccttgaggacgagggggagcagccggcccctgaggaggacgagctggaggaagacgagctggggcagcagagcatggaggactcagaggaggactgtggcggagctcccgacaacagccacccacccagggcgctaccaggcctggatgccttggtggccgccaccatcaacctgggggacctgcccagcgacagcccaccggaccctcagcccccagcggcctctgggccccccagcacagtccccctgcctcatagctcagggattcatgggatcgctctgctcagcgagctggctgacctggcaatccagcggcagaggagtgagaggactgtgccagaggaggaagaggacgtgctanccttcaacctgcagcacctggccacgctggccacagcctggtccctggtggaggcngctggcctggacagctccactgccccagcgcagccgcccacagccaacccctgcagcggccccaggctcaccccccgcatgcagatcctgcagcgcaaggacacctggacccccaagaccaagcctgtgtgccccctgaaggccgccatcgaccngctggacacgcaggaggtggggatgcgcgtgcggctggcggagctgcagcggcgctacaaggagaagcagcgggagctggcccgcctgcagcgcaagcacgaccatgagagagacgagagttcacggagccctgcacggcgggggcctggccggccgaggaagcgcaaacactcaagctcgctgcctgccccacgtcccacggggccgctccccaggagcgatggcaagaaagtcaaggcggtgcggacaagcctgggtctgctgtgtgcggagctgcgaggaggcagtgggggcgagcctgcgaagaagcgaagcaagctggagaggagcgtctatgcgggcctgcagactgcctccgtggagaaggcgcagtgtaagaagagcagctgtcagggcgggctggcgccctccgtggcccacagggtggcccagctgaaacccaaggtcaagagcaaagggctgcccacaggcctcagctctttccagcagaaggaggctacccccggggggcgcatccgggagaagctgtcccgagccaagagtgccaaggtgtctggggccacacggcacccacagcccaagggccacggcagccgggagacacccaggtgcccagcccagccctccgtggctgcgtcccaggaggcaggcagtggctatgacagtgaggactgcgagggtctcctggggacagaggcaccacccagggaagcagggctgctgctgcacgccggggccagtgtggccgtgctggggccctcaccctcctctgtggtcaagatggaggccaaccagaaggccaagaagaagaaggagaggcaggggttgctaggggcctgccgcctgtccagccctgagagtgaggtcaagatcaagaggcggtcggtgaaggccaaggtgggcaccaccctggagcgggccccagggcagaggcccccaggtgcgctgggcaagaagaaagccaagggcaaggccaagggcagcctgcgggcagagccgggggccacccccagcagggacgccctcttcaacccctctcgggccttcgcctgccgtgaggagggcagccagctggccagtgagcgcctcaagagggccacgcgcaagggcacagtgctgcagccagtgctgcggcggaagaacggggccctgtccatcacgctggccacacgcaacgccaaggccatcctggggaagggccggaagctgagcaaggtgaagcacaaggccggcaagcagggcaagggccgggccgtgagccgcctgctggaaagcttcgccgtggaggaagactttgagttcgacgacaacagcagcttctcggaagaggaggaggacgaggaggaagaggaggaggacagcggccctctgagcgcagagcagagcgccgccctagcgcgctcgtgtgccatccacaaggaggacctgcgggacgggctgcccgtgctcatccccaaggaggatagcctgctgtacgcgggcagcgtcaggaccctgcagccacccgacatctatagcatcgtcntnnaggncgagagggcaccggcagaggatctactcantgnancagctgctgcaggaagcgttctcgatgtgcggccacagtccagccggtacctcccgcccggcacgcgggtctgcgcctactggagtcagaagtctcgatgtctgtacccgggcaacgtggtccggggggcctccggtgacgaagatgaggacctggactcagtagtggtggaatttgacgatggggatacaggccacatcgccgtctccaacgtcaggctgctgccccctgacttcaagatccagtgcacagagccctctccagccctgctagtgtctagcagctgccggaggaccaagaaggtatccagtgaggcacccccgcctagtgaagccgccacccccagcctgtcccccaaagcacaggacggccccgaagctttgaagacacctgggaaaaaatccattagcaaagacaaagctggtaaagccgaactcctaacctcaggtgccaaatcccccacgggggcctccgaccacttcctgggccgccgtggcagccccttgctgagctggtccgcggtggcgcagaccaagcggaaggcggtggcagcggccagcaaggggccgggggtgctgcagaacctcttccagctcaacggcagcagcaagaagctgcgggcccgcgaggccctgttccccgtgcacagcgtggccacacccatatttggcaacggcttccgcgccgactccttcagcagcctggccagctcctacgcgcccttcgtcggggggaccgggccgggcctccccaggggagcccacaagctgctgcgggctaanaaggccgagagggtggaggccgagaagggtgggcggcggcgggcgggcggtgagttcctggtcaagctggaccacgagggtgtgacctcccccaagaacaagacctgcaaggcgttgctcatgggggacaaggacttcagccccaagctcgggcggcccctgcccagccccagctatgtgcacccggcccttgtgggcaaggacaagaaggggcgggcacccatccccccgctgcccatggggctggcgctgcgcaagtacgcgggccaggcagagttcccgctgccctacgacagcgactgccacagctccttctcggacgaggacgaggacgggccggggctggcggccggcgtgccctcccgcttcctcgcccgcctgtccgtgtcctcttcctcctctggctcgtccacctcctcctcctcaggctccgtgtccacctccagcctctgctcctccgacaacgaggactcgtcctacagctcagacgacgaggacccggctctgctgctgcagacctgcctcacccaccccgtgcccaccctcctggcccagcccgaggccctgcgctccaagggcagcggccctcacgcgcatgcccagcgctgcttcctgtccagggccacggtggctggcaccggtgcgggctcaggccccagcagcagcagcaaatccaagctcaagcgcaaagaggccctgagcttctccaaagccaaagagctctcccggaggcagcggccgccctccgtggaaaaccggccaaagatctcagccttcctgcccgcccggcagctctggaagtggtcggggaatcccacacagcggcgtggcatgaaggggaaggcccggaagctgttctacaaggccatcgtgcggggcgaggagaccctgcgtgtcggggactgtgccgtcttcctgtcagctgggcggcccaacctcccctacatcggccgcatcgagagcatgtgggagtcgtggggcagcaacatggtggtcaaggtcaagtggttctaccaccctgaggagaccaagctgggcaagaggcagtgcgacggcaagaatgcgctgtaccagtcctgccacgaggatgagaacgacgtgcagaccatctcccacaagtgccaggtcgtggcgcgcgagcagtatgagcagatggcccggagccgcaagtgccaggaccggcaggacctctactacctggcgggcacctacgaccccaccaccgggcgcctggtgacggctgatggcgtgcccatcctatgctgagccgccaccgcagatgcctcccacgtgcgccagggaccctgtgtgcggagcctggcgtcggccaagccaccgggcaggaggcagccccggcctcccaagggcgcatctgagcaaatatgcaaaagcccacagggcaagacccaggctttcttacggttttccctggaaagagcgctccaggtgtcggaatccagtcccgtcccatcctctgcggagggtcgggctgtggccctcatgggtccccggcccgcccacccacagcgccctccgtttcccgcaccggcagttcacgggagatttgaatccaagccatattccctagtacctccgactgtctcccaccagggaaagcagaaatcaggtgtgttgtctatttatttctctatgtaaatattgtatttctgcggggaaattttatggtaaaaagtggaaaagggtttttccccatccgcgtgacaaggtgtgtgtgagcgtgtatgtgtgtgcgcgtgtgtggcgatttttgtcctggggtttcctttggaaatgcactgttctcagcccagctgggttccaacgggggcacctgggacgacagaggcatctcggggcagggggcagaggccacgggagggtcaggtgggacccttgacggcaccctctgatctcttggggggacgaccgtgtaagatgaaagtcggtcaagtttatttgctttcagtgcatctcctagaaaagaagtgttggagcagggggtggtgatgaggggcccgtggggaaaggattcaagaggcaaagcccagaccagggagtgtgacaacagccgtgagcatctcacctgtgttcaaaacaagacaaagacgaacaaatattttaaagtattgataagaaaaagcaatgtttggattgtatctgctgaatcatattccaacctatatctgatttctggttccgctttgtccctggttttttcctttttttttctgtgtgcgtgcgaatggtgcggcccctcccctctcaccgtggttaacgtgacgaaggcacgattcctgtaaatgtgtaaactaaggggatggttggattttttttcaatgtaaacactaaaaacaaaatggacaaaaaaacacacaaaggttttatgaacagcagactctatgtaaaggcattttagtatcaaattttttattgataacttgcttaagaataaatatatggactattgtacaggt

SEQ ID NO: 111739 - DNA, 540 bp, Homo sapiens
cggcacgagctcatcagtaacatggggagagtggtatcaaccactaagaggattaaatgagtgaatatttgtaaaacacgtagcctagaatagatatttataaagcacaagatctatgtaaagtgtttataacataatacattggaatatgagacttgaacattttgaagattctaataaatgaataatttaatttagtgctcatttgaaaaatattttatcctcatgtttacatttaacacatataatttatatcttagtttttatcccatttatatatatatttaccagaaaaatgttttgtaataccttaattttatgtggagttgaatttaaataattaggccgaatttgtatgtattgttggatgggtatgtgtattgacctgatttataaaataaagtatttattaaactgagttttgcacttccaggtagagtcacatttaagataatcctttgaaatattttagcttttgaaagtagattaagcaagataaataaaatgtatatacgtcattaaaaatacttaaaatgcttt

SEQ ID NO: 111740 - DNA, 445 bp, Homo sapiens
aaagagccagaggaaaaaaatggaactttttctcaagggacttgacttagtggatagctaaatgtccagtttcaaaagcttatccttttgaaatgcttttatacttataaaagcccaaagaaaccttaatatgggccacataactataatgtaatttttccaaggtaggaaaggcagtaatactgtactattagaatatatggattttcataagagcagctgttgtttcactaaggtttacattattttaggtcctagttttctgtttggaggtgtattaatgagttccttggttaatttattcccattctctatatttctgattcttaattgtatgatgtggtttatattcattgttttgacgtgataggaatgccaacaatgtgcctttggttttcttatgcttaaaaaataaaaaaataaataaacattaaatgtaaaatca

SEQ ID NO: 111741 - DNA, 323 bp, Homo sapiens
catcacaactgtcttgtggctcatggagactttcagattgatgcagtggctccaaggcgaagtgacctcaattgctgatgcaaaactagattctataagtgtaaactggtggttcacaaggacaggtgagaagtgctgatggtggcaagggaggcaattataacaatatccctccccttctaccccatcctccaccccacttgtgacagacatagacaaggacttaattgtggcacagaggaagggcaactgactcttgagaccagtgaatctgtagtcaaaacgcactgatcactgttgaataactactggaattatcaaga

SEQ ID NO: 111742 - DNA, 457 bp, Homo sapiens
tgcttaacaaggggcttctgtggctcaggcagctgagttggggaggggaagaacctgttgtctgatttaggcaacagccctccacacccctaccctgcaacctgcactgtccctaccagacccctgctgtgagcatgtgaaggggccaggaacatctgtggcccagaaccaggcaggatgaggagacattcctgtgtcagggtaaccctgggaggttcccatggcaacagccagccagtccagtgtgtgtccttgggcccagccggacgaggctgggagccactctcaaaaggagcaatgtgcctctgaccttccagaagccaataggggtggtcaggctgggaagcgaagtgacccactaccacctatgacccacccaccccatctgtctccaccacctgtcaccccaggatgggtgtgaatgccaggcaatggggaaagcctggggcctagggga

SEQ ID NO: 111743 - DNA, 423 bp, Homo sapiens
gccagttcataaagactggaagaagtggctttttttgtcaagtgcacagatcccaacaaagctttcgagacgtagaagaaacagggaaacatggcccaaagaaaggagcaaaataaatcttcacaaaccaatcctaaagaaacaaagacatgaattacctgacaaagaattcaaaatagccctcataaagatgctgtatgagctcaaggtaacaatgcatgagcaaaatgagaatatcaacaaagagacagaaaatccaaaaaaaaaaaaaaaaaaaaaaagaagaaccaaccaattttggaactgaagaatacaatagctacactgaaaaattcacaataggggttcaacagcagactcagtcaagcagaagagagaaacagcaaactcaagacaagttatttgacattatccacccagagg

SEQ ID NO: 111744 - DNA, 325 bp, Homo sapiens
aaacagttaactacttagaggaagaaataacaccagggagagtaatatggtgtcagaaaaggaagatgactccaaaataatgataaaccacagctctaaaattttaatgtaacttaatgaaaactaattcaattgaagcgtgtttcagtttggtattagctctgaacctgggaaacttgagtcctggcattaggggaatctcttcattttatggaccctggtttcttcatctgtaaactcaggagattggaacagatgatctttaaggctcctttgaacctgtataatttcttgattcagtttcctgaagtaagatgtgcttttt

SEQ ID NO: 111745 - DNA, 476 bp, Homo sapiens
tccttgacccccaaaccacacccaaaggagcccacattttggaattctgcttctagggctgtgatggcacaggatccctctcctttgcccacagcttgagggcagcgtgaggacagtgtgagggagcaagcaccctcagaggtggcccctgccctcactcacaccgctggctgaaacgctggtatctctccatcggacaggatctgttcaacatcaatgctgttctccactggggcatcccgagagacctatataagggggcaactcacatccatctgtgatggcagcaaagtgtggcaagaacctaatgtgccttctgagtcatctttaaactatgcaaggtccctgcctgcaatcaatatattctaatactttagattaatactttctgattaatcaatctatgacaaacccctggatcctcaacaatggcatctaaaaaaaaaatgtagtgcaactggctgagcacagtgact

SEQ ID NO: 111746 - DNA, 1011 bp, Homo sapiens
atgacccaccaatcacatgcctatcatatagtaaagcccagcctatgtctaatagtacattttcagtcactagcttttttaagtacacctgcaatgtattcacttagaaccacaaaaaaagatacaaaaaaaaaagaggagaggatgaaagatggaggaaaaaaggaaagaggaaagaaatagtaaatgttctctgcctcttaaaaccatataatctataacaagaatagggtaaaagagacttaacagtaacaacagggcttaactatctttcatctcatcaattccaatgaaaaccattaccttaaaatttggccttcccgcacagtgggggggtccttcatcattggacttagcaccggtctgaagtcatagcataatcagtcacatgtcaccttaggtagtcaggacagacttccaattccttaaatccatctatccgggattgcaggtcgcacaagcattttccaacaaagagggataatcctagagaatcaatcatattttatgcataacgtaaacagtggaccacagtgacttattggccagttcgctagtgtgccctgttaacctaagttggtaagggcatttggagcacacatttctacttcgccccacattcaccaactgcggcagcaatctccagctggtcacactcgtctttaacctaattccgcaagaacggattctcccaccttcacatgttccacacaatgcacagagcatctgtgtgtactaactattctagaaaaactgttggcaaattaccaaaacaacctggtgggtctcactaaactggggacagatgagcccactatcggtgccccgcggacactataactttccccacgaggatggtttaaacgaccaagatcaaaaacacaacaaagacaacaagagaaacaacaacaacaagcgacaagagacacaacaacgaaagagcaaagaacagcagacgagaccacgaacagacacagacacacgacagcaaacaccaacaagactcagacc

SEQ ID NO: 111747 - DNA, 425 bp, Homo sapiens
agagagaacaggtagagcagaggctctcaggtgggcgggagcacacctgacatgatggggaaactacaaaaagacctgaatatctggagaagattgggcaagggcgagagtgttgggagctgaactcacagagctaaggtgtcgggaaggagaaagcagatcatttagggccttgcagaccattgccagggcactggctttaattttgggaaaaatgaagaattgctatgtgattttgaatgtagtagcagtgaagatgccgaaagatcaatggattgtggatgtattttgaaggtagagctagtggagcctgagaaagggtagtcaaggatgactcctagtttttttatctgagcaaattgcaagatgccagcccaggaaaggctgcagcagggacaggtttaagggagaagatcaggagttcg

SEQ ID NO: 111748 - DNA, 177 bp, Homo sapiens
gtctggggcattgtctggtcttatctgatggccagtatcattcttgatgctttctcttccctggctcctacctctctgtctttcctcatagatcagctgtgtctttttattgatccttagcttccaccctggttaatcagtgctcccaacaattccgagcttcccaagatcccttta

SEQ ID NO: 111749 - DNA, 367 bp, Homo sapiens
tcaccaagtatagctgactatctccataacatctctccagttgtggccttagttccagccttcatcactctgcattctgaggagctgttatctgtctcctgctgccagcccctcacccccagtcggtctccaacatactttttttttttttttttttgagatggagtcttgctctgtcacccaggctggagtgcagtggtgcgatctcagctcactgcaacctctgcctccagggctcaatagattctcgtgcctcagcctctcgagtagctgggattacaggcgtgcaccaccacacctggctaatttttgcatttttagttgagatgaagttttgccatgttgatcaggctggtctcaaactcct

SEQ ID NO: 111750 - DNA, 632 bp, Homo sapiens
ggccaaatcactcttctcaaagaccctcctttctccttaatgaaataatgactattcttggtcttggatgtttatgatctggccccaagcaactttttttgtagtcacatgtcatgatagtcctccttatgcttgttttccaagtatttctttcccactcttattttctatcttagctctctctagagccttaagaacattcctcaagaaagggaaaagtgaggtgaggtgcagggcagaaaaagcagcaattattgtaaagtgaacctggaagggagagtttttcccaaagcaggaataagaaggttaaagccatgaaagcaatacctttcatgttccctcaaaacataactactttggtcagtaaaacatttttgtaagaaatttccttttcattctttgatgccacattaacttggatttactttctaaatgtctgttttttcagttgcctctttttggtagcggaaattgttagggatgattcaaccattctttaatcctgctgtgagcatagtttataaaagtatttttgtctaggaaattcagtgtgccagtaatttgataaaataggagaaaagggcccttgaaatgcttacattatttccacatggctcatttttactgatttg

SEQ ID NO: 111751 - DNA, 237 bp, Homo sapiens
cagaagtgcctggcatgtgtggcttgaatgaacaagggactgttttgccaacccattgtgcaagtattgagtccctgcttatggaggagggaaactgcagatcagagagccagtgactggcccgagctcgagggcggggctgggatctggcaaagcctcagtctctgacctcaaggctcaaatagactgtgggctcctctgcagcctcctcaatgcctggtccaggtctgggacccc

SEQ ID NO: 111752 - DNA, 260 bp, Homo sapiens
tggaaatagtctcccagttgaatttaacaccccttgtgactatacttttagtaatcttttttagctaattagctctttgctttgtcaagtatttattgagtgcccactctgtgtgcgagcatggtgttaagcacttaatataaaacagtgactataaagatgtgtgactcctgccttcatggggcatttaattcacacccccccaacaattttttaatagcgcttttgaaaacattgcataaagtcagatatatatatat

SEQ ID NO: 111753 - DNA, 255 bp, Homo sapiens
agtgtaatgctattgccacagtcttataattttttaaaaaaatgtatctttgaactgtgttttgtaagcaaagttggatggggcaatggaccacatgcatgaggagaagcactatgtgcaatgtgcatgccccaccattcctggccttcccactcacatatgatgtctcatgatcacagaattccagtggactcacaatgcatgggagttcagcaagactcaatatgagtaccaggtacatgtttcaccttagag

SEQ ID NO: 111754 - DNA, 672 bp, Homo sapiens
atcctgaagagacttaatgactaaatataatgtggtatcttgggtgggatctgggaagagaaatcactcctataatcccagcactttggaagtccgaggcggtggatcgcctgaggtcaggagtttgagaccagcctgaccaacatggtgaaaccccatctctagtagaaatacacaaaattggctgggcatggtggcggtgtaatcccagctactcgagaggctggggcgggagaattgcttgagcctgggaggcggaggttgcggtaggctgagattgtaccactgcactccagcctgtgtgacagagggagacttcgtctcaaaaaggaaggaaggaaggaaggaaaaaaaaaaaaaaaaaaaaaaaaaaaacttgttgtggggggccttgggcccttggaaaagtttttataaaccatttggggtgggggggggggccccagtagggaacagcgacacgggcactaaggcgggttcccaaaggggaaaactcgggcgcacagcgacaacggcgcgggagattccacgacagaataaaaaagaccgcccggggggggcaacacgaagggcgttcgagaacaaatcgcggacagggcgtcccagggggacaaacgggggactctacacaaggggggtgctcaagggcacgtccagaattacaaataaccg

SEQ ID NO: 111755 - DNA, 316 bp, Homo sapiens
ccaaaatgccaattttttgccagtttttcatgtacatttcctttttatattccctgtgtcactgcctcagcttagtttttaatcgtctccttcctagctcatagcattggttccttaattgtttaactggatgatgccagtgatactgttcttaatttcattctcttggtgaggttcttaacggtaaccattgtgtaccttgtttgtcctcataatgtttagctactctgatttgtgattctattctagttgacctcacattctattttgaaatagtttttaaaagaatcataaaaaattagggaacttagtattt

SEQ ID NO: 111756 - DNA, 1191 bp, Homo sapiens
ctgatctggtagggctgccagagcaaagtaccagcaagtaggtggcgaaagtaacagaaatttattttctcatggttctggaggctggaagtcccagtcagggtgtcagcagggttggttgcttctgggagatgtaaagagaggagttatccccggcctctctccttcgcttgtaggtgaccgtctcctcccaacgtgtcctcacgtcatcgtctctctgtgcatgtctatctctgtgtctgtttatatagtcagcagtcatattggattagggcccaccctaatgacgtcattttaacttgattacctctgtaaagaccctgtcactaaataaagtcacattctgaggcactggaagttaggatttcaacatataaattttgggaagaagtagtttggcctgtaacattaaggggcagagtaatcagagtgattcagaagtcaggtaaacagaaccagggtacacagatttctgaaaatgggaaaaggggagacagcctaagtaaaacatgaaacataataggctccatggcagctgcaggagtggagcagagcgaagaaaacagggctagcaagcatggggcactgggaaagatgcctctctcatattcatggtgtggtggaaccagtgtggcttcagtaaggcctatacatccctctgtctgtataactctatgaccctgagtcattaaagccattatatggacttaaattgtaatacaaggttgggagtctccaaacagaagagcttatttcctaaggaagcatctttcttcatggcctcctttaaaaacgggagatcgatcatgattggtttcagatggtcaatgcttggcagtatgacacagtctggacaacacccgagtaatccttcaatatatattatttagtgatcctatgagcattcagggcaatgaaaggagcgatttaatcttaacatgcgtgcacacacaaaagcacaaattaaaatgtctgtgacagacttccagttatattaatgatggaagaacctatcttagactaactctcctgcagatagctgttacaaactctggacaaaatacttttgttaaaaaaactattcatagtctaactaaaagaaggcagagaatgtaggaaatttgatccttgaaagagggtcatttgatccttgaaagagtgagaactatgtttatatagcttctcccatga

SEQ ID NO: 111757 - DNA, 849 bp, Homo sapiens
gagattatgttgatcttgcttaccttttaattttcagtgcctaaaacaatgcctggcacagtagcattccatacatttgattgaataaataaatttgtttcttcatcctttacatgttgtctttgccagtgttaccttttttattttttgagacagagtctcactctgttgccaggctggagtgcaatggtgcaatcttggctcactgcaacctctgcttcccaggttcaagctcttctcctgcctcggcctcccaagtagctggaattacaggcacctgccaccatacccagctaatttttgtatttatagtagagacagggtatcaccacattggccaggatggtctcgatctcctgaccttgtgatccaccttgcctcggtctcctaaagtgctgggattacaggcgtgagccactgtggctggcccagtattgcctttttattgtaagatatagaaaggtatttatttgttcatttataaaaaataagacatggtctctgatctcaaggaatttaaaatctggttaaaaagacaagatatatatgcatgaaaaattaaacactcttgatgatacaagaaaatgtgtatcgagtatcaaatgaatagtatggactgtgagtgctgtgagaatttaggagagaggatcatagtgggccaggacaggggaagaaagctttgttgcccatgtgggacctaaattgagtctcaagcgtgagtgggattaaaatagtcagatatgatgaaaggtattccttatagatttcaggtcatggggtagaaagtgtgagcaaagatggagacaactcagcttttttttggagttggggtaaaagctgaagaattca

SEQ ID NO: 111758 - DNA, 313 bp, Homo sapiens
tctttttttttgagacagggtgttgctctgttgcccaggctggagtgcagtggtgggatcaaagctcactcactgtagcttcaaacacctaagctcaagtgatcctcctgccttagcctcccaagttgctgggactacaagtgcccactactatgtctggctaattaaaaaaaaattttttttttaaagatggggtcttgctatattgatcaggctggtctcaaacgcctggcctcaggcgatccacctgcctcagcctcctgagttactgggattataagcaagagtcacgtcacccagcgtatttggtttc

SEQ ID NO: 111759 - DNA, 743 bp, Homo sapiens
ggctgactagtttttcctcctgaggaaagaggagaaatttgattgcaatgcatcgttggactttacaattttcttgacatctgtttctgcaaaagaatgtgtttaaagggtgttatattcttaaaagtgcctaggatggctacataaaatgtttagtaaaagcactgcctgtataaatacatgtaagacctttcagttacatactcagacatgtggagtaaacttgatactattaatagttttctttgactctttataggtgtcgattttgcttgagaatattgaaggtcttgacagaagttgtggatttcagttttaacaaatgtgttttaagtggaagagcattttcctggtcttgtccctccaatttgagaattagaaatgccatgtttatgattattcagctgtatttgttgctaacttgtaaagcaatacaaacattttttggtctgtttgactgaatttgtcccacaactcattgttgctctgttcatttttttccaggtttcttttttctttctgtgtttcattttggatagtttttattgctatgctatgttttcaatttgtctttttatttttggcagcatcctgtctggtatttaactaattcagtgaaattttcaatctcagacattttaaaaaacctttagaactaagttcaaattgagtctttaaaaatacgtttatgctttcctctactttcttgaacatataaaatatagttataatagcagattcaa

SEQ ID NO: 111760 - DNA, 332 bp, Homo sapiens
caacattgcacgaaggatccagtttccccacatccatgtcaatacttgttaaactttctttttttttttttaatttgccagtagcctcataatgagcgtgaggtagtatctcattgtagtgttaatttgcatttacctaacaattcgtgatgtggagcatcttttcatgggcttgttggctgctgtgtctcttctttggagaagtgtctgttgaagttgtttgacattttttaatcaagttgttggacaggttcccttgtttttaagtcagagtaggtgatgtttgtcttgaaggttataaaaagagaacatgtttgctatgacatgtagtt

SEQ ID NO: 111761 - DNA, 459 bp, Homo sapiens
ttgtttcctaagatgtgcttgtgaacagttgcctttgagaagttgaaaataaagaagcagatcagtttactcatatgtaattcaaacaaccagcaggggtatttatctggtgagctactttactgaaaagaattgaatgagttcagtttatgatacttaggttctgtttgtactttcactgagtagcagaacaacaacaacaacaacaacaaccacaacaaaaaaccctcctttttccttcctcctcttcctcctccatcccctgtaatggaataacattcgaatgccgacatcacaaacacagaggacccttcacttcttggcttgccactccctgcctgtcacatgccttctggtttgactggagtaatcctggtagaatccacgtagctctgaagagtgggtattctgaagagcgcaggttctttgaggggatgatacatgttcagttgctctgtt

SEQ ID NO: 111762 - DNA, 376 bp, Homo sapiens
ttcctctgaatgtaaccctttgcttttgaatttctgagtggtagatccattttaccatctccttacagtattagtacccataaagacattacctgtgattgagtctctttgatcaagggctgtaaacccatccaaggtgagaatgtaagggtgggaaaatccatttttctgtgacatcaggaccaaataactgcaaaggaaaggtgcccaaatatattaaatattgtcttagtgacttttactaaaaaacataactgtgagatggagttctgctcgagtactgtcaggcacttaatatattccaaataaatatggctggagttagattgactgaacttattcacagagggagagagtttggaagtgacttactgat

SEQ ID NO: 111763 - DNA, 573 bp, Homo sapiens
tagagctgttggaggattaagtgatgtttaatctacacatggctcaatgccagagaaattcagcatttaaaaaatttccttagaagtttctttttcttttccttcaagaattgttgaggataggaggaggtcatattgagagtttgtcatctcgtagaataatcagtatgagattagaaaaggtagaggttttttggattagaggcagtttagaaattgtgtgactggcttattattaatcgaattagcagtttctgttttctggtttccccatcatttcacctgctactcagccgtaaaagtttatttttgattcaaatgcagagattgagttttgaaacaaatctagattagtaaacatctatacttatatatagatttataaaatataaccagattatctaaaacttataaatgcatcttaaaattttttctttcttttacaggcaggaatttatacgtgcatgtttaaaggcgatacttttcaaatgccagacttcctcagcttgtgctatacttcccgttcacacactgccgtgtctttgctatgccctcccatacaccaaaaaaaaa

SEQ ID NO: 111764 - DNA, 374 bp, Homo sapiens
ctctatgggggcatcagcattgccaattcccagatcagcagactgagtctcgggcgggagacctcactagtccactcacactgcaggtaggtggcggagccaggatcacactccagcctgtctggctctgaagctcgtggtctgcacaccgccaggctgactcctgttcccaggcagtgggtgtgtgtggtgttcgcagggcactggctacaggcctaggttggatgcagagtcggtgtacaggagcttggtgccgagctgggctgggagccgtcagccatggcctgggcgctccgcactgcttccttcatctccgctgggacacgggggctgtggggcaggtagacagactgggattcggatgcctgtgttct

SEQ ID NO: 111765 - DNA, 2518 bp, Homo sapiens
ggcagccagaagcacctgtgctcccaggataagggtgagcactcaggatgactgtggagaaggaggcccctgatgcgcacttcactgtggacaaacagaacatctccctctggccccgagagcctcctcccaagtccggtccatctctggtcccggggaaaacacccacagtccgtgctgcattaatctgcctgacgctggtcctggtcgcctccgtcctgctgcaggccgtcctttatccccggtttatgggcaccatatcagatgtaaagaccaatgtccagttgctgaaaggtcgtgtggacaacatcagcaccctggattctgaaattaaaaagaatagtgacggcatggaggcagctggcgttcagatccagatggtgaatgagagcctgggttatgtgcgttctcagttcctgaagttaaaaaccagtgtggagaaggccaacgcacagatccagatcttaacaagaagttgggaagaagtcagtaccttaaatgcccaaatcccagagttaaaaagtgatttggagaaagccagtgctttaaatacaaagatccgggcactccagggcagcttggagaatatgagcaagttgctcaaacgacaaaatgatattctacaggtggtttctcaaggctggaagtacttcaaggggaacttctattacttttctctcattccaaagacctggtatagtgccgagcagttctgtgtgtccaggaattcacacctgacctcggtgacctcagagagtgagcaggagtttctgtataaaacagcggggggactcatctactggattggcctgactaaagcagggatggaaggggactggtcctgggtggatgacacgccattcaacaaggtccaaagtgcgaggttctggattccaggtgagcccaacaatgctgggaacaatgaacactgtggcaatataaaggctccctcacttcaggcctggaatgatgccccatgtgacaaaacgtttcttttcatttgtaagcgaccctatgtcccatcagaaccgtgacaggacaggctcccaagctcactctttgagctccaacgcttgttaaacatgaggaaatgcctctttcttccccagactccaggatgactttgcacgttaatttttcttgcttcaaaattgtcccacagtggcattctggagtccgtctgtcttggctggaaattctctgacgtcttggaggcagctggaatggaaaggagaattcaggttaaagtgggaggggtgggtagagaggatttagaagttccaattgccctgctaaggaggatcaagacccgtaatccggcacaacaccctggggttttccactctttcagagaaacctcagcttcatcacatcaaagttactccagagcaaccaagcaattctcctgatattgtcatccagggcttttcttggccaaaccccctagaatttccatgtctctgcttagctgtgctggcagctagcagctggctgtgtttgcagtgcaaatagctctgttcttggaaatcctgctcatggtatgtccccagtggtttcttcatccacatcatctaaagcctgaacccgttcttctctggttcaagtcagtggctgacacggacttgtatctccttcagagctcggctggcacccagcctcccttctccttccactcccttagtacactggagtgccgagccctgccttccacccagcgtccatccagcccctgtcctcacctctccggcacctcctcctccttctgcatttcctatcttcctgtgtcttgtgcatgggaagcagccttcagtgccttcatgaattcaccttccagcttcctcagaataaaatgctgcctgggtcaaggacaaaaaaaaaaaaaaaaaaaaaaaaaaaaaaaaaaaaaaaaaaaaaaaaaaaaaaaaaaaaaaaaaaaaaagacaaacaaaaaaaaaaaaaaaaaaagaggagggggcggcagaaaaacactccccagggggaggcaataaaataacgccagccacgatgtatagaaaaacaggagcggccagcaccaacaagggagcggtcattatattatagacacaaacgaacgaggcgggacgcgataacaaaaaacacagcagcagaggagcagagaacagaaaacgcgacaacagagaggagcaacaatggtgaaagaagcagaaacacacacaaaataaggggaggagagacagaaacagaggcgcagcgccccccccccccccaacctggattttatggtcgacagggggagataacgacagacacagaaatagagaagggagaaagagagagtggaggacaaaaccaacccccgcccacccccgcgacagacaaaaaagaaaaaaaaagaaaaagaagaggagcaaggagcaaaggatgagctaagagatagataagtgagaagaagacaaatactatcatcgacacggagagcgagtaggacagcggagtacacacagtaaaagaagaggcagaggcgaagcagactact

SEQ ID NO: 111766 - DNA, 1869 bp, Homo sapiens
ggcagccagaagcacctgtgctcccaggataagggtgagcactcaggatgactgtggagaaggaggcccctgatgcgcacttcactgtggacaaacagaacatctccctctggccccgagagcctcctcccaagtccggtccatctctggtcccggggaaaacacccacagtccgtgctgcattaatctgcctgacgctggtcctggtcgcctccgtcctgctgcaggccgtcctttatccccggtttatgggcaccatatcagatgtaaagaccaatgtccagttgctgaaaggtcgtgtggacaacatcagcaccctggattctgaaattaaaaagaatagtgacggcatggaggcagctggcgttcagatccagatggtgaatgagagcctgggttatgtgcgttctcagttcctgaagttaaaaaccagtgtggagaaggccaacgcacagatccagatcttaacaagaagttgggaagaagtcagtaccttaaatgcccaaatcccagagttaaaaagtgatttggagaaagccagtgctttaaatacaaagatccgggcactccagggcagcttggagaatatgagcaagttgctcaaacgacaaaatgatattctacaggtggtttctcaaggctggaagtacttcaaggggaacttctattacttttctctcattccaaagacctggtatagtgccgagcagttctgtgtgtccaggaattcacacctgacctcggtgacctcagagagtgagcaggagtttctgtataaaacagcggggggactcatctactggattggcctgactaaagcagggatggaaggggactggtcctgggtggatgacacgccattcaacaaggtccaaagtgcgaggttctggattccaggtgagcccaacaatgctgggaacaatgaacactgtggcaatataaaggctccctcacttcaggcctggaatgatgccccatgtgacaaaacgtttcttttcatttgtaagcgaccctatgtcccatcagaaccgtgacaggacaggctcccaagctcactctttgagctccaacgcttgttaaacatgaggaaatgcctctttcttccccagactccaggatgactttgcacgttaatttttcttgcttcaaaattgtcccacagtggcattctggagtccgtctgtcttggctggaaattctctgacgtcttggaggcagctggaatggaaaggagaattcaggttaaagtgggaggggtgggtagagaggatttagaagttccaattgccctgctaaggaggatcaagacccgtaatccggcacaacaccctggggttttccactctttcagagaaacctcagcttcatcacatcaaagttactccagagcaaccaagcaattctcctgatattgtcatccagggcttttcttggccaaaccccctagaatttccatgtctctgcttagctgtgctggcagctagcagctggctgtgtttgcagtgcaaatagctctgttcttggaaatcctgctcatggtatgtccccagtggtttcttcatccacatcatctaaagcctgaacccgttcttctctggttcaagtcagtggctgacacggacttgtatctccttcagagctcggctggcacccagcctcccttctccttccactcccttagtacactggagtgccgagccctgccttccacccagcgtccatccagcccctgtcctcacctctccggcacctcctcctccttctgcatttcctatcttcctgtgtcttgtgcatgggaagcagccttcagtgccttcatgaattcaccttccagcttcctcagaataaaatgctgcctgggtcaaggac

SEQ ID NO: 111767 - DNA, 327 bp, Homo sapiens
ggcaagtcgcttcacctctgttccatctggatcaaatggggatcatcatcctgcctagcacgttgctgggaggatttgagagcagagcggccggccttggccagattcgtgggtgtgcagtgaatcctggcttccttctacaccagccaccccaagtctcccatgctgggaactccagccactgttgaagccccacacatggcaggagcttcatgaacactttgtcgggctcctgcctgtaatcctagcactttgggaggccaaggcgggcagactgcctgagctcaggacttggagaccagcctgggctaaaccctatctctacaa

SEQ ID NO: 111768 - DNA, 2271 bp, Homo sapiens
  misc_feature (984)..(984): n is a, c, g, or t
aacaatttaggggggaaaataaaaatgaaaatgcattctgagttacataagagcatgtttactcttcacaaagccatatttatttatacttccaccaaaagccattttttttaagtctgtagacatatgataaaggacttttagtggacttggaagcatttttcacaatgggctagaatactgaggttgaatgttatgtaggaaacccacataatataaaattattttacacttgaaaaagaaaacaatatgttgtacagtatagctataaacaaatagcattggtgggtctgggactagttaaaattatgaagcaaagtttatatctacaatcaactatcccttgggactcctcctcagttttgcttaactctctcattctgcttcccttttttctgccctgatattcagtgcttttatacggcccaccctatagacatttctttactttcttgtgacatgaattggaataaattacaaataaccctaaatgttctttgcctttctccttctttaaattttaaacttattccacattttagctttttaagatcagacataacttccaaatagaagaaaccatgtttaaaaaaaaatccatgctttttaatcattttcttatgtaaaaagcctcaagtggctggaataaggtctaagtaacaaataaagaactaaacttttcagataaaggctccgaaagtccctcttgttttcagctttcaaaattctttctctctctctatcaatatatggttcacgtgtaaaaatgtgcttacctgtgtagggatgaaattaagactgtctgtcatctactcctcacaaaaggaaggaagtgagattattgtcctactttttccttatcttttctttttttctctgttggaggtataggatcaaccctcatcccttttgttaaatataaatgaatcatttaaaaggttaattattgtaggtaggtaacctgatgcgttaacctaattgcantacccagttgaagaaaatctgatatataatttaccagtatggcaggtttttttggttttgtttggatttttgatgttttttgttttttaattttcctttcaggaccatctttttcattgttctccagagtgtaccttataggtagctactcactctccaaataggtaaaactcccctcaagctatggatgtcaaagatagtaatctatccatttaatcataagcttttcttccagaagttactgaatgaaagaggattagaagatggtctgtgtagcaaaggatttgcttacattttgggccagtttgcttacccgtgaagcaggcatagtaagacttagacccacctcatgaagttgttgtacggatcaaatgagattttaaaaaagcacgttgaagttggtaaagctgaatgtgcttgcaaagcatgacatttacaactgaaaatccaatttgtgcttttgtgttcgtacctggagaaatcacttagcttttcaggtctgcagttttctcactcagattcgaaaggtcccccatcgatttaaaaattgtggactttggccagatgacctcctgaggtcccctgattctgtagttgtaaatgtcctgtgtaaatcagggaagtaattcatatacaagcacagtatactgaggagaagttggaagccaggtatcatgattcctggctgaggactaggctacgtgttcactgaatgagactgcccaaggcttaccagagattagatgctacagaatgagagtggaattgtaatattagagatagagccgtggggaatctggagttccaacccagtcaacatggagaaatccttgttaacttcagttatctagctgagataacacaaaagataggtttgaggaacaaggaccatgctctaatataaggcctactctagacccaggctaagactagtaaaagaaggccccaattaattcttacagggtagaccaaatttggacaatgagtctcaccgagatagagaagcctgggaaatatcctgagctttcagcagatcagcataccaaaggttaaatccaaacctatacaagttcaaggagtcaactattaactgacttatatgtactagaataaaaatcactgctcctcagaagaaattaacagaaccatatttgcaatatatcccatgttgaacttttaattaccagacatgcaaagaatcaggaacatatgatctatagagcagaaaagagcatgcagtagaaatcacctctgaggagtcctatttggtttaacagaaaaaaaaaa

SEQ ID NO: 111769 - DNA, 2217 bp, Homo sapiens
  misc_feature (984)..(984): n is a, c, g, or t
aacaatttaggggggaaaataaaaatgaaaatgcattctgagttacataagagcatgtttactcttcacaaagccatatttatttatacttccaccaaaagccattttttttaagtctgtagacatatgataaaggacttttagtggacttggaagcatttttcacaatgggctagaatactgaggttgaatgttatgtaggaaacccacataatataaaattattttacacttgaaaaagaaaacaatatgttgtacagtatagctataaacaaatagcattggtgggtctgggactagttaaaattatgaagcaaagtttatatctacaatcaactatcccttgggactcctcctcagttttgcttaactctctcattctgcttcccttttttctgccctgatattcagtgcttttatacggcccaccctatagacatttctttactttcttgtgacatgaattggaataaattacaaataaccctaaatgttctttgcctttctccttctttaaattttaaacttattccacattttagctttttaagatcagacataacttccaaatagaagaaaccatgtttaaaaaaaaatccatgctttttaatcattttcttatgtaaaaagcctcaagtggctggaataaggtctaagtaacaaataaagaactaaacttttcagataaaggctccgaaagtccctcttgttttcagctttcaaaattctttctctctctctatcaatatatggttcacgtgtaaaaatgtgcttacctgtgtagggatgaaattaagactgtctgtcatctactcctcacaaaaggaaggaagtgagattattgtcctactttttccttatcttttctttttttctctgttggaggtataggatcaaccctcatcccttttgttaaatataaatgaatcatttaaaaggttaattattgtaggtaggtaacctgatgcgttaacctaattgcantacccagttgaagaaaatctgatatataatttaccagtatggcaggtttttttggttttgtttggatttttgatgttttttgttttttaattttcctttcaggaccatctttttcattgttctccagagtgtaccttataggtagctactcactctccaaataggtaaaactcccctcaagctatggatgtcaaagatagtaatctatccatttaatcataagcttttcttccagaagttactgaatgaaagaggattagaagatggtctgtgtagcaaaggatttgcttacattttgggccagtttgcttacccgtgaagcaggcatagtaagacttagacccacctcatgaagttgttgtacggatcaaatgagattttaaaaaagcacgttgaagttggtaaagctgaatgtgcttgcaaagcatgacatttacaactgaaaatccaatttgtgcttttgtgttcgtacctggagaaatcacttagcttttcaggtctgcagttttctcactcagattcgaaaggtcccccatcgatttaaaaattgtggactttggccagatgacctcctgaggtcccctgattctgtagttgtaaatgtcctgtgtaaatcagggaagtaattcatatacaagcacagtatactgaggagaagttggaagccaggtatcatgattcctggctgaggactaggctacgtgttcactgaatgagactgcccaaggcttaccagagattagatgctacagaatgagagtggaattgtaatattagagatagagccgtggggaatctggagttccaacccagtcaacatggagaaatccttgttaacttcagttatctagctgagataacacaaaagataggtttgaggaacaaggaccatgctctaatataaggcctactctagacccaggctaagactatctcaccgagatagagaagcctgggaaatatcctgagctttcagcagatcagcataccaaaggttaaatccaaacctatacaagttcaaggagtcaactattaactgacttatatgtactagaataaaaatcactgctcctcagaagaaattaacagaaccatatttgcaatatatcccatgttgaacttttaattaccagacatgcaaagaatcaggaacatatgatctatagagcagaaaagagcatgcagtagaaatcacctctgaggagtcctatttggtttaacagaaaaaaaaaa

SEQ ID NO: 111770 - DNA, 429 bp, Homo sapiens
catgtccagctaattttgtatgtggagataacgcttttgccatgttgcctaggctggtcttgaactcctggcctcaagtgatcatcttactcagcctcccaaagtggtgggattacaggtgtgagccactgaacctggctctgtgatctattttgagttagtttttgtgaagagtgtgagggctgagtctagactggttttttgcatatggatgtttagttgttccagcactctttgttgaatagactgtctttgctccattgtattgtctttgttactttgtcagagatcagttttctatgtacagatgtattctgggctattttgttccactgatctatttgttctttcactaataccatattgtcttgataactgtagctttttaggaagtcttgaggtcaagtagggcaaatcctttcactttgt

SEQ ID NO: 111771 - DNA, 451 bp, Homo sapiens
aaactactaacacagaatgtccgtgcttttggactttcttcctcccagactgtatcacgtgtattctctcatttgatgtctcaattatcctgtgcaggaggtagggctgatgttgaggtttagaaaatttaagtgacttgtgcaaaccccagtggccacttagttgcagagctgcaacttgcaccagagctctttccagcccccaactcttttcccacttctacaaccgcccctatctcctccagtggcttctccttcagccgtccttgagaaagactcagcagcagcagctcagccacctgtgagtctgcagcactggctctcaccagctctgtggctcacatcacagtggttaagtgttcactgaccacttggctgtgttacaatcatttaattagtctgtgtcacagaggaaaagatgctttatttagaagcctaatagtgaaaactt

SEQ ID NO: 111772 - DNA, 3311 bp, Homo sapiens
caatcaggagcgcagcttgagaggcggagggggtttccgggatctggcggggcctttgtcttgtgctccagctggagctttggtcccgtattctcggctatttatccccagctgcgggaggccctggtgactctgctgctgcagtgtctggtttccctgtgacctgcaggtactgggagttacatagctaagatgccaggacaccccgaaagccggaaaacgagacgcattctcactatgttgcccaggctggtcttgaactccttccctcaagtgattcttctgcctaatcctcccaaagttcttagattattactcatgaatggattggtgttcttaccactgcagttagtgtgttctctgttagttcatgtgaaagctggttgttaaaaacaaaaacaaacaaacaaaaaactgatattcctcttgctttgtcttttgccatgatacccctttgccttttattatgcataaaagcttcctgaggcctcatcagaagttaagcagatgttgatgtcatgcttgtatagccaacagaactgaggctaataaacctcttttctgtattaatttgccagtgttaagtattcccttctagcagcacaaaatggactaacatcccataggttatatttttatttttttcttttgtaaatactggacaatgatactcttatataatcttcagtataaccattataattgcccactataaaggagtataatgaaaggccatgtattttgaatcacgaatgactatttacaaaatgtcatactacgtttttctttgagcctgtgacccctctggcctgtaaaaacacatacatacatttagttttgattaacatggagttaattttaagtctgtcactctaaacataagtgttagctttaagagaattacagagcatgtaattgtgtttgagtgtaggtgtgtacttttttgagaagaaaacaaaaatattggaacaaaatataatttaaaaagtattggtaatttactagcaaactaggaatctcaaagattctgaaagtaaatatttattctctgctttgtattgaatttacttctgtaaaatcttatggctgctggctcagaatcttctcatgcaaatcctgtttttttcttgtctgttgatcatactaaacctaatgtatagttttctcattccaaagttcatgaaattttctctatattcctgagaaattctaagaataactttcataaaatgtattgatgttcacaagataattttaagatgtaattctacaatatgtgtgttactacattttatttaattagtatattttatttttgtatttcaattggagaaccctattttggccaatttttacttggtttttgtttccattttaatattttacataattgaatttttttcactttattgagccattttgtttagatgtacactgggaaggcttcataattcacaaagttgttttgacatataaatgaggtgaacaaacacaggaaagtgctaggtttcctgggggtataatagatgctctataattagcagtaaatattcttgtttaagtcactttttggctacaagtaagagattagaaatattcagcataaagagatggcattaactctgcatgtaaagaaaacacatgtatacccaggctgtacaactgcctctgaaattaagaggaattgtgtttatttcatagttatctctggtacttcactgttattttattttcacccccaactatgcgtcaatcatagccctttcccttctttgcttattatggctacagatttctcactgttctctgcagcccatgtaatttcatacagtattttgtaggttgtgataaggaatttgaaatttttaatatagtgaaaaattggatttaactggagagtttgaggacatttttaagttagaaatgcaccatttgaatcatttaattggcataattgggatgtactctacacagtttataggattaaattactgagttagtaatgtttgtatgaaagaaatgttattagattctaccacaaaatatagtaaacatgaaatcagttagaataggtaaagcattaataatggtaggctatatatcataatcactatataaagaaacatcagaatttggaaaccccttaagcaaaaatatatcttagaaatcttaaggacacttaatggcaagcaaaaaagtttaaatttagttttttataaattacatatagcacaatttatgtgtacatgtagaatcttttagtttttagtgtttatgtaatatattagacaataataaacatttacatttatgtttacatttatatttaatttttcaaatttaatttaaatttctaaatgcttctgtggatttaaattttggaataatcttttcttccccattgatactggaatcttgggaagtttcttactcatatcacaatatgttttatttaaatggatgcagcttacattgcagagtttatataaataatcacataacaagccaattccttagtcattttctgtattaaaaaactcagagatctagagagcttttggattgaaatatttccttggtgattttggatgcaaacctgatttctgtgttcacaccatggccagagatgggactgttagcaccacctgcttctttaatgtcgtccatatgatcagcatcagcaccagaaactccaggtgtcccaaacttaaagtgaaagccatagagtcctttggtgactcccatgttctgtgctggttctagaacatgctggtaaatatcagagtttctatgcttatggctgataagtagacatttttaaaaatcataaaaactgtattttctatatagttcagctaagtttatgaaaaagatgcagactcagtatttggagcattgctatcgctccatgatgtgtttaaaaattatttttaaattgacaaaattttatatctacatatatatatatcttgtaacacatgatgtttgaaatgcttaattctagccaattaaaaatgctttacctcaatagttatttttattgtgagaaaggtcaacatggtcttggcacttaaaaaaaaaaaacaatatattctcaataactgtattcactctgcactacaataggtctcttgaactaattcctcctagctaacaggcattgtttatcatttaacagataattctctaagcccccttctcctaaaacttcagcatctcttaaccttctttctagtctctacttttatgagatcaacttgtttagattccacgtgagtgagaccatgaggtattcatctttctgtgttctg

SEQ ID NO: 111773 - DNA, 3331 bp, Homo sapiens
tttttagaatgcaatttcttttcataaaacaaaattatttttaatgtgttaagaatattttgcattgaatgaagtatatcttgccacaataattaacctataccaccttacccaaagttgtaggtaacagatagtaacaatacactactgggtaacagtgaaaggacacctctagtaatctcttttcccagtggcttttaatttcaaacaacttggggaggttttttttatgtgatatgctttggtttttttgtgccttacctcatgttgaaatgtgttcccccatgttggaggcggggtctagtggaaggtgtttaggtcatgggtgtagattactcatgaatggattggtgttcttaccactgcagttagtgtgttctctgttagttcatgtgaaagctggttgttaaaaacaaaaacaaacaaacaaaaaactgatattcctcttgctttgtcttttgccatgatacccctttgccttttattatgcataaaagcttcctgaggcctcatcagaagttaagcagatgttgatgtcatgcttgtatagccaacagaactgaggctaataaacctcttttctgtattaatttgccagtgttaagtattcccttctagcagcacaaaatggactaacatcccataggttatatttttatttttttcttttgtaaatactggacaatgatactcttatataatcttcagtataaccattataattgcccactataaaggagtataatgaaaggccatgtattttgaatcacgaatgactatttacaaaatgtcatactacgtttttctttgagcctgtgacccctctggcctgtaaaaacacatacatacatttagttttgattaacatggagttaattttaagtctgtcactctaaacataagtgttagctttaagagaattacagagcatgtaattgtgtttgagtgtaggtgtgtacttttttgagaagaaaacaaaaatattggaacaaaatataatttaaaaagtattggtaatttactagcaaactaggaatctcaaagattctgaaagtaaatatttattctctgctttgtattgaatttacttctgtaaaatcttatggctgctggctcagaatcttctcatgcaaatcctgtttttttcttgtctgttgatcatactaaacctaatgtatagttttctcattccaaagttcatgaaattttctctatattcctgagaaattctaagaataactttcataaaatgtattgatgttcacaagataattttaagatgtaattctacaatatgtgtgttactacattttatttaattagtatattttatttttgtatttcaattggagaaccctattttggccaatttttacttggtttttgtttccattttaatattttacataattgaatttttttcactttattgagccattttgtttagatgtacactgggaaggcttcataattcacaaagttgttttgacatataaatgaggtgaacaaacacaggaaagtgctaggtttcctgggggtataatagatgctctataattagcagtaaatattcttgtttaagtcactttttggctacaagtaagagattagaaatattcagcataaagagatggcattaactctgcatgtaaagaaaacacatgtatacccaggctgtacaactgcctctgaaattaagaggaattgtgtttatttcatagttatctctggtacttcactgttattttattttcacccccaactatgcgtcaatcatagccctttcccttctttgcttattatggctacagatttctcactgttctctgcagcccatgtaatttcatacagtattttgtaggttgtgataaggaatttgaaatttttaatatagtgaaaaattggatttaactggagagtttgaggacatttttaagttagaaatgcaccatttgaatcatttaattggcataattgggatgtactctacacagtttataggattaaattactgagttagtaatgtttgtatgaaagaaatgttattagattctaccacaaaatatagtaaacatgaaatcagttagaataggtaaagcattaataatggtaggctatatatcataatcactatataaagaaacatcagaatttggaaaccccttaagcaaaaatatatcttagaaatcttaaggacacttaatggcaagcaaaaaagtttaaatttagttttttataaattacatatagcacaatttatgtgtacatgtagaatcttttagtttttagtgtttatgtaatatattagacaataataaacatttacatttatgtttacatttatatttaatttttcaaatttaatttaaatttctaaatgcttctgtggatttaaattttggaataatcttttcttccccattgatactggaatcttgggaagtttcttactcatatcacaatatgttttatttaaatggatgcagcttacattgcagagtttatataaataatcacataacaagccaattccttagtcattttctgtattaaaaaactcagagatctagagagcttttggattgaaatatttccttggtgattttggatgcaaacctgatttctgtgttcacaccatggccagagatgggactgttagcaccacctgcttctttaatgtcgtccatatgatcagcatcagcaccagaaactccaggtgtcccaaacttaaagtgaaagccatagagtcctttggtgactcccatgttctgtgctggttctagaacatgctggtaaatatcagagtttctatgcttatggctgataagtagacatttttaaaaatcataaaaactgtattttctatatagttcagctaagtttatgaaaaagatgcagactcagtatttggagcattgctatcgctccatgatgtgtttaaaaattatttttaaattgacaaaattttatatctacatatatatatatcttgtaacacatgatgtttgaaatgcttaattctagccaattaaaaatgctttacctcaatagttatttttattgtgagaaaggtcaacatggtcttggcacttaaaaaaaaaaaacaatatattctcaataactgtattcactctgcactacaataggtctcttgaactaattcctcctagctaacaggcattgtttatcatttaacagataattctctaagcccccttctcctaaaacttcagcatctcttaaccttctttctagtctctacttttatgagatcaacttgtttagattccacgtgagtgagaccatgaggtattcatctttctgtgttctg

SEQ ID NO: 111774 - DNA, 3277 bp, Homo sapiens
tttttagaatgcaatttcttttcataaaacaaaattatttttaatgtgttaagaatattttgcattgaatgaagtatatcttgccacaataattaacctataccaccttacccaaagttgtaggtaacagatagtaacaatacactactgggtaacagtgaaaggacacctctagtaatctcttttcccagtggcttttaatttcaaacaacttggggaggttttttttatgtgatatgctttggtttttttgtgccttacctcatgttgaaatgtgttcccccatgttggaggcggggtctagtggaaggtgtttaggtcatgggtgtagattactcatgaatggattggtgttcttaccactgcagttagtgtgttctctgttagttcatgtgaaagctggttgttaaaaacaaaaacaaacaaacaaaaaactgatattcctcttgctttgtcttttgccatgatacccctttgccttttattatgcataaaagcttcctgaggcctcatcagaagttaagcagatgttgatgtcatgcttgtatagccaacagaactgaggctaataaacctcttttctgtattaatttgccagtgttaagtattcccttctagcagcacaaaatggactaacatcccataggttatatttttatttttttcttttgtaaatactggacaatgatactcttatataatcttcagtataaccattataattgcccactataaaggagtataatgaaaggccatgtattttgaatcacgaatgactatttacaaaatgtcatactacgtttttctttgagcctgtgacccctctggcctgtaaaaacacatacatacatttagttttgattaacatggagttaattttaagtctgtcactctaaacataagtgttagctttaagagaattacagagcatgtaattgtgtttgagtgtaggtgtgtacttttttgagaagaaaacaaaaatattggaacaaaatataatttaaaaagtattggtaatttactagcaaactaggaatctcaaagattctgaaagtaaatatttattctctgctttgtattgaatttacttctgtaaaatcttatggctgctggctcagaatcttctcatgcaaatcctgtttttttcttgtctgttgatcatactaaacctaatgtatagttttctcattccaaagttcatgaaattttctctatattcctgagaaattctaagaataactttcatgttactacattttatttaattagtatattttatttttgtatttcaattggagaaccctattttggccaatttttacttggtttttgtttccattttaatattttacataattgaatttttttcactttattgagccattttgtttagatgtacactgggaaggcttcataattcacaaagttgttttgacatataaatgaggtgaacaaacacaggaaagtgctaggtttcctgggggtataatagatgctctataattagcagtaaatattcttgtttaagtcactttttggctacaagtaagagattagaaatattcagcataaagagatggcattaactctgcatgtaaagaaaacacatgtatacccaggctgtacaactgcctctgaaattaagaggaattgtgtttatttcatagttatctctggtacttcactgttattttattttcacccccaactatgcgtcaatcatagccctttcccttctttgcttattatggctacagatttctcactgttctctgcagcccatgtaatttcatacagtattttgtaggttgtgataaggaatttgaaatttttaatatagtgaaaaattggatttaactggagagtttgaggacatttttaagttagaaatgcaccatttgaatcatttaattggcataattgggatgtactctacacagtttataggattaaattactgagttagtaatgtttgtatgaaagaaatgttattagattctaccacaaaatatagtaaacatgaaatcagttagaataggtaaagcattaataatggtaggctatatatcataatcactatataaagaaacatcagaatttggaaaccccttaagcaaaaatatatcttagaaatcttaaggacacttaatggcaagcaaaaaagtttaaatttagttttttataaattacatatagcacaatttatgtgtacatgtagaatcttttagtttttagtgtttatgtaatatattagacaataataaacatttacatttatgtttacatttatatttaatttttcaaatttaatttaaatttctaaatgcttctgtggatttaaattttggaataatcttttcttccccattgatactggaatcttgggaagtttcttactcatatcacaatatgttttatttaaatggatgcagcttacattgcagagtttatataaataatcacataacaagccaattccttagtcattttctgtattaaaaaactcagagatctagagagcttttggattgaaatatttccttggtgattttggatgcaaacctgatttctgtgttcacaccatggccagagatgggactgttagcaccacctgcttctttaatgtcgtccatatgatcagcatcagcaccagaaactccaggtgtcccaaacttaaagtgaaagccatagagtcctttggtgactcccatgttctgtgctggttctagaacatgctggtaaatatcagagtttctatgcttatggctgataagtagacatttttaaaaatcataaaaactgtattttctatatagttcagctaagtttatgaaaaagatgcagactcagtatttggagcattgctatcgctccatgatgtgtttaaaaattatttttaaattgacaaaattttatatctacatatatatatatcttgtaacacatgatgtttgaaatgcttaattctagccaattaaaaatgctttacctcaatagttatttttattgtgagaaaggtcaacatggtcttggcacttaaaaaaaaaaaacaatatattctcaataactgtattcactctgcactacaataggtctcttgaactaattcctcctagctaacaggcattgtttatcatttaacagataattctctaagcccccttctcctaaaacttcagcatctcttaaccttctttctagtctctacttttatgagatcaacttgtttagattccacgtgagtgagaccatgaggtattcatctttctgtgttctg

SEQ ID NO: 111775 - DNA, 789 bp, Homo sapiens
caatcaggagcgcagcttgagaggcggagggggtttccgggatctggcggggcctttgtcttgtgctccagctggagctttggtcccgtattctcggctatttatccccagctgcgggaggccctggtgactctgctgctgcagtgtctggtttccctgtgacctgcaggtactgggagttacatagctaagatgccaggacaccccgaaagccggaaaacgagacgcattctcactatgttgcccaggctggtcttgaactccttccctcaagtgattcttctgcctaatcctcccaaagttcttagattggactactggcattcagtgatgtggtcatagaattctctccagaggagtgggcatgcctggaccctgcccagcgaaatttgtatagggatgtgatgttcgagaactacagaaacctggtctccctgggacttccaggactatgttaaaatagaagcattgataatgggcacaatatcactttgcattggtgtctgtgcatttgaaggagcaaacacctctaccagtttttataaactggtttatacagctattttatcttattccattcaagaccttttgccagagcaggatatgaaagatttatgccaaaaagtgacactgacaagacatagaagctggggccttgacaatttgcacttagtgaaagactggagaactgtgaatgaaggtaaggggcagaaagaatattgcaatagacttactcaatgttcatcaactaaaagcaaaatctttcaatgtattgaatgtggcagaaat

SEQ ID NO: 111776 - DNA, 700 bp, Homo sapiens
caatcaggagcgcagcttgagaggcggagggggtttccgggatctggcggggcctttgtcttgtgctccagctggagctttggtcccgtattctcggctatttatccccagctgcgggaggccctggtgactctgctgctgcagtgtctggtttccctgtgacctgcaggtactgggagttacatagctaagatgccaggacaccccgaaagccggaaaacgggactactggcattcagtgatgtggtcatagaattctctccagaggagtgggcatgcctggaccctgcccagcgaaatttgtatagggatgtgatgttcgagaactacagaaacctggtctccctgggacttccaggactatgttaaaatagaagcattgataatgggcacaatatcactttgcattggtgtctgtgcatttgaaggagcaaacacctctaccagtttttataaactggtttatacagctattttatcttattccattcaagaccttttgccagagcaggatatgaaagatttatgccaaaaagtgacactgacaagacatagaagctggggccttgacaatttgcacttagtgaaagactggagaactgtgaatgaaggtaaggggcagaaagaatattgcaatagacttactcaatgttcatcaactaaaagcaaaatctttcaatgtattgaatgtggcagaaat

SEQ ID NO: 111777 - DNA, 544 bp, Homo sapiens
catgtggatattaagatacagaagtcataaaatatttgtaatcttcatagtatctgtaggttaagtagtggttctaatttctgggaggaagctcaagtactccttattttgttgaaccatatttaatttaaaagaccaaccagcagttgaaaattttctattgctgtttagaatagattcatcccaactttggtagaggagtccatggctgaatattgccatgagtgaagaaagattctttctcactttcttctggaagctttgttttcatcctcctttggattggcttctgagagaccataaaaagaaatgggtgttgattgcatttaatggttcctactgtgaacaagcagtaggtaccgttcttgccctttcagtatctgcagactcattttatcagaagagtgcaactgataaactttgcataagagaaaatgtactggccaaacattgattttgcttacatacacatacttaacacgcacattcttgacctacatctatttaaaaaaaaaaaaaaaaagaacttgtatataaaaatctg

SEQ ID NO: 111778 - DNA, 814 bp, Homo sapiens
cagatatattttgctcccaaacgccgccctagaagaaggactacactgaaatgaaacggagatgattaaagtctgatttataggctgtacaagccctgaaagcaagaacggggttcacggcatcttgatacccccatgtggggacgttttggcgattttatttacaagaaagggattttacaccggagaggcttttaaatatgctaacagactggaccagctttctcatccccactggctgattaatgattcctccatgccaacccggttctcagagacaccaaggccagctctccaaagacctgggaaaaaattacttcatgtccttgtaaaaacgttttcacaaatttaagtgcaccagctttgaagcaagacagaattgggatcaagtccctgttccacccttaccagaaagtcttttcgtagctcacaaggggacatcaaagatgacaaagaggagtggaagaagacagagagaatcaatgtgaggagcctggaacagggctctgaattgtcttcccacagtgaaatcacttgtctattgctgagccaagaatttgactctgagcatctaggatgagaaagaagaactggcacctacgccatctctgcccctcgggactgactattttggtaagttcagttcacccatggaggaagtggttctcgtactttatctgcatgtaacaacaaaattcaggttcttggggctgatgcttggagattgtgattcagatctgggatggggctcaggaacctgcattttaacaatggaggttctaatgtggtcattggcaggttgttctaatgtggg

SEQ ID NO: 111779 - DNA, 706 bp, Homo sapiens
gtgtgtgatcaacgcgtacacatgtggcgggtgtgcagatgccgcccgtgcccggcacggtgtgatgtgtgtacacggcctggagtgtaggggtggcgtgtcggagccccacactacaccacagggatgagcgtgtatccccttcagaggtgtgcctggggactccgtgtgcgcgactaggtgctctcctggggctggcaggggcatctgtccctttaccggtgcaatggggagggtgcacacggttcaccagctttcgggctagctgggtaggaggtgatgctgccccggtctggcacccacttccccgggcctctcctaacccataggacagtagtgctcctggcttgtgctgcccagaggctacctggctttccctaattcaccgaccccaggattaaccccatggtggttggtatcaggggatgaggccagagccctttgagctgtgcccctcacaggggtagggtcatggcctcagccatcccggtaccatctgtgcccagccggggactgggaacctggtttctccatgaggagccatcccagggcctgcaggagggactagaagccagaggactctgaggctccgcttcctggggactgcagggggatcagaatgtcccaagcttgggacagtctgggaaggcagtggccatcccatccagatgagtacatccctctctccttgcctacttccctccta

SEQ ID NO: 111780 - DNA, 480 bp, Homo sapiens
tgtagttgagccacagctcttgtatattctgttctgggtaggttttcttttttttcagtcttttttctgtttttcagttttggcagtttctattgagatggcttcatgttcagagattttttccttcagctgtgtccagtctactaagaccatcaaaggcattcttcatttctgctacagtgcttttgatctctaccatcttttttggtaccttattaaattatctatctctctgcttacattacctattggtcttttcatgctatctactttatgtgttaaagctcttagtaaattaatcatagttattttaaattagtggtctaataccaacatctctaccatatcttgaatttggttctgatgcttgtactgtctcttcaaactgtgtttttccttttagtatgcctcgtaattttttcttgataactggacataatgtactgggttaaagaaattgctgtgatgttcctttagtaa

SEQ ID NO: 111781 - DNA, 453 bp, Homo sapiens
taaagtgaagggatgcaaactgtagtatgtaaccttgtttgcttcaggtttgtggctatataactcccctcttcacattgttgttgtaaagaaacaatgtaagaaaattgttggaaacatttgtgtggatgtttttgttttttgtttttttaagatagggtctcactttgtcagtcaggctggagtgcagtggcacgatcacagcttactgcagcctcaacctccccttgctcaggtgatccttccacctcagcctcctgagtagctgggactataggcgccaccacgcctgctactttttggatttttagtagagacatttgaaacaatagagcagagtagtctttctgtttggagtctgtactaatgaactgcaatacatgagggatctaaaacattttcctgtaaccaatactatttccatttgacaacccacttaatttttaaaaagca

SEQ ID NO: 111782 - DNA, 306 bp, Homo sapiens
gccttgctgagatggaaagggtcaaagtggacaggagaggaagaggagacccaaatttataagatgagagaagaatttttaccctcagcaaactgcattgttgtcctaagagcagcatatgggcctaggtgctggtgttgtaagtccaggaggaactttagtatggaaggcaccaaggtgtaccaactctactcccaatggtgcccacaggccaagagggcctgaatagtaatcatctttcctgccaattatcactaaagccacaaacagttttctcagaagtgagatcatctgatcacaacttaa

SEQ ID NO: 111783 - DNA, 435 bp, Homo sapiens
agccgggacacagtggggaggctggaatcacagtaaggattaagagacatagctgatgactccaacctagagtcagggtttccctgagaactaagagctggaagtgtgagatgagatcctatagacggaagggcccagttgaaagaagaaaacagggctttgctggcagtctttggagctctcatcaccacaagggtgacaccagtatggtgactaaacttggcttggagattgctgatccagttggtggcccctcacagtgctagcctggggctttgcacatagtaggtgatctatatccctagatggctgctggtcccatgtgcttgccctcattctcaatcacctgacctttccttttcatgcacattcagagtaagttctttaagtgtgaaattctctgagtaacacaatcccagctcccacagggcaagg

SEQ ID NO: 111784 - DNA, 753 bp, Homo sapiens
acaatgggggatcatttttatatgtggtatgaatttggggcctgtattttctccaagtgtttagccaattttcacaataatgttttttaaataatctaccattttctcaatgatctacttaccaagttcttatatacacatggatttgttttagatcctattttattttagattctattctattgtctatttggcatttttagtgtcagtatcacactgaattactagagcttagtaatataccttaatatctagtaagatatttcccaacctctctcttctttttatgaactgttttagctatttgtggatttgcgtgtgaccaattcacctctattggattttttattttagttacattaaatttatattttaatttaggaagaatttatatctttatgttaaatcttccttccacaaatctggtatttctacctaatcagttctttttttaatgtcccttaataatgctttaaaatgtcttccaaaataatttttgcattttaggtcagtttatatatatatatatatatgctattgtaaacagtatcttatcgtctattatattttttaacggctgttggtgtaaaataagtctatttatcattacgtactgatttgtgctcagcaagcaaactgaactctctttttagctttagtcatttgtctgttgattctcttgagttttctatgtacttaaatcatctacgcgtactgacagttttgtctccttccttatagctttatccctta

SEQ ID NO: 111785 - DNA, 1025 bp, Homo sapiens
aggaaaggagggcgttgctagcctctagcagtgccgcgtttattctaagatgtgggagattcttttccttgcaacagtttttgtcatctgcattcttccaaggcttttaaggtgcattttcttctgtgtgaaaggaaattctttgtccttttcctctcagcaccgtggcttcccaaggtagacactattttgtgcctgtcacagagagagggagtgcaggtttgcaatgctcacagacaattgattgtctgccctaatgtgtttcatttacatgtttataacgtcaatggtgctggggtgtccactgtaccattcattcccgcattcccacaagggggcaattgtctgaatggccaagtcagacacctttttgattgctctttggttgtcttttcagagcaaagagataaaggaggaaaatctgtgatgcagaaacactagttgaaaatatacagaattaaatgtcaccacaaaagcagatgttaacataagcccaaatatgctttttagccaagatgtgaaggttgaaaaaaataattcagagcagagggaaggatgatttaaaccaataaatatagccctattccccctctttacttcttttctgtctttagcaatcagaagatgaaatgtaattttccttttcatttttaagccttgaaacatccaggcacctcctcattatttgtatgtttgctgtgatttgtgaattttgtatatatttacatagctctgtttatgccaacagcatcagcttaccacttggaaaatctattgaatgactatttgggctgtggggagggtaaacttttaaaaagtaagatccaagtatttcttcatcaagcagtttttaaaaggaaaacgataataatcagtaggctccatggaagcctttgccttaatagctatgtgccaaatacttttatcttgtgtgacagtcatgtcagagtgaaatctctcaggaaaagtgtaactagtagttacaaagtaaataaaggatttcattttaaggtgaaatgtagtgt

SEQ ID NO: 111786 - DNA, 307 bp, Homo sapiens
cagcctcctgtgaagcgaggaagggtcttcctgccggcctctggagatcagtatgggaatgcacaagtaggaaacgctggatgggaatccctctgccctgtgataccaaggcagtgagtttgtagactatggaattgctgtcggagggctctgtaaccggccaaggtcacacaggtagccattggtagagcagggactggaatcccagacccccaacttccaggactgtgcacctttctttatcccatacagccttacagtcaagtgccagtgcaacacctgattcccaggttccagcctttgtctt

SEQ ID NO: 111787 - DNA, 399 bp, Homo sapiens
gttatgtagcatcacacgttgattctgtttacttttcagcatttttcaagttgttattttaaaatgttatgttaaatgtggttaccaattgcattacagtacactaatgcattttaataacattttaaaatgttatttttaaataacacctttaatggaatcactgcattgtttaaacaatcaaaatgggcagggtgtgatggctcacacctgtaatctcagcactttgggaggcccggcaggcagatcacttgaggtcaggagtttgagaccagcctggccaacatggtaaaatcttgtctctactaaaaacaccaaaagattagctgggcatggtggcacacctgtggtcccagctactcaggagactaaggcaggagaattgcttgaacctggagg

SEQ ID NO: 111788 - DNA, 834 bp, Homo sapiens
acagaaaagggggaacccgctggcccaatggcagcgtcctacagtgtagcctccgcctcccgattgactggcctgcttggcaaggcaagtagcggcggcgcttcaagatgcgctgcctgaccacgcctatgctgctgcgggccctggcccaggctgcacgtgcaggacctcctggtggccggagcctccacagcagtgcagtggcagccacctacaagtatgtgaacatgcaggatcccgagatggacatgaagtcagtgactgaccgggcagcccgcaccctgctgtggactgagctcttccgaggcctgggcatgaccctgagctacctgttccgggaaccggccaccatcaactacccgttcgagaagggcccgctgagccctcgcttccgtggggagcatgcgctgcgccggtacccatccggggaggagcgttgcattgcctgcaagctctgcgaggccatctgccccgcccaggccatcaccatcgaggctgagccaagagctgatggcagccgccggaccacccgctatgacatcgacatgaccaagtgcatctactgcggcttctgccaggaggcctgtcccgtggatgccatcgtcgagggccccaactttgagttctccacggagacccatgaggagctgctgtacaacaaggagaagttgctcaacaacggggacaagtgggaggccgagatcgccgccaacatccaggctgactacttgtatcggtgacgccccaccggcccgcagcccctgctgcccaataaaaccactccgaccccaaaaaaaaaaacaacaacatactcacagtgcactgaagaaacga

SEQ ID NO: 111789 - DNA, 816 bp, Homo sapiens
acagaaaagggggaacccgctggcccaatggcagcgtcctacagtgtagcctccgcctcccgattgactggcctgcttggcaaggcaagtagcggcggcgcttcaagatgcgctgcctgaccacgcctatgctgctgcgggccctggcccaggctgcacgtgcaggacctcctggtggccggagcctccacagcagtgcagtggcagccacctacaagtatgtgaacatgcaggatcccgagatggacatgaagtcagtgactgaccgggcagcccgcaccctgctgtggactgagctcttccgaggcctgggcatgaccctgagctacctgttccgggaaccggccaccatcaactacccgttcgagaagggcccgctgagccctcgcttccgtggggagcatgcgctgcgccggtacccatccggggaggagcgttgcattgcctgcaagctctgcgaggccatctgccccgcccaggccatcaccatcgaggctgagccaagagctgatggcagccgccggaccacccgctatgacatcgacatgaccaagtgcatctactgcggcttctgccaggaggcctgtcccgtggatgccatcgtcgagggccccaactttgagttctccacggagacccatgaggagctgctgtacaacaaggagaagttgctcaacaacggggacaagtgggaggccgagatcgccgccaacatccaggctgactacttgtatcggtgacgccccaccggcccgcagcccctgctgcccaataaaaccactccgaccccaatcgaccaaaaaaaaaaaaaacaac

SEQ ID NO: 111790 - DNA, 982 bp, Homo sapiens
acagaaaagggggaacccgctggcccaatggcagcgtcctacagtgtagcctccgcctcccgattgactggcctgcttggcaaggcaagtagcggcggcgcttcaaggtgggtgttcacgttttggccgtgaaagtcgggcttgggcagcgtggcgtcgggggcgagtgtggtgtccccgttggcgccgccagctctgcgcctgggcttcccctcggctcactcaggatccgcggcctccgtgtccttcaggtgcagcggggagccggctctcagggcgcatgcgccgcccgctctgcgccaccggcctagttagggtcggagatcactgggaaggtggggaaggtgctgggttgggtccctggaactgcagtcagtgatccaaaggagtgggcctgttagggggttcacaggtcgtgggatgagctcttatgagcgccggctaagtgccgggctctggggtgcccttggcatgtacgggctcccctaattcccaagaccaaccgcccccaacccacttcataggtgagaagacggaggtcaggtcacatcatctgcccaaggtcacgcggcaggctgggggacagttccaggagggccttgaagctggggaaaggaatgtggtaccgaggactgttcaggccttgaagagtttccagcagggcagggctgggttccgatcctcggcccacctccttatcgtgtgacttccgacaagtcacttttttatcttttttttgagacaaggtctcactctgtcgcccaggttggagggcagtggtgcagtctgggctcactgcaacttctgcctcctgggttcaagcgattctcctacctcaactcccgagtagctgggattataagtgcccaccaccacacctggctaatttctgtatattttggtagggacggggttccaccatgttagccaggctggtctcaaactcctgacctcaggtgatccacctgcctcagcctcccaa

SEQ ID NO: 111791 - DNA, 3978 bp, Homo sapiens
  misc_feature (907)..(907): n is a, c, g, or t
  misc_feature (1383)..(1383): n is a, c, g, or t
acagaaaagggggaacccgctggcccaatggcagcgtcctacagtgtagcctccgcctcccgattgactggcctgcttggcaaggcaagtagcggcggcgcttcaagatgcgctgcctgaccacgcctatgctgctgcgggccctggcccaggctgcacgtgcaggacctcctggtggccggagcctccacagcagtgcagtggcagccacctacagtgagtacctgggtggcctctagcctcaggtgttcctgactggtcctgctggagtaggggaagagacctgagttccagtcctggctttgtcaggggcgttcttctctgagcctgtttccacttttaaaatgattatggtgatggagactgactctgattcacaggggcagggtccatcattgccgaggttagcatgtgtgatctcagagctccctgggtgtgatggggagggggttgccaggtgtgagccatgggtacctgtgcctattgccagtccctggtgaaggcaaaggctcaagccccccacctaccccccttgattcctctttcaagccctgttgggcagggaagtgcgtctgggctccaatggccacccaagcacagggagaggtaggcacggacgggctcaggccagaggcggcctccagggtccttgctgaggctggggagaggtgtggtgagtgtacagcccctttgtagcccagcagttgcacctggaagtgagggccaggctgctctccctgaggctccagggagacagtgtgtgaggcctcttgccatggcctccctgcccgcctctctgcagagtatgtgaacatgcaggatcccgagatggacatgaagtcagtgactgaccgggcagcccgcaccctgctgtggactgagctcttccgaggtgcgtcctgggcangaggggacagggaaggtgccgggtgggcacggatgcatgggggaggagggtgcccctgcccaccacacccgtgctgcccacaggcctgggcatgaccctgagctacctgttccgggaaccggccaccatcaactacccgttcgagaagggcccgctgagccctcgcttccgtggggagcatgcgctgcgccggtacccatccggggaggagcgttgcattgcctgcaagctctgcgaggccatctgccccgcccaggtgagcccctgccccaaccggccaccacgccagcccctgccactgggagagggaggccaggcagccctaggcccaaaccctagcccctgcttgatgtgcgtccccaggaagtccctttccccctctgagccacttccctcgtgaatgggaatgatgagggcttgttaccagagcacagagtcagtgagttggcagagtgaagcttccagccctgggcagncgcctgacacacagaggttcccccttggggtctggccaagggtgtgacccctgggcctctgagccatggggtgacacctgaggccatccacgcctccctggatgtagccaccgtttccggagtcctgcttgtgtgcctgttgcagcttcccttccccagtggctgctcccctgaggcccggctttccgttctcttagtgggtctcgtgcttacccgtgggggccaggcctgccagcacgggaacaatatgactcggtcagagctctggtcagacccctgtgtgtgcctggcaggagccccggcagccgccgtcgctactttctgtgtgcacagcaacccctcccagtgttctgtgactcgggtggctcctgtccagatcctagtttgtcctctggagcactcccaggtcctccaggccatgagctgcggccctgatgtctctactccagccacggactgagagtgcataggagtgtccccaaacagcagtcacgatggtcacaaccttggcttccagacagtgagtgctgtccacagacagacccgttgctgtgccatgtgtgtgactcacagcctctcctgtaatctccacaacccctcgaggaggtcgaggttattgtctccatctttataagcactaaaggatgagcctgccagccacaggtcccactgtgagttgtggacactacatttctgggatgggggcatatgagagtccttgccaagcacatttgaaggttttcccagccagcccctcccccagcgggctacccaggaactgagagttaggacgtgcccttgagtttgggctgtgcccccacttgctgtgtagctttggggagcccctcaacctctcggaaccttgtttttctcatccatcaaatggagagaagtagatttaaggcacaggattgcacccaacagtgtaggcattcttggcgatgttgcaggttcggctccagaccatcggggtaaactgagtcacacagctgttttggttttccagtgcatttaaaagttagatttagaccgggcacagtggctcatgcctgtaattccagcactttgagaagccgaggtgggcggatcacttgaggtcaagagttcgagaccagcctggccaacatagtgaaaccccgtctctactaaaaataacaaaacttagccgggcacgttggcaggtccctgtaatctcagctacttgctaggctgaggcacgataatcacttgaaccgggaggtgggggttgcagtgagccaaaattgaaaaaaaaaaaaaattagggccggttgcggtggctcacgcctgtaatcccagcactttgggaggccaaggtgggcggatcacaaggtcaggaattcaagaccagcctggccaacatgttgaaaccccgtctctagtaaaaatacaaaaattagccgggtgtggggttgcacacctgtagtcccagctactcaagaggctgaggcaggagaattgcttgaacctgggaggcggaggttgcagtgaactatgattgcaccaccatactccatcctgggccacagagcaagacttcgtctcaaaaaaaaaaaaggatttacactgtactgtaggctgcgaagtgtctaaaacacaatgtatataccttaattaaaaatactttaggggccaggcacagtggctcacacctgtagtccaagtgctttgggaggtcaaggtgaggggattacttgagcccaggagtttgagaccagcctgggcaacatggcaaaaccccgactctacaacaacaacaaaaaatacaaaaaattagcccctgtaggcccagttacttgggaggttgaggtgggaggatcgcttgagcctgggaggttgaggctgcagtgagctatgagctgcaccactgtactccagcctgggtgacagggcaagactctgtctcaaaaaacaaaaacaacaacaaaaactttattcctaaaaagtgctgacccagagataagaagcaagcacatggttggtaaaatgacatcagtgagcttgctttatgcagggttgccccaaaccttcaatttgtaaaactcaaaatatctggaaagcttggtgaggcgaggcgggactgtaactcagcactcaccgcagggtgagacccttagggcagcgggtgctacactgaacaaagcggtgaacagccccctcgtgagagggggttcttggcagatgacgccagcagctgacaaacaggcaaggcaggccgggccacggtggctcacgcttgtaatcccagcactttgggagtccaaggccatcaccatcgaggctgagccaagagctgatggcagccgccggaccacccgctatgacatcgacatgaccaagtgcatctactgcggcttctgccaggaggcctgtcccgtggatgccatcgtcgagggccccaactttgagttctccacggagacccatgaggagctgctgtacaacaaggagaagttgctcaacaacggggacaagtgggaggccgagatcgccgccaacatccaggctgactacttgtatcggtgacgccccaccggcccgcagcccctgctgcccaataaaaccactccgacccca

SEQ ID NO: 111792 - DNA, 1208 bp, Homo sapiens
acagaaaagggggaacccgctggcccaatggcagcgtcctacagtgtagcctccgcctcccgattgactggcctgcttggcaaggcaagtagcggcggcgcttcaaggtgggtgttcacgttttggccgtgaaagtcgggcttgggcagcgtggcgtcgggggcgagtgtggtgtccccgttggcgccgccagctctgcgcctgggcttcccctcggctcactcaggatccgcggcctccgtgtccttcaggtgcagcggggagccggctctcagggcgcatgcgccgcccgctctgcgccaccggcctagttagggtcggagatcactgggaaggtggggaaggtgctgggttgggtccctggaactgcagtcagtgatccaaaggagtgggcctgttagggggttcacaggtcgtgggatgagctcttatgagcgccggctaagtgccgggctctggggtgcccttggcatgtacgggctcccctaattcccaagaccaaccgcccccaacccacttcatagatgcgctgcctgaccacgcctatgctgctgcgggccctggcccaggctgcacgtgcaggacctcctggtggccggagcctccacagcagtgcagtggcagccacctacaagtatgtgaacatgcaggatcccgagatggacatgaagtcagtgactgaccgggcagcccgcaccctgctgtggactgagctcttccgaggcctgggcatgaccctgagctacctgttccgggaaccggccaccatcaactacccgttcgagaagggcccgctgagccctcgcttccgtggggagcatgcgctgcgccggtacccatccggggaggagcgttgcattgcctgcaagctctgcgaggccatctgccccgcccaggccatcaccatcgaggctgagccaagagctgatggcagccgccggaccacccgctatgacatcgacatgaccaagtgcatctactgcggcttctgccaggaggcctgtcccgtggatgccatcgtcgagggccccaactttgagttctccacggagacccatgaggagctgctgtacaacaaggagaagttgctcaacaacggggacaagtgggaggccgagatcgccgccaacatccaggctgactacttgtatcggtgacgccccaccggcccgcagcccctgctgcccaataaaaccactccgacccca

SEQ ID NO: 111793 - DNA, 1105 bp, Homo sapiens
tttccacccctgggcacggttcctgggggaggagagctaacaaagttcgctctcagtgcatgctggcgggggctggtaatgttgtttttggttagatttggggaggatgaagggaggagcagaaaggtgggaaacaggatctctgggagggagaaaggaaggatggatttaaaaggtttcttaggtgaggcagaacttggggtccacagaaactgaattgtagctcagccaagctgaatcagatggaaagctgggaggcgctgggaacaggaaagccatctgtgcctctgacagcaatggggtgcgagtagagggcaaagtgacacatgtcagtggagacttgggatccttgcggtgccagtctcagaagaggatggttcttgggcacaccccaccctccatccctttttatgccaccagaatgcgctgcctgaccacgcctatgctgctgcgggccctggcccaggctgcacgtgcaggacctcctggtggccggagcctccacagcagtgcagtggcagccacctacaagtatgtgaacatgcaggatcccgagatggacatgaagtcagtgactgaccgggcagcccgcaccctgctgtggactgagctcttccgaggcctgggcatgaccctgagctacctgttccgggaaccggccaccatcaactacccgttcgagaagggcccgctgagccctcgcttccgtggggagcatgcgctgcgccggtacccatccggggaggagcgttgcattgcctgcaagctctgcgaggccatctgccccgcccaggccatcaccatcgaggctgagccaagagctgatggcagccgccggaccacccgctatgacatcgacatgaccaagtgcatctactgcggcttctgccaggaggcctgtcccgtggatgccatcgtcgagggccccaactttgagttctccacggagacccatgaggagctgctgtacaacaaggagaagttgctcaacaacggggacaagtgggaggccgagatcgccgccaacatccaggctgactacttgtatcggtgacgccccaccggcccgcagcccctgctgcccaataaaaccactccgacccca

SEQ ID NO: 111794 - DNA, 953 bp, Homo sapiens
acagaaaagggggaacccgctggcccaatggcagcgtcctacagtgtagcctccgcctcccgattgactggcctgcttggcaaggcaagtagcggcggcgcttcaagatgcgctgcctgaccacgcctatgctgctgcgggccctggcccaggctgcacgtgcaggacctcctggtggccggagcctccacagcagtgcagtggcagccacctacaagtatgtgaacatgcaggatcccgagatggacatgaagtcagtgactgaccgggcagcccgcaccctgctgtggactgagctcttccgaggcctgggcatgaccctgagctacctgttccgggaaccggccaccatcaactacccgttcgagaagggcccgctgagccctcgcttccgtggggagcatgcgctgcgccggtacccatccggggaggagcgttgcattgcctgcaagctctgcgaggccatctgccccgcccagggtgagacccttagggcagcgggtgctacactgaacaaagcggtgaacagccccctcgtgagagggggttcttggcagatgacgccagcagctgacaaacaggcaaggcaggccgggccacggtggctcacgcttgtaatcccagcactttgggagtccaaggccatcaccatcgaggctgagccaagagctgatggcagccgccggaccacccgctatgacatcgacatgaccaagtgcatctactgcggcttctgccaggaggcctgtcccgtggatgccatcgtcgagggccccaactttgagttctccacggagacccatgaggagctgctgtacaacaaggagaagttgctcaacaacggggacaagtgggaggccgagatcgccgccaacatccaggctgactacttgtatcggtgacgccccaccggcccgcagcccctgctgcccaataaaaccactccgacccca

SEQ ID NO: 111795 - DNA, 3822 bp, Homo sapiens
  misc_feature (1227)..(1227): n is a, c, g, or t
acagaaaagggggaacccgctggcccaatggcagcgtcctacagtgtagcctccgcctcccgattgactggcctgcttggcaaggcaagtagcggcggcgcttcaagatgcgctgcctgaccacgcctatgctgctgcgggccctggcccaggctgcacgtgcaggacctcctggtggccggagcctccacagcagtgcagtggcagccacctacagtgagtacctgggtggcctctagcctcaggtgttcctgactggtcctgctggagtaggggaagagacctgagttccagtcctggctttgtcaggggcgttcttctctgagcctgtttccacttttcgaggttagcatgtgtgatctcagagctccctgggtgtgatggggagggggttgccaggtgtgagccatgggtacctgtgcctattgccagtccctggtgaaggcaaaggctcaagccccccacctaccccccttgattcctctttcaagccctgttgggcagggaagtgcgtctgggctccaatggccacccaagcacagggagaggtaggcacggacgggctcaggccagaggcggcctccagggtccttgctgaggctggggagaggtgtggtgagtgtacagcccctttgtagcccagcagttgcacctggaagtgagggccaggctgctctccctgaggctccagggagacagtgtgtgaggcctcttgccatggcctccctgcccgcctctctgcagagtatgtgaacatgcaggatcccgagatggacatgaagtcagtgactgaccgggcagcccgcaccctgctgtggactgagctcttccgaggcctgggcatgaccctgagctacctgttccgggaaccggccaccatcaactacccgttcgagaagggcccgctgagccctcgcttccgtggggagcatgcgctgcgccggtacccatccggggaggagcgttgcattgcctgcaagctctgcgaggccatctgccccgcccaggtgagcccctgccccaaccggccaccacgccagcccctgccactgggagagggaggccaggcagccctaggcccaaaccctagcccctgcttgatgtgcgtccccaggaagtccctttccccctctgagccacttccctcgtgaatgggaatgatgagggcttgttaccagagcacagagtcagtgagttggcagagtgaagcttccagccctgggcagncgcctgacacacagaggttcccccttggggtctggccaagggtgtgacccctgggcctctgagccatggggtgacacctgaggccatccacgcctccctggatgtagccaccgtttccggagtcctgcttgtgtgcctgttgcagcttcccttccccagtggctgctcccctgaggcccggctttccgttctcttagtgggtctcgtgcttacccgtgggggccaggcctgccagcacgggaacaatatgactcggtcagagctctggtcagacccctgtgtgtgcctggcaggagccccggcagccgccgtcgctactttctgtgtgcacagcaacccctcccagtgttctgtgactcgggtggctcctgtccagatcctagtttgtcctctggagcactcccaggtcctccaggccatgagctgcggccctgatgtctctactccagccacggactgagagtgcataggagtgtccccaaacagcagtcacgatggtcacaaccttggcttccagacagtgagtgctgtccacagacagacccgttgctgtgccatgtgtgtgactcacagcctctcctgtaatctccacaacccctcgaggaggtcgaggttattgtctccatctttataagcactaaaggatgagcctgccagccacaggtcccactgtgagttgtggacactacatttctgggatgggggcatatgagagtccttgccaagcacatttgaaggttttcccagccagcccctcccccagcgggctacccaggaactgagagttaggacgtgcccttgagtttgggctgtgcccccacttgctgtgtagctttggggagcccctcaacctctcggaaccttgtttttctcatccatcaaatggagagaagtagatttaaggcacaggattgcacccaacagtgtaggcattcttggcgatgttgcaggttcggctccagaccatcggggtaaactgagtcacacagctgttttggttttccagtgcatttaaaagttagatttagaccgggcacagtggctcatgcctgtaattccagcactttgagaagccgaggtgggcggatcacttgaggtcaagagttcgagaccagcctggccaacatagtgaaaccccgtctctactaaaaataacaaaacttagccgggcacgttggcaggtccctgtaatctcagctacttgctaggctgaggcacgataatcacttgaaccgggaggtgggggttgcagtgagccaaaattgaaaaaaaaaaaaaattagggccggttgcggtggctcacgcctgtaatcccagcactttgggaggccaaggtgggcggatcacaaggtcaggaattcaagaccagcctggccaacatgttgaaaccccgtctctagtaaaaatacaaaaattagccgggtgtggggttgcacacctgtagtcccagctactcaagaggctgaggcaggagaattgcttgaacctgggaggcggaggttgcagtgaactatgattgcaccaccatactccatcctgggccacagagcaagacttcgtctcaaaaaaaaaaaaggatttacactgtactgtaggctgcgaagtgtctaaaacacaatgtatataccttaattaaaaatactttaggggccaggcacagtggctcacacctgtagtccaagtgctttgggaggtcaaggtgaggggattacttgagcccaggagtttgagaccagcctgggcaacatggcaaaaccccgactctacaacaacaacaaaaaatacaaaaaattagcccctgtaggcccagttacttgggaggttgaggtgggaggatcgcttgagcctgggaggttgaggctgcagtgagctatgagctgcaccactgtactccagcctgggtgacagggcaagactctgtctcaaaaaacaaaaacaacaacaaaaactttattcctaaaaagtgctgacccagagataagaagcaagcacatggttggtaaaatgacatcagtgagcttgctttatgcagggttgccccaaaccttcaatttgtaaaactcaaaatatctggaaagcttggtgaggcgaggcgggactgtaactcagcactcaccgcagggtgagacccttagggcagcgggtgctacactgaacaaagcggtgaacagccccctcgtgagagggggttcttggcagatgacgccagcagctgacaaacaggcaaggcaggccgggccacggtggctcacgcttgtaatcccagcactttgggagtccaaggccatcaccatcgaggctgagccaagagctgatggcagccgccggaccacccgctatgacatcgacatgaccaagtgcatctactgcggcttctgccaggaggcctgtcccgtggatgccatcgtcgagggccccaactttgagttctccacggagacccatgaggagctgctgtacaacaaggagaagttgctcaacaacggggacaagtgggaggccgagatcgccgccaacatccaggctgactacttgtatcggtgacgccccaccggcccgcagcccctgctgcccaataaaaccactccgacccca

SEQ ID NO: 111796 - DNA, 3111 bp, Homo sapiens
  misc_feature (516)..(516): n is a, c, g, or t
acagaaaagggggaacccgctggcccaatggcagcgtcctacagtgtagcctccgcctcccgattgactggcctgcttggcaaggcaagtagcggcggcgcttcaagatgcgctgcctgaccacgcctatgctgctgcgggccctggcccaggctgcacgtgcaggacctcctggtggccggagcctccacagcatgagccctcgcttccgtggggagcatgcgctgcgccggtacccatccggggaggagcgttgcattgcctgcaagctctgcgaggccatctgccccgcccaggtgagcccctgccccaaccggccaccacgccagcccctgccactgggagagggaggccaggcagccctaggcccaaaccctagcccctgcttgatgtgcgtccccaggaagtccctttccccctctgagccacttccctcgtgaatgggaatgatgagggcttgttaccagagcacagagtcagtgagttggcagagtgaagcttccagccctgggcagncgcctgacacacagaggttcccccttggggtctggccaagggtgtgacccctgggcctctgagccatggggtgacacctgaggccatccacgcctccctggatgtagccaccgtttccggagtcctgcttgtgtgcctgttgcagcttcccttccccagtggctgctcccctgaggcccggctttccgttctcttagtgggtctcgtgcttacccgtgggggccaggcctgccagcacgggaacaatatgactcggtcagagctctggtcagacccctgtgtgtgcctggcaggagccccggcagccgccgtcgctactttctgtgtgcacagcaacccctcccagtgttctgtgactcgggtggctcctgtccagatcctagtttgtcctctggagcactcccaggtcctccaggccatgagctgcggccctgatgtctctactccagccacggactgagagtgcataggagtgtccccaaacagcagtcacgatggtcacaaccttggcttccagacagtgagtgctgtccacagacagacccgttgctgtgccatgtgtgtgactcacagcctctcctgtaatctccacaacccctcgaggaggtcgaggttattgtctccatctttataagcactaaaggatgagcctgccagccacaggtcccactgtgagttgtggacactacatttctgggatgggggcatatgagagtccttgccaagcacatttgaaggttttcccagccagcccctcccccagcgggctacccaggaactgagagttaggacgtgcccttgagtttgggctgtgcccccacttgctgtgtagctttggggagcccctcaacctctcggaaccttgtttttctcatccatcaaatggagagaagtagatttaaggcacaggattgcacccaacagtgtaggcattcttggcgatgttgcaggttcggctccagaccatcggggtaaactgagtcacacagctgttttggttttccagtgcatttaaaagttagatttagaccgggcacagtggctcatgcctgtaattccagcactttgagaagccgaggtgggcggatcacttgaggtcaagagttcgagaccagcctggccaacatagtgaaaccccgtctctactaaaaataacaaaacttagccgggcacgttggcaggtccctgtaatctcagctacttgctaggctgaggcacgataatcacttgaaccgggaggtgggggttgcagtgagccaaaattgaaaaaaaaaaaaaattagggccggttgcggtggctcacgcctgtaatcccagcactttgggaggccaaggtgggcggatcacaaggtcaggaattcaagaccagcctggccaacatgttgaaaccccgtctctagtaaaaatacaaaaattagccgggtgtggggttgcacacctgtagtcccagctactcaagaggctgaggcaggagaattgcttgaacctgggaggcggaggttgcagtgaactatgattgcaccaccatactccatcctgggccacagagcaagacttcgtctcaaaaaaaaaaaaggatttacactgtactgtaggctgcgaagtgtctaaaacacaatgtatataccttaattaaaaatactttaggggccaggcacagtggctcacacctgtagtccaagtgctttgggaggtcaaggtgaggggattacttgagcccaggagtttgagaccagcctgggcaacatggcaaaaccccgactctacaacaacaacaaaaaatacaaaaaattagcccctgtaggcccagttacttgggaggttgaggtgggaggatcgcttgagcctgggaggttgaggctgcagtgagctatgagctgcaccactgtactccagcctgggtgacagggcaagactctgtctcaaaaaacaaaaacaacaacaaaaactttattcctaaaaagtgctgacccagagataagaagcaagcacatggttggtaaaatgacatcagtgagcttgctttatgcagggttgccccaaaccttcaatttgtaaaactcaaaatatctggaaagcttggtgaggcgaggcgggactgtaactcagcactcaccgcagggtgagacccttagggcagcgggtgctacactgaacaaagcggtgaacagccccctcgtgagagggggttcttggcagatgacgccagcagctgacaaacaggcaaggcaggccgggccacggtggctcacgcttgtaatcccagcactttgggagtccaaggccatcaccatcgaggctgagccaagagctgatggcagccgccggaccacccgctatgacatcgacatgaccaagtgcatctactgcggcttctgccaggaggcctgtcccgtggatgccatcgtcgagggccccaactttgagttctccacggagacccatgaggagctgctgtacaacaaggagaagttgctcaacaacggggacaagtgggaggccgagatcgccgccaacatccaggctgactacttgtatcggtgacgccccaccggcccgcagcccctgctgcccaataaaaccactccgacccca

SEQ ID NO: 111797 - DNA, 791 bp, Homo sapiens
acagaaaagggggaacccgctggcccaatggcagcgtcctacagtgtagcctccgcctcccgattgactggcctgcttggcaaggcaagtagcggcggcgcttcaagatgcgctgcctgaccacgcctatgctgctgcgggccctggcccaggctgcacgtgcaggacctcctggtggccggagcctccacagcagtgcagtggcagccacctacaagtatgtgaacatgcaggatcccgagatggacatgaagtcagtgactgaccgggcagcccgcaccctgctgtggactgagctcttccgaggcctgggcatgaccctgagctacctgttccgggaaccggccaccatcaactacccgttcgagaagggcccgctgagccctcgcttccgtggggagcatgcgctgcgccggtacccatccggggaggagcgttgcattgcctgcaagctctgcgaggccatctgccccgcccaggccatcaccatcgaggctgagccaagagctgatggcagccgccggaccacccgctatgacatcgacatgaccaagtgcatctactgcggcttctgccaggaggcctgtcccgtggatgccatcgtcgagggccccaactttgagttctccacggagacccatgaggagctgctgtacaacaaggagaagttgctcaacaacggggacaagtgggaggccgagatcgccgccaacatccaggctgactacttgtatcggtgacgccccaccggcccgcagcccctgctgcccaataaaaccactccgacccca

SEQ ID NO: 111798 - DNA, 1065 bp, Homo sapiens
acagaaaagggggaacccgctggcccaatggcagcgtcctacagtgtagcctccgcctcccgattgactggcctgcttggcaaggcaagtagcggcggcgcttcaagatgcgctgcctgaccacgcctatgctgctgcgggccctggcccaggctgcacgtgcaggacctcctggtggccggagcctccacagcagtgcagtggcagccacctacaagtatgtgaacatgcaggatcccgagatggacatgaagtcagtgactgaccgggcagcccgcaccctgctgtggactgagctcttccgaggcctgggcatgaccctgagctacctgttccgggaaccggccaccatcaactacccgttcgagaagggcccgctgagccctcgcttccgtggggagcatgcgctgcgccggtacccatccggggaggagcgttgcattgcctgcaagctctgcgaggccatctgccccgcccaggccatcaccatcgaggctgagccaagagctgatggcagccgccggaccacccgctatgacatcgacatgaccaagtgcatctactgcggcttctgccaggaggcctgtcccgtggatgccatcgtcgagggccccaactttgagttctccacggagacccatgaggagctgctgtacaacaaggagaagttgctcaacaacggggacaagtgggaggccgagatcgccgccaacatccaggctgactacttgtatcggtgacgccccaccggcccgcagcccctgctgcccaataaaaccactccgaccccagaaaaaacaaaaacacaacacaaaaaacaaaaacaaaaaaagtggttgtcgcgccccgccgggcacccaagaagaaaatttctaacaacccatctccggtggggcgcgcgcggcggcggccacgtatgggttcgtcgtcaaacacgggcgcacaagagggtgtccacgagagaaaaaccggggtcacaagacacaggggtccgggtcttctctccccaatataaaaaagccccgggggcaaacccggggcttccgtgaacaatccccgatgggg

SEQ ID NO: 111799 - DNA, 935 bp, Homo sapiens
acagaaaagggggaacccgctggcccaatggcagcgtcctacagtgtagcctccgcctcccgattgactggcctgcttggcaaggcaagtagcggcggcgcttcaaggtgggtgttcacgttttggccgtgaaagtcgggcttgggcagcgtggcgtcgggggcgagtgtggtgtccccgttggcgccgccagctctgcgcctgggcttcccctcggctcactcaggatccgcggcctccgtgtccttcagatgcgctgcctgaccacgcctatgctgctgcgggccctggcccaggctgcacgtgcaggacctcctggtggccggagcctccacagcagtgcagtggcagccacctacaagtatgtgaacatgcaggatcccgagatggacatgaagtcagtgactgaccgggcagcccgcaccctgctgtggactgagctcttccgaggcctgggcatgaccctgagctacctgttccgggaaccggccaccatcaactacccgttcgagaagggcccgctgagccctcgcttccgtggggagcatgcgctgcgccggtacccatccggggaggagcgttgcattgcctgcaagctctgcgaggccatctgccccgcccaggccatcaccatcgaggctgagccaagagctgatggcagccgccggaccacccgctatgacatcgacatgaccaagtgcatctactgcggcttctgccaggaggcctgtcccgtggatgccatcgtcgagggccccaactttgagttctccacggagacccatgaggagctgctgtacaacaaggagaagttgctcaacaacggggacaagtgggaggccgagatcgccgccaacatccaggctgactacttgtatcggtgacgccccaccggcccgcagcccctgctgcccaataaaaccactccgacccca

SEQ ID NO: 111800 - DNA, 716 bp, Homo sapiens
cggcacgaggcttaagctgcgctggttcatgaatgcgctgcctgaccacgcctatgctgctgcgggccctggcccaggctgcacgtgcaggacctcctggtggccggagcctccacagcagtgcagtggcagccacctacaagtatgtgaacatgcaggatcccgagatggacatgaagtcagtgactgaccgggcagcccgcaccctgctgtggactgagctcttccgaggcctgggcatgaccctgagctacctgttccgggaaccggccaccatcaactacccgttcgagaagggcccgctgagccctcgcttccgtggggagcatgcgctgcgccggtacccatccggggaggagcgttgcattgcctgcaagctctgcgaggccatctgccccgcccaggccatcaccatcgaggctgagccaagagctgatggcagccgccggaccacccgctatgacatcgacatgaccaagtgcatctactgcggcttctgccaggaggcctgtcccgtggatgccatcgtcgagggccccaactttgagttctccacggagacccatgaggagctgctgtacaacaaggagaagttgctcaacaacggggacaagtgggaggccgagatcgccgccaacatccaggctgactacttgtatcggtgacgccccaccggcccgcagcccctgctgcccaataaaaccactccgacccca

SEQ ID NO: 111801 - DNA, 1682 bp, Homo sapiens
  misc_feature (699)..(699): n is a, c, g, or t
acagaaaagggggaacccgctggcccaatggcagcgtcctacagtgtagcctccgcctcccgattgactggcctgcttggcaaggcaagtagcggcggcgcttcaagatgcgctgcctgaccacgcctatgctgctgcgggccctggcccaggctgcacgtgcaggacctcctggtggccggagcctccacagcagtgcagtggcagccacctacaagtatgtgaacatgcaggatcccgagatggacatgaagtcagtgactgaccgggcagcccgcaccctgctgtggactgagctcttccgaggcctgggcatgaccctgagctacctgttccgggaaccggccaccatcaactacccgttcgagaagggcccgctgagccctcgcttccgtggggagcatgcgctgcgccggtacccatccggggaggagcgttgcattgcctgcaagctctgcgaggccatctgccccgcccaggtgagcccctgccccaaccggccaccacgccagcccctgccactgggagagggaggccaggcagccctaggcccaaaccctagcccctgcttgatgtgcgtccccaggaagtccctttccccctctgagccacttccctcgtgaatgggaatgatgagggcttgttaccagagcacagagtcagtgagttggcagagtgaagcttccagccctgggcagncgcctgacacacagaggttcccccttggggtctggccaagggtgtgacccctgggcctctgagccatggggtgacacctgaggccatccacgcctccctggatgtagccaccgtttccggagtcctgcttgtgtgcctgttgcagcttcccttccccagtggctgctcccctgaggcccggctttccgttctcttagtgggtctcgtgcttacccgtgggggccaggcctgccagcacgggaacaatatgactcggtcagagctctggtcagacccctgtgtgtgcctggcaggagccccggcagccgccgtcgctactttctgtgtgcacagcaacccctcccagtgttctgtgactcgggtggctcctgtccagatcctagtttgtcctctggagcactcccaggtcctccaggccatgagctgcggccctgatgtctctactccagccacggactgagagtgcataggagtgtccccaaacagcagtcacgatggtcacaaccttggcttccagacagtgagtgctgtccacagacagacccgttgctgtgccatgtgtgtgactcacagcctctcctgtaatctccacaacccctcgaggaggtcgaggttattgtctccatctttataagcactaaaggatgagcctgccagccacaggtcccactgccatcaccatcgaggctgagccaagagctgatggcagccgccggaccacccgctatgacatcgacatgaccaagtgcatctactgcggcttctgccaggaggcctgtcccgtggatgccatcgtcgagggccccaactttgagttctccacggagacccatgaggagctgctgtacaacaaggagaagttgctcaacaacggggacaagtgggaggccgagatcgccgccaacatccaggctgactacttgtatcggtgacgccccaccggcccgcagcccctgctgcccaataaaaccactccgacccca

SEQ ID NO: 111802 - DNA, 3477 bp, Homo sapiens
  misc_feature (882)..(882): n is a, c, g, or t
acagaaaagggggaacccgctggcccaatggcagcgtcctacagtgtagcctccgcctcccgattgactggcctgcttggcaaggcaagtagcggcggcgcttcaagatgcgctgcctgaccacgcctatgctgctgcgggccctggcccaggctgcacgtgcaggacctcctggtggccggagcctccacagcagtgcagtggcagccacctacagtgagtacctgggtggcctctagcctcaggtgttcctgactggtcctgctggagtaggggaagagacctgagttccagtcctggctttgtcaggggcgttcttctctgagcctgtttccacttttaaaatgattatggtgatggagactgactctgattcacaggggcagggtccatcattgcagtatgtgaacatgcaggatcccgagatggacatgaagtcagtgactgaccgggcagcccgcaccctgctgtggactgagctcttccgaggcctgggcatgaccctgagctacctgttccgggaaccggccaccatcaactacccgttcgagaagggcccgctgagccctcgcttccgtggggagcatgcgctgcgccggtacccatccggggaggagcgttgcattgcctgcaagctctgcgaggccatctgccccgcccaggtgagcccctgccccaaccggccaccacgccagcccctgccactgggagagggaggccaggcagccctaggcccaaaccctagcccctgcttgatgtgcgtccccaggaagtccctttccccctctgagccacttccctcgtgaatgggaatgatgagggcttgttaccagagcacagagtcagtgagttggcagagtgaagcttccagccctgggcagncgcctgacacacagaggttcccccttggggtctggccaagggtgtgacccctgggcctctgagccatggggtgacacctgaggccatccacgcctccctggatgtagccaccgtttccggagtcctgcttgtgtgcctgttgcagcttcccttccccagtggctgctcccctgaggcccggctttccgttctcttagtgggtctcgtgcttacccgtgggggccaggcctgccagcacgggaacaatatgactcggtcagagctctggtcagacccctgtgtgtgcctggcaggagccccggcagccgccgtcgctactttctgtgtgcacagcaacccctcccagtgttctgtgactcgggtggctcctgtccagatcctagtttgtcctctggagcactcccaggtcctccaggccatgagctgcggccctgatgtctctactccagccacggactgagagtgcataggagtgtccccaaacagcagtcacgatggtcacaaccttggcttccagacagtgagtgctgtccacagacagacccgttgctgtgccatgtgtgtgactcacagcctctcctgtaatctccacaacccctcgaggaggtcgaggttattgtctccatctttataagcactaaaggatgagcctgccagccacaggtcccactgtgagttgtggacactacatttctgggatgggggcatatgagagtccttgccaagcacatttgaaggttttcccagccagcccctcccccagcgggctacccaggaactgagagttaggacgtgcccttgagtttgggctgtgcccccacttgctgtgtagctttggggagcccctcaacctctcggaaccttgtttttctcatccatcaaatggagagaagtagatttaaggcacaggattgcacccaacagtgtaggcattcttggcgatgttgcaggttcggctccagaccatcggggtaaactgagtcacacagctgttttggttttccagtgcatttaaaagttagatttagaccgggcacagtggctcatgcctgtaattccagcactttgagaagccgaggtgggcggatcacttgaggtcaagagttcgagaccagcctggccaacatagtgaaaccccgtctctactaaaaataacaaaacttagccgggcacgttggcaggtccctgtaatctcagctacttgctaggctgaggcacgataatcacttgaaccgggaggtgggggttgcagtgagccaaaattgaaaaaaaaaaaaaattagggccggttgcggtggctcacgcctgtaatcccagcactttgggaggccaaggtgggcggatcacaaggtcaggaattcaagaccagcctggccaacatgttgaaaccccgtctctagtaaaaatacaaaaattagccgggtgtggggttgcacacctgtagtcccagctactcaagaggctgaggcaggagaattgcttgaacctgggaggcggaggttgcagtgaactatgattgcaccaccatactccatcctgggccacagagcaagacttcgtctcaaaaaaaaaaaaggatttacactgtactgtaggctgcgaagtgtctaaaacacaatgtatataccttaattaaaaatactttaggggccaggcacagtggctcacacctgtagtccaagtgctttgggaggtcaaggtgaggggattacttgagcccaggagtttgagaccagcctgggcaacatggcaaaaccccgactctacaacaacaacaaaaaatacaaaaaattagcccctgtaggcccagttacttgggaggttgaggtgggaggatcgcttgagcctgggaggttgaggctgcagtgagctatgagctgcaccactgtactccagcctgggtgacagggcaagactctgtctcaaaaaacaaaaacaacaacaaaaactttattcctaaaaagtgctgacccagagataagaagcaagcacatggttggtaaaatgacatcagtgagcttgctttatgcagggttgccccaaaccttcaatttgtaaaactcaaaatatctggaaagcttggtgaggcgaggcgggactgtaactcagcactcaccgcagggtgagacccttagggcagcgggtgctacactgaacaaagcggtgaacagccccctcgtgagagggggttcttggcagatgacgccagcagctgacaaacaggcaaggcaggccgggccacggtggctcacgcttgtaatcccagcactttgggagtccaaggccatcaccatcgaggctgagccaagagctgatggcagccgccggaccacccgctatgacatcgacatgaccaagtgcatctactgcggcttctgccaggaggcctgtcccgtggatgccatcgtcgagggccccaactttgagttctccacggagacccatgaggagctgctgtacaacaaggagaagttgctcaacaacggggacaagtgggaggccgagatcgccgccaacatccaggctgactacttgtatcggtgacgccccaccggcccgcagcccctgctgcccaataaaaccactccgacccca

SEQ ID NO: 111803 - DNA, 910 bp, Homo sapiens
acagaaaagggggaacccgctggcccaatggcagcgtcctacagtgtagcctccgcctcccgattgactggcctgcttggcaaggcaagtagcggcggcgcttcaaggtgggtgttcacgttttggccgtgaaagtcgggcttgggcagcgtggcgtcgggggcgagtgtggtgtccccgttggcgccgccagctctgcgcctgggcttcccctcggctcactcaggatccgcggcctccgtgtccttcaggtgcagcggggagccggctctcagggcgcatgcgccgcccgctctgcgccaccggcctagttagggtcggagatcactgggaagagtatgtgaacatgcaggatcccgagatggacatgaagtcagtgactgaccgggcagcccgcaccctgctgtggactgagctcttccgaggcctgggcatgaccctgagctacctgttccgggaaccggccaccatcaactacccgttcgagaagggcccgctgagccctcgcttccgtggggagcatgcgctgcgccggtacccatccggggaggagcgttgcattgcctgcaagctctgcgaggccatctgccccgcccaggccatcaccatcgaggctgagccaagagctgatggcagccgccggaccacccgctatgacatcgacatgaccaagtgcatctactgcggcttctgccaggaggcctgtcccgtggatgccatcgtcgagggccccaactttgagttctccacggagacccatgaggagctgctgtacaacaaggagaagttgctcaacaacggggacaagtgggaggccgagatcgccgccaacatccaggctgactacttgtatcggtgacgccccaccggcccgcagcccctgctgcccaataaaaccactccgacccca

SEQ ID NO: 111804 - DNA, 375 bp, Homo sapiens
cctggctaatttttgtattttttgtagagatagggtttcaccagggttgttcaggctggtctcgaactcctgggcctcctagagtgctggaattaaagccagcctgggtgtgagccattgcacccagccaaaacttttaattatgaaattattttagattcacagtaaatttgcaaaaatatgcagaagatttctgcatacccttcacccagttcccctaatgttagcatcttacatagctatagtagaatgtttgaaactaggcaataagaaatactgaatactgatatagtgctattaggtaaaatataggccttattttaaatttcattttttccagtaatgtctttttctctattctgaatcccatactgt

SEQ ID NO: 111805 - DNA, 569 bp, Homo sapiens
aacacagccatgcgtcgacgtttatgtgttatgtagggctgcctgagttaagtagttggctacaaagcctatcatggcctataaagcctgaaatacttactatctggtcctttatagaaagtgttttctgaccctgtactagactagcttgtctcaaaattcttcaatgaatttggaagttttctcaccacattttctgaccataatgcacttgagttagaagtaaataagcagataaacaacaaaatcctcatgcatttggaaattaaaaataacacttaaataattcatattcaaagaaaaaatcaaactggaaattaaaaaaaattttaaacctacagataactacattaatatgcattaacatttttagaacttagggatagttacaatgatatacattaaaactggtaagaggctgggtgcgttggctcacgcctgtaatcccagcactttgggaggccgaggctgggggatcacgaggtcaagagattgaaaccatcctggccaacatggtgaaaccccgtctctactaaaaatacaaaaatcagctgggcgtggtggcacgc

SEQ ID NO: 111806 - DNA, 352 bp, Homo sapiens
acacccctcattccttaggaggcaattcgaatcaaaaacgtaatggacattcacagagctttcgttccctgccaggtactctgctaagcacacgtcttatattaccgtatttaattctcacagcaaccataagagataggctttacttttactttaaagagatcttgagaggtaagataaattttcctaggtcactcacctgttaagtggtagagttagaatttaaacctgggcagtgtatctatactcaaccactgtgctatactggcttcactgtagtctactaaaatactgtcctaaaaataaaaataaagctaaaagagcactttcaaagccaccatttgttattatg

SEQ ID NO: 111807 - DNA, 218 bp, Homo sapiens
tgaatgttattaataaaatacataaattatttaaattgtgtgacactgtaagattttttccacatcagataactttaaaaaatgtatctttcaggccaggtgcggtggctcatgcctgtaatcccagcactttggaggctgaggcagaagaatcacttgaacccgagaggtggaggttgcagtgagctgagatcacaccactgcactccagcatgggt

SEQ ID NO: 111808 - DNA, 351 bp, Homo sapiens
tgcaaggctataggtggaagttcaaaatggtacaacttctttgcaggggaattttgcaatatctaattacatatgcatttgtcgtttgatgaagcaatctcctcctcatctaagaagatttcaagaataccaaaaaaatacatacacaaagtaattctctggggcattgtataaaatagctaaatattgaaaacaatctaaatacccaaccacagaagactggtttactcaattatggtaaaaccaagtaatggagtactatacagcaataagaaatgaatgaagaaggtttctgtgaactgatacagaatgatttccaagatatattgttaagtaaacaaaacatagtac

SEQ ID NO: 111809 - DNA, 637 bp, Homo sapiens
acattttatatgttaaagaatattgatctcagaccaataaccaatattatacttagcaataaaacattagaagcatttccactgatgttagtaattcaactataattaccattatttaacattattctggaagtgctcatcaatgtaacaatgagaaaaggaaatgagggaggtataaatatttgataggaagagataaaattatcatttttccaagatgatatggttgcttgagaaactattagacttaagacacttagaaagtttggcaattataacagaaatattaaaaaactaatagctttcctatatatatcagcaatactctgttaagatagataatggaagaaagaactcatatatgacagcaataaaaaaatcaaagcacctaggaataaacttaatgataaatgtacatatctacaaaactttaccatgaaatctagaaagaaatttgaatacagggaaaggcagtccacatttctgtattagaaaatttaaaattgtaaaggtattaaatttcctcaagctaaacctataaatttaacaaaatcccaataaaaatacctgggaactatttttagaatgtgaaaaaaaaactattttaaggcttatttagaaaaataaatgaagaatg

SEQ ID NO: 111810 - DNA, 654 bp, Homo sapiens
gaacccaccctgtctgctgagactaagttattaggtcaaagagatgcttgatatatgtggaatttgaatacagattcattgtgtgagccagctctgatttgttggttgcggctgcctggaactcctatgtttgggagcatctgagctcatcaggaaagagagctgtgatcccatagtgatttctgctttaggtgcaggagaacagtaacccaggatcctctatccttcaactagaacagtgttagatgtttcaaagacatttctgttagactggggttaatacggtggattgcttttctcaactataggaataattccttaagggattatgctgatgtttagcattagaacatcttcagtgctggccaaataccctgcctttctgtagattgcattcaaggcctagcccttgtatcactccttggtaaattcttaattgatttagttgtatttttctttacatttcattcccaagaatattctttgggctctgatcataattggatatttctcaagtttctttgcttataatttatgtaccatttaaaaagatcatttagttttgtctattatatgtttactttgacaagttttactgtcaatgggtgactttctcatgacaataaactcaaattctagaagttgaaatgtgtg

SEQ ID NO: 111811 - DNA, 248 bp, Homo sapiens
cgtgagccaccgcacccggcctccatatcccccttttaaaattctgtagtgtatggtaagtcatatcagatatcagacctaatttaaatttcattttagctttacaagtccaaaaacacagaatttatatattcagatactctagcactaattttagtcttaaaatattcccacgatattctgtacacaaaatgttctttttgttacaagagctgagttgcatatactgtagataaatcatattattt

SEQ ID NO: 111812 - DNA, 468 bp, Homo sapiens
tttcttgaatgtggtatcttcacatcttggaccttggtcagttgtactattaattattaaaaactaaaactttggcagttcctgcatttaaaaaaaaaaagcacccacatgttaaaagtaaaaatgtaatgtcaggaaattattaagaaaatattttagcctcttcctttgcccgcttactttattctttacttttttgtgtgtgtgttccatagacatttattcacttctccaaagagacataaaatcaaatttttaatattttaagatttaggatataatggctatatgtgtatgtatacatcataggaacagaaaaaaatgtacagcagtccccccttattcatgggggatgtgtcccaataccctcaatggatgcctgaaactgtggatagtaccaagccctaacatgtactatgttcttttaatctgataactgagatggtaactaagttattaatgggcagg

SEQ ID NO: 111813 - DNA, 794 bp, Homo sapiens
ctttaatataagaactcaaatttgacttcataggtttacttctgaataaacattgaacaatgaggtaacaaaaaaagctcaccctaggagtgctttctaagcacccggcccagagttcaggctttgcattgatcgtgtaatcctcgccacagccttttgaggtggtttatggcatcatcccatcttcacagaggaggaaatggacacgtagaagggttgcatctatgatgtgtgagtgggaagtcaggggcccacattcacagccagaccctctaacccggagcccacactcttcaccccagtgcctgctgcctttcacacatctgtgtcggaatgaaacagacacaggcccgctccggcctcctggcattctgctgatccatgatgcctacaatgcctgtgcatgtcagatgccctgcacccacatgccaggctgtgtgaagggcacccaagatgtgttttaatcaaacacaaagacacacagtcatggaaatgactgtcatgaagggaaaggttcatgctctcgggtccctgggaacaggaggcacacatggcccaccatgcagggccacacagagaagcaccggggttggtcaggaggccgagggaacctttattgtcgattccaagagaaagaatgggtgagagagagtagtatgaataagtgtagtgggatctgggagggaggagctgtccctaattatctggtgtctgcccggggattggttaagtcaggggacagggaccaggacatgagagcctgaaggacctggttggggtgtgagctttaggtg

SEQ ID NO: 111814 - DNA, 764 bp, Homo sapiens
gaaatttgtgtaggaagagagcagtttgaagatagatgttggagatgtttccattgttatgtgattttattgttgaatcaatgccaatatgtcacctgttaaaaattcttgtgtctgcgcttttaaaacatttacaaacagctttctaagctattttaaaaaaatcttccaaatacagagtttttgtctttttaaatccacttgttaaaaacgtaaaatgcaataccttctggttagttttcatttactgtttaaaatctagaaagatagaaatttgctggtctaattcaacaaaatttgtgaataatcgagggatgtaattaaaaagtaaattttgtgattttgtaaatacagccaatgatgcatttatttcatctgatgtagacataattgtgaaaaattatttttgtttaaaaaagctgtcaaaaaccaaatatcaaaacatgttgatctttaaactagattttttatcaaattcaagcttttcagtaaatgcaaactaatcagaaggtgttatgtaatctcaatttttaacatgcggggggacttttgggactgtggggcattcctaactggagatgtccaccaaagacatgtccaggccgggcgcagtggctcatgcctgtaatcctagcactttgagaggccgaggcaggcggatcacgaggtcaggagattgagaccatcctggctaacacagtgaaaccccgtctctactaaaaacacaaaaaattagttgggcgtggtggcgggcgcttgtggtc

SEQ ID NO: 111815 - DNA, 285 bp, Homo sapiens
gatgagaaacaggctagtcacatagtttcaaagcatctccttgaaaagtatccatcacaaaggtaaatatagtagctttacagtggaaaagtctggcagatccaccaaaaccaagtcatcaaagctaacgtcaccagaagtgagacggacatcatgtgactcccaataaaacacacagcagaagacacacatggcttcttgatattctggccaaaaatgcatgcctggctataatcgtgaggaaacatcagacacacccaaattgagaaacattgtcaaaaccac

SEQ ID NO: 111816 - DNA, 344 bp, Homo sapiens
ttatgtttcagacgcaccctgtccctactagaatgtgcggggaggttgtatggggtcgtgactgggtctcctctgacgtggctgctgggtgactgtaaaaagtctgggatgtatctatgaagtatggttccttgcatcatgagggattgaggctagagggcaggaataaattgttctgaaacagttggtacaggttccccatgggatttcttctggggagctttgagtggtggaggcagggaaagtgtggatggcattctcagatcccacctcactttgaggttcagtgatttgccatcagctctagttagtgagagcccatagtcggtgggtcagaacataag

SEQ ID NO: 111817 - DNA, 296 bp, Homo sapiens
ctggtatgttaatagttcattgcttttttttcttgtgacagggtcttctgtcactctggctggagtaccgtgttgcaaacgtggctcattgcagccttgacctttcagggtccagcgatcctccttcctctacctccctagtagctgggacatgcaccaccgtgtatggccaattaaaaaaaatttttttttgtagagatggggtctcatgttgcccaggctggttgcaagctcctggactcaagcaatcctcccatctcagcctcccaaagtattctgggattacaggtgtgagc

SEQ ID NO: 111818 - DNA, 342 bp, Homo sapiens
cccggctggtctcgaactcctggcttcaagcagtcctcctacctcagcctctcacatggtgggattacaggtgtgagccactgcaacagccccaggtagtttcaaagccagtattcttaactacctcaccaaagtgaatgtggaaaagagaaaaagggaatagtacttttaaaaaacagttaactatagaaaacccaatcaaaattcattttccaattaagttattgcttagtaaatgaaaatattaaataaagaaccggctactgctccacatggcaaggaagtgtacttcagtgctgacaaccccattactcaggagaacagtttaactgtgatatatgg

SEQ ID NO: 111819 - DNA, 259 bp, Homo sapiens
gggaagtccaaagttgaagggacacaacttgtaagtgccttcttgctggtggggactctgcagagccctaaggtggcagagggcatcaaggtgaaaagctgagtgtgctagtttaggtctccttataaagtcactaatgccactcctgtgataatccattcaagggggtagagccctcatgacccaatcacctcttaaaggcctcacctttcaacaatgccacactggggattcagctttttttttttttttttttttg

SEQ ID NO: 111820 - DNA, 2589 bp, Homo sapiens
  misc_feature (1)..(1): n is a, c, g, or t
  misc_feature (66)..(66): n is a, c, g, or t
naagaacacacacaaacaaatgtgtatagagcgcgacgcgcgcgttacatcaagcgacgaggcaanccggtccccgcccccagacacgccgggctctcggggcaccacagccatgtgctcgttagcgtcaggcgctaccggcggccggggcgctgtggagaatgaggaggacctgccagaactgtcggacagcggggacgaggccgcctgggaggatgaggacgatgcagatctcccccacggcaagcagcagaccccctgcctgttctgtaacaggttattcacatctgctgaagaaacattttcacactgtaagtctgagcatcagtttaatattgacagcatggttcataaacatggacttgaattttatggatacattaagctaataaattttattagacttaagaatcctacagttgagtacatgaattccatatacaacccagtgccttgggagaaagaagagtatttgaagccagtattagaagatgaccttttacttcaatttgatgtagaagatctttatgaaccggtgtcagtacccttctcataccccaatggactcagtgaaaatacatctgttgttgaaaaattgaaacatatggaagccagggcactgtctgctgaagccgcattggccagagcacgtgaggatctgcaaaaaatgaaacaatttgctcaggattttgtgatgcacacagatgtcagaacctgctcgtcatctactagtgtcattgcggacctccaggaggatgaggatggtgtttatttcagctcatacgggcattatgggatacatgaagaaatgctaaaggacaaaatacgaacagaaagctaccgagatttcatataccaaaatccacatatcttcaaagacaaggtagttttggatgttgggtgtggaactggaattctctctatgtttgctgctaaagctggggcgaagaaggttcttggagttgatcaatctgaaatactttaccaggcaatggatattataagactaaataaacttgaagatactattacactaattaaaggaaagattgaagaagttcatcttcctgtagaaaaagtagatgttatcatatctgagtggatgggctattttcttctgtttgagtctatgttagattctgtcctttatgcaaagaacaaatacttggcaaaaggaggctcggtctaccctgacatttgcactatcagccttgtagcagtgagtgatgtgaataaacatgctgatagaattgctttttgggatgatgtctatggcttcaagatgtcctgcatgaagaaagcagttattccagaagctgttgtggaagttttagatccgaagactcttatttcagaaccttgtggtattaagcatatagattgccatacgacgtctatctcagatttggaattttcatcagattttaccctgaaaatcacaaggacatccatgtgcacggcaattgctggctactttgatatatattttgagaagaattgccacaacagggtcgtgttctctacgggccctcagagcaccaaaacacactggaaacaaacagtatttctactggaaaaaccattttcagttaaagcaggtgaagccttgaaaggaaaggtcacagttcacaagaataagaaagatccacgttctctcaccgtgaccctcacgttgaataattcaactcaaacttatggtctccagtgaaacagccataaaagcacactaccttgtagtttttaatgtgggggtagagtgggtcagcaggagggagctggttttatgtgagcagatggatggatgatggaccctttcctaatgagcctcctcaataagagagaagttctcattgtgggaatctgacatagttcagctgaggaagagaatcagctgatcctcatggtctgccacgtaatcattttcttagacgtttgctccaccagatttaaccaaatgtaactcccacattgagtttatctatattgaaaatcatttacattggcctatatttggaagagagatagtcttttgtttttaataagtttcttactataaattttaaacaaattggttagttatttggatattttattaaactagtaacacaggtactacacattttattatggactcctctgaggaggagtttttaattgtatttgctagaaaatcaggatgtaataaagatttgtataaaaaaactaaaatatggaaaagagcttcagccttcatatacaaatcatatatgcagacagcctagttgattatctagcatacttagggttctcattttgtagtttcttccctctttgtgactattccttagccttatagatttctagtactgcccaggaaatctaatttcaatacatttatcctaggtttcatgaaagtttttaaagattgggataaatatgtacttatttactaacgtattatctttttcaaaccagatttatgtgcaaaggttaaacatgtaactgttactaagcagtctataaagttgtcatttacaattactgattcaatttgaaatgtagaataaaattttaataaaatgtatccttataaaatattttaaaaatatt

SEQ ID NO: 111821 - DNA, 2653 bp, Homo sapiens
cgcctcgaggccggaagcgattgcgagccagcgcgcgcgcttcggcgttcccggcggtctgcgaagtttccggagccccggtcccgccgcgggttcgcgcttgtgctcgcgctcgttcctggagtcggcggccgctgcgcgcgctcgttgcccaacccggtccccgcccccagacacgccgggctctcggggcaccacagccatgtgctcgttagcgtcaggcgctaccggcggccggggcgctgtggagaatgaggaggacctgccagaactgtcggacagcggggacgaggccgcctgggaggatgaggacgatgcagatctcccccacggcaagcagcagaccccctgcctgttctgtaacaggttattcacatctgctgaagaaacattttcacactgtaagtctgagcatcagtttaatattgacagcatggttcataaacatggacttgaattttatggatacattaagctaataaattttattagacttaagaatcctacagttgagtacatgaattccatatacaacccagtgccttgggagaaagaagagtatttgaagccagtattagaagatgaccttttacttcaatttgatgtagaagatctttatgaaccggtgtcagtacccttctcataccccaatggactcagtgaaaatacatctgttgttgaaaaattgaaacatatggaagccagggcactgtctgctgaagccgcattggccagagcacgtgaggatctgcaaaaaatgaaacaatttgctcaggattttgtgatgcacacagatgtcagaacctgctcgtcatctactagtgtcattgcggacctccaggaggatgaggatggtgtttatttcagctcatacgggcattatgggatacatgaagaaatgctaaaggacaaaatacgaacagaaagctaccgagatttcatataccaaaatccacatatcttcaaagacaaggtagttttggatgttgggtgtggaactggaattctctctatgtttgctgctaaagctggggcgaagaaggttcttggagttgatcaatctgaaatactttaccaggcaatggatattataagactaaataaacttgaagatactattacactaattaaaggaaagattgaagaagttcatcttcctgtagaaaaagtagatgttatcatatctgagtggatgggctattttcttctgtttgagtctatgttagattctgtcctttatgcaaagaacaaatacttggcaaaaggaggctcggtctaccctgacatttgcactatcagccttgtagcagtgagtgatgtgaataaacatgctgatagaattgctttttgggatgatgtctatggcttcaagatgtcctgcatgaagaaagcagttattccagaagctgttgtggaagttttagatccgaagactcttatttcagaaccttgtggtattaagcatatagattgccatacgacgtctatctcagatttggaattttcatcagattttaccctgaaaatcacaaggacatccatgtgcacggcaattgctggctactttgatatatattttgagaagaattgccacaacagggtcgtgttctctacgggccctcagagcaccaaaacacactggaaacaaacagtatttctactggaaaaaccattttcagttaaagcaggtgaagccttgaaaggaaaggtcacagttcacaagaataagaaagatccacgttctctcaccgtgaccctcacgttgaataattcaactcaaacttatggtctccagtgaaacagccataaaagcacactaccttgtagtttttaatgtgggggtagagtgggtcagcaggagggagctggttttatgtgagcagatggatggatgatggaccctttcctaatgagcctcctcaataagagagaagttctcattgtgggaatctgacatagttcagctgaggaagagaatcagctgatcctcatggtctgccacgtaatcattttcttagacgtttgctccaccagatttaaccaaatgtaactcccacattgagtttatctatattgaaaatcatttacattggcctatatttggaagagagatagtcttttgtttttaataagtttcttactataaattttaaacaaattggttagttatttggatattttattaaactagtaacacaggtactacacattttattatggactcctctgaggaggagtttttaattgtatttgctagaaaatcaggatgtaataaagatttgtataaaaaaactaaaatatggaaaagagcttcagccttcatatacaaatcatatatgcagacagcctagttgattatctagcatacttagggttctcattttgtagtttcttccctctttgtgactattccttagccttatagatttctagtactgcccaggaaatctaatttcaatacatttatcctaggtttcatgaaagtttttaaagattgggataaatatgtacttatttactaacgtattatctttttcaaaccagatttatgtgcaaaggttaaacatgtaactgttactaagcagtctataaagttgtcatttacaattactgattcaatttgaaatgtagaataaaattttaataaaatgta

SEQ ID NO: 111822 - DNA, 2607 bp, Homo sapiens
cgcctcgaggccggaagcgattgcgagccagcgcgcgcgcttcggcgttcccggcggtctgcgaagtttccggagccccggtcccgccgcgggttcgcgcttgtgctcgcgctcgttcctggagtcggcggccgctgcgcgcgctcgttgcccaacccggtccccgcccccagacacgccgggctctcggggcaccacagccatgtgctcgttagcgtcaggcgctaccggttattcacatctgctgaagaaacattttcacactgtaagtctgagcatcagtttaatattgacagcatggttcataaacatggacttgaattttatggatacattaagctaataaattttattagacttaagaatcctacagttgagtacatgaattccatatacaacccagtgccttgggagaaagaagagtatttgaagccagtattagaagatgaccttttacttcaatttgcagaaagcaaaacagaaactggccaaacagtttgaagaattttgaaatcaaaatacaaaatgagatgtagaagatctttatgaaccggtgtcagtacccttctcataccccaatggactcagtgaaaatacatctgttgttgaaaaattgaaacatatggaagccagggcactgtctgctgaagccgcattggccagagcacgtgaggatctgcaaaaaatgaaacaatttgctcaggattttgtgatgcacacagatgtcagaacctgctcgtcatctactagtgtcattgcggacctccaggaggatgaggatggtgtttatttcagctcatacgggcattatgggatacatgaagaaatgctaaaggacaaaatacgaacagaaagctaccgagatttcatataccaaaatccacatatcttcaaagacaaggtagttttggatgttgggtgtggaactggaattctctctatgtttgctgctaaagctggggcgaagaaggttcttggagttgatcaatctgaaatactttaccaggcaatggatattataagactaaataaacttgaagatactattacactaattaaaggaaagattgaagaagttcatcttcctgtagaaaaagtagatgttatcatatctgagtggatgggctattttcttctgtttgagtctatgttagattctgtcctttatgcaaagaacaaatacttggcaaaaggaggctcggtctaccctgacatttgcactatcagccttgtagcagtgagtgatgtgaataaacatgctgatagaattgctttttgggatgatgtctatggcttcaagatgtcctgcatgaagaaagcagttattccagaagctgttgtggaagttttagatccgaagactcttatttcagaaccttgtggtattaagcatatagattgccatacgacgtctatctcagatttggaattttcatcagattttaccctgaaaatcacaaggacatccatgtgcacggcaattgctggctactttgatatatattttgagaagaattgccacaacagggtcgtgttctctacgggccctcagagcaccaaaacacactggaaacaaacagtatttctactggaaaaaccattttcagttaaagcaggtgaagccttgaaaggaaaggtcacagttcacaagaataagaaagatccacgttctctcaccgtgaccctcacgttgaataattcaactcaaacttatggtctccagtgaaacagccataaaagcacactaccttgtagtttttaatgtgggggtagagtgggtcagcaggagggagctggttttatgtgagcagatggatggatgatggaccctttcctaatgagcctcctcaataagagagaagttctcattgtgggaatctgacatagttcagctgaggaagagaatcagctgatcctcatggtctgccacgtaatcattttcttagacgtttgctccaccagatttaaccaaatgtaactcccacattgagtttatctatattgaaaatcatttacattggcctatatttggaagagagatagtcttttgtttttaataagtttcttactataaattttaaacaaattggttagttatttggatattttattaaactagtaacacaggtactacacattttattatggactcctctgaggaggagtttttaattgtatttgctagaaaatcaggatgtaataaagatttgtataaaaaaactaaaatatggaaaagagcttcagccttcatatacaaatcatatatgcagacagcctagttgattatctagcatacttagggttctcattttgtagtttcttccctctttgtgactattccttagccttatagatttctagtactgcccaggaaatctaatttcaatacatttatcctaggtttcatgaaagtttttaaagattgggataaatatgtacttatttactaacgtattatctttttcaaaccagatttatgtgcaaaggttaaacatgtaactgttactaagcagtctataaagttgtcatttacaattactgattcaatttgaaatgtagaataaaattttaataaaatgtatccttataaaatattttaaaaatatt

SEQ ID NO: 111823 - DNA, 2316 bp, Homo sapiens
cgcctcgaggccggaagcgattgcgagccagcgcgcgcgcttcggcgttcccggcggtctgcgaagtttccggagccccggtcccgccgcgggttcgcgcttgtgctcgcgctcgttcctggagtcggcggccgctgcgcgcgctcgttgcccaacccggtccccgcccccagacacgccgggctctcggggcaccacagccatgtgctcgttagcgtcaggcgctaccggcggccggggcgctgtggagaatgaggaggacctgccagaactgtcggacagcggggacgaggccgcctgggaggatgaggacgatgcagatctcccccacggcaagcagcagaccccctgcctgttctgtaacaggttattcacatctgctgaagaaacattttcacactgtaagtctgagcatcagtttaatattgacagcatggttcataaacatggacttgaattttatggatacattaagctaataaattttattagacttaagaatcctacagttgagtacatgaattccatatacaacccagtgccttgggagaaagaagagtatttgaagccagtattagaagatgaccttttacttcaatttgatgtagaagatctttatgaaccggtgtcagtacccttctcataccccaatggactcagtgaaaatacatctgttgttgaaaaattgaaacatatggaagccagggcactgtctgctgaagccgcattggccagagcacgtgaggatctgcaaaaaatgaaacaatttgctcaggattttgtgatgcacacagatgtcagaacctgctcgtcatctactagtgtcattgcggacctccaggaggatgaggatggtgtttatttcagctcatacgggcattatgggatacatgaagaaatgctaaaggacaaaatacgaacagaaagctaccgagatttcatataccaaaatccacatatcttcaaagacaaggtagttttggatgttgggtgtggaactggaattctctctatgtttgctgctaaagctggggcgaagaaggttcttggagttgatcaatctgaaatactttaccaggcaatggatattataagactaaataaacttgaagatactattacactaattaaaggaaagattgaagaagttcatcttcctgtagaaaaagtagatgttatcatatctgagtggatgggctattttcttctgtttgagtctatgttagattctgtcctttatgcaaagaacaaatacttggcaaaaggaggctcggtctaccctgacatttgcactatcagccttgtagcagtgagtgatgtgaataaacatgctgatagaattgctttttgggatgatgtctatggcttcaagatgtcctgcatgaagaaagcagttattccagaagctgttgtggaagttttagatccgaagactcttatttcagaaccttgtggtattaagcatatagattgccatacgacgtctatctcagatttggaattttcatcagattttaccctgaaaatcacaaggacatccatgtgcacggcaattgctggctactttgatatatattttgagaagaattgccacaacagggtcgtgttctctacgggccctcagagcaccaaaacacactggaaacaaacagtatttctactggaaaaaccattttcagttaaagcaggtgaagccttgaaaggaaaggtcacagttcacaagaataagaaagatccacgttctctcaccgtgaccctcacgttgaataattcaactcaaacttatggtctccagtgaaacagccataaaagcacactaccttgtagtttttaatgtgggggtagagtgggtcagcaggagggagctggttttatgtgagcagatggatggatgatggaccctttcctaatgagcctcctcaataagagagaagttctcattgtgggaatctgacatagttcagctgaggaagagaatcagctgatcctcatggtctgccacgtaatcattttcttagacgtttgctccaccagatttaaccaaatgtaactcccacattgagtttatctatattgaaaatcatttacattggcctatatttggaagagagatagtcttttgtttttaataagtttcttactataaattttaaacaaattggttagttatttggatattttattaaactagtaacacaggtactacacattttattatggactcctctgaggaggagtttttaattgtatttgctagaaaatcaggatgtaataaagatctggcctcgttggcctcagcggtggagctctcggcca

SEQ ID NO: 111824 - DNA, 2679 bp, Homo sapiens
cgcctcgaggccggaagcgattgcgagccagcgcgcgcgcttcggcgttcccggcggtctgcgaagtttccggagccccggtcccgccgcgggttcgcgcttgtgctcgcgctcgttcctggagtcggcggccgctgcgcgcgctcgttgcccaacccggtccccgcccccagacacgccgggctctcggggcaccacagccatgtgctcgttagcgtcaggcgctaccggcggccggggcgctgtggagaatgaggaggacctgccagaactgtcggacagcggggacgaggccgcctgggaggatgaggacgatgcagatctcccccacggcaagcagcagaccccctgcctgttctgtaacaggttattcacatctgctgaagaaacattttcacactgtaagtctgagcatcagtttaatattgacagcatggttcataaacatggacttgaattttatggatacattaagctaataaattttattagacttaagaatcctacagttgagtacatgaattccatatacaacccagtgccttgggagaaagaagagtatttgaagccagtattagaagatgaccttttacttcaatttgatgtagaagatctttatgaaccggtgtcagtacccttctcataccccaatggactcagtgaaaatacatctgttgttgaaaaattgaaacatatggaagccagggcactgtctgctgaagccgcattggccagagcacgtgaggatctgcaaaaaatgaaacaatttgctcaggattttgtgatgcacacagatgtcagaacctgctcgtcatctactagtgtcattgcggacctccaggaggatgaggatggtgtttatttcagctcatacgggcattatgggatacatgaagaaatgctaaaggacaaaatacgaacagaaagctaccgagatttcatataccaaaatccacatatcttcaaagacaaggtagttttggatgttgggtgtggaactggaattctctctatgtttgctgctaaagctggggcgaagaaggttcttggagttgatcaatctgaaatactttaccaggcaatggatattataagactaaataaacttgaagatactattacactaattaaaggaaagattgaagaagttcatcttcctgtagaaaaagtagatgttatcatatctgagtggatgggctattttcttctgtttgagtctatgttagattctgtcctttatgcaaagaacaaatacttggcaaaaggaggctcggtctaccctgacatttgcactatcagccttgtagcagtgagtgatgtgaataaacatgctgatagaattgctttttgggatgatgtctatggcttcaagatgtcctgcatgaagaaagcagttattccagaagctgttgtggaagttttagatccgaagactcttatttcagaaccttgtggtattaagcatatagattgccatacgacgtctatctcagatttggaattttcatcagattttaccctgaaaatcacaaggacatccatgtgcacggcaattgctggctactttgatatatattttgagaagaattgccacaacagggtcgtgttctctacgggccctcagagcaccaaaacacactggaaacaaacagtatttctactggaaaaaccattttcagttaaagcaggtgaagccttgaaaggaaaggtcacagttcacaagaataagaaagatccacgttctctcaccgtgaccctcacgttgaataattcaactcaaacttatggtctccagtgaaacagccataaaagcacactaccttgtagtttttaatgtgggggtagagtgggtcagcaggagggagctggttttatgtgagcagatggatggatgatggaccctttcctaatgagcctcctcaataagagagaagttctcattgtgggaatctgacatagttcagctgaggaagagaatcagctgatcctcatggtctgccacgtaatcattttcttagacgtttgctccaccagatttaaccaaatgtaactcccacattgagtttatctatattgaaaatcatttacattggcctatatttggaagagagatagtcttttgtttttaataagtttcttactataaattttaaacaaattggttagttatttggatattttattaaactagtaacacaggtactacacattttattatggactcctctgaggaggagtttttaattgtatttgctagaaaatcaggatgtaataaagatttgtataaaaaaactaaaatatggaaaagagcttcagccttcatatacaaatcatatatgcagacagcctagttgattatctagcatacttagggttctcattttgtagtttcttccctctttgtgactattccttagccttatagatttctagtactgcccaggaaatctaatttcaatacatttatcctaggtttcatgaaagtttttaaagattgggataaatatgtacttatttactaacgtattatctttttcaaaccagatttatgtgcaaaggttaaacatgtaactgttactaagcagtctataaagttgtcatttacaattactgattcaatttgaaatgtagaataaaattttaataaaatgtatccttataaaatattttaaaaatatt

SEQ ID NO: 111825 - DNA, 2543 bp, Homo sapiens
cgcctcgaggccggaagcgattgcgagccagcgcgcgcgcttcggcgttcccggcggtctgcgaagtttccggagccccggtcccgccgcgggttcgcgcttgtgctcgcgctcgttcctggagtcggcggccgctgcgcgcgctcgttgcccaacccggtccccgcccccagacacgccgggctctcggggcaccacagccatgtgctcgttagcgtcaggcgctaccggttattcacatctgctgaagaaacattttcacactgtaagtctgagcatcagtttaatattgacagcatggttcataaacatggacttgaattttatggatacattaagctaataaattttattagacttaagaatcctacagttgagtacatgaattccatatacaacccagtgccttgggagaaagaagagtatttgaagccagtattagaagatgaccttttacttcaatttgatgtagaagatctttatgaaccggtgtcagtacccttctcataccccaatggactcagtgaaaatacatctgttgttgaaaaattgaaacatatggaagccagggcactgtctgctgaagccgcattggccagagcacgtgaggatctgcaaaaaatgaaacaatttgctcaggattttgtgatgcacacagatgtcagaacctgctcgtcatctactagtgtcattgcggacctccaggaggatgaggatggtgtttatttcagctcatacgggcattatgggatacatgaagaaatgctaaaggacaaaatacgaacagaaagctaccgagatttcatataccaaaatccacatatcttcaaagacaaggtagttttggatgttgggtgtggaactggaattctctctatgtttgctgctaaagctggggcgaagaaggttcttggagttgatcaatctgaaatactttaccaggcaatggatattataagactaaataaacttgaagatactattacactaattaaaggaaagattgaagaagttcatcttcctgtagaaaaagtagatgttatcatatctgagtggatgggctattttcttctgtttgagtctatgttagattctgtcctttatgcaaagaacaaatacttggcaaaaggaggctcggtctaccctgacatttgcactatcagccttgtagcagtgagtgatgtgaataaacatgctgatagaattgctttttgggatgatgtctatggcttcaagatgtcctgcatgaagaaagcagttattccagaagctgttgtggaagttttagatccgaagactcttatttcagaaccttgtggtattaagcatatagattgccatacgacgtctatctcagatttggaattttcatcagattttaccctgaaaatcacaaggacatccatgtgcacggcaattgctggctactttgatatatattttgagaagaattgccacaacagggtcgtgttctctacgggccctcagagcaccaaaacacactggaaacaaacagtatttctactggaaaaaccattttcagttaaagcaggtgaagccttgaaaggaaaggtcacagttcacaagaataagaaagatccacgttctctcaccgtgaccctcacgttgaataattcaactcaaacttatggtctccagtgaaacagccataaaagcacactaccttgtagtttttaatgtgggggtagagtgggtcagcaggagggagctggttttatgtgagcagatggatggatgatggaccctttcctaatgagcctcctcaataagagagaagttctcattgtgggaatctgacatagttcagctgaggaagagaatcagctgatcctcatggtctgccacgtaatcattttcttagacgtttgctccaccagatttaaccaaatgtaactcccacattgagtttatctatattgaaaatcatttacattggcctatatttggaagagagatagtcttttgtttttaataagtttcttactataaattttaaacaaattggttagttatttggatattttattaaactagtaacacaggtactacacattttattatggactcctctgaggaggagtttttaattgtatttgctagaaaatcaggatgtaataaagatttgtataaaaaaactaaaatatggaaaagagcttcagccttcatatacaaatcatatatgcagacagcctagttgattatctagcatacttagggttctcattttgtagtttcttccctctttgtgactattccttagccttatagatttctagtactgcccaggaaatctaatttcaatacatttatcctaggtttcatgaaagtttttaaagattgggataaatatgtacttatttactaacgtattatctttttcaaaccagatttatgtgcaaaggttaaacatgtaactgttactaagcagtctataaagttgtcatttacaattactgattcaatttgaaatgtagaataaaattttaataaaatgtatccttataaaatattttaaaaatatt

SEQ ID NO: 111826 - DNA, 1527 bp, Homo sapiens
gtgcaggtactccgtggttccgcccaacaagaagaagagctagggctattttcttctgtttgagtctatgttagattctgtcctttatgcaaagaacaaatacttggcaaaaggaggctcggtctaccctgacatttgcactatcagccttgtagcagtgagtgatgtgaataaacatgctgatagaattgctttttgggatgatgtctatggcttcaagatgtcctgcatgaagaaagcagttattccagaagctgttgtggaagttttagatccgaagactcttatttcagaaccttgtggtattaagcatatagattgccatacgacgtctatctcagatttggaattttcatcagattttaccctgaaaatcacaaggacatccatgtgcacggcaattgctggctactttgatatatattttgagaagaattgccacaacagggtcgtgttctctacgggccctcagagcaccaaaacacactggaaacaaacagtatttctactggaaaaaccattttcagttaaagcaggtgaagccttgaaaggaaaggtcacagttcacaagaataagaaagatccacgttctctcaccgtgaccctcacgttgaataattcaactcaaacttatggtctccagtgaaacagccataaaagcacactaccttgtagtttttaatgtgggggtagagtgggtcagcaggagggagctggttttatgtgagcagatggatggatgatggaccctttcctaatgagcctcctcaataagagagaagttctcattgtgggaatctgacatagttcagctgaggaagagaatcagctgatcctcatggtctgccacgtaatcattttcttagacgtttgctccaccagatttaaccaaatgtaactcccacattgagtttatctatattgaaaatcatttacattggcctatatttggaagagagatagtcttttgtttttaataagtttcttactataaattttaaacaaattggttagttatttggatattttattaaactagtaacacaggtactacacattttattatggactcctctgaggaggagtttttaattgtatttgctagaaaatcaggatgtaataaagatttgtataaaaaaactaaaatatggaaaagagcttcagccttcatatacaaatcatatatgcagacagcctagttgattatctagcatacttagggttctcattttgtagtttcttccctctttgtgactattccttagccttatagatttctagtactgcccaggaaatctaatttcaatacatttatcctaggtttcatgaaagtttttaaagattgggataaatatgtacttatttactaacgtattatctttttcaaaccagatttatgtgcaaaggttaaacatgtaactgttactaagcagtctataaagttgtcatttacaattactgattcaatttgaaatgtagaataaaattttaataaaatgtatccttataaaatattttaaaaatatt

SEQ ID NO: 111827 - DNA, 561 bp, Homo sapiens
gcggccgctgcgcgcgctcgttgcccaacccggtccccgcccccagacacgccgggctctcggggcaccacagccatgtgctcgttagcgtcaggcgctaccggtgggtaccctggcccctcagcacccggctcgtccagccccaggccgcgccgctgtggggccggtggaagaccctccgggacacgggcccgggcagggtggggggctcgcagggatcatgaaggaggtgctgagtgagggccgcgggcgaacggggcggaggagagcccatcgtcacctgctcctcgagcccccgggccgcaccggtgtccgaggccgatctgattgttgtgtgtgtgtgttaggcggccggggcgctgtggagaatgaggaggacctgccagaactgtcggacagcggggacgaggccgcctgggaggatgaggacgatgcagatctcccccacggcaagcagcagaccccctgcctgttctgtaacaggttcgtccgcctcagcgcctggcctctgccctagggtgcccgggcgcgtggggtctgtgtgcccaggaacgccttcgg

SEQ ID NO: 111828 - DNA, 424 bp, Homo sapiens
aaaaaaacaactgtacaatgactatcatataagttattcctataaaagtattcaattgggtgaccctgctgcccaaggcaggctgtttttacgaggctgtttgacaggaaggttctgagcagcccatggggtgagagctgacttgccctgcatatgctgtctccctgacctgctcacctcactccagatcccttcctgtcttccgcagtgccctgggtcccggagagcttcacactcagcaggcaagccaactgggtgcacaaaccttgggtcctctgtacttaggcacagcctgctgtcttttctgggtgcctcagggctctttttctttgaagtgcaaatgctaaccagggaggtttctgggtaacacagattcagttccccctcactgcagggagatgcacttccattacaaaatacttcc

SEQ ID NO: 111829 - DNA, 740 bp, Homo sapiens
cgaggtgggtggattgcctgagcccaggagttcgagaccacatgggcaacatggcgaaacctgtctctactaaaaatacaaaaattagccaggcgtggtggcgcacgcctgtaatcccagctactcaggaggctgaggcacaaagaatcgcttgaacctgggagacggaggttgcagtgagccgagatcacaccactgcactccaagcctgggtgacacagtgagactcagtctcaaacaaaatcaaagttgcatgattatttttaacataagagcttaggctcatatgataggccatgacttttgaaaagctcataaaaagcatgttgatatatttttttgtgggttagaggctgaagtgcgaccccaaaacaagtcactacaagtgaaaaggtgctgtagcctggggtctgggctgaaaggacatcctcctttctggtggggcaagccatcgggagtcctggcgtagctgtggccgggcccgggaggccaagggggagccaaggagctgcacctacttgtcacatgaccaaacatcactctcaggtcacgtgcagtgagagaacacagctgggcaggagcgagcctgggcactgcagagcccatctgctctgtcccttcaacatctgtgctgtctgcccgacagggagaccacactggtgctgctgctccggagtccagcagtccctcagctgctgcttcatgggctgtgtggcccggtgagtcagcccaccctttga

SEQ ID NO: 111830 - DNA, 577 bp, Homo sapiens
gtacagcagcacttaacgataacatttgtaatagcacttacaatactgtcctccttttctttccattggcatttggaggacagggttcctgttggactgaaaaaaaacatgggtaacgtgcctctattttcatattgctcttatgtctagatgttctatccattattgaaggtgaaatattgaggtctgcaactacaagagtaaaactatctagttctcccttcaattatgtcaatgctggtgtcacatattttgaggctctgttgtttgctgcatatatgttacagttgttatagcttcttgatggatttaccctattgttaatagagatggtgtctgatttacaatggtttgacttgcaattttttggttctacaatggtgtaaaaccattgcacttttgacttaatgtgtagtagtcaataaattacattaagatactcaacactttagtatacaataagctttgtgttagattattttgcccaattgtaagctaatatacattttggacttaggatattttcaattaatgatggaaatataaaagaatttatcccaaggaaaataatttcttt

SEQ ID NO: 111831 - DNA, 356 bp, Homo sapiens
aatatttaaatcatgaatgttgaacaaccaatattttaacaatttattgcatagagctactaataatattaaataaaactatggaaaaaaaggacattttactttgtgccaggtatgcttctaagcatagttctacatcttaacttctagtccctgtctacatattttcccttatgtgtagccttagttatactattttgtattcttttctgttttaaaatatatataaactctttcctgttcttttacataagataaataaacttaattttttagctgcatagtattttctcatgttaatgtattgtagtttactaagtcataactttatttttatttaatttgtgaacaataaa

SEQ ID NO: 111832 - DNA, 445 bp, Homo sapiens
tattcaaataaccagacagtttctatttccctaagtggatcttaactgctgcagcacaaattcaattcaactcctcaatgactgcacctggttctcttttagggccacaaataggagcgtggtggaattcctgcctgtccacctaaacctctgtcacctgatccttgttacctttcctgacgcacccgctgcaaactccacccaacctggtctggctcatagcactacttgtgtgctcctaacctggcattttcccccatagttccatgcctcttaccccaactctactgaaacaggacaatgggaaaatgaggcaccctggcatttgaggaagcattgtagagaaggagggaaagttagggcttttctggtgtttattttatacattgatagaaacgacatcagcaaaaaagaatgatttatgctgaggttgatcttcctgacc

SEQ ID NO: 111833 - DNA, 366 bp, Homo sapiens
cacatagtagttgcttaatcaatgtctttaaaatgaatgaggatatgatataatacgttttcagatgtaataagtaagctgcgaacccaaagcacagtggaatcaatttcatcaaccctgctcataacctctgctgctaccaccttatttcaaactaccagtctcccatctgaccttccgctgtgacttctgagctcctgcagccattgccgttgtagacccctgaggatctgtcttccacacagctgcatgtcccgcctctgctcaaaactctccagcaacatcttcaactcacctcttagcataagagccacagtctttgtagaacatgcatggttccacatcatctgcccctaccgtgtgtca

SEQ ID NO: 111834 - DNA, 142 bp, Homo sapiens
aaatgaggggctgggtcaccttggacctccatgcagcatatgcatcttctgtctgctgcttcctcaaaacacaatacagctggacatggggtgcagggctcacgcctgtaattccagctacttgggaggccagggcaggggg

SEQ ID NO: 111835 - DNA, 433 bp, Homo sapiens
tttagtagggatggggtttcactgtgttagccaggatggtctcaatctcctgacctcatgatccgcctgccttggcctcccaaagtgctgggattacaggtgtgagccactgagcctggccctatttatttgttttttaaagagaccaggtcacgctgtgttgcctaggctgcgttagaactcctgggctcaagagatgctcctgcctcagcctccaaagtagccgcgatatagcacgtaccaccatgcctggctctctttcagttaactttaaagaaatctggtgtttttgtttttgttttttgagacagagtctcgctctgtcacccaggcaggagtgcagtggcactatctcagctcactgcaacctctgcctcctgggttcaaacaattcttgtgcctcagcgttctgattagctgggattacaggcgc

SEQ ID NO: 111836 - DNA, 366 bp, Homo sapiens
gtcagtttctccagaaaggcctgcacaatggagttttcatgtaaaaaatttcttacatcctgattttaaaaaatcagatgatcaggaaacattgagttccgattcctttgttacaacctccactaaagctaagtaacagctgctgtattaagatggggctccccctctccatcccacacctgcctcccttacatgcctaactcctgttgtaaatagggaccctaatctgatgtttttgtagtccctttcctaggggcactgtggggaggtggaaggaatttcacctttgttgttggacagacttagatttgagaactggttctactacttactgtttgtgtggtctgggacaagtcacttggtcca

SEQ ID NO: 111837 - DNA, 414 bp, Homo sapiens
aaaaaaagaaaagttgaacttacacacctggctcacgcttgtggctctcgttacgtttcccttgggcaacatcactggggggtagaagtcgacacactttttctataaaagaccagactgtaaatattgtcaactttgcagggtgcacagtctctgttgtagtgactccactctgcagttgcagaggtgaagctgccacacataaaatatatacaaataggcatggctgtgttccaagaaaacattatttgcaaaaacaggtgttgggctggatttggcccatggactgtatttcactgacctctgctgtagaaaaaaaatcagctgtgaactgttagcagccagtactcatattggctggggatggcggtgggggaggggtgcacctgcctggtaaaaggatctgggggagga

SEQ ID NO: 111838 - DNA, 341 bp, Homo sapiens
ggagccaagatcaaggggtcaaccatggaggggctggacaggaggtggcactgtgctcccagcacacccagatgggacatttcactcactggggcccggagtagacaacaagctttctatgtggcagctcagcgaagccctgctccagggtctccttctgaggcctgaagtcatttaaaaatctgctttgcccctaaccccaacctggctcttagctccagcagctgtcacagagcctggtcaggctgttttcccaccctctacttccccttgtcctggcccatgtccacccttctccctgcccatgtccaccattctccctatcccagcctcactctgac

SEQ ID NO: 111839 - DNA, 640 bp, Homo sapiens
gaagcaggctttttggtttttgccagaaagcccaaaataaaagaaaagactcccagccctttgtgaggccaaggtgggtggatcacttgaggtcaggagtttgagaccagcctggccaacatggtgaaaccctgtctctactaaaaatacaaaaattagccaggcatggtggtgggcacttgtaatcccttccgagtagctgggagtacaggcgcccgccgtcatccctggctaattttttgtgtttttagtagagacgtggtttcactgtgttagccaggatggtctcgatctcctaaccttgtgatccacccgcctcggcctcccaaagtgctggaattacaggtgcaagccaccgctcccggcctagagacaatttcaaaagcaaattgttcagttatcttttgagtagtggtattaaatttatactcaaccatctacatgatcacagtttgacccatttgtgacaaatttcagacaattctaggattagaatggctacctataattttcggttatagaagagagtgaaacttacctgttggcaccaggcttttacccaatggtagatgtttccttcttataatttgttaacattttgggtgatcatggagaagtaccttctaaggacttgagaatg

SEQ ID NO: 111840 - DNA, 337 bp, Homo sapiens
gacagggtttcaccatgttagccacgatggtctcgatctcctgacctcgtgatccgcccgccttggcctcccaaagtgctgggattacaggtgtgagccaccgcgcccagcctggtttccattcattctgagggaggagcaaagggctgtgttcctggatgcgggttcctgcttggctgttatttatttttttttaaagagacagggtctcgctctgttgcccaggttggagtgtagtggcacgatcatagctcactgcaactttgaacccctgggctcaaagcagtccttctgcctcagccagtcaaagtgctgggatcacaaggtgtgagccact

SEQ ID NO: 111841 - DNA, 180 bp, Homo sapiens
caacagacacacacacacaaacatgacattgcacttggcctaacgttggcaacacacacacaaacatgacatcgcacttggcctaacattggcaacagacacacacacaaacatgacatcgcactcggcctaacgttggcaacagacacacacacaaacatgacatcgcactcggcctaa

SEQ ID NO: 111842 - DNA, 407 bp, Homo sapiens
accactgaatcttgttaaacaaaatcttcccctctaatgtgaggggatgctggtggtcatggtaaccaagagaaagaggctcttactgttagcagctccgatgaggtagctgacctgggctgaccaagtttgaagtttcagggcccgtgttcacttctccacctcccttcccctcccccacctaccagatcatactggggtgacatgcagtgtgtatttgatgatcattagtctctgaaacaccagaaacaacctctttgggttttttttggttggtctttaccagtgagagggtctggatcctctctcttcctgaagaggaaggaatcccaacagcccctggaacgctggactggtcttaaggccaagactgtagccactggctttcctcaccacctctgtccacg

SEQ ID NO: 111843 - DNA, 476 bp, Homo sapiens
taaacaatccttacaggtagcagctcatcatcatagttgtactgacacaagtttaagcctttgagccaatttttgtagatgtgtttccttggatgacctgattagagacaaagggaaaggttcattaatatttcctctctattaattaattcattcattcttaatcagctttctcaggttgactgttttctctctgtttagaaaagagctattggaaagtaacaaaattttactagattctttctaggagagaaagatggcctggttttttctcattgttactatcaaacagcaacctcagacctcttcagcggaaggtgtagcatgcgtgagagcagacttataagtatcatggggccagttttaggccatttgtgattcatgggccccctcacacaatgctgacctttgaatgaatttggaaatttgctcagaaccaaagattaattttagtggaggaaatatacttgagaata

SEQ ID NO: 111844 - DNA, 186 bp, Homo sapiens
ggggagaaaagaatgccgccctcacacaggcaaggaagctgggcacccgggggtggggtgctgagaatagacatttttgcattggggccttcctccatatcacccctacttccaaccccacttaaggtgcctttcttggaggagtctccgatgtctaaaatgtgcccatgctgagctccagggact

SEQ ID NO: 111845 - DNA, 198 bp, Homo sapiens
ttcgagttcactgttgcctgttgggatggccctgccctggatctgtggaatgagcagccgctcctgtttgcaccaactgaaatcctctcttctgcttgaaatttttggtagccttgctggcagctcagaatgaggctcagttaggacggggagctcatgaaccccagggtgcaagtactggatgtggtcctaactagc

SEQ ID NO: 111846 - DNA, 471 bp, Homo sapiens
cacattgcctttgtcacagcaccacctagtggtaattaacagcactttcttccaataattcagtaatctattacgctaataatctgcatacttttctgtcacaattcattaagtttctttctttctccttaagctattactcttgttgcacatttcctttgttacagcaacacctagtgggaattaacagcactaacttctcccaccggctgaacttccaagtggactggagaaaactcatgaggaatttaaaagatcacctaatctaatatacggcacagtacagtcttaacctattcccagcacttaatctgcagatgtttggccaggcacggtggctcacgcctgtaatcccagcactttgaggggccgaggcaggcggatcacgaggtcagatcgagaccatcctggctaacacggtgaaaccccgtctctactaaaaatacaaaaaaaaatagccagacttggtgg

SEQ ID NO: 111847 - DNA, 455 bp, Homo sapiens
taaaagtgtttggcattttcagggaggtttgttttttgttttgttttttgaggctcatgttgcccaggctggagtgcaatggtgcagttctcggctcactgcaacctctgcctcctgggttcaggggattctactgcctcagcctcccaggtagctgggattacaggtgcatgccaccatgcccagctaatttttgtatttttagtagagacgggatttcaccatgttggccaggctggtctcatactcctgacctcagatgatccgcccccctcagccttccaaagtgctggggattacaggcatgagccactgcacctggccaggagagtttttttctgataatagaagtaatactttctcactttagaaaatgtgaaaagttcagatatataaggaagtcaaacaaaacgtctcctatatatgaagaagaaaagaagcaagtttaaaaaaaa

SEQ ID NO: 111848 - DNA, 334 bp, Homo sapiens
  misc_feature (2)..(2): n is a, c, g, or t
tnaagacctgggcccctgctcagtgcctttgctctagaatgggtccagcttggctttggctactgggaacagggatcctggcctctgtccactgtcagccccttcttgcccatggagataaaagtctgcaggggcctcaaccccccaggcatcagctctcagagccagcccccgcctaccacagaatcacacccaccattaccaattttgctttgcgtttgtataaagagctggcagcagacgcccccggaaacatcttcttctcgccagtgagcatctccaccaccctggccctgctctctcttggggcccaagctaacacctcagctctgat

SEQ ID NO: 111849 - DNA, 406 bp, Homo sapiens
ttttggagggcaagaagttttcagttttcagtggcaagaatcaggtttttgaaagctggaatttgttttgttctttcgataggcttgcccttcatgtaatttaaattgtgactgtttaaatgtgacctgcttgcctagctcctgcaataggtcagtggctacattgtaaggaagcagaattctcttggtagagtggctcttttcaggatcattgttactgaatagcaattcggtatcttagccatggattagggtcaaaacttttcaaagcttcatctaacaccaaagcaaagattatgcatgcacaaagcttattctttctcaacttggtgcagtttaaatgcagaagtcaaagggtttttttttttttcctttctcattttttttaagtcaagaaggattttac

SEQ ID NO: 111850 - DNA, 441 bp, Homo sapiens
tgaggagtggaggagcatgtgggcaggactgggaggggctcccctatcctgggcagggcgtgccctaccgcccttcttgacctccaggaacctgaacacatcagcgctggtgactcgtcccaccctctcctcaaggcttctctaggttcagccctgcacaggacacccagcagacctactaaggctgcagctcctggcactctggctctgtgggtctgcttggctctccctagccctacccagcagccgagatcctggccaagctgcagagactccccagctccctgaaagtcagttctcccctcagaaagcaggagcttgtggctggtgggaagaaagaagacaactttatagtccaggcctgactcacacgtagtggctctgtggtctctcagcctcactgagctttgcttttctcttctgtaaaatgggtgtaatgac

SEQ ID NO: 111851 - DNA, 479 bp, Homo sapiens
ggcctcaccatacctgaataataacaaaacctacattgtaaaacaccttcaaaaggtttttagaaagagtagatgtaaaagtactttttaactacaataatccctcctccaaaatcagagatttaaaggtaaaaccaaaaataacaaaagtgccagaggaaaaaaataggacaatatctgtataaatttatatggaatagacaacagacaggtatcatatataaaaagaactgctttaaaaatataaaactttgatgtgacaaaaacaaaagaaagcagaaatgtaagacataaacagaaaatgtgggtcaggcatggtggctcacacctattatcccagtatttcaggaggccgaggtgggtggatcacctaaggtcaggagttcaagatcagtctggccaacatggcgaaaccctgtctctactaaaaatacaaaaattaaccaggcgtggtggtgcatgcctgtagtcccagctac

SEQ ID NO: 111852 - DNA, 286 bp, Homo sapiens
atgcaaaatatacaaagaaataatagcctgcgtttgtgtagccatttataagtttcaagcattttcatgtacattcctgcatttcaacaccaccatgactatgagtgggctacgctgctactggtagccccattttacagataagccaattagaggtgacttgccttaggtcacacagctggtgacaaaaccagaattagagtaatgagatctttgattctgctataccacatttcaaaatcatttttaaactagaaaatatctcatgcttttaatgtaaagtata

SEQ ID NO: 111853 - DNA, 112 bp, Homo sapiens
gttgccatgaggacatgctaaaacataaaacatactgttttccgttgagaaaagaaactgatggtagtccatgtgagcgtgtatacatctcacaccaagagaccacttataa

SEQ ID NO: 111854 - DNA, 788 bp, Homo sapiens
gctttatttttcaggcccatgggttgaaatacaagaaaaacaacacattcgtgatacatcaaatttaggatataactgctagagcaggaggaagataaatggcgtcaaggagaggttcatgggggttttttgttagtgaaactgagaatgttaacagtgataaaattgagtacatgagttttcattatattgtactatgttttgtttcgtttatttattttatttttgttttgtttttaaatagagatgggggtcttgctacaatgtccaggctggtcttgaactcctaagctcaagtcatcctccagccttggcttcccaaatttctgggattacaggtgtgagccaccgagtctggccctgtgatccatcttgaagtaatgtttgtatattgactctatttttgtttgcttttactttaccctcacctgactgataaagttgagagatcctcattattttcttcttgtggggtaatggcagaagactgctctgtaacttttaccaaacactttaccgagttgctgcagccaattcgtttatatgtcactgaaaactcagacaaatcgagtcatttctctgctttttaaaataattactcctcatcacactttcagggcctccaggggcctggtttgaaagcagaacattcaggaaagccataggaaaacagcatcctggcttaaaagttaccacctgaaataataaatattacatgtgaacagatgcttatttaatggattttgatggcttctttaccttttatttaagcaccttgtatattgcta

SEQ ID NO: 111855 - DNA, 345 bp, Homo sapiens
tcagacagagtctggctctgtcatctaggctggagtgcagtggtgcgatcttgcctcctccgggctcaagcaatcctcccacctgagcctctgggactacaggcatgtaccaccacacccggctaatttctgtattttttgtagagatggagtttcaacatgttgcccaggctggtctcatcctgagctcaagcaaactgcccgcctcggcctcccaaagtgctggaataacaagggtgagccactgcacgcagccctgtgaagggtttaagctaagaagtagcccaaattaattcattttccccagagatgccttattgggaaatacaattttaaatttacatg

SEQ ID NO: 111856 - DNA, 447 bp, Homo sapiens
ccccacagacccccatactccgcatgaaccatgtgaatatatcagtgaccacctctcagtcacagcagacactcacggctgcttgcattaaaccaaagtggacctccctgtaggaaacctgctcagatagcaccttacatcccaataaaggcttccactcccaggtccctccctctctctcgctattgctccccaaccatcagtcaagcacaggtcttcttgatggctctcccttccagttagccctgcaaagtgtgctgccctcttctctctggaattaataaaaaaactgcttcggttatttcatgtgttgtactgtgctgccttctctgtgtttcacccaactgagtcacccaaacctaactcttcccagtcagtgcttccagctacttgggaggctgaagtgggaggattgcttgagcccaggaggttgaagctgcagttagc

SEQ ID NO: 111857 - DNA, 286 bp, Homo sapiens
cagtggcaatctgcatggaaaggaagattagagactgacaaggcttcttttgggctgaagatggcatttagtagtcctcagaggcacagtgccagctacttgctcaaaagcccagacagttaggggccaaagagataagtgtctccgggtgaatattcatatgcttttcctgattccactctttaataaaaataaccccatacctccttaagagataacattaatggctgggcgcggtggctcatgcctataatcccagcactttgggaggcggaggtaggcagat

SEQ ID NO: 111858 - DNA, 361 bp, Homo sapiens
cagagttgaagggccagggggaagaagcattcggggcacacagcatctgcttcaagaattaaattttccacaagtccaactgctgaaccagccttctgtatccctaagaccagttttacctaatagctgctaaaatgaactgccatgactctaagactggttttacctaccaccatcgctcaccaatcagagcttgctagctcccacaagctctagtgtgaatgagctttcttccaaaacagtatgtaatactgttctttctcataaaacccggaaccttctctttttttttttttgagatggaattttgctcttgttgcccaggctggagtgcaatggcgcgatctcggctcactgcaac

SEQ ID NO: 111859 - DNA, 446 bp, Homo sapiens
ggacatgggcatatttggggagggggacctccaatcaactcactactatcgtcaagtgcatactcttaagcagttcaaagttcgcaactcggttatttttcacctattttagaaagaggttgattttacacaccacattgttctttcagtgaccgacatcttataaaacccagaagtaagtaaagagcatttattgccatggtagccagttttgtcactgagaaacagcccaatgtatgttcacactgtcgtattaggaaagcaaaaagagtaattatattaaaataaaatacagcttcctctcttctttctttcctttattatttctgtgactgacagtctatcagatgaggctttttttttttttttgctgaggttgctcatacagaccatgttgatgtctctagaggttctgcatgtaaggaaagccagatttttcacctttg

SEQ ID NO: 111860 - DNA, 232 bp, Homo sapiens
gtagctgggattacaggcatgcaccacctcgcccggctaattttgtatttttagtagatacaggttttcttcatgttggccaggctagtctcgaactcccgacctcaagtgatccatccaccctggcctcctagagtcctgggattataggcgtgagccaccatacccagcctacatgctggtttttctctggtgcttgtaaatactgtcaggaagtgtttctgaaaaattg

SEQ ID NO: 111861 - DNA, 373 bp, Homo sapiens
ctagaacttaatcaaaaggaaaaccccacctctccacacccacataacaaaaggatcagaggctactccttttacactgcatagccgatgaaaaatggaaagtacccctgattggtcccctcctgcaaccaatcagacaggtcgtggcccaagtcttcatgtctaactttgtaacttcacttcagcctctgattggtcacctcctgtgaccagagtggtcgtcggccaagtcttcatttatggagagtgtaaccaagtaaccaatgggaaacctgtagtgggtatttaaaccccagaaaattctgtaaccagtgctcttgagtggagtgtactttcatttcaataaatctgtgctttcattgcttcattcttt

SEQ ID NO: 111862 - DNA, 418 bp, Homo sapiens
agtgctctccacaaacagtgaaacctaacttaaactataaacatgaggttacagttatagttaaataacaatgtatctctctctttcttttgcgatggggtctcactatgttgcccaggctagactccaattcctgagctcaagtgagccccacctggagtagctgagactacaggtacccacacccagcttataataatgaatcattattggttcatcagttgtaacaaatgtacaacactaatgcaagttttttttactttttgtagagatggagtttcaccatgttgcctaggttgttatcgaagtcctgacctcaagtgatctgcccacctcaggataccaaaatctccataaagttgagattacaggcttaagccatcatgcccaacctcaatgtatgaattctgggaatact

SEQ ID NO: 111863 - DNA, 629 bp, Homo sapiens
taatttatggaaaactggaaaatacccctttaaatttagtcaacgtgtttgcacacagaattttttttgcaagattagtttttacaaaccttccacaacttgttcaaaccgtgagcttattcttatctaatttaaaaatcacataaccctctcaactaggtgaaatttgacattctcctgccttttaaaaatattttaccaaaaacatgtttcactcttctcacacactttccatgtaaaactattttttcagtagtttcaatcatatgttataatggtaactagcaacttttacttttggtggcttaaatttcctttcacgaaccctttcacgactttcccagaccatctacaacatgctttgactttctgacttctccttagcatcccctttttgaacaaaccagttattttactttagaacaacaatttaccatacaagatgctttcttatagaccaaggagtctaacatgtacacgagtcagtggctcacacgaaagctgccatggcacaatgaaggtgaaggccagcgtgctatccggctgaggtgggatcccatggcctcttcagtccactgagggtgcaccatctcacctgctgtgctgggtaggcggagcacaaccacctg

SEQ ID NO: 111864 - DNA, 311 bp, Homo sapiens
aggtgctctagaggatcctccgtcagcactccttgctgtctccctctctccttcctgctcctccaaggtttgggagctaaactggccctagagaagttagatgctgtcacctacttgactaaaagtcttgtcactgctcagatactctgaatactgctgatggtatggaactgctcatagtatttatcttctttgatatgactactacctgggttggatccaagttaatgccatgtcttcaaacactcatctgtaagtagtggccattctctctgagtggcaagacttttagtcaaggaggtgctgacggt

SEQ ID NO: 111865 - DNA, 459 bp, Homo sapiens
ttctgggtgctggttatgattcctttgaactatggagcaggtaaactactatgaatctctgcctgtttttctggtgtttcggaaactccttccttcatttgttctttcactcatcaagtaattattgatctctgctatatgccaggcataatactagatgcttccaagtttgcttagaccttgctgtctccctctctccttcctgctcctccaaggtttgggagctaaactggccctagagaagttagatgctgtcacctacttgactaaaagtcttgtcactgctcagatactctgaatactgctgatggtatggaactgctcatagtatttatcttctttgatatgactactacctgggttggatccaagttaatgccatgtcttcaaacactcatctgtaagtagtggccattctctctgagtggcaagacttttagtcaaggaggtgctgacggt

SEQ ID NO: 111866 - DNA, 548 bp, Homo sapiens
tagatgcttccaagtttgcttagaccttgctgtctccctctctccttcctgctcctccaaggtttgggagctaaactggccctagagaagttagatgctgtcacctacttgactaaaagtcttgtcactgctcagatactctgaatactgctgatggtatggaactgctcatagtatttatcttctttgatatgactactacctgggttggatccaagttaatgccatgtcttcaaacactcatctgtaagtagtggccattctctctgagtggcaacccttttccacattagtcacctggcttcctctagtcctgttacaatccctatttgtaaggcccacattaaactcccagtaagcagctgattatgaccattccattcatttctgaatctccatgtcattaccctcatcaaaacagggctgactacaaaaaggataaaaaagtctcaggtgaggttttgaaggcaaatttcctgtactaaagctttctctacagtcattaaagtcccaaatgccttaaaattgaataattaaaatgatttctg

SEQ ID NO: 111867 - DNA, 735 bp, Homo sapiens
gtctttatgcatatatttaaaatttcttaatttagttttattctttcccacccctttctgtttctcaatttcattttggattcatctcaattctagctggtattgattaattatttacttttgggtatgtgaacaattacaaaaaatcagaactacctaaaaaggtatattcagagatgtgccactgcactcttaccctactacactcttctcatttccagacattttacattacatttccatccaacccttttatgtagccaagctcattagtttctggtttatgtgtcccgtatttcttttgtacaaatgagtatgcacattttcttatattctttcttaaatgaagggtagtacgctataaacacaattcttttgcattttgcttttttacatagcaatgtattctggaaatcactccatatcagctcataaggaacttctccttttttgtgtgtacaagtacataatatgccatttagggatatgtcaactttcaacaaccctccaatgtatgggtatttgagttgtttccagtatttcattatgtaaacaacactgcaatgaataacctatgtatttttgtattgttgaaggtttatcttttcaggtgaattcctacatgtgtgattggtagatcaaaaagtaagtatgcatgttgttttcttagatgttgccaaatttctctccagaaaaggtggaccagtttgaattaccactagtaacatatgaaat

SEQ ID NO: 111868 - DNA, 557 bp, Homo sapiens
caccaggccccacctgcaacattcaggattacaattccacatgagtttaggtagggatacacagctaaaccatattattctgaccctgatcccctgaatatcatatccttctcacagagtaaaatacaatcacgccttttcaaaagttgctgaaagtcttaagtcatttcaacattaactcaaatgtaaaaagttcaacgtctcacctgagaaaaggctacagtcccttttgcctatgagtccctgaatttaaaagggagttcttttctttcaaggtatgatgatggtagaggcattgggcaagttttctcaatccaaagggtttgaggtttgccaggaaaataacacaaatgagatgacagggccaatgcaagtccaaaacccagaaggccagtatccattcaatctcacagctccaaaaccatcacgagaactcaccatcgtgaggaaaacattaaggagacagtgtttaaccatttgtgagggatcctgcctccacccctacctttcacccctcacctccaccaaaatccacccatgctccccaatccccacct

SEQ ID NO: 111869 - DNA, 150 bp, Homo sapiens
gtgtattgctgctgttgttcctctggagacagttttctgcaggctacattaacaggcaatggaaatgcatgccaggctacatcctaacggttgtgtcttcccatcagaaaaagatccttttacccctccctgtcaaatgaaggcttagat

SEQ ID NO: 111870 - DNA, 358 bp, Homo sapiens
cacccccagcactcaagccttactgctatgtgatcttgggcatccttcagccccactctgggctaccaccagctctgagcacctctcatcttggaatttggggcctttctccaacagaggggatgtggtcagagggctgggctgtgtgatcctgagcaagacctggggcctctcagaccctcactctgatctctgaaatgggggaacatggtccttccaggagcacgttgtaagagactggcaaagcctgcaggcatggggtgaacccggcgggcactcagggtcgaggtgggggccatcactcccttgagccctgaggtccctactggagggtcaccccaccaggggacaggttgaa

SEQ ID NO: 111871 - DNA, 271 bp, Homo sapiens
ccgagttaaagaaggaagggctttattcagccgggagcttcggcaagactcacgtctccaacaaccaagctccctgagtgagcaattcctgtcccttttaagggctcacagctctaagggggtctgcatgagagggtcgtgatcgactgagcaagcagggggtacgtgactgggggctgcatgcaccggtaattagaacagaacagaacaggacacggattttcacagtgcttttctgtacaatgtctgtaatctatagataacataactg

SEQ ID NO: 111872 - DNA, 520 bp, Homo sapiens
gcgcactctggccctcgagtgcccattctgcaggcgagcttgccggggctgcgacaccagcgactgcctgccggtgctgcacctcatagagctcctgggctcagcgcttcgccagtccccggccgcccatcgcgccgcccccagcgcccccggagccctcacctgccaccacaccttcggcggctgggggaccctggtcaaccccaccggactggcgctttgtcccaagacggggcgtgtcgtggtggtgcacgacggcaggaggcgtgtcaagatttttgactcagggggaggatgcgcgcatcagtttggagagaagggggacgctgcccaagacattaggtaccctgtggatgtcaccatcaccaacgactgccatgtggttgtcactgacgccggcgatcgctccatcaaagtgtttgatttttttggccagatcaagcttgtcattggaggccaattctccttaccttggggtgtggagaccacccctcagaatgggattgtggtaactgatgcg

SEQ ID NO: 111873 - DNA, 422 bp, Homo sapiens
agctcctcgcactgtacattttaattttagtagtaatggtatcctctttgggctttcataggactgagtccacagcactagtctagcacggataaacaatgacataagtagctattgggtatgtttctcttctcagaagtctgaaggctcctcaaggaacaatattcctgtcaatctttctatgccaagcacttcacatagtacataagataaacacacacatactctctcactctctaaataatgaatataagtaaatgagtagttgaaaccaatagaattggatgggataatttttctccatgaaggaaaaaattggcttcacctattttaggcttatctctgcccccatgagactgtgctttgacttcttgtgacatggtgggtctttaaaattatttaataatttaaaattcttaaag

SEQ ID NO: 111874 - DNA, 368 bp, Homo sapiens
gtcactgtggatcctttttggaaacaggagaagaaaatatctatctgtatgtctgcctatctgtctatctatctgtccatcatccaatgttttgattttttttttggagaaattatttcccatttttccaaagccttggtaatacttagagttaaatttcttaactagattaattgcagaatggattcaagagatgctaaatggagatccttaagaaagtgggctatatattgtgtacagtgcacattgctcaggtgacaggtacaacaaaacctcagaaatcaccactaaagaacttactgtacccctaaaactgttgaaataaaaatttaaaattaaaaaaatatttttaagttaaaaaaaagaga

SEQ ID NO: 111875 - DNA, 371 bp, Homo sapiens
agtctcaggaatgtgggagccacgaaaccctgtgggaatctgacatttttcagacataaaaaatatgcgcattaaaaaaatgcacacggttgccagaggttgggggttgagagtatgaatcagcggagcaaagaaaatttttttggcagtgaaactactgtgtatgagacgacgatggtagatacatgtcattatacatttgtccaaacccacagaatgcatactaccagaggtgaacccgaaagtaaactatggactctgggtgataaggatgtgtcaatgcagggtcatctgttgcaacaaatttaccactctgggttgggcacagtggctcacacctgcagtcccctgaccctgggaggtcgaggcag

SEQ ID NO: 111876 - DNA, 369 bp, Homo sapiens
cggcctcccaaagtgctaggattacaggcgtgagccaccgtctccggctgcctactactttctaagcaccattacagttctgcctctgccctgcctcaaatgcatcttgtcaaaaccccagtcctcattctttatccaggctaaaatatctactcctctctgtgtgctttcagaacacgttgttcacatggctattatagcacttgtcacttattacaattaatatgtttatgtttctataataaaattaagggccaaaattatgatacatatttgggttcattcactgccttagcgtatagtgatgtgtctgtttatttgttgaaatgaaagaatgtgttttgtctgcatatgaatgctgtcgtggaa

SEQ ID NO: 111877 - DNA, 398 bp, Homo sapiens
agatccattgactttggtcgcatagtgagaacaggaaactctcatgaatcatgtttgttagccaatgtttttgtgtagaggggtgggcaaaatctgagtaaaagacatgaattcacttgagtggttaggtcacaacagaatctatcagggattttttgattcagtgtatttttaggaatgaatgctacaaaaagagcattcagcttaataagagggagtaaagataaatgcaatcaagctaaattacagaggcacacaaatctgattgtagggttcttttttttttcccttctccaggaagaaaaaatgtttatcatggggacaacaattcattttttgctatatcctatttgtagagttggtgatagaacaggcaaatgtactagcacttgaaatat

SEQ ID NO: 111878 - DNA, 335 bp, Homo sapiens
cctactttccccaggataacatcaactccagccagcacagtcctctccccttcccacctgaccacccatggcactgaattctgaccgtatggtggtcagacagtagcctcctcactggtcttggtctcaggtacacaggagccctgccaagccactcttactgagctctctacaagaacagagatgggttccacctcttcctctctctgagttctctggatcttttccagggcagctccaccttcctaatactacatgtaatgttccaggaagggcctctcttgtcctagaagttttatatcaaataatatttttctatcttcattttctctctt

SEQ ID NO: 111879 - DNA, 342 bp, Homo sapiens
tttgggcataggaagatgacatcctcaggagttatacaaaaaaggctaatcttattcccatgaagccacactgcctgtaaaatacatctctacatgtaaactattcagcatttactgctttgaggaaaccatgtgggattccacatataccagcagaccaggaggcctgcatattagtctttcttcttccactcacggggatgctgcactgctagtgttgctaccaatatgctgggaaggctattatcattatcatgctgtatgtgcaaagggaaagaaaataagagtgatgtagaaagagcagagaaagaggtttcagttctaggtctgccgtcaagtagc

SEQ ID NO: 111880 - DNA, 159 bp, Homo sapiens
agcccttgatgcaagtattcactttaaattttcctttaaaaagaaacaggcttctgcttacacatctacccagctgagggggctttttgctttgctcattttaatttttttgttgaagattaacagttctgttgttctggctactgttgcctggaagaa

SEQ ID NO: 111881 - DNA, 209 bp, Homo sapiens
tgtggaaataaaaagaacaatttttatttttttacttggcacaattttgatagaacaggaagaggaataaagtcttgagtttatgttttagtatagtttttagattgtcaatgtatttccattttgtatgctaacttgaatctctaacaatttattttgataattaaaaataattgctatcatttattgactatacattgtcatagatc

SEQ ID NO: 111882 - DNA, 438 bp, Homo sapiens
tcatcctataaaagtcttttctcaatcatacatttgtagatcaagagcagtctgaacagatcattggagcataaaagactagggaacagattcgtacctctaaaaagcaaagttaaaggaaacaaacatgacaacttcatgatagttataaagaaaaaaacgatatgttatcttaattatgtaaggccagaaattactgcaataaatatttcaactccgtggacaatttcctagtgtgatcaaaagatgaaagtaattcactagttcagaagtccatccagtatagtgaccatcattctgaaaggaaaaagaaatgtttttgagggaaatgtaatggaacaatactcatttttaggcttgagatctgcaggagaggggaatcaatactagagactgctacgcattttggaaatcaaagtacagttaagccactttcct

SEQ ID NO: 111883 - DNA, 247 bp, Homo sapiens
ggggtggacctctgtttgtccgtttgtaaccacttctgtctggcatgggctccaagagttgatgctgcatgcaggcctcatgtactttgacacaagtgtgagagtgctgggggttggaagactcatgtgtgccagcctccaggtacagctagcctgtttcctccatgccaaggccttgtctcccttgaggcagagtggtgtggtggagcgagtactggactaagtcagaaggtccaggtatgcaggc

SEQ ID NO: 111884 - DNA, 335 bp, Homo sapiens
ggtagattgcttgagcccgggcgtttgagaccagcctgggcaacatagcgagaccctgtctctaaaaaaacaaaaaaacctacgtaatttccaggatatggtctgtggttggtgtacttgcaggttaatctccaacacttcctgcaccattgtgcagtggtcactgacagtcacagtgatcctttggtactttactttgttcctcagaggaggattaaaacatgttagggtactctgtcactcaagggagaaaggtatactgagttttaaaataaatttcagtaacaaaagttggaatcaaaatggtttccttgttaactttcatttaagcaaaa

SEQ ID NO: 111885 - DNA, 397 bp, Homo sapiens
cagtgactattcctttatagttcttgggctcagactctgtaaaaggatttgccacttatttttgaagctcttgtcacaattactttgtcagtaacttatgaaaccactagaaactgtatgttcctgctaaacctcttcttaaaaggagttttgccatttttcttttcagttattacagtacaatgcatttttctctaaggaaaatttataaaatagattcttttcatattgatagaatattttttcattaattggaaaatgctgtacaacttttagcaattctaattgctaacttaacagatgtaatagttaaaatgttctctgacttaagctatatttatgatcatgcaaataagcatgtgcttttctagaccattcataaattctaaaaattctt

SEQ ID NO: 111886 - DNA, 176 bp, Homo sapiens
aggagtctcagtaatagatatgtaacaaaggagcagagcaggactctttataagagctagatgtcgtaaggagattctgcatgaaccactgctgtgccaatcctctccttacgaccatctagctcttataaagagtcctgctctgctcctttgttacatatctattactgagactc

SEQ ID NO: 111887 - DNA, 653 bp, Homo sapiens
cacggtggctcacgcctgtaatcccaacactttgggaggctgaggcgggcggatcacaaggtcaggagttcgagaacatcctggctaacacggtgaaaccccatctctacctaaaatacaaagaaaaattagctgggcatggtggcgagcgcctgtagtcccagctactcgggaggctgaggcaggagaatggcgtgaacccggaaggcggagcttgcagtgagcctcgatcgcgccactgcactccagcctgggtgacagagcgagactccgtctcaaaaaaaaaatactagatccagaacttactgtgtgaacctgggcaaggttcttaaacacctttgtcctgttttctcatctataataccaggatattaacagtatctatgtcatagggaggtgtgaagagaaaatgagttaccacttggtgcagtgcccggcacatggcaaattaaataaatgttagctaaaaaaatataaacttaatagtctgctttttaaaagattcaacatggtatcataaaccaaaagtatactattaaagtttcataagaaaaatacttaaaaaaaaaactttagcatatgttacattgactgtttttaaaacatatctccctaccatccctttgtctagatatttacagtaatagaatcag

SEQ ID NO: 111888 - DNA, 378 bp, Homo sapiens
gcaatgggttctgggatactggaggaaagttacccagtacaatggattctgggatcccgtgaagagagctgcccagggtgatagattctgagttgcatttctgaaggcaaagaaaagtgggctttttatcaggcgctgactgaaaagcagcaggtgtgtgcatatgaaggagggaagagtgcagtgaacaggaaagcatccaagtgggaaatgatcttcaaggaggaaaaatggccaattggggctgggctgtgagtaggcagagtcgtgagaacagcaggcatggctgagtgtgtgtagaagcaccaagtcccagacagctatttttttcatgagctgctggatgggaggggcggggagtcaacactgcactcgggg

SEQ ID NO: 111889 - DNA, 379 bp, Homo sapiens
gccactgcgcccggccaactggcccaaattacttaagcagtaagagacaaacaaaagcatactaaaatcttcatcttcatcttagatcatgtttatctattagatcaccttgatcttagagaggtgaccataaattctgtttaactttttatgctgataaatataagttcaatatgttcattaaaaatataagtaataacagtattactaaaactaatattagttaacatgtatcaagtatttataatggatgtgacagacactattttaaaggctttgcatacaataatccagccaggcacggtagctcacgcctggaatcccagcactttgggaggccaaggcaggtggatcacttgaggccaggagtttgagacca

SEQ ID NO: 111890 - DNA, 340 bp, Homo sapiens
acgagatagttaataaacgtagttactcaattagcatttcccctctctatgcaaccttcctcagctccctggcagacagtggcagcagtgtcctctgtgtccccacagcactctgcattcacctccaatggcacatttcaatactgctatggctatatgtctgctacacactcaggggcagcaattttttgtatcttccatctagttcatagtaagttcttacattctcaatgaatggctgacttgaagtcctagaaaggatttcacagaagatttcacagaagagaaagaggaaatgcactgaacctatcatctgaaggactgtgcttaaagataagga

SEQ ID NO: 111891 - DNA, 402 bp, Homo sapiens
acagctcagcccagggggcagttcccggccaggagatgccccagtggctctggtgcatttctgctcaggtgcctccatttatgatacacctacctggccgaaccaaaacttaaccaaggctcttgtttctctgccaaagcctggaggctcattctcttggttctgtgtgctgttgttttccttcattctctcaaagcctcagtgataagccaggacttccaactgcctgggcactgtggtcagaggatggggacaggagagggacacgccctgtgtctggtccaccaagaagatgaataaggggctcaaaagacaatggaggccgaggggcacacagcaggtggaccgaggggctaggtccgcctcagccccctctgtcccatgtggcttcctcaagagggg

SEQ ID NO: 111892 - DNA, 338 bp, Homo sapiens
cttttacctaataggttctgctaatggaattgttcagcatgcccaaggttgagttttcctgatatacccccataaaccttgtcctccactggttttctccaactcaggggaatggcatggttatccttcctgttgcacgtaccagaaattcacaagttattttttattctttcctggccctcactcctttcctttaatcatgtatcccaaatctgttcacttcttttcatgttctctagagtcctggttaaacttttaatatatgtgtgtgttcctctaactagactgttagctccacgttggcagggatgtgtctgtttcactcaccattgcagttt

SEQ ID NO: 111893 - DNA, 297 bp, Homo sapiens
ttcatactgattgcttgcacctagtagttcaccagatcctcaggtaaactgtactggaatcatgccaaactgtacagaatgtatccacctcttgaatgaatatatatatatgagtgtgtgtgtgtgtgtatacacacgcatatatacacacacaattatggttgtgtggtattagcttcaaacggttggatagaaagcattcaagcatccccaatagctctgacctgggcatactatgccaatttcactctcatcttcattaacttgtactttttttctggtttatgatatttcata

SEQ ID NO: 111894 - DNA, 299 bp, Homo sapiens
cttctgttcttggaattacccgtcctctctcttgtagacaaaatagctaggaaaactgctcagactgattttgttatatgaagaactaagatgcctaggaataatttagcaatagctcatccaaattaaagcagagttgaactttagaatggaaaaaaaaaagaaattatcatgttagctaaacatttgctgtctggatctcccagttaaaaagtggcataatacttctcaagttagccagtatagaacatgttccacattcagttgtgaaaatggctggtagctattatcaagtatga

SEQ ID NO: 111895 - DNA, 269 bp, Homo sapiens
gccagagcccagaagctgggactacagttaggagggctgctggcagggctgtgccaagaaggacatgggcactgctggcgatgtccctgaagcaagacgggagaagacgctggctttaccaccagtgtctcctgttggccatgttgaccaggaaccaggagtgaggggcggggggcctctatgagacagtgcagggcactgatgagtgtggctgagctgtcactcacctggccagcccttgaggacagctggggctcctcacggcaggc

SEQ ID NO: 111896 - DNA, 275 bp, Homo sapiens
ccactggtccttatgctggattcgttcatcttcaaatggcaggtaaccacagctgcagacctcaatttatagtacattatcaagcaattcaattttttcttttaatgtcgtaactcttctgtttcttaggagcacttctagtatcactaggagcacttaaaatgggtcccctggtattattcaaggcttacagtattctactaaacacgatgaaaaatatgcaagaatcacacatttcactgtggcatgcaacttactggagagacgaactgctt

SEQ ID NO: 111897 - DNA, 242 bp, Homo sapiens
ggcagaggacatgccagggctctagagggtgagtgggggacggtgtgtcctgctggggagacacagcccaggaggcgagaaggggcatccacatggcctgcgtggggtcagcctgcaggacgccagagccacctcttatccactcacacgggctgtcaaaatttcaggaatttttggaagccaattgtgtatgtgtgtagacgtatgtaagtctaagtgtgtaggtgtgtgtagctctatgt

SEQ ID NO: 111898 - DNA, 315 bp, Homo sapiens
ttcagttataccgacagtgaaacggggggaagaaggccccccacccacccctcgtaacatgttggcagctcgcactttttaattctcctctaggcagtttgctgacgtcctgttttttccccagagtgactgaccaggaggcacagggctcaacgtgacgtgggccccggggccggagcccagactccctgctgggcatcctttatctcagttctggattcgtgggggagcagcgggaacagtacggccttcttccctgcctaggggtcttgatctggaacctttgagagtctatgtaggctgtaagtggccact

SEQ ID NO: 111899 - DNA, 119 bp, Homo sapiens
tgtcacccaggctggtgcagtggcgatcctagctcactgaaccctcgaactcttgagctcagatgatcatcttacctcagcctcctgaggagctgggatacaggcctgtgccaccatgc

SEQ ID NO: 111900 - DNA, 156 bp, Homo sapiens
gtgactgtgagtatatactctatacttgctttctaaaaggagatgtgttctcaaaccatattgtttgagtccttctacccagggattgatcccagcccagtgccattcttactcacttggcaaaggacttgtacaggttgggtttccaccaatacc

SEQ ID NO: 111901 - DNA, 456 bp, Homo sapiens
cgcatctttcagattcacacaagcaggatgacgctggctgatgatgtaaccctggacgacctggatcatggctaaagatgacctctctggtgctgacatcaaggcaatctgtacagaagctggtctgatggccttaagagaacgtagaatgaaagtaacaaatgaagacttcaaaaaatctaaagaaaatgttctttataagaaacaggaaggcacccctgaggggctgtatctctaatgaaccatggctgtcatcaggaaaatggttgggagatttctcaatccctgaaagggatgaggttgggggagttgcccagaggaatccctgttcccactgatttttattagcaaaacatcctgtgtcttttggagtacgatgtgtaagtgcccattgggtggcctgttggtcactgtgcagcagtctgcttcccaataaagcgtgctctttcacaaaca

SEQ ID NO: 111902 - DNA, 279 bp, Homo sapiens
ggagcccgagggcctggcgggaggcggcaggaagtgtgtgctgagccagggcagggaggaggaatgtgagctatgaacgccgcccgagctcctcggctctctgggccccccttccccacgagcccatgtgctgccagcagcccaccctggcccctccattgcagcccctccacctgaggttttagtgctgtgcctggcgccactgggaccctgctgacaatgaaggggtttaggtttgataggcagaacttcttgccttgtagagtgaaagacggctgc

SEQ ID NO: 111903 - DNA, 773 bp, Homo sapiens
gtacccttgaattcctgggctcaagcaatgctcctgcctccgcttctgagtagctggaactacaagggtgtaccaccatgcccagataattttttatgttttttgtagagacagtcttgctattttggcaaggctggtctcaaactcctggcctcaagtgatcctcctgccttggcctcctaaagtgctgggattataggtgtgagccactgtgcctggcctagattggcattcttgagtgaccaatgaaccaaatgtcagatctcctagacaggcatgaagtgatgttctcccgggtatggtacaagcgctaatgggaaactaggggtgccactgagcgtgtgaaatgaaagtctagagattctgccagcataaccacagctaagggtattctttacagggaataaccaaaagctttagagatgctgcagcttcatagaaacattgtagaatatcaaagaaggctgatggattagttgtcaagagggaaagaggccaacaactatgatttcctggggctactatgttctgacacagcatgtatcttgcatagggtgacacagctagtaaagggctgagctggccctccagcccaggagtaatatgtcatcaaagctcgtgctttttctgctatgctacactaactcatgtcaacatccactctttgggaatagtaggatgtcatgatgactgagttatttcagaatatcttcaaaaactattttgtccacagaaaagaatgtctttggccacactttgtatttagtgtgact

SEQ ID NO: 111904 - DNA, 372 bp, Homo sapiens
ttagaaatcattggaattttgccttttggcattaatgaaagatgaatgccacacttttgaaagcaaagctggcaggccacctcacagttccctgtctttcaggtgagagaattaaaatcaggaaagtttggttgcttgcctaaaatcataagttggggagaaagcctatcgtaattactggaaaagaaacttcctgaaaaaaacggattcttagagtgaattaaacatgaggagaatgaggcaccaatgggcttccctgtcaaaggagagggggtccctcactcttgggtccttgattgaagatgtaaagatgtaactattcattgccagcagattctggaactggtgtgagtttccaaaggctgttttgaa

SEQ ID NO: 111905 - DNA, 570 bp, Homo sapiens
cggtaccagtatatgcagagaaccgaactgatggacaaaaatagacctcattttgggaagcctggcatgaaattaaattccagggccatagctacagctttgccaatgggctggctttctactaatgtgcagaaatgcccttgtcatgcaagttggagatggtggtggagtggggaagggaggagagcctcttttgtgggtattctaacatggcaggggctgctccacctgtctttagtcgcttgctgtttaaaatataatctgcagacctgcagccttggtctcatttgggagcttgccagaaatgctgaatctcaggcaaagcctgggactagggtgagagatggcctcctctagtgcaaaatgtaaggaggtgcccccaaactcagtaatcaaaataaacaatattttaaaatatcaaaatcactgcaaaaaatccttgataaacaaaatatcaacattttaaataaaggcgagatctgactcagcacttaaacaatcctgccccacttatctcatgccaatcttgactctgatctcaggttccatcccagacccatagaatcagaa

SEQ ID NO: 111906 - DNA, 207 bp, Homo sapiens
ggtgaaaaatccaaaaaagtagtttgtatggtgtagtggtagtctttatgccacttagaatattatttgagcttatgtagacagaatgttaattctgattttctgtgtttgttttatattcaggattggtatggaagaagacttatgaaaaccacagcgccattataacatttttccttcaagcatggcattctgttttatatactg

SEQ ID NO: 111907 - DNA, 240 bp, Homo sapiens
ttgtcttgaactcctggcttcaaatgattctctcacctagacctcccaaagtgttgggatttcagctgtgagtcaccgtgctcagcctaaacttcgacttttaaaagttacataacatcatcaatctggttatattttataaatgagaaggaccatgtctcattttccactatatcatcccagcacctgcctagcataacactatgcacataataggtatttaagtgtgtattactaaag

SEQ ID NO: 111908 - DNA, 279 bp, Homo sapiens
catgagccactatgcctagcctgcaacttctattttcttatttttgttctttcttagttttataaaatttctcaatgaacttgcgttgtttttgtaattaaattttaaaagttattttaagaaaggtctgtgtcatcatgatatagttctaaagtttagatgcatgcatgactttcagagttactgtcttttcaggttttaagagcatgttcacatggccagaattgatattattcatttttatctttaaaataattaattttaaaattgagcataaag

SEQ ID NO: 111909 - DNA, 332 bp, Homo sapiens
aagctaaaagataatgtagttcactgttttgcttagtgatcaaaaattttattttgtttattcattgctgttcactggaagacctgctgtcttgggtggctctgagtggggtgagattgacttgtagaatggttttcaactcttactggttgtgaatttacaaatacaggtagtgaggaaaagtttttccagtgtactctgatattattgagaatgatgactacaggatgaaggaagagaattatattttctgagtggtggtagctaatattttatgttactgttgataaccatcagatcattcttctttaaggggaaaaatagacttaatt

SEQ ID NO: 111910 - DNA, 439 bp, Homo sapiens
gtactactgcactaaattgtaaactccataaagcaatactattaaataaaaatatacgaggcatgcatgtaacttcagattttctagtagccattatttgaaaagtcagaagtaggtgacattaataatgcatcttaatatatccagaatatcacttcaacatgtaattaacataaaaatgagatcgcttacattcatgttcagcactaagtctttaaaagtcggtgtgtcttttatagcttctgcatatttctattcagactggccatgctcatccacatgtgccggtggcgacctgtattcaattcggtacgttggacagagcaacccaaaaataagggctttgtcttagaccagagcatgccctatcagcgccttacctatagtagatattcatacagcaaacatgtattagagcttactcggaacaaagaagctg

SEQ ID NO: 111911 - DNA, 659 bp, Homo sapiens
ccagctaattcggcatgaggtttttttggtagagacagggtttcgccatgttgcccaggctggtcttgaattcgagctcaagcgatccgcttgccttagccttcctcaaagtgctgggattacagtcatgtgccaccgcaccaggctaatttagactaattgtaatctgaaaaacctatccgcgaagaaaatcaaacaatggaaacccatcggtgagttatacacaggaaatcaaagcaaatactccccaccatccaattaacccatgttaaagattagggatactcatagtctaacaaaatacatttttctggatttagaaacctggcatccaccaccccaaccttccaaatgtttcataaaaatataaagtccgaaatgtacctctacattctcaacaggaacagtgtgtggcagcagaaaaattcctaaccaaaaacctgtcagataattatttgagaccataatcaacaattcagaacaactccaaggcaattatgtgggacagttaacttcctgacgttaatgcacacaggtttcttgaattagctctgaagtattaagaaatttttatgaaagtaatcctaaaatttctataaaatattacagtccaaaacaaaaccctgaataagaaacacaacattttttaaaagtggaaa

SEQ ID NO: 111912 - DNA, 265 bp, Homo sapiens
tatagactgccctctgaaggtcatagtcagtcactgcagtatgttctgataaagatgattatcattcttacggaatttctcgtggagcagaaagtttgctctccatgttatgataccagttgcaagtgttgtttaggggcaaatttgaatgctaatagaaatacatatagcaacatgcatcctattttatttgagcacatttccctcttatttgtaaaggttttcaattgaaataacataggatttagcttacaactatggaaag

SEQ ID NO: 111913 - DNA, 524 bp, Homo sapiens
tgggattacaggcgagtgccaccacccctggctaatttttgtatttttagtagagacggggtttcaccatgttgaccaggctggtctcgaactcctgacctcagatgatctgcccacctcatcctcccaaagtgccgagattacaggcatgagccactgcacccggctccatgtccttttttattaccatttggtcttttgaaaagctgagatagtagggaattaatatttttggaagtaatttgttagctaaattttctccattccattatccctctttatcagaaaacagtcattgaatgtcagattaaggaattcctcccaggcccagatgcacactttctccaactgggatcagaagtcagagagccttcaccaggctccactgtcctggagaaatggtcagatctccagcactaaggcaggcctcctctgaccatcacatgcagtgttagtgatccatgtcacatgcacaaaggaaaaagaaactctctggttagggatggctgccgggatcctctaga

SEQ ID NO: 111914 - DNA, 261 bp, Homo sapiens
gtcccaatgatgagttgccatgctaatactgagccaccaggtagggcagtgttgccctggtttgggtgccagtgagtttaacaaaacttctcacatgaagatctgaggggcatgtgaaacagttggcttaatgaatacctccccattccatcatgactgagaaatttctctttgacgatcacaccctcagtttgcctagtgtaggaccctcaaaggaaattgggttatttattcattgcaaatcgtttatgccacctgtct

SEQ ID NO: 111915 - DNA, 353 bp, Homo sapiens
attacaggcgtgagccaccgcacccgaccagtcctgtgctttctgatacaatatcatcccccttctttgcctcaccatctcccatgggcatgatcagttaacaattgctggaaaaatcaactttacctgaacatttaggaagctatttgggatgtccagtgtttttcttcctcttgaaaaacactaacgcaggtctgcatttattaggggagtggggatcatcatctgtctcttctgccgctttgctctaaaggaactcaagagcccataagcattttccctgaaaaggtcatcatttccaaagaaatgagagctcatttaaagtttctaggtatgaaaatcctaggttcttg

SEQ ID NO: 111916 - DNA, 129 bp, Homo sapiens
gaatggaacatatagaaatgtgccaggaaaaatttctttctttctttcttttttattttttatttatttttattttttgagaaggagtctcgttcttttgcccaggctggagtgcaatggcgtgatctc

SEQ ID NO: 111917 - DNA, 458 bp, Homo sapiens
gcattttgaaactgttcacagattctcattcataagctaaatacttatagaaaatagatacagttactgattttatgcattctgtacaattttgcctaagaaattaatgcatagaagtggacttttttatatcaccaacaagattgaaaatataagcaaaaagtgtttataactaattgttttataagaaaggaacttcacctgtttctggatattttttcctctggaattcagccataaaaaagaatgtaatcttgtcatttatggcaatgtggatggaactggaggacattaagtgaaataagccaggaacagaaagttaaacactgcatgttctcactcatatgtgaaagctaaaaaatgttggtctcatagaagtaaaaagtaagacagaggatagataatagaggctgggaagggtaggaggaaggaagggatagggagaaatttgttgaagg

SEQ ID NO: 111918 - DNA, 424 bp, Homo sapiens
gctttccatacggatggaatggagacctgggtcattcagtaaatggtgttgggacagcctgggcctcactcctctgtgaaaatgaattccagatgaatcaaacatttaaatgtaaaaaaaccacaaaagcagagaaaaacacaagcaattatatttataatcttggagtggaggaggccctatttagctgctcacagtccccaaaagtcacagaagacaagattgagaaatgaagttacataattacacaccatttcttcttggtaaagtaaaataagaaaaatacaagggcaaactgggaaaaaatgtttgcaacccaagtcacaaagagctcattcctaaagagctcccacaaatcagtaagaaaaggaccagtgacggccgggtgcggtggctcacgcctgtaatcccagcactttgggag

SEQ ID NO: 111919 - DNA, 531 bp, Homo sapiens
gacacatggggacgttgaggcattgcagcttcttgggaaaagaagtcacatctttggacccttatcctgagaaatgatgcctagaccctgtgtttctagcacaatcttcacttgcaaagcaccccatctctccctgacagcacacttgcaaagacacggggacagcaatccaggcaaacaacagtgaatacaatgaccctggggcataaaacaaagtggtagtttgaggaacagaaaggaaaccaatgtggctggagcaaagtgagtgatgaagagagtagtataagatgaggctagagaatcaggcaaagttagatcattgctggacctgactttgaaggtgtaccagagaaaatagaccggttgggagactactatagcagtccagagaactagggtgttggcagagaagaaagaagatggactcagaatccataggtctttctgaaggattgagtgtagagaaagaactaaataggactccccagtttctgacttgagcaactgggtagaaggtggtgtcatctactg

SEQ ID NO: 111920 - DNA, 821 bp, Homo sapiens
tattcaaatgtacaacagacacaagatagtaaaggggggaagagagggaattaaaaatttcatttagaatccctgttacataaagaattttttctaccttttagcctctacaaaacgtagaaatttattgttaatatatttttcagagatattcacatatatccatgttgttattattttaaaccaaggatataaggcagccatcagtcatcattttcataacctataaaataactttctctgagtgtcaagagtatcagtttttgagtgtcaggtaaacacaacactgcttcaagctgaataactatagaaatgaatcctaggaatatgttacatagatacaaattatgtcctgattcctaccaatttaataaactatggacttaaagatttcttcttcttcctcctctccttcctcttcttcttcctcctcttcttcctcttctcctcctactcctcttcatttttcttcttcttctctggcaaagcaatatttatgtttcaggaataacagtattaagtgctatggagaagggttagagggttgagattgaggttacattataaagacaagttgaaagcttcaatttatacttgagaataacaagatatgaaaggattttgagaaaatcctttgttcattagataatgtttatttaacaagatgagtgttttcaatgagattatactgtggattttattgaaaagactttaagaagtaaggtctctgttctttaaatcctgctgatttaaagaaatattattaaatacttttaagtccatttttattcagctttgtctacttgccattggttataata

SEQ ID NO: 111921 - DNA, 256 bp, Homo sapiens
tccacctccccaccagcccccagcccttatcccccttttatccccccattcaagttctctgtactttgcttatttacttggcaattgcttcttgatggctggggcctattaaggatcctgtcctagggactgatgatacaaagctgagctgtacaaggtggccccagcctggttttctaagggctaggagaatggtctgagccgaacaacactgcagcaacaagagctggataaacattcccacaggcaagaacat

SEQ ID NO: 111922 - DNA, 359 bp, Homo sapiens
ttttgagggtgatgagggctactaattacaccaggacaacagcaacaaactggaactgacttgggtgaaccagatatgatccccctttgtaagaggtatttagtatatacaggatggttgtactagcaagtgtcagacacaaatgttaggaggcggggcatggtggttcacgcctgtaatcccagcactttgggaggccgagacaggcggatcacctgaggtcacgagttcgagaccagcctagccaacatggtgaaaacctgtctctactaaaaatacaaaaattagcctgatgtggtggcacatgcctgtaattccagctactcgggaggctgaggcaggagaattgcttaaaccca

SEQ ID NO: 111923 - DNA, 245 bp, Homo sapiens
aagcatttgatctgttgactcaacactgtgggcatgtagataaaatagctgttggcagtacagagagttagtcatttagggcctaaaagcagaactggaaggttaaataggagacacataattcgactgtgaactcgcatgacatcccaataaattttcccagatgaaaatcactggtctcagtgacatcagtttacccctatttggttgttccttctccaccctccccattggctgccaatctg

SEQ ID NO: 111924 - DNA, 644 bp, Homo sapiens
cattcctggacattgctgggagccagacactgagttgatcatagtgtgctgtcaacagtgaaagaaaatctgagggatcctcacagaaacggggcgcactttggaatgaaggagcacttttggtgagtcgaaaactattagctgactgcagtcaagatgaaatccactttggaaatgtttgggtgtttttttaagtttggctcaatcacttgtttttcactgttccttatgtaatcttgtgggatgtggcgtcagaaagtcataaatcattcatggtgctttggggaaaaaaaaaacaacactgtgcaaagcagatgcaacttaaaatgaaatgagagaagtttttgggtgaaaccgaaaagaaaagcgtaactcgcatggtttgtagccaacgctgatcactaattctcgcaatctctatatggcttggtcatttgtttccagtttcttgtgcttcactgtaaatggagagtgagtgaaagatatagcctatcacaactgcattgcatttttccaacagtcttagaaaagatgctgtagtagcggcatttttggaaatgattcaaactggcagatttttatttcctgcttgaagaaatccagaaagccccattttgttcaaaaaatcccttttacgacatgct

SEQ ID NO: 111925 - DNA, 410 bp, Homo sapiens
caagaaatgccaaggactgccagcaactatcggaaggcagaagaaaggattctccccttattgggaggcatcgccctaccaacaccttggctttggacttctagcctctagaactgtgagaaaataatactgctgctgtaagccttcaaaagtttttgataggttgttacagcagccctaggaaactacagaagcagatggcactgcaagaagctgggactaggctgggtgtggcagctcacacctgtaatcccaacactttgggaggctgaggcgggaggatcatgaggtcaggagttcgagaccagcctggccaacgtggtgaaacccagtctatactaaaaatacaaaaattagcctgtaatcccagctaatcgggaggctgaggtaggagaatagcttgaaaccag

SEQ ID NO: 111926 - DNA, 310 bp, Homo sapiens
tagaggcaaagctacatacacccattaaacaaggaaatctaattgttttgttggcacacttcttgctcatctgtgtatgctctactctcctatttggtggatgtattggcatctgctatgcacagttatgcactgcataacaacacttcgcatatactacaggggtcccatgagattataatggagctgaaaaatttctattgcctagtgatatcttgatgatcctgaccctgtgtaggcctgggctaatgtgtgtgtttgtgtcttagtttttttgtgtgtgtgctttattttttgagacggagtctcg

SEQ ID NO: 111927 - DNA, 538 bp, Homo sapiens
agcgggacctcgggcggcgggtcacgtcggccgggcatggctgcatggagcccggccgcggcagcgcctctcctccgcgggatccgcgggcttccacttcaccatcggatgtttgccactcagactgagggggagctcagagtgacccaaattctcaaagaaaagtttccacgagctacagctataaaagtcactgacatttcaggaggttgtggggcgatgtatgaaattaaaattgaatcagaagaatttaaggagaagagaactgtccagcagcaccagatggttaatcaggcactaaaagaagaaatcaaagagatgcatggattgcggatatttacctctgtccccaaacgctgaccacgccctggctgcatagatgctgctgcttaagaccttggatgaacttcactgacatcattcttccctaagcagtcaccaaaaaatttatatattttgctcatatacatttccatattataattatagaagatgtataatctatttagatgttaattaaaggaaacaaacaactgaa

SEQ ID NO: 111928 - DNA, 897 bp, Homo sapiens
agcgggacctcgggcggcgggtcacgtcggccgggcatggctgcatggagcccggccgcggcagcgcctctcctccgcgggatccgcgggcttccacttcaccatcggatgtttgccactcagactgagggggagctcagagtgacccaaattctcaaagaaaagtttccacgagctacagctataaaagtcactgacatttcaggaggttgtggggcgatgtatgaaattaaaattgaatcagaagaatttaaggagaagagaactgtccagcagcaccagatggttaatcaggcactaaaagaagaaatcaaagagatgcatggattgcggatatttacctctgtccccaaacgctgaccacgccctggctgcatagatgctgctgcttaagaccttggatgaacttcactgacatcattcttccctaagcagtcaccaaaaaatttatatattttgctcatatacatttccatattataattatagaagatgtataatctatttagatgttaattaaaggaaacaaacaactgaaaaaagataaatttaagacactgggtagtattagtatattgttttggttatgtagggctatttttttatttattagtggtcgtccttcgtttgtgggtgtgtttgttctcctatgtggggagtcctcccccgcgtttttttttttagtggggggttaaaatataattccctcttttattatgttaatgtggttggtgcgttgattgggtgggtgagggtgtttattttacatatgaaggtatttaacggttgacagacgagacggagtgatttttcacctgaaaaatagtggggcgcagagagcgtataaagagtggttgatactacatgaaggccggttgtatttgtgatttttctcta

SEQ ID NO: 111929 - DNA, 387 bp, Homo sapiens
cggacgcgtgggtgacccacgcgtcgcagctataaaaggtcactgacatttcaggaggttgtggggcgatgtatgaaattaaaattgaatcagaagaatttaaggagaagagaactgtccagcagcaccagatggttaatcaggcactaaaagaagaaatcaaagagatgcatggattgcggatatttacctctgtccccaaacgctgaccacgccctggctgcatagatgctgctgcttaagaccttggatgaacttcactgacatcattcttccctaagcagtcaccaaaaaatttatatattttgctcatatacatttccatattataattatagaagatgtataatctatttagatgttaattaaaggaaacaaacaactgaa

SEQ ID NO: 111930 - DNA, 449 bp, Homo sapiens
agcgggacctcgggcggcgggtcacgtcggccgggcatggctgcatggagcccggccgcggcagcgcctctcctccgcgggatccgcgggcttccacttcaccatcggatgtttgccactcagactgagggggagctcagagtgacccaaattctcaaagaaaagtttccacgagctacagctataaaagtcactgacatttcaggcactaaaagaagaaatcaaagagatgcatggattgcggatatttacctctgtccccaaacgctgaccacgccctggctgcatagatgctgctgcttaagaccttggatgaacttcactgacatcattcttccctaagcagtcaccaaaaaatttatatattttgctcatatacatttccatattataattatagaagatgtataatctatttagatgttaattaaaggaaacaaacaactgaa

SEQ ID NO: 111931 - DNA, 857 bp, Homo sapiens
agcgggacctcgggcggcgggtcacgtcggccgggcatggctgcatggagcccggccgcggcagcgcctctcctccgcgggatccgcgggcttccacttcaccatcggatgtttgccactcagactgagggggagctcagagtgacccaaattctcaaagaaaagtttccacgagctacagctataaaagtcactgacatttcaggcactaaaagaagaaatcaaagagatgcatggattgcggatatttacctctgtccccaaacgctgaccacgccctggctgcatagatgctgctgcttaagaccttggatgaacttcactgacatcattcttccctaagcagtcaccaaaaaatttatatattttgctcatatacatttccatattataattatagaagatgtataatctatttagatgttaattaaaggaaacaaacaactgaaaaaaaaaaaaaaaaaaaaaaaaaaaacaaaaaaacaagaggggggggcgcgcccccaagagatattatccccccgcggggggggcaccccaaggtcgaaggcggttaacccaggttttcgtggggtcaacaaggggggcccccctaaaagggagagggcagttaattaaaaaccagaggcccgcgggcgccgccgatttaacaacaaccgtctgcggagctgcgggggaaacacctgctggcaagcccggggggaaaactcgtgcgggaaaggagaaccccttcaaaatgcccggcgggggggtggaaccactaattgtgggggcaccaaacctcacccatgccacaagagaatttaaaaggccctcccaggggggacaccatatgacacgctttcaaggggttgccc

SEQ ID NO: 111932 - DNA, 348 bp, Homo sapiens
tatttttagtagagatggggtttcaccatgttggccaggctggtctcgaactcctgacttcaggtgatccacctgcctcggcctcccaaagtgctgggattacaggcatgagccaccatgcccaacagatgcatggattgcggatatttacctctgtccccaaacgctgaccacgccctggctgcatagatgctgctgcttaagaccttggatgaacttcactgacatcattcttccctaagcagtcaccaaaaaatttatatattttgctcatatacatttccatattataattatagaagatgtataatctatttagatgttaattaaaggaaacaaacaactgaa

SEQ ID NO: 111933 - DNA, 282 bp, Homo sapiens
  misc_feature (37)..(37): n is a, c, g, or t
aacaaatattcgttaacattttgctcccccccccccncctgtgggtaactgagaacacttagatgcatggattgcggatatttacctctgtccccaaacgctgaccacgccctggctgcatagatgctgctgcttaagaccttggatgaacttcactgacatcattcttccctaagcagtcaccaaaaaatttatatattttgctcatatacatttccatattataattatagaagatgtataatctatttagatgttaattaaaggaaacaaacaactgaa

SEQ ID NO: 111934 - DNA, 683 bp, Homo sapiens
agcgggacctcgggcggcgggtcacgtcggccgggcatggctgcatggagcccggccgcggcagcgcctctcctccgcgggatccgcggggtgagcgtgggcagggtcggggctgctctccccgggacgggagctgcggagggaccgcggggctggcggctgtcggggcttgaggactggctcccggagggcgcgcgcggcactggcaatggggggctcctcttcctttctctcattcattctttcattcattcattcactcagcgacaacggcattcgaaatttcaagctctggcgcgctctaggggagctcccgagctgggtggaggttggaggtcaggcggacagacacatgaacagtcataatactgcgggcacaggaaaaaaaaaggattgatttaccgagcagaagacaggagtcatagcccagagtcaaggcgtgggtgcgagggactgcagcggggccggggccttgggaaggtcgactgggcctctgaccttgatcctcctccaaatcccacactaccggagcagaacccaagcagggggcacttcccacgcgctctcctaatctctccccctttctgaaccatcctttgcttcagctcataccattctttctcttaactttcattttccttctcccctggttctgaacctgcctgccctgtgcatgaagagaa

SEQ ID NO: 111935 - DNA, 199 bp, Homo sapiens
gggtgacctggaacttgttgtgaggatgaccaaaggtacttgggagtgctccttgccttgctgtggcaattggaagtcttcatcttaccttgcgccatgcagggagggtgtgccctggatggacccagtgtggcctgtgtgcttgctattcggtacctctctcacctgtcattaactcgggggcattataaattgatcg

SEQ ID NO: 111936 - DNA, 494 bp, Homo sapiens
tgtgtggaagtcagttgacagagcaatgtggcacatatcatgcccgggcaccagcctgtcctgtaatcctggccagccctgctgacttacactagtgtcccagcgcactctactccaccatgcctgtttctccatctgaatgtggagataacagctcctccgttctacactgagtccttctttgtataattatacggttaattactttttaaagtaattaacttaagctttccactcttttaagctttatactatgaaaaccattagatcagttaggaggaataagttcaagagatctgttgtacaacctggtgcctgtagttaataacgtactgtattcttgaaaattgctaagagaatagattttaaatgttctcgctacaaagaaaaagatgcatacgtgaagtaatgcatctgttaattagctcaatttagcaatttcacaatgtacagttatcccatgccaaaactccaggaatgctcaagtgccttat

SEQ ID NO: 111937 - DNA, 562 bp, Homo sapiens
ggttctccaagtgacctgcacatgaacttggcaccagcaaaatgccctcaaggatacaggcagataccacagctccagttcctgctttgtaaacattttacacttctattatttctttcgtgagtgggagtctcgctctgtcacccatgctggagtgcagtggcacgatcttggctcactgcaacctccgcctcctgggttcaagcgattctcttgcctcagcctctcgagtagctgggattacaggtatgtgccaccacacccagctaattttttttttatttttggtagagacagggttttgccctgttgacccaggctggtctcaaactcctgacctcaggggatctgcctgcctcggcctcccaaagtgctaggattacaggcatgagccactgcgcccagccctctgttatttctttacaacacaagttcattgtgaaagaattcgaaaacgaaccctatctagagacatatttcggtgtatatccttggacattttatatcctagtggctacatgtaagtgcacaccataataaaactgtacaaagtcaatatcat

SEQ ID NO: 111938 - DNA, 135 bp, Homo sapiens
tcatcattgagacttcagttgtcaatattgccattgcttctattatggttgcatgtcttttttctttctttctttctttttaagaaagatttttttgcacttttgcctgggtgtttttttttttttcctctgttt

SEQ ID NO: 111939 - DNA, 154 bp, Homo sapiens
actatttgagcacctcatatgcattagtctccatattaagtgtcaggtatacaatggtgaagaaatcagttctggtttttgtccacatgttcatggagtttacaatctagtgtaggaaacaaacaataagcactgaagtaagcacaattttaaa

SEQ ID NO: 111940 - DNA, 839 bp, Homo sapiens
gtaagcctactgctaacatcatgcttaatgggagaaaattggatggttccttcctaacatcaggaataagacaaggatgtctgctttaccacttctattttatgttgcgttggaggttctagccaggataattagacaagaaaaagaaataaaaggcatccagattgcaggaagaattaaaactatctctattcccagatgatgtgatcttgtatataagaaatcctaaggaatccaccacaatattattagacctaaaaatgagttcagcaagtttacagtatacaagatcatatataagaagcaattgtatttctatacactaacaatgcacagtggacaatcttttacaatagcatctaaaagaataaaatatttaggaataaatttaaaaaaagaagtgcaagacatatatacttaaaactacaaaccatcattgaaagaaattgaagaagacctaaataaatggaaagacgtgttgtgctgatgaatctatgagcttaattattaagatagcaatactccccacgtcggtatacagatttaatgcaatctttatcaaaatatcagttggctatttttcagaaatggataaggtgaccctaaaagaaggatccatttgtatggaaatgcaaaagacccaaaatagctgaaacagtcatgaaaaagaaaaaagtttttttttccccccaagatggtagattagagcggtattagcatgcctgtcctccttggaaagacaaaatagtgtatagatattcacactgtgaaccttttcccaagaagcaacataggaacttaacaggaaaatggaataaaaccccgaaaccctttgaaag

SEQ ID NO: 111941 - DNA, 729 bp, Homo sapiens
tctaaaaatactaagatctgaatgtcgaaaaaatttgtaattgttctaataaccatagataacaacagcacatagaccacattacaatcggcggttttcccgcatgcagctcgtcccattcgtagtgtgaaagtctcattagcttcgattttaagcagtgcgttttttttaatcttcccctacgttctggttcccatcttatttttgaggcccatagctgtctaagtcatggtatgtgcagagagagattttttcctgctgattgtatgaaaaattgtgcaaaaggggttgtcatctaaaaaagcgtgtgacactgggagagaccttgtatagtgagcagggcttcccatgagttcatcctggatctttcactgagaacaggatgttttgtcaaggatgggcaaagaggggcacagcagaaagacaaaaggatgtgccagctacaaaaaccacgtgggccaaggacagggggctgcaatgcaaagactggaacttgcagcacggcaaactagagcgtggcaagattagcgtttcagactccagacaaggccacttccctctccaggaaagacgatctcctcaccaacacaagcgcttggcgcttcccttttccgtccaggcgtcctggctggaacgaggaaactcaaaagtgctacgaaagaacaaaagtggcccaaattctgaaaattcttaaaattaaaagattgtaactcaaaggaaaaaaaaaaa

SEQ ID NO: 111942 - DNA, 258 bp, Homo sapiens
gaactaaagtgtcgtagtagactatacaaagtttttgtcataatcactgccttgtttttactgaaactaattagaaggtggtttttcttaaagcagtttctgcaaagtcaaggacttctcacaggatttcttttagtaaattttgataggtatgcttgaggagacttttgggggagactttgaagagacttggtgtttcggctttttgagaaactgaattgagattttcttcatgctttgctttgctcattgtaaatt

SEQ ID NO: 111943 - DNA, 194 bp, Homo sapiens
aagggagctgggaactgggaaatgttttactaagaaacaaaagagaaatctgagcttccaaagaactacttgcggtttgtctgttttttaacaagaaggacaggtgtttgggagaccatctctgagagaaatgtccatgggaggaaaaagagcacaggcttgggagttcaaatactgggtgcaaatctcagatc

SEQ ID NO: 111944 - DNA, 311 bp, Homo sapiens
acagcgttcaccgtttgagtcatgggtacactagaagccctaccacatgcaatatacccatgtaacaaacaagcacatgtatcccgttggtatggtttgcctctgtgtccccacctaaatctcatcttgaattgtaagccccacatgtcaagggagggacctggtgggaggtaattggatcatgggggtggttttccccaagctgttttcatgttaatgagtgagttctcatgagatcttgtggtttaaaagtggggcccttccccagtcactctctcgctcctgccaccgtgtaagatgccaccttgctt

SEQ ID NO: 111945 - DNA, 392 bp, Homo sapiens
tagggtgtcagaaaggccacagtctctctgaaggctctgtgggagaattccttatatacttcttctagcttatggtggcgccaggcatcccttgacttgtggccacatcacttcagtctctgactccgtggtcacattgcctccttctcttctgtttcctctttttccaaataaagtgaacattcacagctcctgggaatttagaacctgggcatatctttggaaggccattattaaccgattacattctcttcactttttctcttgtggtgaaggaacttactcaaattaacccttttgctatgggtttcttatttgaagttccagtttcttcagcagagatttgttggacttcccggtttgtatataccggaggcttttctttccctgct

SEQ ID NO: 111946 - DNA, 483 bp, Homo sapiens
  misc_feature (286)..(286): n is a, c, g, or t
ttacaaaagcagtgcttggaaataggactaagtttgttccttttatttgtggatgaagatctgtcatccataaataaaacttggaataaaagcactgcaattagaatcaaataattattgaagattcctggaaacctgcgggtgagtgtgcacatgtgtatctgttttgctcatgaaatgactttttaaaaaactgcagtatggcacagtggctcaaacctatattcccaccactctgggaggccgaggcaggaggatctcttgagatcaggagtttgagaccaanctgggcaacatagctagaccccatctctacaaaaaataaaaaattagctgggtatagtggcacataactgtactcctagccatttgggaagctgaagcaggaagattacttgagtccaagagtttgaggttacagtgagctatgatcacacaactgcactctagcctgggcaacagagtgagatcctgtctcaaaac

SEQ ID NO: 111947 - DNA, 544 bp, Homo sapiens
gctctgttacaactacttaattccgcctttgtaattctatagcacccattgataatacataaacaaatgagcatgaatgtgtctcagtaaaaatttgttcacataaacaggcagtccacccatgaagctatagcttgctgaccccttgtttaaacaatcaattgaattcaaacagaaataaaaggatcttatatatttaaccatgttgataccatttccagtgcttttcattcttctatgtagatccaaatttccttttgatattattttacttctgcctgaaacattttctttaacattttttatagtgttgttttactggtgatgatttctttcaggttctaagtgcctgaacaaaatctttatttcacctacatcttgaaagatagtttctctgagtctacaattcccagctgacaatgtttatcttccagtactttaaagatgttgcttcattatcttctaattttctttgtttccaataaaaacagatgcgtccgaaccactaacaccacacatcaccacacaatcagcggaatacaag

SEQ ID NO: 111948 - DNA, 119 bp, Homo sapiens
atttagaatagttaaggcttcttgttggattgtaccctttatcattgtgtaatggccttcattgtccttcttaatttttattggtttaaggtatgttttatctgatatgaaaatagcaa

SEQ ID NO: 111949 - DNA, 433 bp, Homo sapiens
cacctcagaccttatttaagaagaaattccaaagaaaccaaaagacaacagggaagacaaaaacatgaacactagaggaaattttggcctctgatacttacaggtacagcaaacagtgaacatagcctaacccctagccagataaacacaaaaccttacactaaaggcctatttacctcagttccttctacaccacgtacgatctctgactttcaatgaaaaattttaaaacatgctaaaacacagtttgaagaaacaagcatcagagtcagactcagatatagcagaaatactggcattatcagactactaatttttttaaagctctaattaatattcctagagctctaatggaaaaaaggtgggcaaaatgcaaaggcagagaaatggaaactctaagaaagaatcaaaggacaatgttcaggccaggcat

SEQ ID NO: 111950 - DNA, 652 bp, Homo sapiens
gaacacagagagtcagggccagccaaatggaaattgtctgctcataggagaagccccggggccatactctgaaagaggtagcttggcgacagacaaattttctaagagagacagtatggggagaagaaaaggcaaaggtccaagactcaaaaaatgaatgaatgttaaaacatcagaagagcaagataaacgagttaagaagatggcacaggagccgcagagaggtggaagatggcttggaagagtgaaaacagttttgctgaggacaggtaagaagagatgaggtggggatggtccatgaagatgaatgactgcttcctaagacactgtggcgaggaggctgtggaaagatggcagcagcagactgtggagagaagtcaattcactgtgagtggtcagacaatacctgaaccaagaagacacatgggacaacctcttgggaacagaaagttcagaaaagggctaagaaataggatggagatagggatactcaatgatctagtcataagggatcaaaatgggaatgcaattaggaagtagaaggcctgagatagacagcagccactgggattggaagcaattttaggatgatttcccaaagggtagagatgttccaacaatagcttgatgataaattttgtattttttcagg

SEQ ID NO: 111951 - DNA, 428 bp, Homo sapiens
gacagagtctcactctgttgcccaggctagagtgcagtggcaccatctcggtttactgcaacctgtctcctgggttcaagcaattctcctgtctcagccccccaagtggctgagattacaggtgtgtaccaccatgcttggctaatttttgtatttttagtagagacagggttttaccatgttggccaggctggtctcgaactcctgacctcaggtgatctgcctgcctcggcctcccaaagtgctggaataaaggaactgtgtattaacatgttaacaattcataactgcacttcttatgacattttgaaaatctatgtatagttacagaacaatgggttttgttaaactatcacatttatacttgcagaaattatttcatcattattagtaggaattttattggttcaataaaattggcaaaactg

SEQ ID NO: 111952 - DNA, 923 bp, Homo sapiens
tcaaagtcatctgcagcctttaattactcagtctcaccacactctatttaacagagaaaagaggaaggtatggaaaagagtgaaattggcataaaaaatccaataaagggcaacgagcaggaaacaacaaaaacatgggaaactgccgacctgaggaatcgcgctcttctaactttacagcttcacctgccgtgtttgctcctggaggactgagacttttgtctgattcgtctgctgctgtcttcccgatgcctagaacactgcctgatgcacgggaagtatttgtcagatacatcccatggcttctaatgccatttgcaaggatgaaagctgggtgtgcccggctgtacggcaatacttccaaaggcctgtaggactccccagtgactgtcccattcaccaggaggaggactgcagtcacctgcattgtcctgggaaggtcagccaggccttttcccaatgtctgtctgggaaaagccccggtgtagtctgctcggtcctacacccagaatcacgggggcttcaggagcaggcattacgaggcaaggagtagcttctccccctcacctcccactcagcagaacgcactagccctgtgctcttctgatcctgaaggcagctgagtctgaaaagttcctgtacctttaaaggtactagaggcagtgtggtgcccactcaggaactgcatgatttaaataggtttctaggataaaggcaactcgtagcacaaaggaacaagtcccagggagtggcattccagatcatttgattcctgagcgaaggaattattatggtgtggaggtggggacctccttactacattccaaattgcaataaggttgtaagggttttctcttccattctgaagtactttgacaatagttttgaacttcaaaaatgtttattaaaggtgttttcacagc

SEQ ID NO: 111953 - DNA, 237 bp, Homo sapiens
gcgttttggtcgtactctcgaggtatcccctctagatccttgccaggcacagtggctcacgcctgtaatcccagcactttgggaggtcaaagccggcggatcacctgaggtcaggagttcgagactagcctagccaacatggtgaaaccccatctctactaaaaatacaaacattaggccgggcgtggtggcttatgcctgtaatcccagcactttgggaggccgagacgggtagat

SEQ ID NO: 111954 - DNA, 483 bp, Homo sapiens
ctttttcctgtgtccctgattattgtttaatagtgtttgtatactgacaagatacataatatccaccttctgcacccacagtgtccgcctttatgcttggacaagagcatgcagggtaggacatttctgagccttgcttttttccctggaagttttttgtttgtttgtttgttttttaagagacagggtctcttgctgtctcactcaggctagagtgcagtggtgtgttcatagctcactgcagcctcaaactcctgagttcaagccatcctcttgcctcagcctcccgagtagctaggactacaagcatgcaccactatgcctggctaggtttttttttttttgttttttttttttggagaaatggaggtgtctcaccatgttgcctgggctggtcctcaagcaatcctcctgcctcggcctccgattcactggtattaagttgtgagtcaccacgcccagctctacctttcagctcttctt

SEQ ID NO: 111955 - DNA, 721 bp, Homo sapiens
gaaggcatgtaagtatctctgcctggtgatgtttggcattgccttgttcttgggttccattgtcaccctggctgtttggggaagacttctgagaggtaggggaggagactaacttaggtcggagtctccaggggcagagcctgaaatgggcattctgggcaagagctgtgttgagggagtgctctctggggaatcctgtaagggactgaagaaggaaaaatagggcggcaggaagctaagcaaagctgtggactcagccaaggtctagcctcagcctatccaggagcataaatgacgctgcagagttgtcccaccttgaggcacagactggtcagttccaaccccaagtcaatcagtcattggctgagagctgccccggcagggagggagtagactcctaggcccttctggaccccatgagggctcctgtgggtcatgggtgattctcaggagaaggctgcagctgttagcagctggggatgggagcatcactggccagagggatctgagcagagcaccaacagcatctaggacagagagacgatgggagctggtgccctagtgttgtcctcatcccctccctctctgtgggggtccctcgagaatgtgaccatgagcttccatctctctccaggttgagcccatggtagaactcatcaaagagaaccaggaccctgggtgttgaagcttctaggctacaaagacagggattctgaagacc

SEQ ID NO: 111956 - DNA, 395 bp, Homo sapiens
accctatctctacaaaaaattaaaaattagccaggcatggtggtgtgtgcctgtagtagtcccagcttgaggctgaggcgggaggatcgcttgagcccaggagctcgaggttacagtgatctgtgattgtgccactgcactccagactgagcagcaggatgagaccctatctcttaaaaaactattacatgaataatggggagtcatcatgtgttttgtaaatagggagtaatttaacacaaggataattggctgaattaatctggcagtaatgtttagggttcaacagaggcagacaaactaaataataggatgctgcagcaagtcatgcatgagtaggtgggattctgcatcatggtggtgacagaaataacagattaaagggacattcaaag

SEQ ID NO: 111957 - DNA, 856 bp, Homo sapiens
ggactctgtcctttccagatgaggagccgagctcacaagctttaaggaataccctgtgactaacgccacccagggtgctaaacccagtcagactgttgaaggatttaaaatgcgcttccctgctacctaagtgtttctgtggaagaagtacctcagggagaatgtattaaaacttttttattttattttattttattttattttactttattttacttttttattttattttattttatttttatgttatgttatgtttgttatgttatgttatgttatgttatgttatgttatgaatttttttgagatgaagtcttactctgtcgcccaggctggagtacagtggtacaatcttggctcactgcaatttctgcctccttggttcaagcgattctcctgcctcagcttcccaagtagctgggattacaggtgcctgacactgcgcctgcctaatttttgtatttttagtagagatggcgtttcaccatcttggccaggctggtcttgaactcctttcctcgtgatccacccacctctcccaaagtgctgggattacaggcatgagccaccgtgcctggccaagaaaacattttatatttcagcgtatgctgagtttttaaaatggcattttcccccgtttttgaaaagataacgtgttgcacgtgcagtttctccagtgcccggctgtgggaaagcctgcattccctttggagcacagacttcaggagtgaagccactgcggggctgtgctgtgtttccacaagtgccgtcaccacctttcgtgtactgaatgctgggaattcagtagtgagccgtggcctaccagagccagctcttagcctcttattaatttttt

SEQ ID NO: 111958 - DNA, 615 bp, Homo sapiens
tgtagacccaccaacagcttatactgggcacctggaaatgccacagacactcaacagtagcccttgagagcagccatgcagagccacagcggtgcaactgcccaaggccttgggagtccaccccttgcatcggtgtggcctggggtcaaagattattttggggctttaagatttaatgactgccctgctgggtttcagacttgcatgaggcctgtagccgctttgttttggccaatttctcccttttggaatgggagcatttacccaatgcctgtacccccactgtatcccagaagtgactaacttgttttttattttacaggcttataggtggaagagacttgccttgtctcagagtttgtactcagacatttgaattaatgctgaaatgaataaagacttgggggactgctgagaaagtatgattgtattttgcaatgtgagaaggacatgagatttgggaaggaccggggtagaataatatggtttggctctgtgtctccacccaaatctcatatcaaattgtaattgctagtattggaggaggggccttgtggaaggtgattgaataatgggggcaaacttcccccttgctgttctcatgagatttggttg

SEQ ID NO: 111959 - DNA, 299 bp, Homo sapiens
cccactgactgtggatttggttcatcattctgttaagatgtgatggtagcctctaccaattaaactagagttggcagaggagatgaaaaacattttctatctttgctttggactatggtgttgttccttaagagacgaagtcacagaatattagagattatctaacattacctcctcattttacagactgcaaaataaaggctcaggtgagtttcttgccccaggtttcactggaaatgcaaacaaactaagaaacaaatacaaactaggtcggcgtggtggctcacgcctgtaatccc

SEQ ID NO: 111960 - DNA, 174 bp, Homo sapiens
ctgactttgcagagccagcaggagtggtcttcctgggccactgtgctgcaccttctgcggtctcccgtggagtgacaggaagacccacgggtcaggaaacaagctagaaagccgcggggccgccctgcagggtgtaggattaaggaaccaacacagcctttccctggtggttgt

SEQ ID NO: 111961 - DNA, 340 bp, Homo sapiens
ctgtcttcatgatcacagtgatttcataccatccttacactgtccccattgacaccattatcacacataccttggccacatacctccactaccccactaccacacaatactctctccctatctctccatcaaacacatgacccacatcacttaggattttacacttgtggtgctcattccctgatatctcattttccttcttttatttcctctcctctcccttcttgtcccccactcctatcttattctctcatacacacacacacacaaacacacacacacacttactttcctgatatgtggatcttacatcaacccagatataacagagaagtttctc

SEQ ID NO: 111962 - DNA, 603 bp, Homo sapiens
gagctgaatattttcttaaaatgacattcaaagtttttctgagatttttttctatcctattaatttagcaaattataaaccaattgcaggagaaataagcattcttgtatatcttctatttctcttgatgagcaagataatttttgatctctctaattgatcgatgaaacacgagcatatgattgtttcataaatatggattaaaaagccaacccctcatatcagattttgaaatcgactttacaattctgaagagcatagatgacttcattttaatttctactccaaacactaattcaatttacagtggaaatagtagtaactaataattattatttaaatttgaatatgaaagatttaacatgttcattaatgtattcgatgttgaaagaaacatttatctaacagaatttatattggaatatgctgcagtcgacatactttatatattattaacacagtttccaaagtgtaataagctttttcctcatatttagtaaaagaacatctttggaaagtcatataaaaaaataaagcatatacaccggaagctgtataacaggggagacaacaaataatgcatataacaaagtgtaatccagg

SEQ ID NO: 111963 - DNA, 258 bp, Homo sapiens
  misc_feature (223)..(223): n is a, c, g, or t
aagattttctattgagttggagagtgattggtaatttgggaaggtgttatttatttatttattttagagacggagtcttgctctgtcgcccaggctggagtgcagtggcttggtgttggctcactgcaatctccacctcccaggttcaagcaattctcctgcctcagcctcccaagtagctggaattataggtgcacaccaccaagcctgtctctactaaaantacaaaattagccggacgtggtggtgcatgcctgt

SEQ ID NO: 111964 - DNA, 227 bp, Homo sapiens
ccaaagtgctaggattacaaacgtgagccatgacacctgccccaagtcggtttttaaatcaaatcatttctccaaaaaatttaactacctgggattactgccacatcctctccctccttacctaccatttgcctatcaatacttattcatataaactcgctcactgaggtaggtcctgcctcccagacaataaatccctcaaggtcagcccaaagcctgcctcagct

SEQ ID NO: 111965 - DNA, 538 bp, Homo sapiens
cctgcctcagcctcctgagtaactgggattacaagtgtgcactaccaaccctggctaattattgtattttttttagaagagacaggatttcaccatgttggccaggctggtcttgaactcccgacaagtgatctgcccgcctcaacctcccaaagtgagcgactgcacctggcctcttattcttttggctcattcacatactttcccagaagagtgatttcttataatactgtaatacctgaaacttgtttctgtatggaaacaaccatagatgatttcttcgcaggaaagaggtagatagggtgtggctgttcccttgttggggaactgttagtttctgtagaagaggttttagccttttacttcattagtaatttttaacatgggtggcgttgattggtgaagtcttttttaactttattcccccccgccctttttttttgagacagggtcttgctctgtcacccaggctggagtgcagtggcatgatcctacctcactgcagcctcgaactcttgggctcaagcaatcttcccac

SEQ ID NO: 111966 - DNA, 955 bp, Homo sapiens
ggttcaagtgattcttgtgcctcagcctcccaagtagctgggactacaggcatgcaacaccatgcccagctaattttttgtatttttagtagacggggttttgccatgttggccaggctagtcttgaactcttgacctcaagtgatctgcccaccttggcctcccaaagtgctgggattacaggtgtgagccactgcacccagcctctgaaagcatttttgatcagtaacacagcaggttttaaattcagaataaaaacatgatgaataaaagctattataaaatgaagaaactgtcttgatatttttttaaaagcaggcaaaatcaagcaaggtgagaaagaaattaggcaaagtaaagcaaattagactttgaacaagtaagaatttcaagaaaaatagaaaatatggctattttcctctgttaccatgtacctcccaaactaactgttataactaactgttacaactaaaaaggaaagggggcgaatgaaattttacaaagtcacaggtgtcctgagtcatccacaacattgggtcagtccaaactatgtgtttggtcaatgacacactgaactttcctccaaaggtgagttacttctaaatatgccagaaaaactaagaataacaattcaatttggtacattcttacataaaaggctggtctagccagtctttccccatcataaagaactgaattgtaaagaactgaaaagtaaaccaaatcaataaaaggtcacttttataggtttatttgagtcctcagagttttaaatcatctcatataaaattaacttgctagacagggcacccccacaaacacgtatttttagcctagttttccatctctcagaatttttctctgaagttctcattaataataagaaagttaaaacaccttcgaccagtcaacataaattgtcattagatgtgacaagaaatacaaaacccaaccc

SEQ ID NO: 111967 - DNA, 986 bp, Homo sapiens
cgcccagtctggagtgcagtggcgcgatctcggctcactgcaagctccgcctcccgggttcacgccattctcctgcctcagccgcccgagtagctgggaatacaggcgtccaccaccacgcccggctaattttttgtatttttagtagagacggggtttcactgtgttagccaggatggtctcgatctcctgaccttgtgatccgcccgcctctgcctcccaaagtgctgggattacaggtgtgagccaccgtgcccggcccacttttgaaaaacagtttcagtgagtatcgaattctaggttgactacttttttcttttgctactttaagaattttcttacactgctttctcacattgtttccagtgagaaatctggtgtcatcctaatttttgttcctctgtttataaaatctttttgtttttcatctggctgttgtcaagattttctctttgttactggtcttaagaaatttgattatgatgtatcttggtttatctttgtgtttcttctgcttggggtgtgttgagtttcttgtatctttggttttatagtttgtatcaaatttgggaaatttggggttattatttctttaaacactctctctgttcctttctttctctctccttatgggcctccagttacacatatattaaaatgtcccacagctcaccagtgttcttttcattaaaaaaaaatatattcattccttctggggcagggcatggtggctcatgcctgtaatcccagcactttgggaggccaaggcagtaggatcacttgagcccaggagtttgagaccaccctgggcaacatggtgagacctcatctctacagaaaatttttaaagattagccaaacatggtggtgtgcgcctgtagtcccagctactcgagaggctaaagtgggaggatcgcttgagctggagaggttgaggctgcagtgagtcatgatcacgccagtgcactccagcctaggtgacagag

SEQ ID NO: 111968 - DNA, 494 bp, Homo sapiens
ccacacctccccaggctcttggccccccagcccaacaacctaatatgtccatatggcccagaggtgagagaacacagctggctttgagaggggagctaagcccacacaagggcacaggcatggcattgcacagacccttaacctctcttttgacctgtttcctcacctgtaaaatgaggctgaatctaacagcaggtgcccatctcagagctagtgaaggaattaggtaatgcaatcaaagcaggcagtgcaactttcggctgacagagcacgcactggcaaacgctggctgttactattgtgaatggtgttaataactactgtctgctgccctgtacagtttataaagcacatctgcatccaggatcttccatggctgttgagaggcctgagtaagtggatggtgggaaccccatggtgagcctgctgcggtggccagggtgttgctatggtcactgcacactgtgaacgcctccagggagctggtgggggca

SEQ ID NO: 111969 - DNA, 416 bp, Homo sapiens
gaagacttctgatgcaggtgtagggcgattaaaagaacctccttctcctctgcgacattgcaccggcgtggattcaatagtgagcttggcagtggtgggtgggttccagaaggttagaagtgaggccgtgagcaggacctccttccaggagacatgccatctgcaggcagtgcaactttcggctgacagagcacgcactggcaaacgctggctgttactattgtgaatggtgttaataactactgtctgctgccctgtacagtttataaagcacatctgcatccaggatcttccatggctgttgagaggcctgagtaagtggatggtgggaaccccatggtgagcctgctgcggtggccagggtgttgctatggtcactgcacactgtgaacgcctccagggagctggtgggggca

SEQ ID NO: 111970 - DNA, 335 bp, Homo sapiens
ctcaaggtcaaggtgaaacctctggatttacagatcagcaaagctgcctaccattgtgtttctagcatctttgtcctccctcatttcatctggggaaaggaggtgagctagacagattccagcccatagggagtgtatgtctcatggggagacatcaatgaaatgaccacacaaataatccatatgctatgatctgggataaatgccatgaaggaaacaggctgagttatgagagcttatggtggggtgaactgactccatccaggaaggtcagggaaggctttgccatagggcatttgagctgagagccaaagggtgagtgacagttaactagg

SEQ ID NO: 111971 - DNA, 289 bp, Homo sapiens
atcgagccggtaccctagcttagaagtttcaatagcagccgggcgcgtggcgcgtgcctgtcctcccaatgtgctgggattataggtgtggaccactgtgggcctgtgttgttgctttaaaaaacccactgtgaagatgcataagtggggaaatggaattgtagtcaaaagaggcttaatcttagcaaaatactataaaatgtatcagtctaatgatgatgacacttaatagcatatattaaatttatttcagttacaacattgctttagaaattaaaatgaactatag

SEQ ID NO: 111972 - DNA, 219 bp, Homo sapiens
tgacatgccaaacacagtaacttcttcttttagaggaagcctctctgcatttgcactcatcattctttttccccaaaatgtccttcttgttttctccagctagtaaagatgtcctcttctttcaagaccctcttgtgaaggaagttttgagggttgcttcatattgaagtagcactttctctgtatgtcaactgagtgctgtctgagtctctatcacaa

SEQ ID NO: 111973 - DNA, 271 bp, Homo sapiens
ctagtgcctttaaagcacctactatgtttcaggcactttgatttactttcagaatgtttttctccctaatttaatgctcccagctacctaagagatatatggtattactacattttatagataagaaatgtgaggtttagaaagggactgtttgttcattgtggaacttaaattggaactagcctccaaagttggctgaaatttctgtttggaattcagaatttgaatgcataccacttgtcccaacttataaacaggactcttgtagtga

SEQ ID NO: 111974 - DNA, 127 bp, Homo sapiens
cctgtctcaaacaacaacaacaacaacaagaggtgagcaaggctcatgtggtgacccagtccgcccccaccaaaagcacccggctacttcccagacccccttctctgtagaggaccaggtcatctct

SEQ ID NO: 111975 - DNA, 485 bp, Homo sapiens
agctggggcacagaggtttgtatcctgtcagaattaacaaaattttgtattgaaggaaattggtgaatagaaatgagaatagctatgaaacacagtccttgagataaaaatttccctaactcctaaataacatagtaagcctttccactagtgctaatgtgaattctcgcatttgagtatttttttttaaaataataacctgaaagaggaagatgtagtgtggctaaagttggaaagtgaataaaacagatatattggaaacataaaatctactcatcagaatttatgagtatagaagtttctgctaaaatatgcatcatgtatcacatgggcttgtggatgtgtgttttttccagaaaatttggaaagacagaaccttctaggggcacataaagtatgaacgtaagcttttaagtgctaagagaaggtgactgaaaaatatttttgttgaatcttcacttgtttcatttttaatcatctctcct

SEQ ID NO: 111976 - DNA, 1006 bp, Homo sapiens
cagggctgtggcctggagacctgctgccgccccagctgctgtcagaccacctgctgcaggaccacctgctgccgccccagctgctgtgtgtccagctgctgcagaccccagtgctgccagtctgtgtgctgccagcccacctgctgccgtcccagctgctgtcagaccacctgctgcaggaccacctgctgccgccctagctgctgtgtatccagctgctgcagaccccagtgctgccagtctgtgtgctgccagcccacttgctgccgtcccagctgcagcatctccagctgctgtcgccccagctgctgtgtgtccaggtgctgcaggtcccagtgctgccagtctgtgtgctgccagccaacctgctgccgtcccagctgctgcatctccagctgctgccgcccctcttgctgtgaatccagctgctgccgcccgtgctgctgccgcccctgctgctgcctgcgtccagtctgtggccgagtctcctgccacaccacttgctatcgcccaacctgtgtcatttccacctgcccccgtcccttgtgctgtgcctcctcttgctgctgagctccttgcctgaaactatctcctccccttcagctcactcctcacagaagcagaccttgtgcatctcataaacaactcagaagaggccattcccaccaactgtgtgtccatatcctggacatatatctaggatatatgtcctggctatacatctagaatatatgttccccatgttgacccaagtgtgaaattagatattatttacagaaagaaattaatagaatttaccaaattttataccttatatttgtatttatggataccaagttcttctgtcccaaacatggaaattcttgcagggtaactcggggcaaggatgtctcactctcagatttgaaagtctgattgtttcaccctgtatttccttttacagcaatgtttctgtatcttatttttgctgcttctgaataaaactccacttttgtcgcatagaaat

SEQ ID NO: 111977 - DNA, 221 bp, Homo sapiens
gctcattgccttcttagggtaggttggaataggagttaagagtttaaaaccactgctcatgcaaactttacattttaacaagaatgctcttgaaagtgaataatgcatgctgaaagtgaaaatgcgtgttggatatgaagtattttgaaaataaccagtatttcacggaattcgacaacatttattttaatcgcagatctcttatatgaatatagtaatta

SEQ ID NO: 111978 - DNA, 426 bp, Homo sapiens
aaataccagttgcaaaacagtcagcaccctgcctggcacagagtgcaggagctcagagcacagcagcgtgaggatcgctgctctcaaggaggcctcaggaagatgaggctgagcaacagcctgatgcaccacctgctctacctgctcaaattgggtcaggcgagcggtgtacccagctgttgccaaggcacccagcacacagggaaatactccagccaggacggcaggtgctgtaggggtggggccttgggcctgcttcactgacaccacccatgctgccaccaccaggtctctgggccatctcgggggttcctgggggtgggggaaatatgctattgatctgggtccaggatctaaccaggtccagttcccccagaccctactccaacctggaaacaatggggcctttgctgtctagaggggcag

SEQ ID NO: 111979 - DNA, 300 bp, Homo sapiens
attatatttaattgaacaagagggaagtttctatgaaattctaccacaagtctccaattgttatatgttaactgtatttaagagaactaaatataaataagggtagttataaacatgagattaacaacctgataggttttaactacaagcctatttccttaaaataagagggacaaaatatagaatctacagtgacgctaggaataactcacttcgttttttttcaacatgtaagaaatagttaacatatcaagttttcagaggctgtgattgtttaagccaatgtaaaccaaccaatat

SEQ ID NO: 111980 - DNA, 298 bp, Homo sapiens
tctaccatccccaagcaactgttttttctcatctctgtaatccctctcttatagcactcaagtcacaggattattgggtgtccatgtcttccccacttgaccacgatccaattgaacacaaggatgtgtattattcacttttgtcttcacaagacctcagcagtttgatcccacagactttcacaaatccttctcttgtactacctggcacttgctgcacttagtgctggagatacaaagataaatatcccctgatgagacttccaggctagtacctcaatgtctgattcactgagga

SEQ ID NO: 111981 - DNA, 245 bp, Homo sapiens
caattcctccacaaccattgttttaagagggatttttttttctttgatgtgataatgagcatcaaaataacaatgacattatcatcacaattatttaaaactctctttaataaaataaaactggctgggtatgctggctcacgcctataattcccacacttttttgggaggctgaggcaggagaatcacttgagcctaggagttcaaatccagctctggcaatatagtgagatctcatctctaca

SEQ ID NO: 111982 - DNA, 400 bp, Homo sapiens
agccagtttgcataaacaggatgtgtgatatttactcttgataggaggcatagcaggcccttagagctttacttaaactgcatggcaaattgaaatgaatcattttagtgtttagctagccactaaatcccttgctgatctgtcctgcgtagtttaaaacgtggccatgttataaagaaaagtcttgaagcatccggttattgctgagttttcagaagaaaacaacgcaagcaatctcttgccctttttccacgttaccctttaaaataacctttgttcagtggtacatttagttaaggcatttgtattcaaatgtagcatagtatttgcagagaaattaccttttaaaacatctcaaaagtgttttctaaaatgatgaaataaacggtggggttctgtc

SEQ ID NO: 111983 - DNA, 543 bp, Homo sapiens
ttcagtgggttttagctggctccattactgcaaccttttatcagcaatgtctttatgacctgtattttgtgttgacctcccgtctcatccaaatgccttaaccatctgggaatgcagcccagtaggtttcagcctcattttacccagctctatttaagatggagttgctctgactcacacgcctttgacagaatgagaccgagaggtaggcaggggtcacagtggggattgagagaagtggacagattctgggagtatttgagaaatggaattcacaaggacttgggctgaactcaatatggagagtgtggcagaggagaggcttcatgactcacacaccgtgatgcactgtggtgctcttcactgaaatagctagcattggaacagcaggttttgttggggcttgctgtgtgactaggagggataggggcggcatgagtttggttttctgcctgttagtttgaggtggctttgctagatctaaacaaagtgttcaagtagtcacttgtattttcttgtctggagtttagaggggagagatat

SEQ ID NO: 111984 - DNA, 399 bp, Homo sapiens
gtttagttaactagcattcaagtttatgaagatttttgtgtagatgtaatgcttgcttctgccaaggaataagaatgttgtaatccaccatcttttattctggcttttaggcagctgttgaggtaaacaaactaagtttaatgctcgaagatagtgtattcctcagaactaacacatttgattttccataggtttattttcctttacctgttctaatttaactttttgtaaaatgccacagtccatttttagaaagattaagggatatttcattattatagataagtttctaggtttctttcaaacttgatatacctaatataaaagttcagattatttttcctctttatttttcactttttattcagccaactgtgatttctagaattttgattttca

SEQ ID NO: 111985 - DNA, 741 bp, Homo sapiens
gcatatcatgttatgttgatatatattttatggctttgaacagtgtctggttgtgtactgtgtgatggggcagaaatttagctttaacatatttaaaaatgttttctcagcttactggttccttgaatgttattcaattatcacttttatttctcaaactatcttttaaatcttattttaatttctaacttatataactctttctgactatactttttgatttactgaggtaaataaactgaaacaacataggatatctttcaagttgtaaaatatagttgaatttatcagtagcattagaaaatcaattattgaaattatggaaatgtttattttattggttactcctacgtcactattccctaacatttcatatgtagaataacatcccaatacattaactgcccatagagttgcaaaagagaggagaccaggtaatttacctaaattgtactaaattgctacctacccaagttaagtatgaaattgaaataactatgttttgtacccatcatatagcaaattatgtcatagccctagtatgtgtgtaggtggggagcagtgaggttgaggtttagaactttatttgagcactaaaattggtttactgtttcttattgatttccagtcttgcaataaatctaggctgccttggttcagtttccatctctgctacctagtgactttgtaaattacttggacaaggttgagcctctctgtaccttagtttcctcatgtaca

SEQ ID NO: 111986 - DNA, 234 bp, Homo sapiens
gatgctggtgaaaggggcaaaggaggtctctttgggatgaattggctgaacagtaaatagtctaggagataaagagccttgactccaattctggccaccactgccgagaacaacttggcccaattcctaattattctctctcactttctgcctctgcaatgggggtaattattgaaatatgttaacaaggtgtgttgagatcattggatagaagacaaatatcatttatactca

SEQ ID NO: 111987 - DNA, 583 bp, Homo sapiens
agacagatacgaatcgagctcgtacggggatctttcaatacggcgatctgacggcatgcgtgctcggaggcggtcgtcgttttacaatgacgttgattggttaccacaaaatgctcttgtctcatcttgttttttccctgcccagccctggaatcaatcacttctctaaggagccccacccacattgttttgaaaaagtcccaacatccagacagcaccctagattaactcagaatctctagctgtgaagtcacggaatttagcttttaaaaagttccccaggtgattccaatgtgcatttgaggttgggaaccacaaatctagactttacttctggtggctaaagaatagttaaaattttgttaaattcccacatgccaaagactttagtgtacttcccagcaggctcttaggctccctgaagacaagtttttaaaatctctctaactagcacacatcccagaacctggtacataaatggtgttaaaagaatgaaagttaaacaagtaaattaagctttggcttccttggggaaattagcctaggtctaactcttttcttaatccctcattcgtctttaaat

SEQ ID NO: 111988 - DNA, 1255 bp, Homo sapiens
gacacaggcaggtggcttcttaaatcagtgtgctctgaactccctgtgacctcagccaacctgtgacaactgagaatgagacaggctctatcctcagagcctctttttgccctctctgcagcctagtggctccttccctcccccacccataggcctgcgtccccgccctcctttcttccatcaagcctgagcttgggaaagaatctgataaacttcttacattgtaacctttaagtgaaggaatgagacgttagggatggatttgaggcacaagtgagacagtgcagaaggaatttgagggttggagggggctttcttgaatctgagcgattcagaccataaaagtaaacttgtctttgtttatttgaccaggcttacatcaaacatggtttctcttttattaatatcaaacacaatgtatttcaattcagtaaatatctgagggacagaaaccaacctaggtgctgttggtcacagtcttggaggacagaatggcagaagtaaatactccataaatacatggaatagaaatctgtgcaaagtgccaaaaacatagaagaggtagcagttatttcattggaagcagtggggcagattaaggaaaaattcagaatgaaaggtaacattagacactgggtgtctagaggaataggagtttgccaggcagctggaggaagggcagcaccggggcagaggaaccagcgtaagcaaaggcagggagatgtgaagagttatggggaatggagaaaagactggtgaggcaggagtggaggatactgagagttgcaagaggtggagagagattggagctggattatgatgggaagtgtgaagatatttacacctaatggtttttgaacaggagagcaaataggtccaaaaatgcctggcagcctcacagagaataggctggagcctgggtacgtagacttgtcaagctttatacaaactcatacaaactgctacaacctgattaagagcctctcatccagagtttttattcctggtccttcgctgactggcactgtttttgttttttttttttaactgggggagatgacctcacacaggatatcatgctaaccaaatttttatgctgccaagtcaggccattttttttaaaaaaatccatccactgtcactatttcataaaatgaaagacattttaataccaagaaaaagcacaaaggctaaacttgaaagatgaaggcagtcctttacatttaataaatttagatttatgaaaaacttgcaa

SEQ ID NO: 111989 - DNA, 264 bp, Homo sapiens
ggtgtgagccaccacgcctagcctaggcctgcaatttttaacttcctgtccaaatagttgataaatggggaaatttttaaaaatagttttattttctagaagttttagacttacagaaaaattgagaaggtagtacaagagttcccatataacctgccctcagtttaccctattattaacatcttatattagtatggtatatttgttacaattaatgaaccaatgctgatacattactattagctaaagtccacagttttttta

SEQ ID NO: 111990 - DNA, 988 bp, Homo sapiens
cgtgatctcagcttactttaacctccacctcccgagttgacgtgattctcctgcctcagcctcccaagtagctgggattaaaggcatgtgccaccatgcctggctaatttttgtatttttagtagacatggggtttcgccatgttggccaggctggtctagaactcctgacctcaggtgatctgcacacctcgggctcccaaagtgctgagattacaggtgtgagccaccatgcctggcctttttacatcccttttaaactttttatctttcatttcattctactttgttttattttcttctttttttaaattctactttctgaaatatattgatactaattagtggtttttagaagttagtatttaattaggatgggattatgggggattccagtaatctggatcaatatgcactatcttccatgcaactgcaaataatttccttcagttgtgttttgtgtgtgggagggggttgaaggataagggggtggcatggggatggctatctttactattttcaaaatagttttgtttctagtttgaaattattttttaaatgttaactgtgttgctgagacaattcagcggggaaagaatagtcttttcaacaagtggtcctcagacaattagatattagcatgcaaaatattgaagtttgatgtctacctcaggtttgacctctgcctcacaccatatacaaaattaattcaaaatagatcaaagacctaagtttacctgctaaaactagaaaactcttagaagaaaacataagcataaactgtattgaccttggattaggcataatcttagatacaaaaataaaagcataaataacaagagaaaaaaataaaaagcaaacttctgtgctacaaattatactatcaagaaagtaaatacacaaccacagaatgggagaaaatttttgcaaacatgtatctgagaatggatttgtatctagaatataaagaactcttacaactaaacaaa

SEQ ID NO: 111991 - DNA, 418 bp, Homo sapiens
aaaatctctcctggattagtgttagatttctagaccagaagtgtcaattaagtttaacaatttcttcaggcagagaaaattgcttttgaggtatcacttaagcaaccttagtgcttctaagcaacataactgccttttgaggtatgaactgaagggaagtgaagtataagcaatagagttgggattttttttttcttgagacggagtttcattcttgtcacccaggctggagtgcaatggcaccatcttggctcactgcaacctctgcttcctgggttcaggggattctcctgcctcaccctcctgagtagctgggattacaggtgcatgccaccacagccagctaatttttgtatttttagtagagacggggtttcaccatcttggccaggctagtctcgaactcctgccctcaggt

SEQ ID NO: 111992 - DNA, 537 bp, Homo sapiens
gcagccaccttccatgtccaggccctgttattgctgggcatacaggcccctggacagttagtgagtgtgggtcacagaactggggagcaggatcgggggtgccactttgtgggaatggaagaggctgaaacagaggcccagagcccagccagccactgcttggaaagggggttgcctcctgcctgtgctggcgtggctgaacagagccaggctagctttttcctacactcctaataaaactcgctttataacaatggtgagagcgtttccagttttcccacgttttcctgcatgaggcttgggcagaccctcccttctctgagaatctgggggatggagtgagtcggaataaacttagaggcaggtttggtcccaggaaatcttagccgttgtcgctcttgggttcagccttcctgtaatttgtctccagtgtaaacctggttcctttttcaatgtgatggtaatgataccagcctcacattcaggccgtgccccatggtctgaatttcctgatcacatggcatggtggttcacaga

SEQ ID NO: 111993 - DNA, 276 bp, Homo sapiens
cactataaaacggtttacatttattatctcatttaatcttacaacaatcaaaagtggaaggtagtgttattttcttcattttacaatgaaggaatggagaacgaaataggttaagatacttgcccaaggtcatacagctactcattcataaaggaaaacaattcacatttgtttgtcaaggttaacccattgcaggagtgactcatctcattcctaattataagccactcttttatatgacctattttatactccttcctctcctcttccattaca

SEQ ID NO: 111994 - DNA, 643 bp, Homo sapiens
cctggctctgtacttagttatgtttagaaagagcaagggtgctactggtagacacttgaaattcgaagtgttttttgtgaataaaatgtgtttatggtaacttagggaaaagtcgtagtaggacagcaaacgtggttctacatgtacatgaagttaggcaagctgactcccctcctagaaagcctacctttcaggcacatatttgtgccaaaatcccagtgaagcacaaacaacagtaatttatattagtatgtggcacagttcacatttccaatagaacttcatcttccctgaaacaatactcagtacagtctcaaatcacaaatagcctcacttaaagctctacccctgaaagaactactgaaagattcaggaaggtcaggagatccagattccaattaacttagcacctgatgcctgtgtaactctggatgggtctcagttctctagtagttgaggactggtatctcaaaggttaatgaaatttgcctaaggtgaaggtagattaagccttccattctcacacaaattgcccatcttccaatcccctttgtaccttgacattttcaacacaaaggggttggggtgctcagaggattacacaagcaagcacatatttgtcacagcacctgattatagacct

SEQ ID NO: 111995 - DNA, 460 bp, Homo sapiens
ctttgtgtccttcaatctaactccaagttgacactcagtattaaccatcacacatatgttgtagttttgcaaaatgtgacagcaagggaaaatatagctatttaaagaaacacagtaatgctatcatttagaaaataaactgattggagtccctggatcatagcttggcttcaactctctcaagtttacaagagcgttgtctgggaaaattaatcaacaaggttagaaatgagttctgggaaacttggctcactatagtccaggaaccaggccgaactacagcatgggccaggtactgaataaatggcaggaatatagttagggcagtaggtggctctaaattttctctttttgtttccctggtgtatgtcacagcagttttctgtggggtgaagtgagtatcctcaaccaaggagctgggcatggagaaaatgagaggaacctcattaatacatggcaa

SEQ ID NO: 111996 - DNA, 110 bp, Homo sapiens
tttgctaattcaatgtgggagagagctacgcaaggttgtagataacttgattcactgagggaattgctacaacaatctaccacaacctctgaagcacatttaccaatgtt

SEQ ID NO: 111997 - DNA, 414 bp, Homo sapiens
ctggaggccattttagtgccacacaaaaagtacctaatattagaggcccagatgcctcacaaaagctaaagctagtctgttgacctagattttcatgtcactatgttccctatgagctaccatagactcttttcccttcctcagtcctatatctagtaagataaatgacactgtatctgttgttaaaattatctcactaatatttcacaagcataatgtggaaataatacaacttatctagccaattatgctctttataaggagtcttcaatggattctaaaacctgagtaaaatgctgctggggaataagatattcacaagacaagtaaataaaatgcaggatccttgattggaccccggattttttttttaattgctatcctgaaatgacagaattgagacactggggaaat

SEQ ID NO: 111998 - DNA, 316 bp, Homo sapiens
aaagcaacaatagcagccgttggtcattcataccttaatgtggtttactgagtcttcctaaaacccaaatgaacaatgaaccttaaggctatccctttggacttgaagaaaggacttctattggaggatgagggtgagcagaaagaaaagcagtttcacagttggttgttctcctggggaaggtagttcagaccattcgagggtgtagttagaaccatgagtgcactattttggatgaacaccaggagctaagagagtaacatagaggtgtggacagaggattaagtcctcaagacaatagccccagccccatggg

SEQ ID NO: 111999 - DNA, 760 bp, Homo sapiens
caatttgtcacctcgtggccctcaccatctggacaacagcagccctggcccaggttctgaggcccgtggtatcaatggaggcccttcccgcatgtccccaaaggcacagcggcctctgagaggtgccaagactctgtcttcgcccagtaataggccttctggagaaacttctgttccacctcctcctgcagtgggccggatgtatcccccgcgttctcccaagtctgctgcccctgccccaatctcagcttcctgtccagagcctcccatcggctcggcagtgccaacctcttcagcctccatccctgtgacctcatcagtctcagatcctggagtgggctccatttctccagcttctccaaagatctccctggcccccacagatgtaaaagaactctctaccacggaacctgggagaaccctggatccccagtagctggctcagatagctgagaaagtccctggtcttcagaatgaacagaaactattccatctggaagaactgagaaagtgtggggcccagtttaatcttcagcccagtagttcccctgagaacagcctggatccttttcctccctggaccttaaaggaggaggccaaaggaaaggagaaggaggatgatggtctgttgacttcagagcccatggggtcccccgtctcctccaagacagagtctgtatcggataaggaggacaaaccacccctggcaccagcaggaggcactgaggggccagagccgcccccaccaccttgcccaagc

SEQ ID NO: 112000 - DNA, 471 bp, Homo sapiens
ccataatgtgtgccaggaagccaaggtttgttgtatagtagaaggggttggggtatgagagatcagccagacacgattggcaggcagagcacgcgtgtttttatgaagaattatgccgaggtggcgcacattatggagggactctgtgtaatagaaagggttgggatgaatcagggagaactgtgtgggaacagtttctagacctgttttcaaggaacagaaagaggagtggggaaaggatttaggatctatggggtcagctaggtttccctttgtgagtttatataatggttttgttaggatggcaaaaccaggtatccaaaggcgaaagtatctaaccatgcccaggaaggaaaggagttgttgttttgtagaaggggttggggtttgagagatcagccagacacgattggcagggagagcacgcgtgtttttatgaagaattatgccgaggtaggtaacagatggaga

SEQ ID NO: 112001 - DNA, 224 bp, Homo sapiens
tataatatataactttttatttttcattttaaaaaaacaaataataaaatcacaaccccctccccacaataataataaaacagctggtgttgtgtattcccagtaccaggaaaaaaaagaaagaaagaaaaaaatgtaaaagccacattgcgttggaggtgtttccagatgctggaggctgatgaccaaagatgacctcagcacaacggagccagttcccgatc

SEQ ID NO: 112002 - DNA, 348 bp, Homo sapiens
agtgggtacataaacatgcataggaaactataacattgcttaacttcatacgtgcccgttaatgggggcctaatctaatattatgctcctgcaacaaaaataaaaactaagaaggaagaatgagaagagcaacaaaccagtctgggggtgcaaccagtaaagagtctgcagacttcacagaggccaatgtttcaatactctgccatgtaactacctccaaagtccaatgtaacaaagctatgcaatgccttgtaattttctttctgaatggctgacaaattttaacaaaatatggcatagaatctatacacacatcctgttagtttccttgtaacaagaaccatgaga

SEQ ID NO: 112003 - DNA, 711 bp, Homo sapiens
tcaatttggcctattagaccctttgaccttggccctcacctacatgtgcagctacctctctccccttgcttgaaagaaggcctggactaaggaccacgcctcacctcccatctaagggttgttaagcactgtcaactccaggagtttgctcaagttgtcccttctatgtaatgccctctatcccgctgcccctgatgtaaactagctttcatgcaaggcctttgaggaccccctaccaggcccaccccaggcagagtgactggctcagctttgctcatgtgggcagtagtcctctccttcactgaactatcattatgcctgaactgcctcccacctggaatatgagttccttggaaactgggctagatcctgtgcacaattgcccccatgcccagtgcctggtgtggcatgcagcaggagctcaataaagaggttgtaggccaggtgccatggctcatgcctgtaatcccagcactttaggaggtcgaggcagtcagatcacctgaggtcaggagttcaagaccagcctggccaacatggtgaaactgtgtttctactaaaaatacaaaaaattagctgggcatggtggtgtgcacctgtaaacccagctacttgggaggctgaggcaggagaattgcttgaacccaggaggcagaggttgcaatgagccaatatcgtgcctttgcactctagctttggcaacaagagtga

SEQ ID NO: 112004 - DNA, 628 bp, Homo sapiens
agtgcctgtgccacctgcaagttcaggggtcctcaggcctatccttgcttccccagcacttcaactagggccgaggccagctcctagggcccaggactagctctgccactcttgaggacaggttaaaaacaccaaaggtcacactggagaggaaggccccatgcagcttttctgtcaccttggtgatgagccaccaggcagaacccattaagtgctaatattgctgtttatgggtataaactgcttagaagctacattttacagagtgtctaataggcaatgaggagcagctgcaggcatggacattagtttggattgctgagttcattagtttctggacccttcccatggcttccaaatgccaagctcctgcatagagcacgtctcagcagtttctacagagcatggctcctgggagcaagaggacactgtccctggctgccagagcaagcagcttgatgccagaggcagagagacaagagatgcaactgtggggagcctgccagcagaaactaaccagactgctcgtccccgtggaccagcctctgcaggccagaaggaaagatcagtcaaccaagcagtgaggaacccagcctttggggtacaggatgcggactcagtctccagg

SEQ ID NO: 112005 - DNA, 468 bp, Homo sapiens
atgaaggactgcagtgtcaggtggagggagaaaggccaggtattaggtggcaacagatgaagactcatagtggaaggtggccctgttgggtgacaaaggatcaaagttagtggtggaagatcgacgatggtagagaacgcagtgaggggatgatagaggatggggaatgttggccaagatgatgccaaaggatggtgaaggctgctgaatgaacagcaatcaccgggcattgtgctgtgagcagtgcaagatggtgcccttggaggggtggaatctggaattggagagaagaacattcgcataacaggatggagaatgtcagtggaatgtggtagtttgggtcagtgaagggtgatgctttatcagtgatggatggaggaagacagaattggagaagggcaaatgtttggccagcagggggtggagaaaatcaatgggaaatactaggactaagaaaggacagtaaac

SEQ ID NO: 112006 - DNA, 859 bp, Homo sapiens
atgttttgtatagacagggtctcgctatattgcccaggctggtctcaaactcctggcctcaaaagatcctcccacctcggcctcccaaagtgctgggattaaaggcatgagccagccaccatgcctggtctattttttattgataaatgaaatagaccatgcctgttctatttttaattgataaatatcctgggagaaatactttgggacaatgcaaatatcctgtttctcctccaacttttacccactgatttcagcatatatcagtggatcttgcctgcaaccattattaccatggcatttgcctactagtgattttgtgtttccttcatttgttctccatttattaattggaattcttctgtaaggaggagttgtcccttctccccaacttatccatttattcaattttttttgtaaactatggactcatgggcatctattttattctatgagctataattcaatactgtcatcatttagtttcttgctcaagttattctaacttcagccattgggagctccttcagactggctactatgctgtcttgtcatgcccccaccctttctctagcactttcttacattcttacaccaaaagacattacagcctcatcttgtattttccctgcttctgtccagaattagccattattccaaagatcccgagttcctttattggagaatgatattagacacaaagatgtgggtactaagtatactcgttgctgttggggtgttaattgcttctagggcttcccaagacagagctaggaaatgaaagcatacataataacccatgcatacacacagatcaatatctattcctgtatctatctgtatacatactcatgtgtcc

SEQ ID NO: 112007 - DNA, 806 bp, Homo sapiens
tactgttgagcaaatgaaattagaactcatttagaatcctgtaaacacctcagaactatgtagtgacatttcttccttgcattcctgttcagctctgtggaatagggagccagtgccaatccaggtggccttttctgtactgagatataaacagcaactctacaaatacttgttttggaaagagtaagccaacttacccctgatggaaagcttgtgagagcaatgtggctaacacagcattgtgttcacctggacctgtattgtagccttgctgttttgtggggaggatcctgtagccgtgcttctcaaacctgagcttacatagggattccctggggaaatctggtaaaatgaggattctgatcctgagattctgcattcttaacaaactccccaggaattatgccactgagggttcatgggcttatccatggctgtgatggttttatcttcattgtccagaccctaataaaaagatgacttcacatctttggcattttgaatgtttgctgaagaggctcatttgataagaaggtggtgatcatacactgagaggtatcatcaggtgcctgtccctccccattcttagcaggacttccagctttgaggtacagcttgattttaaatggaaatgtactagaagaattttttctttttttatggctgaaagaaagttctcggtgaatgctaggaggcccatgagatccatcacttaaaaagaaatgtgaagtcccaaactgtatgtgtaatgtctgactgtcagacaaatcagtcatgtatgcacggaaaggctgccgccctgggaa

SEQ ID NO: 112008 - DNA, 1971 bp, Homo sapiens
cggcacgagcaggtattctgaaggtgaaagataccagagattctcaaagatgcgagttttctgtgtgggactactccttttcagtgtgacctgggcagcaccaacatttcaaccacagactgagaaaactaagcaaagctgtgtggaagagcagaggcaggaagaaaaaaacaaagacaatattggttttcaccatttgggcaagagaataaatcaagagctatcatctaaagaaaatattgtccaggaaagaaagaaagatttgtccctttctgaagccagtgagaataagggaagtagtaaatctcaaaattatttcacaaatagacagagactgaataaagaatatagtatcagtaacaaagagaatactcacaatggcctgaggatgtcaatttatcctaagtcaactgggaataaagggtttgaggatggagatgatgctatcagcaaactacatgaccaagaagaatatggcgcagctctcatcagaaataacatgcaacatataatggggccagtgactgcgattaaactcctgggggaagaaaacaaagagaacacacctaggaatgttctaaacataatcccagcaagtatgaattatgctaaagcacactcgaaggataaaaagaagcctcaaagagattcccaagcccagaaaagtccagtaaaaagcaaaagcacccatcgtattcaacacaacattgactacctaaaacatctctcaaaagtcaaaaaaatccccagtgattttgaaggcagcggttatacagatcttcaagagagaggggacaatgatatatctcctttcagtggggacggccaaccttttaaggacattcctggtaaaggagaagctactggtcctgacctagaaggcaaagatattcaaacagggtttgcaggcccaagtgaagctgagagtactcatcttgacacaaaaaagccaggttataatgagatcccagagagagaagaaaatggtggaaataccattggaactagggatgaaactgcgaaagaggcagatgctgttgatgtcagccttgtagagggcagcaacgatatcatgggtagtaccaattttaaggagctccctggaagagaaggaaacagagtggatgctggcagccaaaatgctcaccaagggaaggttgagtttcattaccctcctgcaccctcaaaagagaaaagaaaagaaggcagtagtgatgcagctgaaagtaccaactataatgaaattcctaaaaatggcaaaggcagtaccagaaagggtgtagatcattctaataggaaccaagcaaccttaaatgaaaaacaaaggtttcctagtaagggcaaaagtcagggcctgcccattccttctcgtggtcttgataatgaaatcaaaaacgaaatggattcctttaatggccccagtcatgagaatataataacacatggcagaaaatatcattatgtaccccacagacaaaataattctacacggaataagggtatgccacaagggaaaggctcctggggtagacaaccccattccaacaggaggtttagttcccgtagaagggatgacagtagtgagtcatctgacagtggcagttcaagtgagagcgatggtgactagtccaccaggagttcccagcggggtgacagtctgaagacctcgtcacctgtgagttgatgtagaggagagccacctgacagctgaccaggtgaagagaggatagagtgaagaactgagtgagccaagaatcctggtctccttgggggaatttttgctatcttaatagtcacagtataaaattctattaaaggctataatgtttttaagcaaaaaaaaatcattacagatctatgaaataggtaacatttgagtaggtgtcatttaaaaatagttggtgaatgtcacaaatgccttctatgttgtttgctctgtagacatgaaaataaacaatatctctcgatgat

SEQ ID NO: 112009 - DNA, 737 bp, Homo sapiens
catgatggctcatgcctgtaatcccagcactttgggaggccaaggtgggtggatcacttgaggtcaggaattggagaccagcctgggcaacatggtgaaatcccatctctactaaaaatacaaaaaacttagctgggtgtgccagtgcatgcctgtagtcccagctactcggtaggctgaggcatgaaaattgcttgaacccgggaggcagaggctgcagtgagccaagatcacgtcaccgcactccagcctgggcaacagagcaagaccgtctcggaaaaataaataaataaagtacagtataaggcatatagttatttgttaatacctataatttcagttttaaattaaacagtaattaacgattttgacttttcactaattcaagagattctgttcatacctgctttacttacaagtttactactcactgaagtgttgaaaacctcctaacatgtgtccttatcaaacagaattacgagaaatcttttccaaagccaatggaaaccaaaaaagtgcagaagtggctatactaatataagacaaaatagatttcaagacaaaaactataggaaaagccaaagagggtcactatataatgataaagcagtcaattcagcaagaggatgtaaccattttaaacataaatgcacccaacactggagcactcacatatataaagcaagtattattagagcaaaagggagagacaggccccaatatgataaaacttggag

SEQ ID NO: 112010 - DNA, 1580 bp, Homo sapiens
cgcgctcgccggagagctgggtgctaccgctgtttccgctgctgagccctgcccgccggccggcccgctcgctagctcgcttcccctcgcccagggggaaaggtcagcagcgtcctggagccgccgtgtcactccccgaaagccatgaactgcagcgagagccagcggctgcgaacccttctgagccgcctgttgctcgagctgcaccaccggggtaatgccagcggcttgggcgctggccctcgtcccagcatgggcatgggggtcgtgcctgaccctttcgtgggccgcgaggtgaccagcgccaagggcgacgacgcctatctctacatcctgctcatcatgatcttctacgcctgcttggccggaggcctcatcctggcctacacccgctcccgtaagctcgtcgaggccaaggacgagccgtcccaggcttgcgccgagcacgaatgggccccgggaggcgccctgaccgccgacgccgaggctgccgcgggctcccaggccgagggccgccgccagcttgcctccgaggggctgcctgccctcgcccagggcgctgagcgggtctaaaaccacagccccagattgctggttcgcgccctcctcatctcgctcatccctgggcgcgcctcccaccttccacccccaactcccttccagggttcgcctcatctgaggcccagataatggtgagaggccaggagaccttgtctggaaggccctggaaggagaagcaccaccttacccattcgggccagtttctccctcttcacccctgcgcctccacccctaccccgcacatccaactgcactaaactgcctctgctctcttgtcttcagacagccctgacagcacgctccagccctctgggaactgaatccaacacgtccaacacttggcactgaactgaagcaatgcattctatcagaactctgggccgtctaactggcagctgctccaggggctgccagggactgctcactctgcagagccaacgggcttgccaggccgactgcagcagctccagcttccagttgccttagggacagagacaaaggaaatgaagagacctcagacatcttttccctccctctctctttcagcagggagctagcaggacactaggaccagtctgtgggatagaatgaacttaatgggggacggaagggggaggagtgctcaacggggagggaaatgatctatgactccaactgtatgattttcttgcctccccagttttcatcccagtggtaacgcctgatttttggtagctatgccatcttctgctgaggattaccattactgggtgtatcaccccagtacttccaaatgcctctcctctattgattcagttgttattgcagtgtctgcttcatccgtggaacttgaggctcagatgccccctgctctgtaaccctggggaatgtcagaggcaggtaataaaggttgtttaaacaataacgcaagactcttctctcagagattccagccttaagacccagtaccatatggagaaggaatcctttttcttttgcttttggaaatgatgtttggatttgggggttgggtggttgtg

SEQ ID NO: 112011 - DNA, 1118 bp, Homo sapiens
tggtgcctcatgaagccttctttctttctctcctttagagcccactgtggctttgccagccttctggactccgacagtgcttaccatctgtgtctgtcctttggcaactagccaaactcaactcagttcaattcaaccaacttccatagagctgcactgttggcaggaagcactcacagtctcaaggaatggggaaagcatttcctatccatggcgcctcaattgtacttttaaaacaaacttggcatggaagagaacctttcccgagactctttgaaagtctaaatacatgattgtaaattacttccctttgtcaacacccttgattaccattttggaaatgagttccaggtgatggataaacagatgattatttgacagacagccctgacagcacgctccagccctctgggaactgaatccaacacgtccaacacttggcactgaactgaagcaatgcattctatcagaactctgggccgtctaactggcagctgctccaggggctgccagggactgctcactctgcagagccaacgggcttgccaggccgactgcagcagctccagcttccagttgccttagggacagagacaaaggaaatgaagagacctcagacatcttttccctccctctctctttcagcagggagctagcaggacactaggaccagtctgtgggatagaatgaacttaatgggggacggaagggggaggagtgctcaacggggagggaaatgatctatgactccaactgtatgattttcttgcctccccagttttcatcccagtggtaacgcctgatttttggtagctatgccatcttctgctgaggattaccattactgggtgtatcaccccagtacttccaaatgcctctcctctattgattcagttgttattgcagtgtctgcttcatccgtggaacttgaggctcagatgccccctgctctgtaaccctggggaatgtcagaggcaggtaataaaggttgtttaaacaataacgcaagactcttctctcagagattccagccttaagacccagtaccatatggagaaggaatcctttttcttttgcttttggaaatgatgtttggatttgggggttgggtggttgtg

SEQ ID NO: 112012 - DNA, 759 bp, Homo sapiens
tggtgcctcatgaagccttctttctttctctcctttagagcccactgtggctttgccagccttctggactccgacagtgcttaccatctgtgtctgtcctttggcaactagccaaactcaactcagttcaattcaaccaacttccatagagctgcactgttggcaggaagcactcacagtctcaaggaatggggaaagcatttcctatccatggcgcctcaattgtacttttaaaacaaacttggcatggaagagaacctttcccgagactctttgaaagtctaaatacatgattgtaaattacttccctttgtcaacacccttgattaccattttggaaatgagttccaggtgatggataaacagatgattatttgacaggtatggggctcgtggaaaatgggggtggaggggtggtgaggaatgagaaccagtgcccatctggtggatttgcagtttcattaagtgtggtagggaaaggggttagcatctcagccattccaggctggcctggaactgagatttaaaggatgcccatcagcccctagtgtgaaaagaaagccaggatcccctccaccccacacctgttgttttttttggagtgctgggcctttttaaattttatgactattctccgtttctatttccacccgcttttacacatctatccctccccatgccattcttctataaattagtaggttgacttctctctggtagtgatttctttcaataaaactagaagtagcaaaaaaatta

SEQ ID NO: 112013 - DNA, 353 bp, Homo sapiens
acataaaacctcttactcctaagttgctcacatgtctcgatagataagaattgtggcctgtaatcccagcacattgggaagccgaggcaagcggattacgaggtcaggagttcaagaccagcctgaccaacatggtgtgaaaccccgtctctactaaaaatagaaaaattagccgggcgtggtggcgcacgcctgtaatcccagctactcaggaggctgaggcaggagaatcacttgaacccaggaggcagaggttgcagtgagccgaaatcgtgccactgcattccagcctgagcagcagagtgagactccacctcaaaaaaaaaaaaaacaaaaaaaaaaaaacagatttg

SEQ ID NO: 112014 - DNA, 572 bp, Homo sapiens
atgggacagaaccatcccctcacccagtggttctatgtgagttgccagcatcaaattagaaaataatcacagattagcactgtaggccaaggacacccgacagactggttgttgtgacaaggttatatttgacattattctaacatgataatgtaggcaatgtgtttaagagaattagaaatactcagctacaacggtacccaaatctgccaggacttggcacatcacagtcaatattttgaatgagtgaatgagtgcctaagtggatgaatgaatgatagaatatacatgacctatacaatacctgcaataaaacacagccaccttcaaaaccacactcaaggaacaatattcacaaagccagactgaacaagcaacattggataaggagttaaggcatcttgtttctcaaaaatttcaatgatacaaaggcactagctgggaggcggcagtgtgagagaagtaactcaaagcaaggcttcacagctttccaaggacagggaccggctctggagttggcgtgcgtgagatgtcaggcacgctcacacgcagggtcctgtgtgtggtcctga

SEQ ID NO: 112015 - DNA, 2027 bp, Homo sapiens
acctaggttacaagatcctaacaaaacaccaagattttatcctgttgttaaagaaccaaaagccattgatgtaaagagtccaagaaagagaaaaacaaggcatagcacaaatccccctctagagtgtcatgttggttgggtaatggattccagagaccgtgggccaggaacatcctctgtcagcacttcaaatgcttcaccttcagaaggcgcaccactagcaggaagttatggatgtactcctcattcattcccaaagttccagcatccttctcatgaacttttgaaggaaaatggctttacccaacaagtgtaccacaagtatcgtcgaagatgcctaagtgagagaaaacgcttgggaattggtcagtcccaagaaatgaataccctctttcgtttctggtcctttttcctcagagatcacttcaataaaaaaatgtatgaggaatttagacaacttgcttgggaagatgcaaaagaaaattacaggtatgggttagaatgtctgttcaggttttatagttatggactggaaaaaaaattcaggcgagaaatttttcaggatttccaagaagaaaccaaaaaagactacgaatctggtcagctgtatggactagaaaagttttgggcttatttgaaatattctcaatctaagacacagtctattgacccaaaacttcaggaatacctctgtagttttaagaggttagaagacttccgtgttgatccccctattagtgatgaatttggaagaaaaagacattcctctacttctggtgaggagagtaatcgtcatagacttccacctaattcctctacaaagccaccaaatgctgctaaacctacatctaccagtgagcttcaggtaccaataaactctcccagaaggaatatttcaccggagtccagtgacaattcacattaaacagtgctgcctgtgtcctgtggtctcaagaaatggtgaaatgcctgagaaatagactcttatgaaagttctttgtccttgaagtcaacatttacatcagtatttatttggggaaaatcttctggtgtttaattgtgataataagaaagaagaaaaagaaagaaaagtggtagcattttttctaacaagataaattctaaaaatgttttccctgatttcacaaacaaggatagtcttggtgaccttttatagagatcttctagtaatgtattttgatctcagatttctttttcaaagccatggttttacaaaaacagcattccttaaatatatttaaaaaacaatacaaggaatgcctaacatttcagctcatacttcttaaagaagatatagtatgttgtattctcttcttagagctttcttaaagaatccacaatccaattaccccactgtcaattcatatttgaacttaccaaaacaaaggaggattacgtatatgttttttaaattcaaaaaagaatatgaaattatacctttagtatccctttgagacatatagtttaaagaaaactttttttaaaacaaaagtaggaatatatagtaagattgtagttacaatgagtatatgcacttttgatgctaggttttgcttttctccccccagtcatatctcatgatttccacagttgttgtattggtgtggagttttctgaattggctataagctgattacatattagaggtttatttttatgattctatataaacgtgcacgagtaatttaaaacctgcattgggattgattggaatattgtcctaaattaattaaatcttgcactgttttgaatgcatctgctatttatacatctgcaagtgggtatgtcataaggagtcagattatctttaatttaaaatgaatacttagttttacctttttgtttattttttgtttaattttgtttttataaatgttttcaagagttatagcaaattgatttctaatttttattgctattacaactgatgtaaatggtagtttcagtttttgtgagatttaaaaaaataaagcacatgaggtcagccgttacttagggtagctttc

SEQ ID NO: 112016 - DNA, 2047 bp, Homo sapiens
acctaggttacaagatcctaacaaaacaccaagattttatcctgttgttaaagaaccaaaagccattgatgtaaagagtccaagaaagagaaaaacaaggcatagcacaaatccccctctagagtgtcatgttggttgggtaatggattccagagaccgtgggccaggaacatcctctgtcagcacttcaaatgcttcaccttcagaaggcgcaccactagcaggaagttatggatgtactcctcattcattcccaaagttccagcatccttctcatgaacttttgaaggaaaatggctttacccaacaagtgtaccacaagtatcgtcgaagatgcctaagtgagagaaaacgcttgggaattggtcagtcccaagaaatgaataccctctttcgtttctggtcctttttcctcagagatcacttcaataaaaaaatgtatgaggaatttagacaacttgcttgggaagatgcaaaagaaaattacaggtatgggttagaatgtctgttcaggttttatagttatggactggaaaaaaaattcaggcgagaaatttttcaggatttccaagaagaaaccaaaaaagactacgaatctggtcagctgtatggactagaaaagttttgggcttatttgaaatattctcaatctaagacacagtctattgacccaaaacttcaggaatacctctgtagttttaagaggttagaagacttccgtgttgatccccctattagtgatgaatttggaagaaaaagacattcctctacttctggtgaggagagtaatcgtcatagacttccacctaattcctctacaaagccaccaaatgctgctaaacctacatctaccagtgagcttcaggtaccaataaactctcccagaaggaatatttcaccggagtccagtgacaattcacattaaacagtgctgcctgtgtcctgtggtctcaagaaatggtgaaatgcctgagaaatagactcttatgaaagttctttgtccttgaagtcaacatttacatcagtatttatttggggaaaatcttctggtgtttaattgtgataataagaaagaagaaaaagaaagaaaagtggtagcattttttctaacaagataaattctaaaaatgttttccctgatttcacaaacaaggatagtcttggtgaccttttatagagatcttctagtaatgtattttgatctcagatttctttttcaaagccatggttttacaaaaacagcattccttaaatatatttaaaaaacaatacaaggaatgcctaacatttcagctcatacttcttaaagaagatatagtatgttgtattctcttcttagagctttcttaaagaatccacaatccaattaccccactgtcaattcatatttgaacttaccaaaacaaaggaggattacgtatatgttttttaaattcaaaaaagaatatgaaattatacctttagtatccctttgagacatatagtttaaagaaaactttttttaaaacaaaagtaggaatatatagtaagattgtagttacaatgagtatatgcacttttgatgctaggttttgcttttctccccccagtcatatctcatgatttccacagttgttgtattggtgtggagttttctgaattggctataagctgattacatattagaggtttatttttatgattctatataaacgtgcacgagtaatttaaaacctgcattgggattgattggaatattgtcctaaattaattaaatcttgcactgttttgaatgcatctgctatttatacatctgcaagtgggtatgtcataaggagtcagattatctttaatttaaaatgaatacttagttttacctttttgtttattttttgtttaattttgtttttataaatgttttcaagagttatagcaaattgatttctaatttttattgctattacaactgatgtaaatggtagtttcagtttttgtgagatttaaaaaaataaagcacatcgatgtcggccgaaaatttcctacttatcctttttgttgactactatat

SEQ ID NO: 112017 - DNA, 2908 bp, Homo sapiens
agcgggttatctacagtatgaaaatgtttgagtcatttatagtcagagggttttaatttacttgtgaagttcacactattgaaactaattgcaatgcttgactttattttctttagagtccaagaaagagaaaaacaaggcatagcacaaatccccctctagagtgtcatgttggttgggtaatggattccagagaccgtgggccaggaacatcctctgtcagcacttcaaatgcttcaccttcagaaggcgcaccactagcaggaagttatggatgtactcctcattcattcccaaagttccagcatccttctcatgaacttttgaaggaaaatggctttacccaacaagtgtaccacaagtatcgtcgaagatgcctaagtgagagaaaacgcttgggaattggtcagtcccaagaaatgaataccctctttcgtttctggtcctttttcctcagagatcacttcaataaaaaaatgtatgaggaatttagacaacttgcttgggaagatgcaaaagaaaattacaggtatgggttagaatgtctgttcaggttttatagttatggactggaaaaaaaattcaggcgagaaatttttcaggatttccaagaagaaaccaaaaaagactacgaatctggtcagctgtatggactagaaaagttttgggcttatttgaaatattctcaatctaagacacagtctattgacccaaaacttcaggaatacctctgtagttttaagaggttagaagacttccgtgttgatccccctattagtgatgaatttggaagaaaaagacattcctctacttctggtgaggagagtaatcgtcatagacttccacctaattcctctacaaagccaccaaatgctgctaaacctacatctaccagtgagcttcaggtaccaataaactctcccagaaggaatatttcaccggagtccagtgacaattcacattaaacagtgctgcctgtgtcctgtggtctcaagaaatggtgaaatgcctgagaaatagactcttatgaaagttctttgtccttgaagtcaacatttacatcagtatttatttggggaaaatcttctggtgtttaattgtgataataagaaagaagaaaaagaaagaaaagtggtagcattttttctaacaagataaattctaaaaatgttttccctgatttcacaaacaaggatagtcttggtgaccttttatagagatcttctagtaatgtattttgatctcagatttctttttcaaagccatggttttacaaaaacagcattccttaaatatatttaaaaaacaatacaaggaatgcctaacatttcagctcatacttcttaaagaagatatagtatgttgtattctcttcttagagctttcttaaagaatccacaatccaattaccccactgtcaattcatatttgaacttaccaaaacaaaggaggattacgtatatgttttttaaattcaaaaaagaatatgaaattatacctttagtatccctttgagacatatagtttaaagaaaactttttttaaaacaaaagtaggaatatatagtaagattgtagttacaatgagtatatgcacttttgatgctaggttttgcttttctccccccagtcatatctcatgatttccacagttgttgtattggtgtggagttttctgaattggctataagctgattacatattagaggtttatttttatgattctatataaacgtgcacgagtaatttaaaacctgcattgggattgattggaatattgtcctaaattaattaaatcttgcactgttttgaatgcatctgctatttatacatctgcaagtgggtatgtcataaggagtcagattatctttaatttaaaatgaatacttagttttacctttttgtttattttttgtttaattttgtttttataaatgttttcaagagttatagcaaattgatttctaatttttattgctattacaactgatgtaaatggtagtttcagtttttgtgagatttaaaaaaataaagcacagcacgatgcgtgaattttttgaattgatttttaattatttttatttagaatatagttgaaaagctgtaatattcagttttgctagtaaaagaccatttttttgtgtgaatgaagtttcaattataaacttacattcactttattgagcactacataatttacagatattttgttgtattggcaaaagcaagtggtttccatatgctaaattaattgtattttctttttgagcagattggatatcttgttcttataaattataatattgaaatacatataatctttggatggatgggctgttaatttgtaaataggttttcattaagttatttctcatgataagtaataatcagcagttttataatatttactatttggagggtcattttgatgctttaaattgcagaaatagtcaaatttgaatattcagaaaataaatttatttagatatattgtaaagagggtgcaaaacaagcaatgggttagaataatagatcttcaagtcttttcttaaatggggtatgtagttccagcttttcagtgagaaatttccaaaccgtgcttattagctttaaatggtctcttgaaatgatcataaatttttctcagtgtcctttttgtgttgaacacatatatctgaaacctgtatttaaccagatatttctactcaactgaatatacaagtgtaaatttgattggaaaattgtatattataaatgaaaatacaataatcaggagttttgtggtttgtattaattagtagttttatcatatttttattataaaagtaatacatgtacattgggaaatttagaaaagcacaaagaagaaaataaagtacttgttataaaaagaagaaaaaccaaaaaag

SEQ ID NO: 112018 - DNA, 2451 bp, Homo sapiens
  misc_feature (32)..(32): n is a, c, g, or t
  misc_feature (72)..(72): n is a, c, g, or t
gagtagttattgtaattttcttaacagaatgnagaagttagcgcacggctctcttattctccaccgctacangtatgggttagaatgtctgttcaggttttatagttatggactggaaaaaaaattcaggcgagaaatttttcaggatttccaagaagaaaccaaaaaagactacgaatctggtcagctgtatggactagaaaagttttgggcttatttgaaatattctcaatctaagacacagtctattgacccaaaacttcaggaatacctctgtagttttaagaggttagaagacttccgtgttgatccccctattagtgatgaatttggaagaaaaagacattcctctacttctggtgaggagagtaatcgtcatagacttccacctaattcctctacaaagccaccaaatgctgctaaacctacatctaccagtgagcttcaggtaccaataaactctcccagaaggaatatttcaccggagtccagtgacaattcacattaaacagtgctgcctgtgtcctgtggtctcaagaaatggtgaaatgcctgagaaatagactcttatgaaagttctttgtccttgaagtcaacatttacatcagtatttatttggggaaaatcttctggtgtttaattgtgataataagaaagaagaaaaagaaagaaaagtggtagcattttttctaacaagataaattctaaaaatgttttccctgatttcacaaacaaggatagtcttggtgaccttttatagagatcttctagtaatgtattttgatctcagatttctttttcaaagccatggttttacaaaaacagcattccttaaatatatttaaaaaacaatacaaggaatgcctaacatttcagctcatacttcttaaagaagatatagtatgttgtattctcttcttagagctttcttaaagaatccacaatccaattaccccactgtcaattcatatttgaacttaccaaaacaaaggaggattacgtatatgttttttaaattcaaaaaagaatatgaaattatacctttagtatccctttgagacatatagtttaaagaaaactttttttaaaacaaaagtaggaatatatagtaagattgtagttacaatgagtatatgcacttttgatgctaggttttgcttttctccccccagtcatatctcatgatttccacagttgttgtattggtgtggagttttctgaattggctataagctgattacatattagaggtttatttttatgattctatataaacgtgcacgagtaatttaaaacctgcattgggattgattggaatattgtcctaaattaattaaatcttgcactgttttgaatgcatctgctatttatacatctgcaagtgggtatgtcataaggagtcagattatctttaatttaaaatgaatacttagttttacctttttgtttattttttgtttaattttgtttttataaatgttttcaagagttatagcaaattgatttctaatttttattgctattacaactgatgtaaatggtagtttcagtttttgtgagatttaaaaaaataaagcacagcacgatgcgtgaattttttgaattgatttttaattatttttatttagaatatagttgaaaagctgtaatattcagttttgctagtaaaagaccatttttttgtgtgaatgaagtttcaattataaacttacattcactttattgagcactacataatttacagatattttgttgtattggcaaaagcaagtggtttccatatgctaaattaattgtattttctttttgagcagattggatatcttgttcttataaattataatattgaaatacatataatctttggatggatgggctgttaatttgtaaataggttttcattaagttatttctcatgataagtaataatcagcagttttataatatttactatttggagggtcattttgatgctttaaattgcagaaatagtcaaatttgaatattcagaaaataaatttatttagatatattgtaaagagggtgcaaaacaagcaatgggttagaataatagatcttcaagtcttttcttaaatggggtatgtagttccagcttttcagtgagaaatttccaaaccgtgcttattagctttaaatggtctcttgaaatgatcataaatttttctcagtgtcctttttgtgttgaacacatatatctgaaacctgtatttaaccagatatttctactcaactgaatatacaagtgtaaatttgattggaaaattgtatattataaatgaaaatacaataatcaggagttttgtggtttgtattaattagtagttttatcatatttttattataaaagtaatacatgtacattgggaaatttagaaaagcacaaagaagaaaataaagtacttgttataaaaagaagaaaaaccaaaaaag

SEQ ID NO: 112019 - DNA, 3069 bp, Homo sapiens
agcgggttatctacagtatgaaaatgtttgagtcatttatagtcagagggttttaatttacttgtgaagttcacactattgaaactaattgcaatgcttgactttattttctttagagtccaagaaagagaaaaacaaggcatagcacaaatccccctctagagtgtcatgttggttgggtaatggattccagagaccgtgggccaggaacatcctctgtcagcacttcaaatgcttcaccttcagaaggcgcaccactagcaggaagttatggatgtactcctcattcattcccaaagttccagcatccttctcatgaacttttgaaggaaaatggctttacccaacaagtgtaccacaagtatcgtcgaagatgcctaagtgagagaaaacgcttgggaattggtcagtcccaagaaatgaataccctctttcgtttctggtcctttttcctcagagatcacttcaataaaaaaatgtatgaggaatttagacaacttgcttgggaagatgcaaaagaaaattacaggtatgggttagaatgtctgttcaggttttatagttatggactggaaaaaaaattcaggcgagaaatttttcaggatttccaagaagaaaccaaaaaagactacgaatctggatggggcaccaggtagtaagaaggcctttcctgggaggtgttggaaagtaactactctcaagtctttcttttatggaggtatattttgtcattatccctttgacaaacgtggctactcactgatgttccgttacatgaaaattctatgcaacatcagcaggtcagctgtatggactagaaaagttttgggcttatttgaaatattctcaatctaagacacagtctattgacccaaaacttcaggaatacctctgtagttttaagaggttagaagacttccgtgttgatccccctattagtgatgaatttggaagaaaaagacattcctctacttctggtgaggagagtaatcgtcatagacttccacctaattcctctacaaagccaccaaatgctgctaaacctacatctaccagtgagcttcaggtaccaataaactctcccagaaggaatatttcaccggagtccagtgacaattcacattaaacagtgctgcctgtgtcctgtggtctcaagaaatggtgaaatgcctgagaaatagactcttatgaaagttctttgtccttgaagtcaacatttacatcagtatttatttggggaaaatcttctggtgtttaattgtgataataagaaagaagaaaaagaaagaaaagtggtagcattttttctaacaagataaattctaaaaatgttttccctgatttcacaaacaaggatagtcttggtgaccttttatagagatcttctagtaatgtattttgatctcagatttctttttcaaagccatggttttacaaaaacagcattccttaaatatatttaaaaaacaatacaaggaatgcctaacatttcagctcatacttcttaaagaagatatagtatgttgtattctcttcttagagctttcttaaagaatccacaatccaattaccccactgtcaattcatatttgaacttaccaaaacaaaggaggattacgtatatgttttttaaattcaaaaaagaatatgaaattatacctttagtatccctttgagacatatagtttaaagaaaactttttttaaaacaaaagtaggaatatatagtaagattgtagttacaatgagtatatgcacttttgatgctaggttttgcttttctccccccagtcatatctcatgatttccacagttgttgtattggtgtggagttttctgaattggctataagctgattacatattagaggtttatttttatgattctatataaacgtgcacgagtaatttaaaacctgcattgggattgattggaatattgtcctaaattaattaaatcttgcactgttttgaatgcatctgctatttatacatctgcaagtgggtatgtcataaggagtcagattatctttaatttaaaatgaatacttagttttacctttttgtttattttttgtttaattttgtttttataaatgttttcaagagttatagcaaattgatttctaatttttattgctattacaactgatgtaaatggtagtttcagtttttgtgagatttaaaaaaataaagcacagcacgatgcgtgaattttttgaattgatttttaattatttttatttagaatatagttgaaaagctgtaatattcagttttgctagtaaaagaccatttttttgtgtgaatgaagtttcaattataaacttacattcactttattgagcactacataatttacagatattttgttgtattggcaaaagcaagtggtttccatatgctaaattaattgtattttctttttgagcagattggatatcttgttcttataaattataatattgaaatacatataatctttggatggatgggctgttaatttgtaaataggttttcattaagttatttctcatgataagtaataatcagcagttttataatatttactatttggagggtcattttgatgctttaaattgcagaaatagtcaaatttgaatattcagaaaataaatttatttagatatattgtaaagagggtgcaaaacaagcaatgggttagaataatagatcttcaagtcttttcttaaatggggtatgtagttccagcttttcagtgagaaatttccaaaccgtgcttattagctttaaatggtctcttgaaatgatcataaatttttctcagtgtcctttttgtgttgaacacatatatctgaaacctgtatttaaccagatatttctactcaactgaatatacaagtgtaaatttgattggaaaattgtatattataaatgaaaatacaataatcaggagttttgtggtttgtattaattagtagttttatcatatttttattataaaagtaatacatgtacattgggaaatttagaaaagcacaaagaagaaaataaagtacttgttataaaaagaagaaaaaccaaaaaag

SEQ ID NO: 112020 - DNA, 2120 bp, Homo sapiens
ctcgtgccgaattcggcacgagcttctggtgaggagagtaatcgtcatagacttccacctaattcctctacaaagccaccaaatgctgctaaacctacatctaccagtgagcttcaggtaccaataaactctcccagaaggaatatttcaccggagtccagtgacaattcacattaaacagtgctgcctgtgtcctgtggtctcaagaaatggtgaaatgcctgagaaatagactcttatgaaagttctttgtccttgaagtcaacatttacatcagtatttatttggggaaaatcttctggtgtttaattgtgataataagaaagaagaaaaagaaagaaaagtggtagcattttttctaacaagataaattctaaaaatgttttccctgatttcacaaacaaggatagtcttggtgaccttttatagagatcttctagtaatgtattttgatctcagatttctttttcaaagccatggttttacaaaaacagcattccttaaatatatttaaaaaacaatacaaggaatgcctaacatttcagctcatacttcttaaagaagatatagtatgttgtattctcttcttagagctttcttaaagaatccacaatccaattaccccactgtcaattcatatttgaacttaccaaaacaaaggaggattacgtatatgttttttaaattcaaaaaagaatatgaaattatacctttagtatccctttgagacatatagtttaaagaaaactttttttaaaacaaaagtaggaatatatagtaagattgtagttacaatgagtatatgcacttttgatgctaggttttgcttttctccccccagtcatatctcatgatttccacagttgttgtattggtgtggagttttctgaattggctataagctgattacatattagaggtttatttttatgattctatataaacgtgcacgagtaatttaaaacctgcattgggattgattggaatattgtcctaaattaattaaatcttgcactgttttgaatgcatctgctatttatacatctgcaagtgggtatgtcataaggagtcagattatctttaatttaaaatgaatacttagttttacctttttgtttattttttgtttaattttgtttttataaatgttttcaagagttatagcaaattgatttctaatttttattgctattacaactgatgtaaatggtagtttcagtttttgtgagatttaaaaaaataaagcacagcacgatgcgtgaattttttgaattgatttttaattatttttatttagaatatagttgaaaagctgtaatattcagttttgctagtaaaagaccatttttttgtgtgaatgaagtttcaattataaacttacattcactttattgagcactacataatttacagatattttgttgtattggcaaaagcaagtggtttccatatgctaaattaattgtattttctttttgagcagattggatatcttgttcttataaattataatattgaaatacatataatctttggatggatgggctgttaatttgtaaataggttttcattaagttatttctcatgataagtaataatcagcagttttataatatttactatttggagggtcattttgatgctttaaattgcagaaatagtcaaatttgaatattcagaaaataaatttatttagatatattgtaaagagggtgcaaaacaagcaatgggttagaataatagatcttcaagtcttttcttaaatggggtatgtagttccagcttttcagtgagaaatttccaaaccgtgcttattagctttaaatggtctcttgaaatgatcataaatttttctcagtgtcctttttgtgttgaacacatatatctgaaacctgtatttaaccagatatttctactcaactgaatatacaagtgtaaatttgattggaaaattgtatattataaatgaaaatacaataatcaggagttttgtggtttgtattaattagtagttttatcatatttttattataaaagtaatacatgtacattgggaaatttagaaaagcacaaagaagaaaataaagtacttgttataaaaagaagaaaaaccaaaaaag

SEQ ID NO: 112021 - DNA, 2191 bp, Homo sapiens
tcataatgtatattattctttgttattaggtcagctgtatggactagaaaagttttgggcttatttgaaatattctcaatctaagacacagtctattgacccaaaacttcaggaatacaggttagaagacttccgtgttgatccccctattagtgatgaatttggaagaaaaagacattcctctacttctggtgaggagattccacctaattcctctacaaagccaccaaatgctgctaaacctacatctaccagtgagcttcaggtaccaataaactctcccagagtccagtgacaattcacattaaacagtgctgcctgtgtcctgtggtctcaagaaatggtgaaatgcctgagaaatagactcttatgaaatcaacatttacatcagtatttatttggggaaaatcttctggtgtttaattgtgataataagaaagaagaaaaagaaagaaaagtggtagcattttttaatgttttccctgatttcacaaacaaggatagtcttggtgaccttttatagagatcttctagtaatgtattttgatctcagatttctttttcaaagccatggtttatatttaaaaaacaatacaaggaatgcctaacatttcagctcatacttcttaaagaagatatagtatgttgtattctcttcttagagctttcttaaagaatccacaatccaattaccccactgtcaattcatatttgaacttaccaaaacaaaggaggattacgtatatgttttttaaattcaaaaaagaatatgaaattatacctttagtatccctttgagacatatagtttaaagaaaactttttttaaaacaaaagtaggaatatatagtaagattgtagttacaatgagtatatgcacttttgatgctaggttttgcttttctccccccagtcatatctcatgatttccacagttgttgtattggtgtggagttttctgaattggctataagctgattacatattagaggtttatttttatgattctatataaacgtgcacgagtaatttaaaacctgcattgggattgattggaatattgtcctaaattaattaaatcttgcactgttttgaatgcatctgctatttatacatctgcaagtgggtatgtcataaggagtcagattatctttaatttaaaatgaatacttagttttacctttttgtttattttttgtttaattttgtttttataaatgttttcaagagttatagcaaattgatttctaatttttattgctattacaactgatgtaaatggtagtttcagtttttgtgagatttaaaaaaataaagcacagcacgatgcgtgaattttttgaattgatttttaattatttttatttagaatatagttgaaaagctgtaatattcagttttgctagtaaaagaccatttttttgtgtgaatgaagtttcaattataaacttacattcactttattgagcactacataatttacagatattttgttgtattggcaaaagcaagtggtttccatatgctaaattaattgtattttctttttgagcagattggatatcttgttcttataaattataatattgaaatacatataatctttggatggatgggctgttaatttgtaaataggttttcattaagttatttctcatgataagtaataatcagcagttttataatatttactatttggagggtcattttgatgctttaaattgcagaaatagtcaaatttgaatattcagaaaataaatttatttagatatattgtaaagagggtgcaaaacaagcaatgggttagaataatagatcttcaagtcttttcttaaatggggtatgtagttccagcttttcagtgagaaatttccaaaccgtgcttattagctttaaatggtctcttgaaatgatcataaatttttctcagtgtcctttttgtgttgaacacatatatctgaaacctgtatttaaccagatatttctactcaactgaatatacaagtgtaaatttgattggaaaattgtatattataaatgaaaatacaataatcaggagttttgtggtttgtattaattagtagttttatcatatttttattataaaagtaatacatgtacattgggaaatttagaaaagcacaaagaagaaaataaagtacttgttataaaaagaagaaaaaccaaaaaag

SEQ ID NO: 112022 - DNA, 1438 bp, Homo sapiens
agcgggttatctacagtatgaaaatgtttgagtcatttatagtcagagggttttaatttacttgtgaagttcacactattgaaactaattgcaatgcttgactttattttctttagagtccaagaaagagaaaaacaaggcatagcacaaatccccctctagagtgtcatgttggttgggtaatggattccagagaccgtgggccaggaacatcctctgtcagcacttcaaatgcttcaccttcagaaggcgcaccactagcaggaagttatggatgtactcctcattcattcccaaagttccagcatccttctcatgaacttttgaaggaaaatggctttacccaacaagtgtaccacaagtatcgtcgaagatgcctaagtgagagaaaacgcttgggaattggtcagtcccaagaaatgaataccctctttcgtttctggtcctttttcctcagagatcacttcaataaaaaaatgtatgaggaatttagacaacttgcttgggaagatgcaaaagaaaattacaggtatgggttagaatgtctgttcaggttttatagttatggactggaaaaaaaattcaggcgagaaatttttcaggatttccaagaagaaaccaaaaaagactacgaatctggtcagctgtatggactagaaaagttttgggcttatttgaaatattctcaatctaagacacagtctattgacccaaaacttcaggaatacctctgtagttttaagaggttagaagacttccgtgttgatgaggctgatccgatagagtaatacctaattatatcaccatgagatggcaaaacggaatgtcagatctgtagacttttgacaggaaaaatcaccatgatcgattacttctgctcatcataaacatctagttcctaagcaggatatgagaatctgccttcctgtgacctctcctgggctcagtgacactccagtcgccgccccaccccacatcaatgccacttccaagtttgacttgcatcttacaaaccatatttctgtttactttttttctgccctgggacatttttaataacttttagataacaacttcaacaaaaatttacctcccaccaagagaagttgtctttattgtgagaagttgtctttattcccaagaaggggaataacttactctttaagtcagttttattacaggtaaatttgtaccagctttttcctctacttgtgttaagacctgtctccaatagacattccaattgaggattgtggaaatagcaaattacattggtgtctgcccaccactgaaggcaaaaagctggtttatctaggccacaggcagagcccgcaggggaggcaggtaacttctcggaccaccagattatcttgatcttcagccagctttattgttgttctacattttaataaacactacatgtttattttaaaaaatt

SEQ ID NO: 112023 - DNA, 2868 bp, Homo sapiens
acctaggttacaagatcctaacaaaacaccaagattttatcctgttgttaaagaaccaaaagccattgatgtaaagagtccaagaaagagaaaaacaaggcatagcacaaatccccctctagagtgtcatgttggttgggtaatggattccagagaccgtgggccaggaacatcctctgtcagcacttcaaatgcttcaccttcagaaggcgcaccactagcaggaagttatggatgtactcctcattcattcccaaagttccagcatccttctcatgaacttttgaaggaaaatggctttacccaacaagtgtaccacaagtatcgtcgaagatgcctaagtgagagaaaacgcttgggaattggtcagtcccaagaaatgaataccctctttcgtttctggtcctttttcctcagagatcacttcaataaaaaaatgtatgaggaatttagacaacttgcttgggaagatgcaaaagaaaattacaggtatgggttagaatgtctgttcaggttttatagttatggactggaaaaaaaattcaggcgagaaatttttcaggatttccaagaagaaaccaaaaaagactacgaatctggtcagctgtatggactagaaaagttttgggcttatttgaaatattctcaatctaagacacagtctattgacccaaaacttcaggaatacctctgtagttttaagaggttagaagacttccgtgttgatccccctattagtgatgaatttggaagaaaaagacattcctctacttctggtgaggagagtaatcgtcatagacttccacctaattcctctacaaagccaccaaatgctgctaaacctacatctaccagtgagcttcaggtaccaataaactctcccagaaggaatatttcaccggagtccagtgacaattcacattaaacagtgctgcctgtgtcctgtggtctcaagaaatggtgaaatgcctgagaaatagactcttatgaaagttctttgtccttgaagtcaacatttacatcagtatttatttggggaaaatcttctggtgtttaattgtgataataagaaagaagaaaaagaaagaaaagtggtagcattttttctaacaagataaattctaaaaatgttttccctgatttcacaaacaaggatagtcttggtgaccttttatagagatcttctagtaatgtattttgatctcagatttctttttcaaagccatggttttacaaaaacagcattccttaaatatatttaaaaaacaatacaaggaatgcctaacatttcagctcatacttcttaaagaagatatagtatgttgtattctcttcttagagctttcttaaagaatccacaatccaattaccccactgtcaattcatatttgaacttaccaaaacaaaggaggattacgtatatgttttttaaattcaaaaaagaatatgaaattatacctttagtatccctttgagacatatagtttaaagaaaactttttttaaaacaaaagtaggaatatatagtaagattgtagttacaatgagtatatgcacttttgatgctaggttttgcttttctccccccagtcatatctcatgatttccacagttgttgtattggtgtggagttttctgaattggctataagctgattacatattagaggtttatttttatgattctatataaacgtgcacgagtaatttaaaacctgcattgggattgattggaatattgtcctaaattaattaaatcttgcactgttttgaatgcatctgctatttatacatctgcaagtgggtatgtcataaggagtcagattatctttaatttaaaatgaatacttagttttacctttttgtttattttttgtttaattttgtttttataaatgttttcaagagttatagcaaattgatttctaatttttattgctattacaactgatgtaaatggtagtttcagtttttgtgagatttaaaaaaataaagcacagcacgatgcgtgaattttttgaattgatttttaattatttttatttagaatatagttgaaaagctgtaatattcagttttgctagtaaaagaccatttttttgtgtgaatgaagtttcaattataaacttacattcactttattgagcactacataatttacagatattttgttgtattggcaaaagcaagtggtttccatatgctaaattaattgtattttctttttgagcagattggatatcttgttcttataaattataatattgaaatacatataatctttggatggatgggctgttaatttgtaaataggttttcattaagttatttctcatgataagtaataatcagcagttttataatatttactatttggagggtcattttgatgctttaaattgcagaaatagtcaaatttgaatattcagaaaataaatttatttagatatattgtaaagagggtgcaaaacaagcaatgggttagaataatagatcttcaagtcttttcttaaatggggtatgtagttccagcttttcagtgagaaatttccaaaccgtgcttattagctttaaatggtctcttgaaatgatcataaatttttctcagtgtcctttttgtgttgaacacatatatctgaaacctgtatttaaccagatatttctactcaactgaatatacaagtgtaaatttgattggaaaattgtatattataaatgaaaatacaataatcaggagttttgtggtttgtattaattagtagttttatcatatttttattataaaagtaatacatgtacattgggaaatttagaaaagcacaaagaagaaaataaagtacttgttataaaaagaagaaaaaccaaaaaag

SEQ ID NO: 112024 - DNA, 2166 bp, Homo sapiens
acctaggttacaagatcctaacaaaacaccaagattttatcctgttgttaaagaaccaaaagccattgatgtaaagagtccaagaaagagaaaaacaaggcatagcacaaatccccctctagagtgtcatgttggttgggtaatggattccagagaccgtgggccaggaacatcctctgtcagcacttcaaatgcttcaccttcagaaggcgcaccactagcaggaagttatggatgtactcctcattcattcccaaagttccagcatccttctcatgaacttttgaaggaaaatggctttacccaacaagtgtaccacaagtatcgtcgaagatgcctaagtgagagaaaacgcttgggaattggtcagtcccaagaaatgaataccctctttcgtttctggtcctttttcctcagagatcacttcaataaaaaaatgtatgaggaatttagacaacttgcttgggaagatgcaaaagaaaattacaggtatgggttagaatgtctgttcaggttttatagttatggactggaaaaaaaattcaggcgagaaatttttcaggatttccaagaagaaaccaaaaaagactacgaatctggtcagctgtatggactagaaaagttttgggcttatttgaaatattctcaatctaagacacagtctattgacccaaaacttcaggaatacctctgtagttttaagaggttagaagacttccgtgttgatccccctattagtgatgaatttggaagaaaaagacattcctctacttctggtgaggagagtaatcgtcatagacttccacctaattcctctacaaagccaccaaatgctgctaaacctacatctaccagtgagcttcaggtaccaataaactctcccagaaggaatatttcaccggagtccagtgacaattcacattaaacagtgctgcctgtgtcctgtggtctcaagaaatggtgaaatgcctgagaaatagactcttatgaaagttctttgtccttgaagtcaacatttacatcagtatttatttggggaaaatcttctggtgtttaattgtgataataagaaagaagaaaaagaaagaaaagtggtagcattttttctaacaagataaattctaaaaatgttttccctgatttcacaaacaaggatagtcttggtgaccttttatagagatcttctagtaatgtattttgatctcagatttctttttcaaagccatggttttacaaaaacagcattccttaaatatatttaaaaaacaatacaaggaatgcctaacatttcagctcatacttcttaaagaagatatagtatgttgtattctcttcttagagctttcttaaagaatccacaatccaattaccccactgtcaattcatatttgaacttaccaaaacaaaggaggattacgtatatgttttttaaattcaaaaaagaatatgaaattatacctttagtatccctttgagacatatagtttaaagaaaactttttttaaaacaaaagtaggaatatatagtaagattgtagttacaatgagtatatgcacttttgatgctaggttttgcttttctccccccagtcatatctcatgatttccacagttgttgtattggtgtggagttttctgaattggctataagctgattacatattagaggtttatttttatgattctatataaacgtgcacgagtaatttaaaacctgcattgggattgattggaatattgtcctaaattaattaaatcttgcactgttttgaatgcatctgctatttatacatctgcaagtgggtatgtcataaggagtcagattatctttaatttaaaatgaatacttagttttacctttttgtttattttttgtttaattttgtttttataaatgttttcaagagttatagcaaattgatttctaatttttattgctattacaactgatgtaaatggtagtttcagtttttgtgagatttaaaaaaataaagcacatgtaaaaaaaaaaaagaaaaaaaaaaaaatttggggggctcgggccagaaaaattttaaaacattctgtggggggggccaagtatataacgtggcaagggtcaaaaaacatcggcgagaacgtggggtttcacaaaaaaagcggggacggggcgaaacacaggtgggtg

SEQ ID NO: 112025 - DNA, 2416 bp, Homo sapiens
  misc_feature (1)..(1): n is a, c, g, or t
  misc_feature (14)..(14): n is a, c, g, or t
  misc_feature (25)..(25): n is a, c, g, or t
ntcgtagggtatcngctctctctgnaaggccgacaaggtatgggttagaatgtctgttcaggttttatagttatggactggaaaaaaaattcaggcgagaaatttttcaggatttccaagaagaaaccaaaaaagactacgaatctggtcagctgtatggactagaaaagttttgggcttatttgaaatattctcaatctaagacacagtctattgacccaaaacttcaggaatacctctgtagttttaagaggttagaagacttccgtgttgatccccctattagtgatgaatttggaagaaaaagacattcctctacttctggtgaggagagtaatcgtcatagacttccacctaattcctctacaaagccaccaaatgctgctaaacctacatctaccagtgagcttcaggtaccaataaactctcccagaaggaatatttcaccggagtccagtgacaattcacattaaacagtgctgcctgtgtcctgtggtctcaagaaatggtgaaatgcctgagaaatagactcttatgaaagttctttgtccttgaagtcaacatttacatcagtatttatttggggaaaatcttctggtgtttaattgtgataataagaaagaagaaaaagaaagaaaagtggtagcattttttctaacaagataaattctaaaaatgttttccctgatttcacaaacaaggatagtcttggtgaccttttatagagatcttctagtaatgtattttgatctcagatttctttttcaaagccatggttttacaaaaacagcattccttaaatatatttaaaaaacaatacaaggaatgcctaacatttcagctcatacttcttaaagaagatatagtatgttgtattctcttcttagagctttcttaaagaatccacaatccaattaccccactgtcaattcatatttgaacttaccaaaacaaaggaggattacgtatatgttttttaaattcaaaaaagaatatgaaattatacctttagtatccctttgagacatatagtttaaagaaaactttttttaaaacaaaagtaggaatatatagtaagattgtagttacaatgagtatatgcacttttgatgctaggttttgcttttctccccccagtcatatctcatgatttccacagttgttgtattggtgtggagttttctgaattggctataagctgattacatattagaggtttatttttatgattctatataaacgtgcacgagtaatttaaaacctgcattgggattgattggaatattgtcctaaattaattaaatcttgcactgttttgaatgcatctgctatttatacatctgcaagtgggtatgtcataaggagtcagattatctttaatttaaaatgaatacttagttttacctttttgtttattttttgtttaattttgtttttataaatgttttcaagagttatagcaaattgatttctaatttttattgctattacaactgatgtaaatggtagtttcagtttttgtgagatttaaaaaaataaagcacagcacgatgcgtgaattttttgaattgatttttaattatttttatttagaatatagttgaaaagctgtaatattcagttttgctagtaaaagaccatttttttgtgtgaatgaagtttcaattataaacttacattcactttattgagcactacataatttacagatattttgttgtattggcaaaagcaagtggtttccatatgctaaattaattgtattttctttttgagcagattggatatcttgttcttataaattataatattgaaatacatataatctttggatggatgggctgttaatttgtaaataggttttcattaagttatttctcatgataagtaataatcagcagttttataatatttactatttggagggtcattttgatgctttaaattgcagaaatagtcaaatttgaatattcagaaaataaatttatttagatatattgtaaagagggtgcaaaacaagcaatgggttagaataatagatcttcaagtcttttcttaaatggggtatgtagttccagcttttcagtgagaaatttccaaaccgtgcttattagctttaaatggtctcttgaaatgatcataaatttttctcagtgtcctttttgtgttgaacacatatatctgaaacctgtatttaaccagatatttctactcaactgaatatacaagtgtaaatttgattggaaaattgtatattataaatgaaaatacaataatcaggagttttgtggtttgtattaattagtagttttatcatatttttattataaaagtaatacatgtacattgggaaatttagaaaagcacaaagaagaaaataaagtacttgttataaaaagaagaaaaaccaaaaaag

SEQ ID NO: 112026 - DNA, 2493 bp, Homo sapiens
ggtccctttttcttcccccaagaggattccactttccaattaaaaaaaaattgttatgaaggatattttaagcccactctggcttggggaaaaatgcaaaaagaaaattacagggtatgggttagaatgtctgttcaggttttatagttatggactggaaaaaaaattcaggcgagaaatttttcaggatttccaagaagaaaccaaaaaagactacgaatctggtcagctgtatggactagaaaagttttgggcttatttgaaatattctcaatctaagacacagtctattgacccaaaacttcaggaatacctctgtagttttaagaggttagaagacttccgtgttgatccccctattagtgatgaatttggaagaaaaagacattcctctacttctggtgaggagagtaatcgtcatagacttccacctaattcctctacaaagccaccaaatgctgctaaacctacatctaccagtgagcttcaggtaccaataaactctcccagaaggaatatttcaccggagtccagtgacaattcacattaaacagtgctgcctgtgtcctgtggtctcaagaaatggtgaaatgcctgagaaatagactcttatgaaagttctttgtccttgaagtcaacatttacatcagtatttatttggggaaaatcttctggtgtttaattgtgataataagaaagaagaaaaagaaagaaaagtggtagcattttttctaacaagataaattctaaaaatgttttccctgatttcacaaacaaggatagtcttggtgaccttttatagagatcttctagtaatgtattttgatctcagatttctttttcaaagccatggttttacaaaaacagcattccttaaatatatttaaaaaacaatacaaggaatgcctaacatttcagctcatacttcttaaagaagatatagtatgttgtattctcttcttagagctttcttaaagaatccacaatccaattaccccactgtcaattcatatttgaacttaccaaaacaaaggaggattacgtatatgttttttaaattcaaaaaagaatatgaaattatacctttagtatccctttgagacatatagtttaaagaaaactttttttaaaacaaaagtaggaatatatagtaagattgtagttacaatgagtatatgcacttttgatgctaggttttgcttttctccccccagtcatatctcatgatttccacagttgttgtattggtgtggagttttctgaattggctataagctgattacatattagaggtttatttttatgattctatataaacgtgcacgagtaatttaaaacctgcattgggattgattggaatattgtcctaaattaattaaatcttgcactgttttgaatgcatctgctatttatacatctgcaagtgggtatgtcataaggagtcagattatctttaatttaaaatgaatacttagttttacctttttgtttattttttgtttaattttgtttttataaatgttttcaagagttatagcaaattgatttctaatttttattgctattacaactgatgtaaatggtagtttcagtttttgtgagatttaaaaaaataaagcacagcacgatgcgtgaattttttgaattgatttttaattatttttatttagaatatagttgaaaagctgtaatattcagttttgctagtaaaagaccatttttttgtgtgaatgaagtttcaattataaacttacattcactttattgagcactacataatttacagatattttgttgtattggcaaaagcaagtggtttccatatgctaaattaattgtattttctttttgagcagattggatatcttgttcttataaattataatattgaaatacatataatctttggatggatgggctgttaatttgtaaataggttttcattaagttatttctcatgataagtaataatcagcagttttataatatttactatttggagggtcattttgatgctttaaattgcagaaatagtcaaatttgaatattcagaaaataaatttatttagatatattgtaaagagggtgcaaaacaagcaatgggttagaataatagatcttcaagtcttttcttaaatggggtatgtagttccagcttttcagtgagaaatttccaaaccgtgcttattagctttaaatggtctcttgaaatgatcataaatttttctcagtgtcctttttgtgttgaacacatatatctgaaacctgtatttaaccagatatttctactcaactgaatatacaagtgtaaatttgattggaaaattgtatattataaatgaaaatacaataatcaggagttttgtggtttgtattaattagtagttttatcatatttttattataaaagtaatacatgtacattgggaaatttagaaaagcacaaagaagaaaataaagtacttgttataaaaagaagaaaaaccaaaaaag

SEQ ID NO: 112027 - DNA, 2858 bp, Homo sapiens
agcgggttatctacagtatgaaaatgtttgagtcatttatagtcagagggttttaatttacttgtgaagttcacactattgaaactaattgcaatgcttgactttattttctttagagtccaagaaagagaaaaacaaggcatagcacaaatccccctctagagtgtcatgttggttgggtaatggattccagagaccgtgggccaggaacatcctctgtcagcacttcaaatgcttcaccttcagaaggcgcaccactagcaggaagttatggatgtactcctcattcattcccaaagttccagcatccttctcatgaacttttgaaggaaaatggctttacccaacaagtgtaccacaagtatcgtcgaagatgcctaagtgagagaaaacgcttgggaattggtcagtcccaagaaatgaataccctctttcgtttctggtcctttttcctcagagatcacttcaataaaaaaatgtatgaggaatttagacaacttgcttgggaagatgcaaaagaaaattacaggtatgggttagaatgtctgttcaggttttatagttatggactggaaaaaaaattcaggcgagaaatttttcaggatttccaagaagaaaccaaaaaagactacgaatctggtcagctgtatggactagaaaagttttgggcttatttgaaatattctcaatctaagacacagtctattgacccaaaacttcaggaatacctctgtagttttaagaggttagaagacttccgtgttgatccccctattagtgatgaatttggaagaaaaagacattcctctacttctggtgaggagagtaatcgtcatagacttccacctaattcctctacaaagccaccaaatgctgctaaacctacatctaccagtgagcttcaggtaccaataaactctcccagaaggaatatttcaccggagtccagtgacaattcacattaaacagtgctgcctgtgtcctgtggtctcaagaaatggtgaaatgcctgagaaatagactcttatgaaagttctttgtccttgaagtcaacatttacatcagtatttatttggggaaaatcttctggtgtttaattgtgataataagaaagaagaaaaagaaagaaaagtggtagcattttttctaacaagataaattctaaaaatgttttccctgatttcacaaacaaggatagtcttggtgaccttttatagagatcttctagtaatgtattttgatctcagatttctttttcaaagccatggttttacaaaaacagcattccttaaatatatttaaaaaacaatacaaggaatgcctaacatttcagctcatacttcttaaagaagatatagtatgttgtattctcttcttagagctttcttaaagaatccacaatccaattaccccactgtcaattcatatttgaacttaccaaaacaaaggaggattacgtatatgttttttaaattcaaaaaagaatatgaaattatacctttagtatccctttgagacatatagtttaaagaaaactttttttaaaacaaaagtaggaatatatagtaagattgtagttacaatgagtatatgcacttttgatgctaggttttgcttttctccccccagtcatatctcatgatttccacagttgttgtattggtgtggagttttctgaattggctataagctgattacatattagaggtttatttttatgattctatataaacgtgcacgagtaatttaaaactgttttgaatgcatctgctatttatacatctgcaagtgggtatgtcataaggagtcagattatctttaatttaaaatgaatacttagttttacctttttgtttattttttgtttaattttgtttttataaatgttttcaagagttatagcaaattgatttctaatttttattgctattacaactgatgtaaatggtagtttcagtttttgtgagatttaaaaaaataaagcacagcacgatgcgtgaattttttgaattgatttttaattatttttatttagaatatagttgaaaagctgtaatattcagttttgctagtaaaagaccatttttttgtgtgaatgaagtttcaattataaacttacattcactttattgagcactacataatttacagatattttgttgtattggcaaaagcaagtggtttccatatgctaaattaattgtattttctttttgagcagattggatatcttgttcttataaattataatattgaaatacatataatctttggatggatgggctgttaatttgtaaataggttttcattaagttatttctcatgataagtaataatcagcagttttataatatttactatttggagggtcattttgatgctttaaattgcagaaatagtcaaatttgaatattcagaaaataaatttatttagatatattgtaaagagggtgcaaaacaagcaatgggttagaataatagatcttcaagtcttttcttaaatggggtatgtagttccagcttttcagtgagaaatttccaaaccgtgcttattagctttaaatggtctcttgaaatgatcataaatttttctcagtgtcctttttgtgttgaacacatatatctgaaacctgtatttaaccagatatttctactcaactgaatatacaagtgtaaatttgattggaaaattgtatattataaatgaaaatacaataatcaggagttttgtggtttgtattaattagtagttttatcatatttttattataaaagtaatacatgtacattgggaaatttagaaaagcacaaagaagaaaataaagtacttgttataaaaagaagaaaaaccaaaaaag

SEQ ID NO: 112028 - DNA, 1576 bp, Homo sapiens
agcgggttatctacagtatgaaaatgtttgagtcatttatagtcagagggttttaatttacttgtgaagttcacactattgaaactaattgcaatgcttgactttattttctttagagtccaagaaagagaaaaacaaggcatagcacaaatccccctctagagtgtcatgttggttgggtaatggattccagagaccgtgggccaggaacatcctctgtcagcacttcaaatgcttcaccttcagaaggcgcaccactagcaggaagttatggatgtactcctcattcattcccaaagttccagcatccttctcatgaacttttgaaggaaaatggctttacccaacaagtgtaccacaagtatcgtcgaagatgcctaagtgagagaaaacgcttgggaattggtcagtcccaagaaatgaataccctctttcgtttctggtcctttttcctcagagatcacttcaataaaaaaatgtatgaggaatttagacaacttgcttgggaagatgcaaaagaaaattacaggtatgggttagaatgtctgttcaggttttatagttatggactggaaaaaaaattcaggcgagaaatttttcaggatttccaagaagaaaccaaaaaagactacgaatctggtcagctgtatggactagaaaagttttgggcttatttgaaatattctcaatctaagacacagtctattgacccaaaacttcaggaatacctctgtagttttaagaggttagaagacttccgtgttgatccccctattagtgatgaatttggaagaaaaagacattcctctacttctggtgaggagagtaatcgtcatagacttccacctaattcctctacaaagccaccaaatgctgctaaacctacatctaccagtgagcttcaggaggctgatccgatagagtaatacctaattatatcaccatgagatggcaaaacggaatgtcagatctgtagacttttgacaggaaaaatcaccatgatcgattacttctgctcatcataaacatctagttcctaagcaggatatgagaatctgccttcctgtgacctctcctgggctcagtgacactccagtcgccgccccaccccacatcaatgccacttccaagtttgacttgcatcttacaaaccatatttctgtttactttttttctgccctgggacatttttaataacttttagataacaacttcaacaaaaatttacctcccaccaagagaagttgtctttattgtgagaagttgtctttattcccaagaaggggaataacttactctttaagtcagttttattacaggtaaatttgtaccagctttttcctctacttgtgttaagacctgtctccaatagacattccaattgaggattgtggaaatagcaaattacattggtgtctgcccaccactgaaggcaaaaagctggtttatctaggccacaggcagagcccgcaggggaggcaggtaacttctcggaccaccagattatcttgatcttcagccagctttattgttgttctacattttaataaacactacatgtttattttaaaaaatt

SEQ ID NO: 112029 - DNA, 338 bp, Homo sapiens
ccttaaaaatgctttcttcactcgtttaaatagtaatgataagaatatggctgcagggggcagcttatgcctgtaatcccaccattttgggagctcaaggcaggagtattgcttgagcccagaagtttgagaccagtctgggcaacatagtggaaacttgtctctccaaaagctaaaagaaaaagccgtgcatggtggtatgcacctgtagtcccagctacttgggaggctgaggtgggaggatcgcttgagtctgggaggtcgaggctgctgtgagccatgattgcaccactgcattccagcctgggtgacagagcaagatcttgtcttaaaaaaaa

SEQ ID NO: 112030 - DNA, 418 bp, Homo sapiens
ctgaacctggccccaccacctatgggcagagttggttccagctcagtgtgtccatgggatgtctttaggttcaccttgcttttctgtcccacgctcacatgttggagctaagctgcatggagtgtcgttctccctgtacatatgagattagtcagcaatcctgtctccttccatattctgtctttatttctgcgacactatttctggagaacattgtatttgtgcttttcctttgatatgtttgtaattttcgttagaaaacccttttagattctaaagcttctacattcagtatttcaatcaatgataacaaactggtgtaagactaaatataaaatacaaacacatttccataaatcaacacatttccataaattgctgttataatgtctgccacaaaaagttcagttgtttgtat

SEQ ID NO: 112031 - DNA, 749 bp, Homo sapiens
gttgagttttgcaggaaaaccccttaagaaaatcttgtgtgaactacgtcctcggttgcaatgccatgagcctgtttcagtgtgtgcattccaggcttgcctttctagctgggtaaggatccggcagactgaggtctccttggtaatttgggtacaccaagtctccagttaatgatagataatcagcctttgggtcattcggtcattctcttattacaaacccctcctgctctctctgatctcctttcaaactaaatttcacacaaacaaataaagcaagacagggacaagttcttaaaaaaagagagagaaatattagaaacgcctgatacagaactctaaacaaggaaaggcaagctaaaagaggataggaaagaacatcttatcaaaatgaacatgttgtgtacaaaacattaaaagaaaaggctctggtttttgttaaagtgacagaaaattaaaataaaaataattgcaggcaccaaagttataaacagggaaggcaggatgctagctggaaatgcgcagcactagggagctaatttgttgttacagattatatatctgcaccctgcttggagaagtgctactttgttccattttccagaagagaatggtttttcttcttaatacttgtgtgaatgcccacttaagttaacacaggccacaactttgaggaatgagaaatggaattgcattctgcttgcgaagcatccaacttcaaacgaagaaattggttgtgtacaaaaaaa

SEQ ID NO: 112032 - DNA, 335 bp, Homo sapiens
ccatcttatgtttttagtctttctgatcttcccctctatcacatccgtcttcttgaatctagccagaaaactattcagtttaagagctcacatgattagatttgatgcaccagggtaatccaagataattgcccaattttaagttcataatcttaattatacctgaaaaatttcttttgccatatcaagtaacatattttcaagatttataaggattagtttatggacatctttgtgaaaggaccattctccctgccaccatcttcaccccggttctcaaatatgtctctggcaaatgtaaaataacatccaccctctcttaaagttcccagtcc

SEQ ID NO: 112033 - DNA, 165 bp, Homo sapiens
ttcattattgcactagttgaggacttccagaactatgttgaaaagagaagtaagagtagtcatcttcaccttgtgtgctaggctgttcttatgttgctacaaacaaatacttgagaatgagtaatttataaagaaaagaggtttaattggctcacagttctgcag

SEQ ID NO: 112034 - DNA, 155 bp, Homo sapiens
ggggaacatccgaggggccaaacaggtaaaaggcaagcccagggccaaccttccccagcccctccatccagaagtcaggactcctgggtccaatttctgagctccggtccagccctgctgtgtgagtccctcatccccacccccgcacctgtttc

SEQ ID NO: 112035 - DNA, 153 bp, Homo sapiens
atatatagatgggaaaaaagacaagtaatctgaatattactagtgatgagttatgattgttattgatatttttcattttatttgtgcttttatatttttcatgtttattattatagtaatgttttaatgtttaattattaaaaataattcttg

SEQ ID NO: 112036 - DNA, 198 bp, Homo sapiens
ggcatgctggctagtgttgccacgtggacttcagcgttatcactttgctgcaaaaggctctctttgctttcacagtatcttgccaagaagagtccctggatatgaagtgtcttcatctggacccaaacctgagaaagaaattaatttgggctgcaccttctaggtgtgtgcctcccctgagcactgtacttctttagt

SEQ ID NO: 112037 - DNA, 196 bp, Homo sapiens
ggcacacagtaatctttctgccttctttctgagctttggaacatttttcttaacagactcaatacttttactcccagaaaccagttctgtgtcttctttccatgttctctgcaagagggtagaaatgggcctggggcagagcagagagaaactttgctttcctaaagttctttccagctggccttagtgagatttt

SEQ ID NO: 112038 - DNA, 528 bp, Homo sapiens
gacaaacctgaaagacactatgctaagtgaaataagccacacaggaaaagctacataccatgagttcatctgtgtaactttttgaaatgacgaaaccacagatggagacagatgaagggttatcaggtggccaagatgggggaagagattaactatggctctaagtcagtagcacattgggacccttgtgctaatcaatctgttcaataccttgattacaatggtacatacacgtgacagaattacacaaaactcgctaggtgtggtggctcatgcctataatcccagcactttgggagatcaaggtggacagattacttgagcccaggagttcaagaccagcctgggcaacataatgataccctgtctcaattataaaaagaaaaaaaaagaattaaaaagggccaggtgcaatggctcatgcctgtaatcccagaactttaggaagttgaggcaggcggatcaccagagcccatgagtttgagaacagctggccaacatggtgaaaccccatctctactaaaaata

SEQ ID NO: 112039 - DNA, 404 bp, Homo sapiens
tatttgaagaactctcaaaactcaacagtataaaactcaaacaatctaattaaaaaatatgcaaaagacataaatagacatttcactgatgaggatataatgataggaaataaacatatgaagagatatttaacatcattagctattagggaaaaggcacattaaaatcacaatgagatattactgctcacctatcagaatggctaaaataatttggtaacaacaccagtggttgatgaggatgtgggaaactataccactcttacattgctgatggggatttaaaatgacgcagatactttgaaaaacagtttgacaatttctcataaaatcaaacatgtaactaccacgtaactcagtaattatactcctaggcatttatcctggagaaataaaaacttcca

SEQ ID NO: 112040 - DNA, 594 bp, Homo sapiens
agggaaaaggagggagtgggacagtggttgaaaaactaactgtttagttagtacctgggtgaagggatcattcataccccaacctcagcattacacaatataccaaggtaacaaacctgcatatgtacctcctgaatctaaaataaatgttggaaaaaactagagatccggaactgggactgctctggtttgaatgtgtccctcaaaatttatgttatgagggagtgggtttcttataaaaggaccctacttttgtctctctctcacccatgtgatgccttctgccttgttatgacacagcaagaaggccttcacagatgccaccaccttgatcttgagcatctcagtctccagaactgttacaaataaatttctgtttatctaaaaaaggaaaaattcaaaaattagtaagtcattaaatgaataaaatgagaaaattaaagattgaaattatacaaaaaactaacaaattctggagctgagaaatgcatgaattaaatgaaaattgcaatagagaatgtcaacagcagaatcaatgaagcagaagaaaggctctgaactcaaagacagtttagtgaaattatacaattggag

SEQ ID NO: 112041 - DNA, 339 bp, Homo sapiens
tgtatttgctgttttctataataaaatacttttactcctgatatccacatgttcacttctttcaagtctttgttgaaatagcatcttctctatgatacctactgggacttcccaacttaaaatggcaataccccttccctcatcctcagcatttccaatcttcccgaacatcctctattatattttccaaagcatatatcttctctctgttacataaaacatatttattgtgtatttttattgtttatttctatctgcactagaacctaaactccattatgttttatataataatatatccatgtattaagaatactgtctgacacccatgaacatgca

SEQ ID NO: 112042 - DNA, 366 bp, Homo sapiens
ccatgtatcaaatggcatgggaaccagggaatcattttgagttactaggttcagtagtgaaactctgtagttttcttggcccttacaaaaccaggtcacagctgcctggcttcctaatttggtttgatgtactgtgaattcccaagggggtgagtcactctcttattcatatggaagtacaggagccattccaaaacaaaaaccagtctgggtttatttatgattttatatgccctttactgccccactatacagatgatccagagttgactttcagctgttaattaccatattggagaggagatacatggcatttttcatcttttgagttacaagacttctttaatgtgaatattccctaagtgc

SEQ ID NO: 112043 - DNA, 345 bp, Homo sapiens
tcttggcgtgatgaaatgcctcttggtacctcatctgccaggtccatgaccctctgttatcttcagtcatgttcctcaggtctgcttctgtttgcacaaggcttcatgcagtggccttgtcctgagacatgccaggggttgggcaaaaccaccgaagcagctgctggcgacatctctttagggcccacgtgagggacgtgacttcctccctaatcaagatggagaatatttatttagctttcaacttaaattgtttcacagggcaacagactctgtttttggcagggcttttctttttgtatttaataaatgctgtacaaattagattttgatgatagttgcttt

SEQ ID NO: 112044 - DNA, 424 bp, Homo sapiens
cgaattagcaagactttgtgactaatgggaagtaaagtcaaagaagtggaagatgatagccagatgtctgatttggtgagaggaatgaatgccttcagcaaaacaggaagtggaggagtggagcaggttgggagttaaggaaagaaggttgaactccattatgattatgctgggtttttaatgcctaagaaacatcaaaaggaaagatctctcaggcaacccagcattggagtcaaatgtttatgagagttctggattgaagaaaactagaaactattttgacaaagcatggagatggtaactgaggccattggagtgagtgaggtcacccagaagagtgggtagagctggaagagaaagaagcctaagaaagaacatttaaggatgggcagaagaaagggaaaaggaaacaaagaataagcaa

SEQ ID NO: 112045 - DNA, 453 bp, Homo sapiens
gaaggcagaggggctgccatttcccctctcccgccctgcaggggagaggggtggggagtatggttatcttgccctggtcatatttgagctttcttccccgaccaggcaccctcacttagtagaaacaagagcagtcacccgtgccgtgtccacgatgacaactgctgcctgctcccccagcagaagaattgccccctccttactcaccccttcatatccctctggttttttgtcccctgtcttgtctgagctagctccctggtaggatgcaccttatgccacactagagacgcatggggagcgtttggttgaggggtccccagggagtgtctcctggttccgtccctcgcattctcctccgcctggagtaccaccagtagagttttgtcccagttgactgaagcttttgtgtctcagtgacacgcaagtttccccagtggagagggagagttt

SEQ ID NO: 112046 - DNA, 304 bp, Homo sapiens
aagcactgggattaccggagtaaactatggctcccagctgcctggtattctttcaatgaagacatgccaaaacgcttacaaatatggtggacatttaatggtttatatttcatttatgtcttcatttaacaacgattaactgagcacctactatgtgccacttttctacaatcaagggatacaatgaagaacaaaacacaaaaatctctgcttttgttgaattcacatttaatgtaacacatgaatacttttaacacacccaacgatctaatgcaaagcgattgagctcgttgtgagataagta

SEQ ID NO: 112047 - DNA, 383 bp, Homo sapiens
ggtgtggggcaagcattctgagttcctttcagacatttaacaatcgagggttttgatgtcattgaaaaaattaaaaagggagcccacagttcttcaatgactattaaatgtttgaaacctctataaataaacagacatgttagaattactccaagaatttaaatacctcaagttctttaagctttcagaaatatacttgtctaatagatacattatggtgaaaagagtatttgagaatgaccattttcatgcaaactaaatcaaactccaactacatattctgctagatttttgatgagaaatttcctgtgaaatgaagttagtttctcattcaaaaaaccagtgcatttttcagtgaaagtgctgttcatctctttgaccaa

SEQ ID NO: 112048 - DNA, 677 bp, Homo sapiens
catttctaggagatatatagcaagactactgaagtaagtctgacttacagactcagtaaaataaaattttcatgtttttaactgaagacactctcgttatgagcgtatttgctcaaattcctcccagatactcccctgccccttccagggtcttttatttttatgatatttgcatgtatcttttttcgtaagaacacaagaatcaggtctcgattccaaggagtagagcctctgcagttcaatctgtgaccaaaggcctacaatgtcttgggctcacttcatatatgtgattacaggaatataaaagttatctttgttatgttgtctatttcttctagtgcatctctaaatttattgacttattttgtattaaatctgatacagttccttctcaaatatttaccttctgatcaatttgtagatttgttgttgttgttttccctcagtgtgctttctgagttatatagccacatggcttaatttttgaccaacaaaatttctttgcccattttctctttagggttggccacttcactgtgtttccatttccatacttgtaacaaacaaacttgtgggttgtgctttattatatgcattgtggtgttgagtacattatatatgaaatacaaaatttagtaagttccttatttaatgaatttttaaaattatttatggta

SEQ ID NO: 112049 - DNA, 1047 bp, Homo sapiens
ctgtgagtgacacacgctgagtggggtgaagggaaatgctggtgaatttcattttgaggtgtgggttgctgttagtcactctgtctcttgccattgccaagcacaagcaatcttccttcaccaaaagttgttacccaaggggaacattgtcccaagctgttgacgctctctatatcaaagcagcatggctcaaagcaacgattccagaagaccgcataaaaaatatacgattattaaaaaagaaaacaaaaaagcagtttatgaaaaactgtcaatttcaagaacagcttctgtccttcttcatggaagacgtttttggtcaactgcaattgcaaggctgcaagaaaatacgctttgtggaggactttcatagccttaggcagaaattgagccactgtatttcctgtgcttcatcagctagagagatgaaatccattaccaggatgaaaagaatattttataggattggaaacaaaggaatctacaaagccatcagtgaactggatattcttctttcctggattaaaaaattattggaaagcagtcagtaaaccaaagccaagtacattgattttacagttattttgaaatacaataagaactgctagaaatatgtttataacagtctatttcttttaaaaactttttaacataatactgacggcatgttaggtgattcagaatagacaagaaggatttagtaaattaacgttttggatataagttgtcactaatttgcacattttctgtgttttcaaataatgtttccattctgaacatgttttgtcattcacaagtacattgtgtcaacttaatttaaagtatgtaacctgaattaactcgtgtaatatttgtgtgtggagtgggatgtggggggtggagggggaatgacagatttctggaatgcaatgtaatgttactgagacttaaatagatgttatgtatatgattgtctgtttaagtgtttgaaaattgttaattatgcccagtgtgaacttagtacttaacacattttgattttaattaaataaattgggtttccttctc

SEQ ID NO: 112050 - DNA, 228 bp, Homo sapiens
gcaaactgacatggcacatgtatgtctatgtaataaacctgcacgttgtgcacatgtaccctagaacttaaagtataattaaaaaataaataaacataaaacttgataaagcaatgggatgaattattttaaaatgatgcttttcccaatgtatttaagtcttgatgctagataaatttgaatctaaagaggctaaagctactcaacgttaacccagcatagaacaat

SEQ ID NO: 112051 - DNA, 308 bp, Homo sapiens
gattttcaaatatatgcattatatacttaccagttcagcttccctaatctggaaatcggaaatctgaaatgcttcaatgagcatttcctttgatcatcatgacagtactcaaaaagtttcgagttttggagcattttggatttctggattgggaatactcaacctgcattactgtggagcagtaaacaagaaatctaaaaacaattagtatcccatctttaataccttctcactctgttgtgacttgattttgaccttctgaaatgattcctcaggtatagtattcatgttttttttccccaagaccc

SEQ ID NO: 112052 - DNA, 377 bp, Homo sapiens
ctgggcaagatgtacagaagtaaactctgagctgagtaacactcattcagcggttcccgtaccaggccctgtcctaacgacttttcaaacacgagctgatttaatcctcactaccttgaggtaggttctgttattatacctgttttacagatgaagaaatcaagacccagaaactttaagtagcctgctcaaggtcacatggttactaagtggctgaggtagcatttgaacccaggtcatctgcagtatttcagacaggggttcaggtagggttacttgaagccgctagggccctgccttaatttaagtgctgattctactatttccctttgtaaacaggatgcttttagaggtggggatgctgtgaggagatggaa

SEQ ID NO: 112053 - DNA, 450 bp, Homo sapiens
catccataagaataataactctaatatactgagactcatcaaatatgtttcatctgtgagtttataaatgatgctaaaaaataagatgtaattgatcgtttttggaggattgtagtgcaccaatttattattttgcaaactggcaggtaatggaaaagaatcaagcatttattcctgcctctcatatgatggttcactggcaaagcaaatagtagatgagggaaagcactcttcataaatgtactccagatgcaaaattaaaaagaaatgacaggatattaccgtttggcaaccttaattaattaatggatttaggtgggctggggactgtggcttgtgcctgttatcccagcattttgggaggccaagatgggagaatcacttgagcccaggaatataagaccagcctgggcaacatagtaagactccatctctacaaaaaaatagaaa

SEQ ID NO: 112054 - DNA, 475 bp, Homo sapiens
ccaaccaggtccctgactctggtataactaatgccctcataaatcttcagatgagaaccacttgacaaatatggagcaggattgtgctcaatacaaactttaagaagcagcctctttctgttaaaacccacaaaagagatgcagaagggaaacacactactatgagagagacttccctagaaggctttctgctctcattgcctatttttcacccttagaagaaatgagcgaagtggggaagcaaataggctcacagttagcatttgtaatgtgttggtgtaggtgggtgttgtgtggtaacttaattgtaatgcaaatcttttacctgtgaaaatcaaacacgacaagtttgctgacacactcaactggaactatatctcagttggagtggtttaggttaggtatagaatagtattttaaaagtggatgttttgagggaagcccttagataatttagtagacaggttagaaatac

SEQ ID NO: 112055 - DNA, 243 bp, Homo sapiens
acccggctaatttttttgtatttttagtagagatggggtttcaccgtgttagccgggatgatctcagtctcctgacctcatgatccgccctccttggcctcccaaagtgctgggattacaggcgtgagccactgcgtccagcaataatctccctatttttaactgtgtataactagttttaaaagtttgtataaaaagtgtggcccagagaaaatgtgtctaaggtctgatttggccaactga

SEQ ID NO: 112056 - DNA, 724 bp, Homo sapiens
ggttcaagtgattctcctgcctcagcctcccaagtagctgagattacaagcatccgccaccatgcccagctaattttttatatttttggtagagatggggtttcaccatgttggccaggctggtctcaaactcctgacctcaggtgatcccccaacctcggcctcccaaagtgctgggattacaggcatgagccaccatgcctggcctaccaaagactttagatattagaattactagatagaaaatatgaaatgtgtgttttaaatattgatgtttttaaatagggacaatcattttggaaaaatattcattcatttcaattttcatgaaaagtggaacatgtgcctgcccaaaacccagaaactctggtcctgtatttctatgtatgtaccagatgacatgcacaagaatatctatagcacttattttaaatgatggaaagaactgtaatgtccaccaacagaataccatatggcagtaaaaatggatgccttgcaactgtacccatcagcatgaatgaaccttaaaatcatgatacttaagttagaaaatgcagtttgcaaaggaatgcagtcagtatgccaccattaagatatcttagcaaaatcaaacattaattatacatacatatatattaaaactataaaggagagaaagaagttattaagaagtaattcagggtagtagttttctctggaagggaggatttgggaagtctcaaca

SEQ ID NO: 112057 - DNA, 642 bp, Homo sapiens
tacttttcacagggtaacttttaaaatcagccagcatggtagctcatgcctgtaatcccagcactttgggaggccgaggcaggcaggattgctagagaccagggggtcaagaccagcctgggaaacatagtgggaccccatctctacaaaaaataaaattagccaagcgtggtgttgcgcacctatagtcccggctacttgggaggctgaggtggggaagaatcacttgaggcctgggaggttgaggctacagtgagccacgataacgccactgcactccagcctgagtgacacaatgagaccttgtctcggaaaacaacagcccaaaaaagccccaaactttacaaatctggaacttaatgaagtgtaaaataaacaaatatgtactcatggcctccacagcacagcagaggttaaaaaataactatagaattctataaagaaacctctactttaagaagattctaagccaattctatgacaagaccaaagttattttacaaaggtctcatcaaggaaactgtcttcaaggcagtcatgatgttgccctcctgtaatcaatcccaactactcaggaggctgagacaggaggactgcttgagctcaagagtttgcaccagtttgggctacatagcggacccg

SEQ ID NO: 112058 - DNA, 498 bp, Homo sapiens
gcagttatgcaatagcaagagaatggaaacaaatgttcagcaagaaaggtctacttaaataaaatacggtgtgtccacagagtggactatgatgttgctgaacaaagagaggaagttctttatgtactcacagggaaagatcactaagacctagataaagaagcacagtacagaacagagtgtacagtatgctacatttgtgtaaacagggtgaaaattaatacccatgcaaacacatgctcatacttacttgtatagtataaatcagaggttagaaaactagccaggtgtggtggttcatgtctgtaatcccagcacttcggaaggccgaggtgggcagatcatctgagctcaggagttggagactagcttggccgatatggtgaaaccccatctctactaaaaatacaaagaaaaaaaaaaaagccaggcttcatggtgcttgcctgtaatcccagctactcgggaggctgaggcagaagaatcacttgagcctgg

SEQ ID NO: 112059 - DNA, 578 bp, Homo sapiens
cctgcctcagcctcccaagtagctgggactacaggtgcgcggccccaagcccggctaattttttgtgtttttagtagagggggtttcgccttgttgcccaggctggtccgaactcctgagctcaagtgatctgcctgcctcaacctcccaacctgctaggattacaggtatgagccaccctgcctggccagatttaatgaaactttattaatcacttagttttgctaattactatctttccataatgttttgaatacaacgctattgtagttaatacgttgttttgcggttatttgcttacatgtctgtttctgctactgaattgtaaatcccttgaatatagggaaaatatatttgtatccctaccatctgaaaatagtacctgcatagtattagatggttgctaattgcttgtttaatgaataaataaaaggcatggaattaggcaggttgacaattattgattgattttatccttataacctagtgatgtgtagatggcattatttctgttttatagacaaggaaactgaaatgaagtgaagtaaattattccaaagtatttgactgctaagtaa

SEQ ID NO: 112060 - DNA, 113 bp, Homo sapiens
tgtccaaacagattcctcagactaaagactaaatcttgcctgccccaataaaacaaaacaaaacaaaacaaaacaaaatgaaaaaacaaacaaacaaaaaccctgtttcgcct

SEQ ID NO: 112061 - DNA, 978 bp, Homo sapiens
ggggtacatgtgatattttgatacaagcatacaacatataatgatcaatgcataatggtaattgagggtattcatcaccaattactacaaacatttgtcatttctttgtgctgaaaacatcccacatttattcttctagttattttgaaatgtgtcataaattatttttaactatagtagccctattgtgctaccaaacactagatgttattccttctatctaactgtattttgtaactttatccccttacccccactacccttcctagcctctggcagccaccattctattcactacctccacgagatcactttgttttagctcctacatataagtgagaacatgcaacatttgtcttcctgtgcctagaagagacgacagtcttattaattttaaagaaaattatattacaaaaacaaccatgagctaggacgtaaaagcttttggctgagccttgaagcaactcttaggccacccaactcatacaggcaggaggcaggcagcaaaacctctagagccctcaactgccattgcagccacggcagataatagacaagcaaagcttcccagatggcagaagcaggggccccacagaacaatggacgggaaaattcctccctgagaacagaatcaagttctgaccatggcacttctctcactgacaagactacataacagctgtccacaggatttcatcattaccatggaccagtgactactgcatacattgcaattttctgttttctgcctaaggtatttattccagttatccagtcctggtgccaccacccatgtggctggagtagaggaggcagaaaatttgcaactaatctagtaatctaataaataattggtaaccttgcatattaacaggttatagtaaagtgtgaaatattttgcaaaaatattacatatatatatacacacacatatgtacacacatgcaaatattatggataactcttaaatatattttt

SEQ ID NO: 112062 - DNA, 226 bp, Homo sapiens
ctgacaagcataaatatgaagcaaatgttagtaattagatatgatcagtttaaaggatatttatttatacactgttccagacaggatttaaagtgacttacaaagattcataaaacatcaaaaaatatcataaattttaaaaataggatcaaaaagaagaaaaataggagtggagacaaactggtagagtcagtatcaaggctccaaaaccaaagggcaactgagg

SEQ ID NO: 112063 - DNA, 659 bp, Homo sapiens
tacactgttctcagcctcagagtagctgggactacaggtgcccgccaccgtgcccggctaattttttttttatggttagtagagatggggtttcaccagtgttagccaggaccggtctcacatctccgtgacctcggtgatccaccacgccttggcctcccaagagtgctgggattacagacgtgagccaccgcacccggcctgtaataatttcatattaagtatcttttctaatggtagggagtattaagtttcatgctggacgcggaattcttcattataaaatatctgacatcccattatcaaagaaaagcatgtatccaatttccaaaggctcatgtcaaagataatcgattactgcacatcagtttccacttattgaaaatctattgtgtatcattgttagatgccttatatatattcctcttacataagcctcaaagtataaggttaagtattttgcacaaagccagtcatacagaaaaaagcaaaatcaatctacatcaagtctgccatgctcccaagtcagtgcaccatggtattttctccaacagtgcatactcgtaacctaacaaatcttgaggtgggtcctataaaacatatagaacctagctgctgaaaagagctacctgtctgggctgacacatgtgtcaccttca

SEQ ID NO: 112064 - DNA, 350 bp, Homo sapiens
ggttaggaggagcggaaacctcatcactaaggtgaagtggctgaaggaaccaccaagaaatgggagttgaggctgggtgcggtggctcacgcctgtgatcccagcactttgggaggccgaggcaggtggatcatgaggtcaggagattgagaccatcctggttaacacggtgaaacctcatctctactaaaaatacaaaaaattagctgggcatggtggcgggcacctctagtcccagctacttgggaggctgaggcaggagaatggcatgaacccaggagattggagcttgcagtgagccgagatcgcaccactgcactccaacctgggcgacagtgcaaaactccatc

SEQ ID NO: 112065 - DNA, 810 bp, Homo sapiens
caagaacgagaagtcagagttttggaagaatcatctatgtggattctgaaatcaccaagaactatatcagggatagtgttgaggggaagggagtgaatcaggtgctaaaattctctcgggataaggaggagtgacctgaaggtgtgtagatgagtgtgacaattttattacagtctttaaaggcaacagtatatcaaatatgacatagaaccacaaatctggacatagaaccacagcccacctaactgcttcctagacagtatggggaggtcatttatctttgctggcagataaatacaagatctctttcatagatatcagttagtgcagctgcattcaagcaactgctccatatagcaaacagtactcaatatttccaagaggtgcttgagaaactgccaattgtgttgggagaagggggaagggaatggcgggagggagtgtggaagggagttgtctagaggaaaaagagaagcaagtgaaggggttctatgttctctgctctatgtcccacacaacccaagaagctctatatttaattgtttaaatttgggcttttcacttgttgtgtgcaatacacataggacacatccaactctcacagacctttccttgcttatgaagttaggattcaaagagaattccaaacatgttccttacaaatacaatcagtttactgtatggggtttcattatgcaggacaattataagggcgtagagtttaagtcaaaacccatctaaatccacaaaataacggattgggggtctatttaaaataaacttctcgggaattccacttttattgggaac

SEQ ID NO: 112066 - DNA, 533 bp, Homo sapiens
ccgcagcagatgtaatcagtgccatgtaatttatggccattatcatcattgtcgtcattatcatcattgtcatcatcatcatcatcacttcgttcataagggtaagagaatctactcagatcagtgcaaattcatcattcttgtttcaataatgtccttctaagaagaaatacaagttcataattagctgataatcatcctctcttcctggtcactaaggctgtttttgattcacaatagaaattctgaaacaggatcagaaacttgaacctgagtcaaaccagagctaccatgcagagttccggtcataattttggtatacaagtttgaaagtcgaatcaatacaaacaagatgacctgagtactgaatgtgtagaacataagggaaaaaagcaaaacccataattatgttaacattctgtacttgtacagctatttggattgcttttttgtgtttctattctatttttgtttttcttttgaataaaacaaaattcccattcttgtaattaggtatcataggaatattttta

SEQ ID NO: 112067 - DNA, 440 bp, Homo sapiens
gtgagctcactaccttctctgtagaagctccttctatcttctcactgggagagagttgcccgatttatgctttcctcacttggaccccagagcagaccataccagactggagatcacagtccttcgcagttgacagttcccagtgacccctacaagggggaggtaagcctgagcagggccacccaccagacctggtgggacctccttcaactctgctcctgcaggggacatactggggatttggagtcctttcccttgtactcagtttctgcatcttagaggcaaagtagtccagaaaggcagaaaacacatcaagagtctaacacatgcttactccaagccctggcagcctagcgaccctgctctgggacccactctggccacagttttcccatctgtggaataaacaacacaacacctccagtaataacccctctatt

SEQ ID NO: 112068 - DNA, 242 bp, Homo sapiens
ggacacggagggtgcaccagcacccgtccacgtacctgcctgtgtgggggtgttcactcagcgttgtgcacgcctggtctcgtacccctccccccccccccgatggggaggtgctgtcgccatccatgggggacagaagaggaaactgaggctcagcagagttaagtcgcttcccctaggtcacactgccaaaaacagccaaccgaggtctatgccacgagactcaccacgaggaatcatga

SEQ ID NO: 112069 - DNA, 598 bp, Homo sapiens
gctatctatgacaaacccacagccaatatcatactgaatgggcaaaaactggaagcattccctttgaaaactggcacaagacagggatgccctctctcaccactcctattcaacatagtgttggaagttctggccagggcaattagacaggagaaggaaataaagggtattcaattaggaaaagaggaaatcaaattgtccctgtttgcagatgacatgattgtatttctagaaaaccccattgtctaagttttattttgattcacttcttgttgttctgggctttatggtcaagtaatttgttttagaaaactttactgggaggtgacatcagcaacatggtggcacaggagacttctacctctccctccacccatggacacgtggaataaacacctacacatggataaattttctttgagagaaagtcagaaaaagttgagagtctcttacacagcagacaactgagaaaatattcacatcaagcaggtagaaaaagctgaggcacacgcaggcacaaatatcaccctgggtactgcaccataaaccaggaaaaactcccaacacataacttctccctgaggagagaagggtatgg

SEQ ID NO: 112070 - DNA, 161 bp, Homo sapiens
ccgcctggacttgggacagaattctgagaatatgcctggacgggggccccatcagggccagctgggaggggaggagggtgactggcgtctgtctcccctgcccagacagttctgggacgtgaggcgccctttttcccaggctgcaccagctcactgtggaa

SEQ ID NO: 112071 - DNA, 816 bp, Homo sapiens
gtagtaatcctgtgcactctcaccagggcagggagctgtcttgacccccagtggaggctgacaatttttttcctgtgtacactggacccctttcatagaggtgggtgctatgcaagtggagctggtgactgatggctgaccattgatacaggctaggaataccaatgagcaaggtgagcactatgttctcagaggacgacttccagtcaacagaaagagccccatatggtccacaactacagtggtcccaggatctgccaagagtccaggtttttagagaacaggccaacctggaggacaggagtcccaggagaacccagaggatcactggaggagaacaagtgctgtggggccccatcacccagatatttcccacagttcggcctgctgacctaaccagagtcatcatgcctcttgagcaaagaagtcagcactgcaagcctgaggaaggccttcaggcccaagaagaagacctgggcctggtgggtgcacaggctctccaagctgaggagcaggaggctgccttcttctcctctactctgaatgtgggcactctagaggagttgcctgctgctgagtcaccaagtcctccccagagtcctcaggaagagtccttctctcccactgccatggatgccatctttgggagcctatctgatgagggctctggcagccaagaaaaggaggggccaagtaacctcgcctgacctgatagaccctgagtccttttcgcaagatatactacatgaccaagatcactcgactttgggtccatttatggctccgcaagtatccgagtcaacggggctgatcaca

SEQ ID NO: 112072 - DNA, 249 bp, Homo sapiens
ttctgttggtcacccagggactaaacaagtgtgtgtgggtggttctgaacaaacctctgaccattagctgcaaaacaactgaagggacaggtcctagaaatgagagtcagaattattatctgaacgactgaaagagttctctgtgttaatggtaataccttcacttttataagggaatttcctcctgcaacccaagttaatgcatgtagaattttaaagggaatggcttttggtttcagatttctattc

SEQ ID NO: 112073 - DNA, 631 bp, Homo sapiens
  misc_feature (607)..(607): n is a, c, g, or t
  misc_feature (609)..(609): n is a, c, g, or t
  misc_feature (615)..(615): n is a, c, g, or t
agagaattgattcataatgtaatattagagattatgtggtgagattgagagaaagtaaagataatacggttagaagatgggagtcataaatagaagatatgttagatcaaaaaatatgcaaatattccaatatctgaaacacttctcatcccaagcattttggataaggaatactcaacctgtattaacaattctctgaagtcttcagatactgtatctggtctgtcctggtcacaaagcaattcttttagaaacattattctggaagcatgatagcttacaatttaatgccatgatacagtggccactatcaccactgtctgatccttcacaggatgtgtctccgtgtccctctcagccagaaggtttctgattcccacagggatcagtctccatatttacaaattttgatgctttctgaagactgactttacccttgaatttctgctcaaagctttgtgctttttcagttagaggatattgtttgcttagtgaaagtactagcatccaggcctttcttcccaataactggctttcctggttcagggatctagtcttcaagcatgcatgcatgcatatttatttatttgtttgtttgtttgacagngngactcngtctcaaaaaaaaaaa

SEQ ID NO: 112074 - DNA, 311 bp, Homo sapiens
gagtatcacctctatggaactaataaaccttcctagaatccgtttttgaataatgtctggctcacaagaacattttcatcaaataattttaactctttttgccaagagatgtaagcaaatatgtgaaactgatcaagagaagtgaaaagctctgtacagtcaaatagaagttagcaactggcaaattagctcaaggtcagattttaaaaatagaattcagaatcatgacactcagaagtgatttgtaatttcacgagtagagacatcctgatattgcataagggatgttttccttttctaagagcagccct

SEQ ID NO: 112075 - DNA, 993 bp, Homo sapiens
gtgtgtttgtgtgtttaaaagtagacttttttttgaagagcaattttagatttacagcaaaattgagtggaaggggcagagatttctcatgtactccctacccctacacatgcacaattttccccattatcaacctcccccaccagaatggttgttacatctgatgacacattgtaattgcacagccttatcacccaaagcccatagtttacattagggtttactcctggtgttgtatattctatgggtgtgagatacatgtttaaaaatattttgtattagataaattggggataatagtcatttcaagaacaaaatgttggataaattaaattagctaataaacacagagtgctttaaacattcctagtgcaaaataagatcttgttgtttgtggtggtggtggctattcaggcttaaggtctagattccacttagtatgtaagtaaataatagcaatcctggctgtcatctgtatgtgtaatgtagtaatcagttttgtttagctagttcttatgtgtagcacattaaagcaatcttgaatagtgaggggacctcattactagattaccattaaatggtaatgttaagtgaccctgaaaccaaagtaatggaaaattgtcttcctttttttctttttttttttttttcccttgagatggagtcttgcactgtcacccaggctggagtgcagtggctcatggcaacctccacttcttgggttcacgagattctcctgcctcagccacccaagtagctgggattacagatgtacgccaccacacccggctaatttttgtatttttagtagagatgaggtttcaccatgccggccaggctgatctcgaactcctgagctcaagtgacctgcccacctcagcctcccagagtgctgggattacaggcatgagccactgtgcccagcctgtcttcctttttctcaaacatttaatttgctgtttcttgatcacatatcatccttctttcctttca

SEQ ID NO: 112076 - DNA, 194 bp, Homo sapiens
gtatgtggtatgttaggattcccaaattagagttgggttcaaggaaggtatggttgaggaagtgaaatttcaagataagcacaagaatgggagaacagtagtctctcttctctcttttttttttttttttttaaaataaagagacagggggaaaaatccgcccagcggaaggaaaaattgggggacccgggccc

SEQ ID NO: 112077 - DNA, 278 bp, Homo sapiens
cattgcactccagcttggagacagagcgatactccatatcaatcaatcaataaataaaatcaaccagaatttggggctaaccaaaaatgaactacaaagagtaacagatgaacctaactgtattataaatgaataatataaccacagtggaaggagtggaaaaggaaagaactaacccaagtaactttggaagcagtattttggctgtgtactgtaaggctaaagacaaaaagtattgtacagtaagctgtctctatccatgcgttctgtatccatgg

SEQ ID NO: 112078 - DNA, 675 bp, Homo sapiens
ggatcatgcatggatgagactcttttcatgtcagctgacatttatcgcataggagccacatggcatgtcctctgttgtgctctgaagatccaaagaagaaagataaatatattttccccaagttattcagtctgggagaggagacttaaaatgctgcattctaaacttacttttccccaggtggagaattttaatacaggtaagaataaatgcctagtcatattttccctaaaagatgagagaaggaatttttaaagggaggagtagcattgtgaaggcacacagtgacacatggaaacctctttccctcagcagcacggagtgccgccctcttccctacacaaagcagatccctccagagagaagacactgttaactagaaaaaccttgcctgggcgtggtggttcacagctgtaatcccagcactttgggaggctgaggagggtggatcacgaggtcaggagatcgagaccatcctggtcgacatggtgaaacccctaaaaatcatctctactaaaaatacaaaaattagctgcgtgtggtggcgggcgcctgtaatcccagctactcgggaggctgaggcaggagaattgcttgaacccagggggcagagattgcagtgagccagcactccagcctgatgacagagcaagactccgtctcaaaaaaaaaaaa

SEQ ID NO: 112079 - DNA, 838 bp, Homo sapiens
gaacaggagaagctgtctttggctcggctggaaggtgaagggattccagatgccggttcctggcttgctccccgctctccatttggcttcatcctggggctctcttcctccccacagaggggtggtgggcactctgtgccacacctctcctctctgggatctcaggtctgtccctgaaacctgctggtagaagaacctctagagtccttgcctccttcccaccgtgtgaccattgcccattggcacatctgtcaagacacagatttttggaagaaaaaagaaagagtgaatgctgcagagatggattgttaattttccaaatgagatatgactctgagatcccacctacccagctggtaggacgttccaccatgctccctaaggtggtttgagtgtttggaatgacaaagactctctcatcaccctgaaaccttagtccggcggcgcctctgagtcttctgcttgacgaggcctgaccttgggcttccccatgtcctttcagaatccagtttgagcaagaatcctgctaagtcagatggagtctcgctctgtcgcccaggctggagtgcagtggtgcgatctcggctcactacaagctccgcctcctgggttcccactattctcctgcctcagcctcccaagtagctgggactacaggtgtctgccaccacgcccagctaattttttgtatttttagtagagatggggtttcaccgtgtcagccaggatggtctcggtctcctgaccttgtgatccgcctgcctcggcctcccaaagtgctgggattacgggcatgagccacagcgctcagccctaatttttgtatttttagtagaaa

SEQ ID NO: 112080 - DNA, 326 bp, Homo sapiens
cagacctggaaggaaggatgcctgtgccaggggcaggaagtcagtgtccctgaataaaattccgtgtctgaaattaggagctggtacctggagaagaacgtgcaaacctggtggccggctgcgtggtgacatttgtagaatttccagcactcctctacgccaggctggagccagtttctagaaggatatttgggctgttttgtaaacatctaaagcatctcttgagcactctggtttcgtgagaccactttatccttctcccgtttcttaaccacgggcacggaatgttctggacatcccgcctcaggtgccatgtgatgtgtcct

SEQ ID NO: 112081 - DNA, 685 bp, Homo sapiens
catggtggctcacgcctcccagcactttgggaggcccagacgggcagatcacaaggtcaggagttcgagaccagcctgaccaacatggtgaaaccccgtctctactaaaaatacaaaaattagctgggtgtggtggcatgcgcctgtaatcccagctactcggaaggctgaggcaggagaattgcttgaacctgggaggcgaaggttgcagtgagccgagattgcgccattgcactccaggctgggcgacagagcaagactctgtctcaaaaacaaacaaacaaacaaaaaaaacaaaagactttagtgttcaccatggctcgtttgcaagatttcctgcatgtaggaacacgaatgacccagtgcaggccaaaacaaaccagagacctgcattcagcagatccggcccaggaaggcagcaggaagtttccatgggcccatgcttactgcatacttgcctgtgtagtttttgccaatccagtggactttctagaatggaatttaaagataacagcatttcatgggcaaaaaggagggtgctgcttggctgagcatggtggctcacacctgtaatctcagcactttggggaggccaaggcaggtggagcgtctgaggtcaggagttcgagaccagcctggccaacatgttgaaaccccatctctactaaaaatacaaaaattagcc

SEQ ID NO: 112082 - DNA, 347 bp, Homo sapiens
ggtggacctagaaagatcaagaggatttgggccattcagaattagctgggaaatgaaaaaactagggccagttggtggacaagcacccaggctaggtagctggacaatcagtgcctagaaatattggcagaggcagctagttaagggttaaatgcttttctaagaaagataagcataagctacccagtctagtttctcgtagatttctgggtttttttgtttttgttttctttgagatggagtcttgctctgttgcccaggttggagtgcagtgacgcagtcggcaacctctgccttctgggttcaagcgattcctcagcctcctgagtagctgggactacaggtgc

SEQ ID NO: 112083 - DNA, 362 bp, Homo sapiens
atgttagtcaggctggtctcgaactcctgagcttgtgatccgcccactttggcctcccaaagtgctgggattacaggcgtgagccaccgtacctggtggtaagtcctcttggttgtaccctgctgctttcccagggtacactgaggcctggaacatctttgatccttcaccctgaactattgtcctctgacctttgtaggtaaccaaggcctggcctatggtagtggcagaaagatagaataaggtggggttgctaagggattatttttttcctacagtgttctacgtctctgttttcctagtaagtttttattaaggcaagtaggctcttacattgatacactgtaattttgacaagggca

SEQ ID NO: 112084 - DNA, 560 bp, Homo sapiens
ctgtgaagccgtttttcttcttctttttgagactgagtctcactctgtcatccaggctggagtgcagtggtgtgatctcagctcactgcaacctccacctcctgcattcaagtgattctcctgcctcagcctcctgagtagttggaattacaggtgcgcaccaccacgcctggctaatttttgtatttttagtagagacaggattttgccacattgcccaggctagtctcaaactcctgacctcaagtgatccacctgcctcagcctccccaagtgctgggattacaggcgtgagccactgtgccaggtcagcagtttttcttttggcgttgcttgtactgaaagtgttaaatttaagcctggtgtcatgaggagctgagcagaattgttgccatttctacttttttttttttttaatttagttgtgacatacttggctcagctagcacttactgccatttcatcttccttttttttttcatttccattagtagggtttggttatactgtctattttcaaaggctattagaaggcgttagtagcttttcagaccttgtag

SEQ ID NO: 112085 - DNA, 729 bp, Homo sapiens
agaggaggtgcgccggttcatgggtcccggagggcccaagtgagccgctcccagaaacggaatctcactctgttgcccagactggagtgcagtggcatgatcacagctcactgcagcctctacctcttgggctccaacgatcctcctgcctcagactcccaagtcgctgggactacagtcgtgcatcaccatgcctggataatttttaaattttttgttaagacagggtctcactatgttgcctaggctggcctcgaactcttggcctcaagcaatcctcccgcctcagcctccccaggcactgggattacaggtgtgagccactgcacccagcctgacacccctctttggaccagcatgtaccctccccagtgccccccattactgacatttaccttgctgggacccacctattggcttttggattgaattgttcaagaatagaagggcgaggaagagagaaaacagggcgggggagaggtgggaaggaaaaggggaagagccacagaaaccttcagcaagttggctttggctatgggccatcagtttctccccttagcttcccgtagtgtcagggaaatactaccaggcacagaggagccacctcatctttttggattgttgggtcactgtacttctccatgagttgcaaaccctctctgcaattaatctgtaggaccagcttgaccaatggagttgtaatgtttggaatcaactcagtgtgggtga

SEQ ID NO: 112086 - DNA, 289 bp, Homo sapiens
cagtggcaccatgtcagctcaccgcaacctccacctcttaaaaggcttttgatggcaaaatgtgagtctcaatgcaggccctagaataacagccccagcactgtacatccattaattcattaaatcctttggccaggcgtggtggctcatgcctgtaatcccagcactttgggaggccgagttgggcggatcacgaggtcaggagatcgacaccatcctggctaacgcggtgaaacctaaaaatacaaaaaaattagccgggcgtagtggcgggtgcctgtagtcccag

SEQ ID NO: 112087 - DNA, 294 bp, Homo sapiens
ccctgaaatctatatccacaaagcacagttatatctatatactgaaaatccattcaagactctcagaagaaaaagaaatgaaggagttacaaacacagtattaactacagcttatcaaatcaagaactaagaatggttccaccaagtagaccgcccctgctaagaagttttgataaccaagtagcccgtctgcctcaaattatggaaactggccctgaagcttttattctcaacacaacaacttacaaactcaattcataaactatgtggttttggccagggatggtggctcac

SEQ ID NO: 112088 - DNA, 272 bp, Homo sapiens
aacagagcgagactaggtggctgttctgtgtactgtgggatattgagtagcatccctggcctccccagtatctcaaatatgaaaacatgttttctatctcgattactgagcttttcggtgcctccttcggttctgcacctaagctaagagccccttcatctcaccctgatctctatccagtttctaacacagcagtcttgtaagatgcccggacttaaacggttatttcctgtgaaacaggtgaaaggggctttcatctctaaaaagtcgga

SEQ ID NO: 112089 - DNA, 186 bp, Homo sapiens
gcaaaaccccatctttacaaaaaatgccaaaaataaaagccggatatggtgaaatgcgcctgaggctgaggcagggaggatcacgtaagccctccccagcctgagcctgggaggttggggctgcagtgagctgcccctcatagctgccactgtactccagtagtctgggtgacagagtgaaaccct

SEQ ID NO: 112090 - DNA, 238 bp, Homo sapiens
ttttcgatgggcccaacatgttagcaactagaagaaaatactaataactcctaatatacacataaattccaaactgttttgctaaaagtccacaacgagtttctaaacatatacatctgcctttgtaaatagagacattcaacaaatagtcattgtgcactgacttatgtcttctcctcaccaaccacacctccccagggtctcatgatgactaagtaggacagagggaaggagtcta

SEQ ID NO: 112091 - DNA, 408 bp, Homo sapiens
ttaccaaaaaaaaaaaaaaaaaaaaaaaaaaacagaagtattagtgaaattattttaaacctgtatgaggtgataactgcaagtctaggcctcctgttcttcagactggccagctatcaggtgggggttcccacaacccctttcttggattcaacaaatttctagaacggctcacaaaatttagggaaatattttcttatatttactgattattataaaggacacaattcaggaacagccaaatggaagaaatgcacagggcaacggatgggggaatgggtgtggaacttccacgccctctctgggcataccctagagcacctccatgtgttcaccaacccagaagcttccagaaacggtatttttgtttctatgaaggtttcattacataggcataattgactgaat

SEQ ID NO: 112092 - DNA, 386 bp, Homo sapiens
accgctgtaaaccacaactctcaacagggttgcatttgcctcatgtttggggggttgccagagactggttctggcttggtttagtccccttgcttagtgggactccttggaaactctactatcttgcttgtgaaaattctgatgtcctttttctccaagtataaaattggctgatagaaatggaatcatttcagagagactttagcataaatactatcgacttggtgcggtgttgatgaaaatataaattctccttcttaggcttttggtatgtttgtctcaaagagaaaataagtgaccatgaagatcagtagctggtatgaacaaatacctttttatgagacgccacagaatttcctgttctgctaaaacaaggctttgacatt

SEQ ID NO: 112093 - DNA, 231 bp, Homo sapiens
cgatcttagggaagtcctttccctgctgcagaggaggtggagaacccttacatcatggccaggcattgcagcaggtaagggagagagagacaggtagacacagacaagcatcgcagccgggtaagggagagaaaggcaggtagacacagccaggcatcgcagcaggtaagggagagagaagcaggtagatgcagcaggtaagggagagagaggcaggtagacacagccagg

SEQ ID NO: 112094 - DNA, 526 bp, Homo sapiens
atccgatgagtaaatcttggcagtatgataaatgttgcctgtgtcagttaactttcagaatttaccgtgtgtgtgaaatactcatattcattataaataaatggattaatctctatggccctttggctacataaaacaaaaaaatctgccatgtgctcagagttcagaaaaagctattcttgtgtggtaatcttttaacaatcaggtttttaatactctcctttaacacaagactgctaaatgatcagcttctcaaattagtgtatcataacgcatgacagaaaatcattaaatggaatcactaatgaggaaaggcattgctgatttttataccttaatcacttgacattgttcatctttataagagggctaaatattacttactacctctgactaggaatactgttaaattgtattactgtgctgatatgcaagaaattctgtccaaatacagaacttatttaaattattaaaaacatatgggccaggcatggtggctcacgcctgtaatcccagcactttggga

SEQ ID NO: 112095 - DNA, 5283 bp, Homo sapiens
  misc_feature (1277)..(1277): n is a, c, g, or t
  misc_feature (1342)..(1342): n is a, c, g, or t
  misc_feature (1620)..(1620): n is a, c, g, or t
ggcacgagggcagcgcgggccgggccgggacggggactgtcggctgcaggcagccatgcccacgaactttacggtggtgcccgtggaggctcacgccgacggcggcggggacgagactgccgagcggacggaggctccgggcacccccgagggccccgagcccgagcgccccagcccgggagatggaaatccaagagaaaacagcccattcctcaacaatgtcgaggtggaacaagagagcttctttgaagggaagaacatggcacttttcgaggaggagatggacagtaaccccatggtgtcctcgctgctcaacaagctggccaactacaccaacctgagccagggcgtggtggagcacgaggaggacgaggagagccggcggcgggaggccaaggctccgcgcatgggcaccttcatcggcgtctacctgccgtgcctgcagaacatcctgggcgtcatcctcttcctgcgcctgacgtggatcgtgggggtggctggtgtcctggagtccttcctcatcgtggccatgtgctgcacatgtacaatgctgaccgccatttccatgagtgcgatcgctaccaacggtgtggtcccagctggcgggtcctactacatgatatcgcgctcgctgggacccgagtttggaggcgctgtcggcctctgcttctacctgggcacgacgtttgcaggggccatgtatattttggggaccatcgagatttttctgacgtacatctccccgggtgcggccatcttccaggcggaggctgcaggtggcgaggcggccgccatgctgcacaacatgcgtgtgtacggcacgtgcacgctcgtgctcatggccctggtggtcttcgtgggcgtcaagtatgtcaacaagctggcgctggtcttcctggcctgcgtcgtgctgtccatcctggccatctatgccggcgtcatcaagtctgccttcgaccccccggacatcccggtctgcctcctggggaaccgcacgctgtcacggcgcagcttcgatgcctgcgtcaaggcctacggcatccacaacaactcagccacctccgcgctctggggcctcttctgcaacggctcccagcccagcgccgcctgtgacgagtacttcatccagaacaacgtcaccgaaatccagggcatcccgggcgcggccagtggtgtcttcctggagaacctgtggagtacgtacgcgcacgcgggggcgtttgtggagaagaaaggtgtgccctcggtgcccgtggcagaggagagccgtgccagcncactgccctacgtgctcaccgacatcgcggcctccttcaccctgctggttggcatctacttcccntccgtgaccggtatcatggcgggttcaaaccggtccggggacctcaaggatgcacagaagtccatccccacggggaccatcctggccatagtgacgacgtctttcatctatctctcctgcattgtgctgtttggggcctgcattgaaggcgtggtcttacgagataagttcggggaggccctgcaggggaacctggtcatcggcatgctggcctggccctccccctgggtcatcgtcatcggctccttcttctccacctgcggtgccggcctgcagancctcacgggggcaccgcgcctactgcaggccattgcccgtgacggcatcgtccccttcctgcaggtgtttggccacgggaaggccaacggggagcccacgtgggcgctgctgctgacagtcctcatctgcgagactggcatcctcatcgcctctctggacagcgtggccccgatcctctccatgttcttcctcatgtgctacctgttcgtgaacctggcctgcgccgtgcagaccctgctacgtacccccaactggcgtccacgcttcaagttctaccactggaccctgtcctttctgggtatgagcctgtgcctggcgctgatgttcatctgctcctggtactacgcgctgtccgccatgctcatcgctggctgcatctacaagtacatcgagtaccgcggggccgagaaggagtggggcgatggcatccgtggcctatccctgaacgccgcccgctacgccctgctgcgcgtggagcacggtcccccccacaccaagaactggaggccccaggtgctggtgatgctgaacctggacgcggagcaggccgtgaagcacccccgcctgctgtccttcacgtcgcagctgaaggccggcaagggcctgaccatcgtgggctcggtgctggaggggacgtacctggacaagcacatggaggctcagcgggccgaggagaacatacggtccctaatgagcacagagaagaccaagggcttctgccagctggtggtctcgtccagcctgcgggatggcatgtcccacctgatccagtcggccggcctgggcggcctgaagcacaacacggtgctcatggcctggcccgcatcctggaagcaggaggacaaccccttctcctggaagaactttgtagacaccgtccgcgacaccaccgccgcgcaccaggctctgctggtggccaagaacgtcgactcgtttccgcaaaaccaggagcgcttcggcgggggccacatcgacgtgtggtggatcgtgcacgacggcggcatgctcatgctgctgcccttcctgctgcgccagcacaaggtgtggaggaagtgccggatgcgtatcttcaccgtggcccaggtggacgacaacagcatccagatgaagaaggacctgcagatgttcttgtaccacttgcgcatcagcgccgaggtggaggtggtggagatggttgaaaacgacatatctgctttcacctacgagaggacactaatgatggagcagaggtcgcagatgctgaagcagatgcagctgtccaagaacgagcaggagcgagaggcccagctgatccacgacaggaacaccgcgtcccacaccgcggcggcagccaggacccaagcgccgcctacgccagacaaggtgcagatgacctggaccagggagaagctgatcgctgagaagtacaggagcagagacaccagcctatccggtttcaaagacctcttcagcatgaagccggaccagtccaacgtcaggcggatgcacacggctgtgaagctcaatggcgtcgtcctcaacaagtcccaggatgcgcagctggtcctgctcaacatgccaggtcctcccaaaaaccggcagggagacgagaactacatggagtttcttgaagtcctgaccgaggggctgaacagagtcctcctggtcaggggtggcggccgggaggtgatcaccatctactcctaatgcccaacagcatcacggcactctgggacaggcacggaggacggcgtgggcagcctgggcctgggcttggcccagggaaacagacggcagacacacctgtcccccagtgatgccacccaagctgcccatggggcttcctacggaagtttctaggcccgtcacctagggctctcctgttcagccttaacaggctcagcaaatcagggcgtggctggacgatttccttgcatctgagggcagacgctgctaccggagtgacctggacgtggccagatcttctcgcaggtcacaagaagccagtgagcccttgccttggtttctggaagttcttttccttggctggatttacccagtggttaggttgcatttctaccccatccagaacattcttggaagagcacccggagctgaagctgtccctgatgatgaaggtgaaacgtcagccctggccatggctccgctcagggccccggtcacctccgagtcactctgttccttgactgtctttgtgtttctgtacctcaaggcactgaagctggaggactctgtccatgcccgtgtcaccctcgtgtgggagcctctgggctcggcaggtccacatttcatgagctgaggcgtgggccagggccatctggaaagggaactcggcttttccagaacgtggtggatcatctgtcgggtgtgtggtgaacacgttcagttcatcagggcctacgctccgggaaggggcccccagctgtggctctgccatgccgggctgtgtttgcagctgtccgagtctccatccacctttagaaaaccagccacttcttttcataagcactgacagggcccagcccacagccacaggtgcgatcagtgcctcacgcaggcaaatgcactgaaacccaggggcacacgcgcgcagagtgaacagtgagttcccccgacagcccacgacagccaggactgccctccccaccccaccccaccccaggagcacggcacacagttcagcctctgagctggctcacacgtgccatccccaccccggtgctccagggaaggaggacacggacccgacgtgggaggtcctcaggcagcagtggcgcctggtgtcaggtctgtctggctgagtcccgggcgtcccctgccatggcctgtgccttgcatggaggcggcggtggcactgaagagatagctttcaagggcccaacactttgcacttcggctggctgtgagtttctgctttgtaggttgtggtcacatttgcaggctgcgggcagtggcaccgacttgggcctccctttctatgtggcatatttatttatttaaacaccccagggagttacgtggtaacaaggttgtccataaagaggttgcttctatatactagaggccccagatggccaggccttgggctacgtctggcttgcatggtctcccaagggaatcagccccatcaacaaagttcaaatcggggcagaggctgcacttgtgcccccagatgtttctgaggagccagactagggctggcattgctgtagagtgacggctgctgcccagagcgtgtcccagacatcacagcggggctcagcagttcccacagcctctgcctgccttggctaagcatgagttaagcagcaaaacgctcctccatgtctggatggggccggcaggtcctgtgtcccctgcacctggaggagagcaggctagaggcacagcggccacatggtgctggctctgaacgttggttggtggctggaaaacagccctgcttctgagggccgctcagttctgcacacgaaaccacctcctgagggctcagctctgcccccgccctgggctgcagcctctgcacgcaagcaccaggcatcctttgtgttgtcaactccgtgtaaccagtaactacagccatttacaattgactccgtttccttttgtaggtttccctgtctgtctgtgttagtagaaaaataaaatcctatgaaatctga

SEQ ID NO: 112096 - DNA, 327 bp, Homo sapiens
cacccgggggagggggccgcggcggcccaggccgggggcccggcgccgcctgctcgaaccggggagcccttgggggctgcggttgcaggaaccttccctctaccctgcttctgagggccgctcagttctgcacacgaaaccacctcctgagggctcagctctgcccccgccctgggctgcagcctctgcacgcaagcaccaggcatcctttgtgttgtcaactccgtgtaaccagtaactacagccatttacaattgactccgtttccttttgtaggtttccctgtctgtctgtgttagtagaaaaataaaatcctatgaaatctga

SEQ ID NO: 112097 - DNA, 2709 bp, Homo sapiens
cggcgaattcgtggtgctgctcggcgaattcgtggtgctgctcggcgaattcgtggtgctgctgcccttcctgctgcgccagcacaaggtgtggaggaagtgccggatgcgtatcttcaccgtggcccaggtggacgacaacagcatccagatgaagaaggacctgcagatgttcttgtaccacttgcgcatcagcgccgaggtggaggtggtggagatggttgaaaacgacatatctgctttcacctacgagaggacactaatgatggagcagaggtcgcagatgctgaagcagatgcagctgtccaagaacgagcaggagcgagaggcccagctgatccacgacaggaacaccgcgtcccacaccgcggcggcagccaggacccaagcgccgcctacgccagacaaggtgcagatgacctggaccagggagaagctgatcgctgagaagtacaggagcagagacaccagcctatccggtttcaaagacctcttcagcatgaagccggaccagtccaacgtcaggcggatgcacacggctgtgaagctcaatggcgtcgtcctcaacaagtcccaggatgcgcagctggtcctgctcaacatgccaggtcctcccaaaaaccggcagggagacgagaactacatggagtttcttgaagtcctgaccgaggggctgaacagagtcctcctggtcaggggtggcggccgggaggtgatcaccatctactcctaatgcccaacagcatcacggcactctgggacaggcacggaggacggcgtgggcagcctgggcctgggcttggcccagggaaacagacggcagacacacctgtcccccagtgatgccacccaagctgcccatggggcttcctacggaagtttctaggcccgtcacctagggctctcctgttcagccttaacaggctcagcaaatcagggcgtggctggacgatttccttgcatctgagggcagacgctgctaccggagtgacctggacgtggccagatcttctcgcaggtcacaagaagccagtgagcccttgccttggtttctggaagttcttttccttggctggatttacccagtggttaggttgcatttctaccccatccagaacattcttggaagagcacccggagctgaagctgtccctgatgatgaaggtgaaacgtcagccctggccatggctccgctcagggccccggtcacctccgagtcactctgttccttgactgtctttgtgtttctgtacctcaaggcactgaagctggaggactctgtccatgcccgtgtcaccctcgtgtgggagcctctgggctcggcaggtccacatttcatgagctgaggcgtgggccagggccatctggaaagggaactcggcttttccagaacgtggtggatcatctgtcgggtgtgtggtgaacacgttcagttcatcagggcctacgctccgggaaggggcccccagctgtggctctgccatgccgggctgtgtttgcagctgtccgagtctccatccacctttagaaaaccagccacttcttttcataagcactgacagggcccagcccacagccacaggtgcgatcagtgcctcacgcaggcaaatgcactgaaacccaggggcacacgcgcgcagagtgaacagtgagttcccccgacagcccacgacagccaggactgccctccccaccccaccccaccccaggagcacggcacacagttcagcctctgagctggctcacacgtgccatccccaccccggtgctccagggaaggaggacacggacccgacgtgggaggtcctcaggcagcagtggcgcctggtgtcaggtctgtctggctgagtcccgggcgtcccctgccatggcctgtgccttgcatggaggcggcggtggcactgaagagatagctttcaagggcccaacactttgcacttcggctggctgtgagtttctgctttgtaggttgtggtcacatttgcaggctgcgggcagtggcaccgacttgggcctccctttctatgtggcatatttatttatttaaacaccccagggagttacgtggtaacaaggttgtccataaagaggttgcttctatatactagaggccccagatggccaggccttgggctacgtctggcttgcatggtctcccaagggaatcagccccatcaacaaagttcaaatcggggcagaggctgcacttgtgcccccagatgtttctgaggagccagactagggctggcattgctgtagagtgacggctgctgcccagagcgtgtcccagacatcacagcggggctcagcagttcccacagcctctgcctgccttggctaagcatgagttaagcagcaaaacgctcctccatgtctggatggggccggcaggtcctgtgtcccctgcacctggaggagagcaggctagaggcacagcggccacatggtgctggctctgaacgttggttggtggctggaaaacagccctgcttctgagggccgctcagttctgcacacgaaaccacctcctgagggctcagctctgcccccgccctgggctgcagcctctgcacgcaagcaccaggcatcctttgtgttgtcaactccgtgtaaccagtaactacagccatttacaattgactccgtttccttttgtaggtttccctgtctgtctgtgttagtagaaaaataaaatcctatgaaatctga

SEQ ID NO: 112098 - DNA, 1429 bp, Homo sapiens
gtcaaaattaagcgtaactggcggaacctcagaggcattgacaacagggttcgtagaagattcaagggccagatcttgatgagcaacattggttatgcaagcaacaaaaaaacaaagcacatgctgcacagtggcttccggaagttcctggtccacaacgtcaaggagctggaagtgctgctgatgtgcaacaaatcttactgtgccgggctgtgtttgcagctgtccgagtctccatccacctttagaaaaccagccacttcttttcataagcactgacagggcccagcccacagccacaggtgcgatcagtgcctcacgcaggcaaatgcactgaaacccaggggcacacgcgcgcagagtgaacagtgagttcccccgacagcccacgacagccaggactgccctccccaccccaccccaccccaggagcacggcacacagttcagcctctgagctggctcacacgtgccatccccaccccggtgctccagggaaggaggacacggacccgacgtgggaggtcctcaggcagcagtggcgcctggtgtcaggtctgtctggctgagtcccgggcgtcccctgccatggcctgtgccttgcatggaggcggcggtggcactgaagagatagctttcaagggcccaacactttgcacttcggctggctgtgagtttctgctttgtaggttgtggtcacatttgcaggctgcgggcagtggcaccgacttgggcctccctttctatgtggcatatttatttatttaaacaccccagggagttacgtggtaacaaggttgtccataaagaggttgcttctatatactagaggccccagatggccaggccttgggctacgtctggcttgcatggtctcccaagggaatcagccccatcaacaaagttcaaatcggggcagaggctgcacttgtgcccccagatgtttctgaggagccagactagggctggcattgctgtagagtgacggctgctgcccagagcgtgtcccagacatcacagcggggctcagcagttcccacagcctctgcctgccttggctaagcatgagttaagcagcaaaacgctcctccatgtctggatggggccggcaggtcctgtgtcccctgcacctggaggagagcaggctagaggcacagcggccacatggtgctggctctgaacgttggttggtggctggaaaacagccctgcttctgagggccgctcagttctgcacacgaaaccacctcctgagggctcagctctgcccccgccctgggctgcagcctctgcacgcaagcaccaggcatcctttgtgttgtcaactccgtgtaaccagtaactacagccatttacaattgactccgtttccttttgtaggtttccctgtctgtctgtgttagtagaaaaataaaatcctatgaaatctga

SEQ ID NO: 112099 - DNA, 5291 bp, Homo sapiens
  misc_feature (1277)..(1277): n is a, c, g, or t
  misc_feature (1342)..(1342): n is a, c, g, or t
  misc_feature (1620)..(1620): n is a, c, g, or t
ggcacgagggcagcgcgggccgggccgggacggggactgtcggctgcaggcagccatgcccacgaactttacggtggtgcccgtggaggctcacgccgacggcggcggggacgagactgccgagcggacggaggctccgggcacccccgagggccccgagcccgagcgccccagcccgggagatggaaatccaagagaaaacagcccattcctcaacaatgtcgaggtggaacaagagagcttctttgaagggaagaacatggcacttttcgaggaggagatggacagtaaccccatggtgtcctcgctgctcaacaagctggccaactacaccaacctgagccagggcgtggtggagcacgaggaggacgaggagagccggcggcgggaggccaaggctccgcgcatgggcaccttcatcggcgtctacctgccgtgcctgcagaacatcctgggcgtcatcctcttcctgcgcctgacgtggatcgtgggggtggctggtgtcctggagtccttcctcatcgtggccatgtgctgcacatgtacaatgctgaccgccatttccatgagtgcgatcgctaccaacggtgtggtcccagctggcgggtcctactacatgatatcgcgctcgctgggacccgagtttggaggcgctgtcggcctctgcttctacctgggcacgacgtttgcaggggccatgtatattttggggaccatcgagatttttctgacgtacatctccccgggtgcggccatcttccaggcggaggctgcaggtggcgaggcggccgccatgctgcacaacatgcgtgtgtacggcacgtgcacgctcgtgctcatggccctggtggtcttcgtgggcgtcaagtatgtcaacaagctggcgctggtcttcctggcctgcgtcgtgctgtccatcctggccatctatgccggcgtcatcaagtctgccttcgaccccccggacatcccggtctgcctcctggggaaccgcacgctgtcacggcgcagcttcgatgcctgcgtcaaggcctacggcatccacaacaactcagccacctccgcgctctggggcctcttctgcaacggctcccagcccagcgccgcctgtgacgagtacttcatccagaacaacgtcaccgaaatccagggcatcccgggcgcggccagtggtgtcttcctggagaacctgtggagtacgtacgcgcacgcgggggcgtttgtggagaagaaaggtgtgccctcggtgcccgtggcagaggagagccgtgccagcncactgccctacgtgctcaccgacatcgcggcctccttcaccctgctggttggcatctacttcccntccgtgaccggtatcatggcgggttcaaaccggtccggggacctcaaggatgcacagaagtccatccccacggggaccatcctggccatagtgacgacgtctttcatctatctctcctgcattgtgctgtttggggcctgcattgaaggcgtggtcttacgagataagttcggggaggccctgcaggggaacctggtcatcggcatgctggcctggccctccccctgggtcatcgtcatcggctccttcttctccacctgcggtgccggcctgcagancctcacgggggcaccgcgcctactgcaggccattgcccgtgacggcatcgtccccttcctgcaggtgtttggccacgggaaggccaacggggagcccacgtgggcgctgctgctgacagtcctcatctgcgagactggcatcctcatcgcctctctggacagcgtggccccgatcctctccatgttcttcctcatgtgctacctgttcgtgaacctggcctgcgccgtgcagaccctgctacgtacccccaactggcgtccacgcttcaagttctaccactggaccctgtcctttctgggtatgagcctgtgcctggcgctgatgttcatctgctcctggtactacgcgctgtccgccatgctcatcgctggctgcatctacaagtacatcgagtaccgcggggccgagaaggagtggggcgatggcatccgtggcctatccctgaacgccgcccgctacgccctgctgcgcgtggagcacggtcccccccacaccaagaactggaggccccaggtgctggtgatgctgaacctggacgcggagcaggccgtgaagcacccccgcctgctgtccttcacgtcgcagctgaaggccggcaagggcctgaccatcgtgggctcggtgctggaggggacgtacctggacaagcacatggaggctcagcgggccgaggagaacatacggtccctaatgagcacagagaagaccaagggcttctgccagctggtggtctcgtccagcctgcgggatggcatgtcccacctgatccagtcggccggcctgggcggcctgaagcacaacacggtgctcatggcctggcccgcatcctggaagcaggaggacaaccccttctcctggaagaactttgtagacaccgtccgcgacaccaccgccgcgcaccaggctctgctggtggccaagaacgtcgactcgtttccgcaaaaccaggagcgcttcggcgggggccacatcgacgtgtggtggatcgtgcacgacggcggcatgctcatgctgctgcccttcctgctgcgccagcacaaggtgtggaggaagtgccggatgcgtatcttcaccgtggcccaggtggacgacaacagcatccagatgaagaaggacctgcagatgttcttgtaccacttgcgcatcagcgccgaggtggaggtggtggagatggttgaaaacgacatatctgctttcacctacgagaggacactaatgatggagcagaggtcgcagatgctgaagcagatgcagctgtccaagaacgagcaggagcgagaggcccagctgatccacgacaggaacaccgcgtcccacaccgcggcggcagccaggacccaagcgccgcctacgccagacaaggtgcagatgacctggaccagggagaagctgatcgctgagaagtacaggagcagagacaccagcctatccggtttcaaagacctcttcagcatgaagccggaccagtccaacgtcaggcggatgcacacggctgtgaagctcaatggcgtcgtcctcaacaagtcccaggatgcgcagctggtcctgctcaacatgccaggtcctcccaaaaaccggcagggagacgagaactacatggagtttcttgaagtcctgaccgaggggctgaacagagtcctcctggtcaggggtggcggccgggaggtgatcaccatctactcctaatgcccaacagcatcacggcactctgggacaggcacggaggacggcgtgggcagcctgggcctgggcttggcccagggaaacagacggcagacacacctgtcccccagtgatgccacccaagctgcccatggggcttcctacggaagtttctaggcccgtcacctagggctctcctgttcagccttaacaggctcagcaaatcagggcgtggctggacgatttccttgcatctgagggcagacgctgctaccggagtgacctggacgtggccagatcttctcgcaggtcacaagaagccagtgagcccttgccttggtttctggaagttcttttccttggctggatttacccagtggttaggttgcatttctaccccatccagaacattcttggaagagcacccggagctgaagctgtccctgatgatgaaggtgaaacgtcagccctggccatggctccgctcagggccccggtcacctccgagtcactctgttccttgactgtctttgtgtttctgtacctcaaggcactgaagctggaggactctgtccatgcccgtgtcaccctcgtgtgggagcctctgggctcggcaggtccacatttcatgagctgaggcgtgggccagggccatctggaaagggaactcggcttttccagaacgtggtggatcatctgtcgggtgtgtggtgaacacgttcagttcatcagggcctacgctccgggaaggggcccccagctgtggctctgccatgccgggctgtgtttgcagctgtccgagtctccatccacctttagaaaaccagccacttcttttcataagcactgacagggcccagcccacagccacaggtgcgatcagtgcctcacgcaggcaaatgcactgaaacccaggggcacacgcgcgcagagtgaacagtgagttcccccgacagcccacgacagccaggactgccctccccaccccaccccaccccaggagcacggcacacagttcagcctctgagctggctcacacgtgccatccccaccccggtgctccagggaaggaggacacggacccgacgtgggaggtcctcaggcagcagtggcgcctggtgtcaggtctgtctggctgagtcccgggcgtcccctgccatggcctgtgccttgcatggaggcggcggtggcactgaagagatagctttcaagggcccaacactttgcacttcggctggctgtgagtttctgctttgtaggttgtggtcacatttgcaggctgcgggcagtggcaccgacttgggcctccctttctatgtggcatatttatttatttaaacaccccagggagttacgtggtaacaaggttgtccataaagaggttgcttctatatactagaggccccagatggccaggccttgggctacgtctggcttgcatggtctcccaagggaatcagccccatcaacaaagttcaaatcggggcagaggctgcacttgtgcccccagatgtttctgaggagccagactagggctggcattgctgtagagtgacggctgctgcccagagcgtgtcccagacatcacagcggggctcagcagttcccacagcctctgcctgccttggctaagcatgagttaagcagcaaaacgctcctccatgtctggatggggccggcaggtcctgtgtcccctgcacctggaggagagcaggctagaggcacagcggccacatggtgctggctctgaacgttggttggtggctggaaaacagccctgcttctgagggccgctcagttctgcacacgaaaccacctcctgagggctcagctctgcccccgccctgggctgcagcctctgcacgcaagcaccaggcatcctttgtgttgtcaactccgtgtaaccagtaactacagccatttacaattgactccgtttccttttgtaggtttccctgcccccctgttccccaccacctaaaccaataaattggttcttgatatgaaa

SEQ ID NO: 112100 - DNA, 4977 bp, Homo sapiens
  misc_feature (1277)..(1277): n is a, c, g, or t
  misc_feature (1342)..(1342): n is a, c, g, or t
  misc_feature (1620)..(1620): n is a, c, g, or t
ggcacgagggcagcgcgggccgggccgggacggggactgtcggctgcaggcagccatgcccacgaactttacggtggtgcccgtggaggctcacgccgacggcggcggggacgagactgccgagcggacggaggctccgggcacccccgagggccccgagcccgagcgccccagcccgggagatggaaatccaagagaaaacagcccattcctcaacaatgtcgaggtggaacaagagagcttctttgaagggaagaacatggcacttttcgaggaggagatggacagtaaccccatggtgtcctcgctgctcaacaagctggccaactacaccaacctgagccagggcgtggtggagcacgaggaggacgaggagagccggcggcgggaggccaaggctccgcgcatgggcaccttcatcggcgtctacctgccgtgcctgcagaacatcctgggcgtcatcctcttcctgcgcctgacgtggatcgtgggggtggctggtgtcctggagtccttcctcatcgtggccatgtgctgcacatgtacaatgctgaccgccatttccatgagtgcgatcgctaccaacggtgtggtcccagctggcgggtcctactacatgatatcgcgctcgctgggacccgagtttggaggcgctgtcggcctctgcttctacctgggcacgacgtttgcaggggccatgtatattttggggaccatcgagatttttctgacgtacatctccccgggtgcggccatcttccaggcggaggctgcaggtggcgaggcggccgccatgctgcacaacatgcgtgtgtacggcacgtgcacgctcgtgctcatggccctggtggtcttcgtgggcgtcaagtatgtcaacaagctggcgctggtcttcctggcctgcgtcgtgctgtccatcctggccatctatgccggcgtcatcaagtctgccttcgaccccccggacatcccggtctgcctcctggggaaccgcacgctgtcacggcgcagcttcgatgcctgcgtcaaggcctacggcatccacaacaactcagccacctccgcgctctggggcctcttctgcaacggctcccagcccagcgccgcctgtgacgagtacttcatccagaacaacgtcaccgaaatccagggcatcccgggcgcggccagtggtgtcttcctggagaacctgtggagtacgtacgcgcacgcgggggcgtttgtggagaagaaaggtgtgccctcggtgcccgtggcagaggagagccgtgccagcncactgccctacgtgctcaccgacatcgcggcctccttcaccctgctggttggcatctacttcccntccgtgaccggtatcatggcgggttcaaaccggtccggggacctcaaggatgcacagaagtccatccccacggggaccatcctggccatagtgacgacgtctttcatctatctctcctgcattgtgctgtttggggcctgcattgaaggcgtggtcttacgagataagttcggggaggccctgcaggggaacctggtcatcggcatgctggcctggccctccccctgggtcatcgtcatcggctccttcttctccacctgcggtgccggcctgcagancctcacgggggcaccgcgcctactgcaggccattgcccgtgacggcatcgtccccttcctgcaggtgtttggccacgggaaggccaacggggagcccacgtgggcgctgctgctgacagtcctcatctgcgagactggcatcctcatcgcctctctggacagcgtggccccgatcctctccatgttcttcctcatgtgctacctgttcgtgaacctggcctgcgccgtgcagaccctgctacgtacccccaactggcgtccacgcttcaagttctaccactggaccctgtcctttctgggtatgagcctgtgcctggcgctgatgttcatctgctcctggtactacgcgctgtccgccatgctcatcgctggctgcatctacaagtacatcgagtaccgcggggccgagaaggagtggggcgatggcatccgtggcctatccctgaacgccgcccgctacgccctgctgcgcgtggagcacggtcccccccacaccaagaactggaggccccaggtgctggtgatgctgaacctggacgcggagcaggccgtgaagcacccccgcctgctgtccttcacgtcgcagctgaaggccggcaagggcctgaccatcgtgggctcggtgctggaggggacgtacctggacaagcacatggaggctcagcgggccgaggagaacatacggtccctaatgagcacagagaagaccaagggcttctgccagctggtggtctcgtccagcctgcgggatggcatgtcccacctgatccagtcggccggcctgggcggcctgaagcacaacacggtgctcatggcctggcccgcatcctggaagcaggaggacaaccccttctcctggaagaactttgtagacaccgtccgcgacaccaccgccgcgcaccaggctctgctggtggccaagaacgtcgactcgtttccgcaaaaccaggagcgcttcggcgggggccacatcgacgtgtggtggatcgtgcacgacggcggcatgctcatgctgctgcccttcctgctgcgccagcacaaggtgtggaggaagtgccggatgcgtatcttcaccgtggcccaggtggacgacaacagcatccagatgaagaaggacctgcagatgttcttgtaccacttgcgcatcagcgccgaggtggaggtggtggagatggttgaaaacgacatatctgctttcacctacgagaggacactaatgatggagcagaggtcgcagatgctgaagcagatgcagctgtccaagaacgagcaggagcgagaggcccagctgatccacgacaggaacaccgcgtcccacaccgcggcggcagccaggacccaagcgccgcctacgccagacaaggtgcagatgacctggaccagggagaagctgatcgctgagaagtacaggagcagagacaccagcctatccggtttcaaagacctcttcagcatgaagccggaccagtccaacgtcaggcggatgcacacggctgtgaagctcaatggcgtcgtcctcaacaagtcccaggatgcgcagctggtcctgctcaacatgccaggtcctcccaaaaaccggcagggagacgagaactacatggagtttcttgaagtcctgaccgaggggctgaacagagtcctcctggtcaggggtggcggccgggaggtgatcaccatctactcctaatgcccaacagcatcacggcactctgggacaggcacggaggacggcgtgggcagcctgggcctgggcttggcccagggaaacagacggcagacacacctgtcccccagtgatgccacccaagctgcccatggggcttcctacggaagtttctaggcccgtcacctagggctctcctgttcagccttaacaggctcagcaaatcagggcgtggctggacgatttccttgcatctgagggcagacgctgctaccggagtgacctggacgtggccagatcttctcgcaggtcacaagaagccagtgagcccttgccttggtttctggaagttcttttccttggctggatttacccagtggttaggttgcatttctaccccatccagaacattcttggaagagcacccggagctgaagctgtccctgatgatgaaggtgaaacgtcagccctggccatggctccgctcagggccccggtcacctccgagtcactctgttccttgactgtctttgtgtttctgtacctcaaggcactgaagctggaggactctgtccatgcccgtgtcaccctcgtgtgggagcctctgggctcggcaggtccacatttcatgagctgaggcgtgggccagggccatctggaaagggaactcggcttttccagaacgtggtggatcatctgtcgggtgtgtggtgaacacgttcagttcatcagggcctacgctccgggaaggggcccccagctgtggctctgccatgccgggctgtgtttgcagctgtccgagtctccatccacctttagaaaaccagccacttcttttcataagcactgacagggcccagcccacagccacaggtgcgatcagtgcctcacgcaggcaaatgcactgaaacccaggggcacacgcgcgcagagtgaacagtgagttcccccgacagcccacgacagccaggactgccctccccaccccaccccaccccaggagcacggcacacagttcagcctctgagctggctcacacgtgccatccccaccccggtgctccagggaaggaggacacggacccgacgtgggaggtcctcaggcagcagtggcgcctggtgtcaggtctgtctggctgagtcccgggcgtcccctgccatggcctgtgccttgcatggaggcggcggtggcactgaagagatagctttcaagggcccaacactttgcacttcggctggctgtgagtttctgctttgtaggttgtggtcacatttgcaggctgcgggcagtggcaccgacttgggcctccctttctatgtggcatatttatttatttaaacaccccagggagttacgtggtaacaaggttgtccataaagaggttgcttctatatactagaggccccagatggccaggccttgggctacgtctggcttgcatggtctcccaagggaatcagccccatcaacaaagttcaaatcggggcagaggctgcacttgtgcccccagatgtttctgaggagccagactagggctggcattgtgcagcctctgcacgcaagcaccaggcatcctttgtgttgtcaactccgtgtaaccagtaactacagccatttacaattgactccgtttccttttgtaggtttccctgtctgtctgtgttagtagaaaaataaaatcctatgaaatctga

SEQ ID NO: 112101 - DNA, 305 bp, Homo sapiens
agcaccaacctgtcctgtctcccgcagaacatacggtccctaatgagcacagagaagaccaagggcttctgccagctggtggtctcgtccagcctgcgggatggcatgtcccacctgatccagtcggccggcctgggcggcctgaagcacaacacggtgctcatggcctggcccgcatcctggaagcaggaggacaaccccttctcctggaagaactttgtaggtaggcatggctggcggcccttcggcatcccctcaccgtcccctctgtgtcctctcagtgtcccctcgctgtcccctcgctg

SEQ ID NO: 112102 - DNA, 2679 bp, Homo sapiens
ggcacgagggcagcgcgggccgggccgggacggggactgtcggctgcaggcagccatgcccacgaactttacggtggtgcccgtggaggctcacgccgacggcggcggggacgagactgccgagcggacggaggctccgggcacccccgagggccccgagcccgagcgccccagcccgggagatggaaatccaagagaaaacagcccattcctcaacaatgtcgaggtggaacaagagagcttctttgaagggaagaacatggcacttttcgaggaggagatggacagtaaccccatggtgtcctcgctgctcaacaagctggccaactacaccaacctgagccagggcgtggtggagcacgaggaggacgaggagagccggcggcgggaggccaaggctccgcgcatgggcaccttcatcggcgtctacctgccgtgcctgcagaacatcctgggcgtcatcctcttcctgcgcctgacgtggatcgtgggggtggctggtgtcctggagtccttcctcatcgtggccatgtgctgcacatgtacaatgctgaccgccatttccatgagtgcgatcgctaccaacggtgtggtcccagctggcgggtcctactacatgatatcgcgctcgctgggacccgagtttggaggcgctgtcggcctctgcttctacctgggcacgacgtttgcaggggccatgtatattttggggaccatcgagatttttctgacaggcacggaggacggcgtgggcagcctgggcctgggcttggcccagggaaacagacggcagacacacctgtcccccagtgatgccacccaagctgcccatggggcttcctacggaagtttctaggcccgtcacctagggctctcctgttcagccttaacaggctcagcaaatcagggcgtggctggacgatttccttgcatctgagggcagacgctgctaccggagtgacctggacgtggccagatcttctcgcaggtcacaagaagccagtgagcccttgccttggtttctggaagttcttttccttggctggatttacccagtggttaggttgcatttctaccccatccagaacattcttggaagagcacccggagctgaagctgtccctgatgatgaaggtgaaacgtcagccctggccatggctccgctcagggccccggtcacctccgagtcactctgttccttgactgtctttgtgtttctgtacctcaaggcactgaagctggaggactctgtccatgcccgtgtcaccctcgtgtgggagcctctgggctcggcaggtccacatttcatgagctgaggcgtgggccagggccatctggaaagggaactcggcttttccagaacgtggtggatcatctgtcgggtgtgtggtgaacacgttcagttcatcagggcctacgctccgggaaggggcccccagctgtggctctgccatgccgggctgtgtttgcagctgtccgagtctccatccacctttagaaaaccagccacttcttttcataagcactgacagggcccagcccacagccacaggtgcgatcagtgcctcacgcaggcaaatgcactgaaacccaggggcacacgcgcgcagagtgaacagtgagttcccccgacagcccacgacagccaggactgccctccccaccccaccccaccccaggagcacggcacacagttcagcctctgagctggctcacacgtgccatccccaccccggtgctccagggaaggaggacacggacccgacgtgggaggtcctcaggcagcagtggcgcctggtgtcaggtctgtctggctgagtcccgggcgtcccctgccatggcctgtgccttgcatggaggcggcggtggcactgaagagatagctttcaagggcccaacactttgcacttcggctggctgtgagtttctgctttgtaggttgtggtcacatttgcaggctgcgggcagtggcaccgacttgggcctccctttctatgtggcatatttatttatttaaacaccccagggagttacgtggtaacaaggttgtccataaagaggttgcttctatatactagaggccccagatggccaggccttgggctacgtctggcttgcatggtctcccaagggaatcagccccatcaacaaagttcaaatcggggcagaggctgcacttgtgcccccagatgtttctgaggagccagactagggctggcattgctgtagagtgacggctgctgcccagagcgtgtcccagacatcacagcggggctcagcagttcccacagcctctgcctgccttggctaagcatgagttaagcagcaaaacgctcctccatgtctggatggggccggcaggtcctgtgtcccctgcacctggaggagagcaggctagaggcacagcggccacatggtgctggctctgaacgttggttggtggctggaaaacagccctgcttctgagggccgctcagttctgcacacgaaaccacctcctgagggctcagctctgcccccgccctgggctgcagcctctgcacgcaagcaccaggcatcctttgtgttgtcaactccgtgtaaccagtaactacagccatttacaattgactccgtttccttttgtaggtttccctgtctgtctgtgttagtagaaaaataaaatcctatgaaatctga

SEQ ID NO: 112103 - DNA, 1367 bp, Homo sapiens
ccgaaaaaaagaacaaagaaaaaaaaacaaaacaaatccgagccaagtacgaggccccgtggtcatcagagacgagggtgaacacgttcagttcatcagggcctacgctccgggaaggggcccccagctgtggctctgccatgccgggctgtgtttgcagctgtccgagtctccatccacctttagaaaaccagccacttcttttcataagcactgacagggcccagcccacagccacaggtgcgatcagtgcctcacgcaggcaaatgcactgaaacccaggggcacacgcgcgcagagtgaacagtgagttcccccgacagcccacgacagccaggactgccctccccaccccaccccaccccaggagcacggcacacagttcagcctctgagctggctcacacgtgccatccccaccccggtgctccagggaaggaggacacggacccgacgtgggaggtcctcaggcagcagtggcgcctggtgtcaggtctgtctggctgagtcccgggcgtcccctgccatggcctgtgccttgcatggaggcggcggtggcactgaagagatagctttcaagggcccaacactttgcacttcggctggctgtgagtttctgctttgtaggttgtggtcacatttgcaggctgcgggcagtggcaccgacttgggcctccctttctatgtggcatatttatttatttaaacaccccagggagttacgtggtaacaaggttgtccataaagaggttgcttctatatactagaggccccagatggccaggccttgggctacgtctggcttgcatggtctcccaagggaatcagccccatcaacaaagttcaaatcggggcagaggctgcacttgtgcccccagatgtttctgaggagccagactagggctggcattgctgtagagtgacggctgctgcccagagcgtgtcccagacatcacagcggggctcagcagttcccacagcctctgcctgccttggctaagcatgagttaagcagcaaaacgctcctccatgtctggatggggccggcaggtcctgtgtcccctgcacctggaggagagcaggctagaggcacagcggccacatggtgctggctctgaacgttggttggtggctggaaaacagccctgcttctgagggccgctcagttctgcacacgaaaccacctcctgagggctcagctctgcccccgccctgggctgcagcctctgcacgcaagcaccaggcatcctttgtgttgtcaactccgtgtaaccagtaactacagccatttacaattgactccgtttccttttgtaggtttccctgtctgtctgtgttagtagaaaaataaaatcctatgaaatctga

SEQ ID NO: 112104 - DNA, 3632 bp, Homo sapiens
  misc_feature (1277)..(1277): n is a, c, g, or t
  misc_feature (1342)..(1342): n is a, c, g, or t
  misc_feature (1620)..(1620): n is a, c, g, or t
ggcacgagggcagcgcgggccgggccgggacggggactgtcggctgcaggcagccatgcccacgaactttacggtggtgcccgtggaggctcacgccgacggcggcggggacgagactgccgagcggacggaggctccgggcacccccgagggccccgagcccgagcgccccagcccgggagatggaaatccaagagaaaacagcccattcctcaacaatgtcgaggtggaacaagagagcttctttgaagggaagaacatggcacttttcgaggaggagatggacagtaaccccatggtgtcctcgctgctcaacaagctggccaactacaccaacctgagccagggcgtggtggagcacgaggaggacgaggagagccggcggcgggaggccaaggctccgcgcatgggcaccttcatcggcgtctacctgccgtgcctgcagaacatcctgggcgtcatcctcttcctgcgcctgacgtggatcgtgggggtggctggtgtcctggagtccttcctcatcgtggccatgtgctgcacatgtacaatgctgaccgccatttccatgagtgcgatcgctaccaacggtgtggtcccagctggcgggtcctactacatgatatcgcgctcgctgggacccgagtttggaggcgctgtcggcctctgcttctacctgggcacgacgtttgcaggggccatgtatattttggggaccatcgagatttttctgacgtacatctccccgggtgcggccatcttccaggcggaggctgcaggtggcgaggcggccgccatgctgcacaacatgcgtgtgtacggcacgtgcacgctcgtgctcatggccctggtggtcttcgtgggcgtcaagtatgtcaacaagctggcgctggtcttcctggcctgcgtcgtgctgtccatcctggccatctatgccggcgtcatcaagtctgccttcgaccccccggacatcccggtctgcctcctggggaaccgcacgctgtcacggcgcagcttcgatgcctgcgtcaaggcctacggcatccacaacaactcagccacctccgcgctctggggcctcttctgcaacggctcccagcccagcgccgcctgtgacgagtacttcatccagaacaacgtcaccgaaatccagggcatcccgggcgcggccagtggtgtcttcctggagaacctgtggagtacgtacgcgcacgcgggggcgtttgtggagaagaaaggtgtgccctcggtgcccgtggcagaggagagccgtgccagcncactgccctacgtgctcaccgacatcgcggcctccttcaccctgctggttggcatctacttcccntccgtgaccggtatcatggcgggttcaaaccggtccggggacctcaaggatgcacagaagtccatccccacggggaccatcctggccatagtgacgacgtctttcatctatctctcctgcattgtgctgtttggggcctgcattgaaggcgtggtcttacgagataagttcggggaggccctgcaggggaacctggtcatcggcatgctggcctggccctccccctgggtcatcgtcatcggctccttcttctccacctgcggtgccggcctgcagancctcacgggggcaccgcgcctactgcaggccattgcccgtgacggcatcgtccccttcctgcaggtgtttggccacgggaaggccaacggggagcccacgtgggcgctgctgctgacagtcctcatctgcgagactggcatcctcatcgcctctctggacagcgtggccccgatcctctccatgttcttcctcatgtgctacctgttcgtgaacctggcctgcgccgtgcagaccctgctacgtacccccaactggcgtccacgcttcaagttctaccactggaccctgtcctttctgggtatgagcctgtgcctggcgctgatgttcatctgctcctggtactacgcgctgtccgccatgctcatcgctggctgcatctacaagtacatcgagtaccgcggggccgagaaggagtggggcgatggcatccgtggcctatccctgaacgccgcccgctacgccctgctgcgcgtggagcacggtcccccccacaccaagaactggaggccccaggtgctggtgatgctgaacctggacgcggagcaggccgtgaagcacccccgcctgctgtccttcacgtcgcagctgaaggccggcaagggcctgaccatcgtgggctcggtgctggaggggacgtacctggacaagcacatggaggctcagcgggccgaggagaacatacggtccctaatgagcacagagaagaccaagggcttctgccagctggtggtctcgtccagcctgcgggatggcatgtcccacctgatccagtcggccggcctgggcggcctgaagcacaacacggtgctcatggcctggcccgcatcctggaagcaggaggacaaccccttctcctggaagaactttgtagacaccgtccgcgacaccaccgccgcgcaccaggctctgctggtggccaagaacgtcgactcgtttccgcaaaaccaggagcgcttcggcgggggccacatcgacgtgtggtggatcgtgcacgacggcggcatgctcatgctgctgcccttcctgctgcgccagcacaaggtgtggaggaagtgccggatgcgtatcttcaccgtggcccaggtggacgacaacagcatccagatgaagaaggacctgcagatgttcttgtaccacttgcgcatcagcgccgaggtggaggtggtggagatggttgaaaacgacatatctgctttcacctacgagaggacactaatgatggagcagaggtcgcagatgctgaagcagatgcagctgtccaagaacgagcaggagcgagaggcccagctgatccacgacaggaacaccgcgtcccacaccgcggcggcagccaggacccaagcgccgcctacgccaagggagttacgtggtaacaaggttgtccataaagaggttgcttctatatactagaggccccagatggccaggccttgggctacgtctggcttgcatggtctcccaagggaatcagccccatcaacaaagttcaaatcggggcagaggctgcacttgtgcccccagatgtttctgaggagccagactagggctggcattgctgtagagtgacggctgctgcccagagcgtgtcccagacatcacagcggggctcagcagttcccacagcctctgcctgccttggctaagcatgagttaagcagcaaaacgctcctccatgtctggatggggccggcaggtcctgtgtcccctgcacctggaggagagcaggctagaggcacagcggccacatggtgctggctctgaacgttggttggtggctggaaaacagccctgcttctgagggccgctcagttctgcacacgaaaccacctcctgagggctcagctctgcccccgccctgggctgcagcctctgcacgcaagcaccaggcatcctttgtgttgtcaactccgtgtaaccagtaactacagccatttacaattgactccgtttccttttgtaggtttccctgtctgtctgtgttagtagaaaaataaaatcctatgaaatctga

SEQ ID NO: 112105 - DNA, 2944 bp, Homo sapiens
  misc_feature (1277)..(1277): n is a, c, g, or t
  misc_feature (1342)..(1342): n is a, c, g, or t
  misc_feature (1620)..(1620): n is a, c, g, or t
ggcacgagggcagcgcgggccgggccgggacggggactgtcggctgcaggcagccatgcccacgaactttacggtggtgcccgtggaggctcacgccgacggcggcggggacgagactgccgagcggacggaggctccgggcacccccgagggccccgagcccgagcgccccagcccgggagatggaaatccaagagaaaacagcccattcctcaacaatgtcgaggtggaacaagagagcttctttgaagggaagaacatggcacttttcgaggaggagatggacagtaaccccatggtgtcctcgctgctcaacaagctggccaactacaccaacctgagccagggcgtggtggagcacgaggaggacgaggagagccggcggcgggaggccaaggctccgcgcatgggcaccttcatcggcgtctacctgccgtgcctgcagaacatcctgggcgtcatcctcttcctgcgcctgacgtggatcgtgggggtggctggtgtcctggagtccttcctcatcgtggccatgtgctgcacatgtacaatgctgaccgccatttccatgagtgcgatcgctaccaacggtgtggtcccagctggcgggtcctactacatgatatcgcgctcgctgggacccgagtttggaggcgctgtcggcctctgcttctacctgggcacgacgtttgcaggggccatgtatattttggggaccatcgagatttttctgacgtacatctccccgggtgcggccatcttccaggcggaggctgcaggtggcgaggcggccgccatgctgcacaacatgcgtgtgtacggcacgtgcacgctcgtgctcatggccctggtggtcttcgtgggcgtcaagtatgtcaacaagctggcgctggtcttcctggcctgcgtcgtgctgtccatcctggccatctatgccggcgtcatcaagtctgccttcgaccccccggacatcccggtctgcctcctggggaaccgcacgctgtcacggcgcagcttcgatgcctgcgtcaaggcctacggcatccacaacaactcagccacctccgcgctctggggcctcttctgcaacggctcccagcccagcgccgcctgtgacgagtacttcatccagaacaacgtcaccgaaatccagggcatcccgggcgcggccagtggtgtcttcctggagaacctgtggagtacgtacgcgcacgcgggggcgtttgtggagaagaaaggtgtgccctcggtgcccgtggcagaggagagccgtgccagcncactgccctacgtgctcaccgacatcgcggcctccttcaccctgctggttggcatctacttcccntccgtgaccggtatcatggcgggttcaaaccggtccggggacctcaaggatgcacagaagtccatccccacggggaccatcctggccatagtgacgacgtctttcatctatctctcctgcattgtgctgtttggggcctgcattgaaggcgtggtcttacgagataagttcggggaggccctgcaggggaacctggtcatcggcatgctggcctggccctccccctgggtcatcgtcatcggctccttcttctccacctgcggtgccggcctgcagancctcacgggggcaccgcgcctactgcaggccattgcccgtgacggcatcgtccccttcctgcaggtgtttggccacgggaaggccaacggggagcccacgtgggcgctgctgctgacagtcctcatctgcgagactggcatcctcatcgcctctctggacagcgtggccccgatcctctccatgttcttcctcatgtgctacctgttcgtgaacctggcctgcgccgtgcagaccctgctacgtacccccaactggcgtccacgcttcaagttctaccactggaccctgtcctttctgggtatgagcctgtgcctggcgctgatgttcatctgctcctggtactacgcgctgtccgccatgctcatcgctggctgcatctacaagtacatcgagtaccgcggggccgagaaggagtggggcgatggcatccgtggcctatccctgaacgccgcccgctacgccctgctgcgcgtggagcacggtcccccccacaccaagaactggaggccccaggtgctggtgatgctgaacctggacgcggagcaggccgtgaagcacccccgcctgctgtccttcacgtcgcagctgaaggccggcaagggcctgaccatcgtgggctcggtgctggaggggacgtacctggacaagcacatggaggctcagcgggccgaggagaacatacggtccctaatgagcacagagaagaccaagggcttctgccagctggtggtctcgtccagcctgcgggatggcatgtcccacctgatccagtcggccggcctgggcggcctgaagcacaacacggtgctcatggcctggcccgcatcctggaagcaggaggacaaccccttctcctggaagaactttgtagacaccgtccgcgacaccaccgccgcgcaccaggctctgctggtggccaagaacgtcgactcgtttccgcaaaaccaggagcgcttcggcgggggccacatcgacgtgtggtggatcgtgcacgacggcggcatgctcatgctgctgcccttcctgctgcgccagcacaaggtgtggaggaagtgccggatgcgtatcttcaccgtggcccaggtggacgacaacagcatccagatgaagaaggacctgcagatgttcttgtaccacttgcgcatcagcgccgaggtggaggtggtggagatggttgaaaacgacatatctgctttcacctacgagaggacactaatgatggagcagaggtcgcagatgctgaagcagatgcagctgtccaagaacgagcaggagcgagaggcccagctgatccacgatcctaactctgggtacgcgagctcg

SEQ ID NO: 112106 - DNA, 808 bp, Homo sapiens
ggttttctttctttttttaaaaagttgagatattatcagtggtaggctggtaaaatgtccctaaaagaaaaaaagccctgatttgtagcatttgctgattcctacctttactatggctgatttcaagttaccaagaggcgatgaacatggagttggaaagagaagcacagaattggtaagcacaccacttacgtacagtgagatgcacagatttcatttttagttggatgaacggtttattttttttcaaacttatgtgacaccaggtatcaggcacacatggggaagcacagataaataactagttcttacttttcaaaatgtcatagtttagcagactgtttcaatgaacttttaagtagggaaagggctcttacactgagaatagttgattaggtctctctttttccactgagaacaaaataaatgccaagtagatccttaaatacctagattagatatgagagaactgaggtctgtaactggcttatttgatgttaggatgatggattatgatttttaagaccctgtttctaaggatgtcaagttaagcataatagattcttgttttgcttgtgtatgtgttggtatgtgtacatgtctaattatcacctttattgaggtataattcacatacaataaaactcactacatttaagtgtacaatttgttgaattttgacagttatcaaaccctatcacaatagaatatttttgccaaactgagaagtttacttgagttcttttccagttaaactcccaaccctccaggagactgccagtctgatctctttcactatagatgagtt

SEQ ID NO: 112107 - DNA, 669 bp, Homo sapiens
gatgtgatccatagaggatcaataacctgttgtttgaaaaactataagttttttatatatttccatttatatttcctttggcaattaagaacatttaaaagaaagtgctggtggatttcatttgagctaagtagaatgtaggaaattcttctgccatccatatacctcgttctatgtaggcagccacagaccaatgagggaagagtatgtaagttgcagcaagtaaaacagccttgctggagatggacacttattaagacaatctggctgctgggtcagatgccctgtcctacctggagcttctcattccagtgcctaatctgtgaagacttgaacatcctgtgttctaataagaggccttatatactagacatgcaacttttaacagtaacattataaagttggaatttttggggaccattatggctagaaagaccatggaatggagaaaggctagcgttaagatggggaatcctgttttctccccattaatcctgccattgatcctgacaaaattaatcaagggccaattgtaaggcaaaaatatacaacaaataaactaaatggggaaatgagtgaacattaacacacatctattatgtactaggtagtattttgttatttctaaattttcatattcaactaatcttttataacttagaaaaggag

SEQ ID NO: 112108 - DNA, 799 bp, Homo sapiens
gaaatttacactccctcgaacaatgaataagtgttctcttttctctgtatccttgccagtatctgtcatttttctgctttttaataattagccattatgaatggtataaaatggtacttcattgcgatttttaattggaatttctctgatcattggcaatgtttaacattttttacatgcttcttggcaatcattgtcttctatttgaaaaatatctgttctcattctttgcctgctttatagtgaggttacttgttttattcttgttgtttgatttccttgtatattgtagacattagttctttgtcacatgtatagttcacaaacatttttctcatttcatgggttgtctgctcacctgctaattaaaagctccttttcaggaactttttagtttaattaagttccatttgtctatttttgttattgctacatctgcttttgagatcttggtcatgaattatttgcccaggccaatgtccagaagcatttatcattgggtttcttctagaatttttatcatttcaggtctaacattttagtcttttaatccatgttgagttgatttttttacatggtgagagtcacgggttccatttcatacttctgcatgtggtaatataatttttcaagcacaacatgttgaatagaatgtcatttttccatgtatgcttttattgattttgtaaatgatcagtacgtggctttatttctaggttctctattctcttacattgatctgggtgtctatttgtatcagtaccatgttgtgttggttattcaagctttctagtataat

SEQ ID NO: 112109 - DNA, 273 bp, Homo sapiens
gagtaggcaaagatcagatcctaggcagtctgattctggaggcttttctcttaaacatgctgtcttgggtactggatggatgtagtgacattagttagaattgaaaacagggagaggattaaagagaataggagattaaagggaaatatgagtttaattttggacatatttctagattcttgtgggaaattctgatagatagaataatggtcagccgggcacggtggctcacgcctgtaatcccagcactttgggaggccgaggctggtggat

SEQ ID NO: 112110 - DNA, 696 bp, Homo sapiens
gtccgggttcccagaggtcgtaaaagagagtttataaaattagggagtctggctgggcatggtggctcacccctgtaatcccagcactttgggaggctgaggcaggcagatcacctgaggtcaggagttcaagaccagcctcgccaacatggtgaaaccccatctctactaaaaatacaagaaaattagccgggcatggtagcgggcgcctgtaatcccagctactcaggaggctgaggcaggagaattgcttgaacctgggaggtagaggctgcagtgagctgaggtcacaccattgccactctagccagagcaacagaacaagactctctctagaaaaaaaaaaaatagggagtctatattcccctgtctcctgtttaattgcccagggcccaccctttgtcttctacacccaggctccttccaaatgtacctttcctcggggggttatctaggtcaaggttcctcaaatattttttaatttaattttttaaaattttaattgtctgtaatcctagcactttgggaggctgaggcgggcggatcatgaggtcaggagattgagaccaacctggccaacagggtgaaaccccatctctactaaaaatacaaaaattagctgagcgtggtggcacgtgcctgtaatcccagctactcgggaggctgaggcaggagaatcgcttgaaccagggagtc

SEQ ID NO: 112111 - DNA, 359 bp, Homo sapiens
tcattcagatccagcaatcccacttctgggtattgttaaacaaaaattatgggaggccgttgttttggactgagctcctacactaggtcccaacagaccagaccaaaccaaactggaattactcatgctatgccacataaccaaacggaaacttcaaggtaggagatagatcccaaaacagatcagtttttttctgaaaatgggagattacagtcttcctgagccagtgtaataaggaagtcccctgtgctttaacccttaccagaaagtaaccgaagtaacctgatgttaaataaaataaaagccaatcaaatctataactaaacttcttgtaattttgtcttttggtagttctggtg

SEQ ID NO: 112112 - DNA, 450 bp, Homo sapiens
gatggtacagtaaccagagagacagaactctaagaaagaatcaaaataaaatggtggaaatgttagaagcatttttacacaagtagaaaaagcctttgatgtgctcatcagtagaatcgacacagccaaggtaagaactagtgagcttgaatataaatctatagaaacttcccaaattgaaattaaaaaaaaaaaaaaaaaagaataaaaacaaaagaccagaacatccaagaactgtgagacaaatttagggatataacataagatgtaactagagtaaaagaaggaaaaataaagacaaaagagagcaaaataaatgtttgaaataataatttcaaactttccaaaattagtgaaaaacaccaaaccatggattcagtaatttcagagaatgtctaaccaaataaatacaaacaaataaacaaaactatatcgaggtataggacattc

SEQ ID NO: 112113 - DNA, 813 bp, Homo sapiens
gatacaaaatgtctcctttggcccagattacagtttgcttttaagtggtagtatatttcaggctattatgcagtgcagaatattagctttaatatcacgtttaagaaaaggaagaagggattccttaagacagtagaacctcattaagccctatagacagtttgggattgttcttgatgctttaccattcataccaatttaagaatgtgaaaaccgtaatggggcatgcgtggctttaggaccaggcagcccaggcgagctgcgtgtgcattattgaagtggcctatctcctttcaattgttgggttcagtttcagggaaaggagagcttccccctcccaggctatataaaaaggtaattgctccaggggaaagatagagacctcccccttccttcccagaggttcttcttgaaatgtaaatgccgagtctgcaaaccacgggaacccagaagttgtaacagatggttttgcatgcagttgccttgtgaacaaagattcctcagctaatacagcaataatgtagtacttaggggcagtgaatccccgggtgggggggcggattggggattggtatctcgagacaattgcaactcctctaggggccccattgtctctggcagcatcctcattggtagggctttgtttttacttttattcagttggtgattaaatttcccataggttttttttctttctttcttctttttgagtagtcaggaatttcaccctttcataaaaatgttcccttgggtggagcaagttaataaacaaactttgctgcttgtctcgcctcgattcttggtcttccttga

SEQ ID NO: 112114 - DNA, 1071 bp, Homo sapiens
ctaggtgaggacaggcatttcctgcccaactgttgcatttcccaagaccaccctggcctgccatgcccccatcttgtgcctataaaaactcccaagaccctagcaggcagactagaggcagctgagctggacgtcgagaggaacacactgacactggcacacctgcaggccaccgaccggcagaagcagaacgacacaaatttggtagggacagttagaggagagtccaggctgctgatcagccagacttcaggggaaaaccatctcccttctggctcccccatctgctgagagctactcccattcagtaaaaccttgcactcattctccaagcctcggtgtgatctgattcttctggtacatcaaggcaagaacccagggtacagaaagccctccgtctttgcagaagataaagggtctaactgagcttacgcaagccgactacggatggctaaactaaaagagcaccctgtaacacacacccactggggcttcaggagctgtaaacattcacccctagacactgtcatggggtcggagcccaacaacctgcccatctgcatgctcccctagaggtctgagcagcgggacaatgaagaagcgagccacatctgcatcgcacaccctgcgagggggacaagggaacttttcctgtttcgacgggacaggaagtgttacaggccaccatctttaattagaaaggcagtgagtgccaaaaaacaaggaatgcaagattcagactaaaaatgtgtctcattcgctaggataattgtgccaactttcgttataggaagccaaaagatcctatcagggtagttatcagatcattaattttgtgtcacatacaacctgtattgttacctttaagaacttcctgtatcctcggcttcaaatatttcagaaagtggtcaggtgtagtacagagatctggggcaatcattgcatgttggagtcccggattccaagggcttttgggaacagatttgtgagaaaagagtgaaaaggaagcaagcaggaggatgtttatttttaataaagggaccctgccctaacttcctgaactaaaaccag

SEQ ID NO: 112115 - DNA, 605 bp, Homo sapiens
gtcgtgagagggtggagggtgctggggggatctgaaggaatcagggcttaggaagctgctggagctttggagagcgctgtttagaggtaacaatgagtgtgaaggtaattttcagggaattaaaaatatactttcaggaaataagcgctgaagggagaacaatagggtcaagtgttgctttttaaaaataggatgaaattgtgtctgttttaaggtaaactgagagaaccaatgaaagaggaaaagttaaagatgctagaaacaaaggggatcagtgagggaacaagaacagggcatctagaggataagtgtttgaaggaatagataaaaagtagtctcaaaaatgaggaagctttttactttgagcgatgaaaacagtttttatctttttagcaaagttgtagttaggatcttctgtctgtttttaggggtctccactggtattaaaggcctgaagaaagtatggcgggaaccaacaagaaaaaaaaattgtcaagcagtaatgagagaccaggtggaaatatggagaataatctgtaatagccagtcagtattctgtggtccaagagcaaaaagggaattgagaattcagagttgaccccatt

SEQ ID NO: 112116 - DNA, 711 bp, Homo sapiens
aagtgagatcatacaggatttgtctttctgtgtctggcttatttcacttagtataatgccctccagccacatctgtattgttgcaaatggcaggattttccccttttaaaaaatttttaattaaatttttatttttatttaaaagaaataggaggtctcagtgtgttgcttagactggtctcgaacttctgggctcaagtgatcctcccaccttggccttccaaagtgctgagattgcagatgtgagccaccatgcctggcctgagccactgtgcctggtcccctttttattgttgaataatattccattgtgtctatatcacatttttttatcaatttatccatcgatggacaattaggttgtttcacccagcctggatgacagagtgagactctctaagaaaaaaaaaattgaaaaatcgaaaaacagaaaaatgaaatggaaagtaatcagtattgttaaggatgtggataaattggagccctcatatattgctagtgtagccactgtgaaaaatttcactagttctttgaaaggttaaacatataattaaccgtatgacccagtaattctgcccctaactatgtacccaagagaaataaaaacacaatatgtctttacggaaacttgcatatgaatgtctgcaacagccaaaaggtggtggtaacctaaaagttcattaactgatgaatagagaaacaaaatgtggt

SEQ ID NO: 112117 - DNA, 665 bp, Homo sapiens
ttctctttcacaggctagaaatctataatggaaacggagttaataattggtatatagaattacatttcattaaacttacacataatcttaaatactaaaatgtgtattagaacaaaatgagaagctgtgttctgtagaaatttcctgtcaagatgtctagacttgtaattatgaattctatttctatggttggaaataaacaggtataatcaagaaattatcgcacctcaaggtgaaaaggtatacaagtgatttagagcttagtcaaaatttcagttgaatttcttcctatattaaaaaaataataattccctcttctttcccaccttccttttatcctaaatctacataacccaatgacagggactagtagacaaacagatctgtcacctttgcaccctctataaacctttatcactggagcatgtgcataaaaacgtccttggctcctgctctgaaactcaaaggacagctgcctttctgccaatgccaggatgttaccaacacttcttagcctgagtccctttcctctaccccgaaggctccttgactcctacagaagtctgcctctttccctaggtgtttaagttactattattgctctgttaggtggataatgccatgtgctagtttctcttatccctcatccctcccctgttctgtga

SEQ ID NO: 112118 - DNA, 149 bp, Homo sapiens
tctgataggggcctgtcgatagcatcccaggctgtttttcactagcgagaagaaaaatacctgcagtggttatgactggaaaggtaataagcagaggtcagcccagcccctagaaacacaactttgattaatgttttcagagggcccca

SEQ ID NO: 112119 - DNA, 301 bp, Homo sapiens
cacatgggctctgtacctcaagagataaagaccagccccacctaagtggccctgcccaggatcaccagccctgataacaagactagctgggcacccgggccagccttcacctgctctggtcccagctgcccttgcttgggagagctgtggggcctggcaggggaggggtgaggttctgtccatggacttctgcctctgaatcctcactagttctgcctgtttgggagtctccagttgtagattgcaggaagcagagcacagggctatttgactgcttttagatgcattttttttttttaat

SEQ ID NO: 112120 - DNA, 207 bp, Homo sapiens
gctgtttcttgagttccttggctcatgcctctatgctaacttctcagcccaatttacattctaagaggtcatttctttcatgaattgcctttcataatctctttgggttaggatagttagatactccttaaataccctgaataagttttattaccatactcaacaggttattttataattatttgatggtgtcctgactagagtgtg

SEQ ID NO: 112121 - DNA, 585 bp, Homo sapiens
gatgaaaatgagaccagttatctttaagaacggtctgtttagggactggtgcaaaggatgaactgcacattgttgaagaagaggcaatgaattacaaaggcagtccaattaaagttaacactggcaactttgaaaatgtctgtacagccaaagctttcccttgggggctttgaaataacaccaccagcgctcttacagttgaagtgtgattcagggccagtgcatattagtggacagcacttagtagctgtggaggaagatgcagagtcagaagatgaagaggaggagaatgtgaaactcttaagtatatctggaaagcagttggtccctggaagtggtagcaagtttccacagaaaaaggtaaaacttgttgctgatgaagatgatgatgatgatgatgattttgatgatgaggaaactgaagaaaaagcaccagtgaagaaatctatacaagatactacagccaaaaatgcacacaagtcaaatcagaatggaaaagactcaaaaccatcatcaacaccaagataaaaaggacaagaatccttcaaaaaacaggaaaaaactcctaaaacaccaaagggacct

SEQ ID NO: 112122 - DNA, 320 bp, Homo sapiens
ctgaggtagaaatggtataatacaaaactttatttcatgcactgttttctaactaactgaagatgttcctaattgactgcttttgtacttttttgcaagcttccatagtgaccgtaatgcaccttgtcaatgctgtggttgacacggtgagcacagaaggtacagttgtaagtgctcgtgcttgtgtctgtgtcttgcagcagccgtgtcgtagagctcggccgcattgctattgcaatggtaggaaaaaacagtttgtggttttgagggggttgagtccttttattttatgcaggtgtgtatatacgtaatatgagtgc

SEQ ID NO: 112123 - DNA, 396 bp, Homo sapiens
tactagggaagatagataatgaaaaaattgtaacttttttcaaatagtgaagagaccagaaaaacatgcaaagtgagtgaagcaattgaggaagggctatgaaaaaaaccctactcaggtacaggggttcaaggaaactttcttagaggataaacaagactgaaagggtgagaggaagccagccatgcaaagaccgggaggaagttcattccagacagaagaaaccgcaggagtattcgctgagaagtgaggaaaagtgtggcgttttctaggaactgaaggaagacaaacacagctgggttataatgaatgaatggaagggtagaccaaaattgaagaggcagacaagaacaaggtcatatggatcttgtagaccctggtgaggaagtcgatttt

SEQ ID NO: 112124 - DNA, 179 bp, Homo sapiens
agggaggttacagcaatgctcccagaactcagtccagagagagaagagtgagtgaaggggagaaagaatgctgctgcccgggaccaggcatggtggctcacgcctataatcccaacactttggaaggctggtctcgaactcctgatctcaggtaatccacctgcctcagccttccaaag

SEQ ID NO: 112125 - DNA, 359 bp, Homo sapiens
gcgtgagctaccacacccggcctcttttgtatcttttaatctgttagttctgtcttccttttttcccttcctattgaagaagcagttgttcgtccctgtagaattccccaccttctcaatgttgctgatggcatctctgtggtagtggttagcatgttcctttatcccttgtttctcctgtaaacttaaagtctatgcatttaaccactactccagctgcctagtgaaagggaggagatgacagcacagcacccagggaacctctgagacctgctttgcttcctttcctcttccttttctggtcatttcctctcctgaactcactgtttttccttccggcccagacaccatgtttgcca

SEQ ID NO: 112126 - DNA, 207 bp, Homo sapiens
ctcgttttctaaatgatggatttaaaatgtcctgctaattaaactcaaactcgtctattgtgttctatattgcatctcttactaacaaaggaagcacaatagatacacattcatatgtgtctttgaatcaaaaagtgtgctgtatgtttactactttctgggcactgtttcttccataatgttattaataatagttctaataatagt

SEQ ID NO: 112127 - DNA, 170 bp, Homo sapiens
caatttaggttttctaaagtctcttataaagtatattaaagttttacactacggaagaatttcaaatatttttatgtaaatcaaaattaaattattaacccttttttttttaacttttgagaacagcaaaaatagctttcaattagagagtgcttcctgtactccaggca

SEQ ID NO: 112128 - DNA, 458 bp, Homo sapiens
ccatatcacttacaaacagaaaacttatgcttaagttgtttagtcagtttctgtgggcgggcatcaggaattagaaaaaagattcaaagataaggattgtacttctgtcacccatatggccttggggtacttgtcctctttgggtaactatctgtatgacattgaacaaagtacttagaatttccaggcattgatttctacgactgtaaaatgaggtaccaggttagatgatgggtatcctcaatattcttctattctgaaaagagtcttaaatttggatctagcttaggaaggtctaaatataatgttaaggcccctccgcactagactgtaagtttctggaaccaacttttaatctactctgtattcccaatgttctggggtaccttccacataagaggtacttaaccttttcttgaatgaataaataaagctggagaattaggcccacttgtcca

SEQ ID NO: 112129 - DNA, 303 bp, Homo sapiens
ctgtccgtggtgctgaaatgagatttacccaagagctgtactgaagatgaagatactgcagtgacctttagtagggaagatgtaatgacagtatctctataagccttaatgttttgttccaagggtaatttcttacacaacacaataaacgggtactgcttttcaagggaaataatacaccacattctctctctttctctcctactttcccaatcccatatacaagcagaacaactgttcctctgtctcacttgcgttctgctgggaaaataaagtcaagggtggtatagatcaaataatttt

SEQ ID NO: 112130 - DNA, 310 bp, Homo sapiens
taataacccagaatccctggatgccacaaatagataagcattctgctcatggtgcgctgatctacatctgcaactttatacaagttaacattttagactcctttttgccaacctagttttccaccttcttaacctttctccaagaatcttatcttgactaaatctgccactcctagctttaatttatcttctttctttctgtattgcactgtctctctaagtcataaatgcagcttaaccacttgttctgcatccctgtttttcctccctttgttgcatttctttcccattagaatggggaaatcagaga

SEQ ID NO: 112131 - DNA, 268 bp, Homo sapiens
ctagagcctccaaagggatcatggccctgatgataccttaatttcagacttctggcctccagagctgtgagagaataaattgttgttgcatttaagccacacagtttgcggtaatttgttgtggcagccccaggagactaaggcaccacctcagcgtatgcaggctggcctgacttccagctgccagaaactgcatttctttaccccaggcttcctctggctgccaagacctactctgcccacttattgaacaagctaggctgattgt

SEQ ID NO: 112132 - DNA, 428 bp, Homo sapiens
aggtcctcagacccgagctttgttttctgtgtaactaagggccgtaaccaacgtctcctccaatttcactctttgaataaacgtgtgtcttcaatccttgcagcgggggggatgtctgccgtcctgagcctaggatcagtctagtgcaattcttagaagttgatccaattacatagaaataaccagtgaatagattgtttctggagagaaaatggacaggtcagaagtgatggagccgctgtggagctcccccggccctagtcacggccgcgataccagcggatcactgggcgggaggccgtgtctctagtcctcagtctcgcgtgtgcagagacggaggtcgggtttcttttccgggctggaaaacaggagaggaggggctcctgcgagagtgagggaggcagcgctataatttggttctcttgcga

SEQ ID NO: 112133 - DNA, 410 bp, Homo sapiens
agcaatcagcccaccttagcttcccaaagtgctagaattacaagcatgagctaccacctgtaacttttttttttttaatactttaagttctgggatacatgtgcagaacgtgcaggtttgttacataggtatacatgtaccatggtggtttgctgcacccatcaaccaacccgtcacctacgttaggtatttttcctaatgctatccctcctctagccccgccatccccagacaggccccagtgtgtgatgttctcctccctgtgtccatgtggtctcattcaactcccccttgtgactgagaacatgcagtatttgggatacaaagtcaatgtgcaaaaatcacaagcattccaacacaccaataatagacaaacagccaaaacatgagtgaactcccattcacaattg

SEQ ID NO: 112134 - DNA, 493 bp, Homo sapiens
  misc_feature (276)..(276): n is a, c, g, or t
gtatgagctttattcacttcctcttcctctcgtttgagtgctgaaagaatgtggctgatgtctatagactagaaaaatctaggagaatatgattcattgtctaaccccatcaaggggttacatattttaaataagacgtcatttctcctcttcactccagcatctcctccttcaaaggcatttttcaccctcttgaaattaatacgctctattcgctcttttcacctaaaaaaaggtcaatcgtcgctctgagaaacaacagtgagatgcaaaatnagggtaaaatggcattgaaatgaatccctttgaaaaagtaagcggtttgctttatcagttaatggtctcatcagcgcttcagtttcctcttctgcaaaaatcagtctgttgaactagagcatatcaaaggttccttctagtgttttgattctaggacctctaaattcatgcaggctgcataatgcaaatttaacctgattaaagccttatttctcat

SEQ ID NO: 112135 - DNA, 370 bp, Homo sapiens
gggtaatctcttttggaatcatatgtttcatgttcccattggaccttgggttcaaaagcataaataaacatttagaaggagtgtttgcctcaaggtaggaccgaggcctgctggctgagtgcaccctggggaagagcttgggctgcctgacctcacgcttcattggatttccctctctaggcacagccaggagcacagcaaaactggaagggagaaacagggtgctggccaatttcatctttcccatgaaaaagttaatgacattcccactaaatgcgctttaacaccagtcagaggataatagggctggcaaagcattcgctctttttcctaaagagagtggaagaccctagtatcttaaaaaacaaaa

SEQ ID NO: 112136 - DNA, 526 bp, Homo sapiens
cgtggcccctgtgctgaatcaggtgtctcagggctcagcatggtatcccatcccatcctcctctgtccctcatcacaatttattgggccctccgtgtacagacctgtctaggtgctggagggggtcagaggtgaaacaaggcctgggtggggagggggctccctgagtggatggagagccctgggccaacacccagtgggacaactcctctgtgaaccactctctggtttaggagagggacgggtcagacgaggccaaggttgcaggggccgctgggctagttacctggagggtctcctggggcatcccaggctcccttctgattgggaccagccactttccagtctgtgcttcagcttcttcagtgctaacccagagctagtcattctgatttccaggaaggctgaaaatttaatcatagaatccctggagaggactgcctatagtatccacttacggcaggggctccctaagtggtggctggaattgtgtgctgtgtgcacccacccctcacctgccagccctt

SEQ ID NO: 112137 - DNA, 104 bp, Homo sapiens
atgaatggagcatattaatgtctcttctgtggatatgattgattctcccccttccttagtgttgtcttcaagcaaatatagttggaccgacactgagtttgatg

SEQ ID NO: 112138 - DNA, 453 bp, Homo sapiens
ttagttgtctttacagcactgaccatgggaatcacctcatccatgtatctgtttaccttctgtcatgcactagcatataaactccatgcaggcagggagtctgtctgtcccagccaccatgctagcccgtgatcccactgatccccagagcctggaacgatgactggcatatggcagcattcattaaatagttgctgaatgaatgaagaaatgtcataaagaacttgacaccatgcctggtcacatataagatgattaaaaactgttcattgatgataataataatattaccagtattattactgcatttcacaggtaagaatatgcaaaccccaagagggcaactgactcactcaggtcaaactctacgtctgatgtctatgacttctatgacacctcccattccatgggcacagaataacagaattcacccaccgcagcaggaacctgaaa

SEQ ID NO: 112139 - DNA, 125 bp, Homo sapiens
gagcggccagaagtgactttgctggcctcttgccatgaggctgcaggaaacagagtcctcgctgtgctgtgcggccttccccagcacacctccacccttgttccctcctggttcaggcccttcct

SEQ ID NO: 112140 - DNA, 346 bp, Homo sapiens
actgcactccagcctgggtgacagagcaagactctgtctcaaacaaacaaaaccaagaaacaaaaaacatttacctgcaattctccactcttgaaaaaatagcccttccgcatgggtcacctccttcactgctctgaagtctgtccttttaacccaccccaaatcttcctgtttgacccatcaagtctcagagacagccttcactcatgccaagcatgggcagtcaccttgcaaagcactcagggtccacattttggcagcagtcattaacgatcgaccagttcaattgtttgcggtcagtttgtggcagtttcggccgggcgtggtggctcacaccggtaatccc

SEQ ID NO: 112141 - DNA, 320 bp, Homo sapiens
aatcatttaagactttgagggactgttgggatggtgtgattggttttgaaatgtgaggacatgaaatttgggaggggccatgggtggaatgatagggtttggttgtgtccccacccaaatctcatcctgaattcccatgcgttgtgggagggacccagtgggaggtaactgaatcatggggacaggtcttacccgtgctgttcttgtgatagtgaataagtctaacaggatctgatggctctataagggggagtttctctgcacaagctgtctttgtctttgcctgccatccacgtaagacgtgacttgctcctcattgc

SEQ ID NO: 112142 - DNA, 357 bp, Homo sapiens
aagacgtcatttattgaaagattagaatgaactgatactgctaatttcatttagtcctcatacaaatctaggaaatagggcctcttatagtccccattatgcagtaatgaaactggcacttagattgtcaattgccaaaggctacacagccagttagtggtggagcttggacttgaagccagtatctgaaaccaccattagtatgtgcctcccatagaaagaagacaaaaaatataaagtagttgtttgaaaagaagacgactgtcagtcattttaagttttgaagaggtgtggcttgagatagttggaaatactgaatgcataaacaggtcctgaagggcagcctgtttaattttt

SEQ ID NO: 112143 - DNA, 360 bp, Homo sapiens
gccaaaggatttctcagttcctttcacactgaggttgcaataaattctggtgcacactgcctggggagaggctctgatagcatggcgcttgtgtgcaagtcaccagcttggctgggaatgaaagaacctcagttcatcctttgtccacaatgactagccatccctgactctcaaaatttatgttttaagaagagttagtcccacaactcttcttaaatacctcccaagaacagttttcaaatgtagtgtgagttattaaagaatgaataaaaatctcataggaagaaataaggtgcagtacacaattaaaaatcatgcccataaacactgtgtaattagggacttctcaaactggaagat

SEQ ID NO: 112144 - DNA, 650 bp, Homo sapiens
acctgctgccgccccagctgctgcatttctagttgctgcaggccttcctgctgtatctctagctgttgcaaacccagctgctgccagaccacctgctgccgccccagctgctgtatctccagctgctacaggccccagtgctgccagccctcctgctgccgcccggcttgctgcatttctagttgctgtcatcccagctgctgtgtgtccagctgccgctgccctttcagctgcccgaccacctgctgtagaacaacctgcttccaccccatctgctgcggcagttcttgctgctgagtgaagctgctctggatttgtgcaccttcttgctctcaaccttcagttcaggcacagagtatctattcagagaacatgtggacttcctgatgtcgtgaaaacagaggcatggactgatttggaaaatattttattagtatgtattctcttttatagaagtttttattcctattgaatctgaatttacagtcaaattccacatcacatgttttagaattctttattctaattcaatatacataaatcttcaaatggtatccttctagatgtttcttcctaatgttttctgtggtatcaattttcatgtggaattgtttgatgttcctcaataaaacttcatagtgttcaaaagc

SEQ ID NO: 112145 - DNA, 240 bp, Homo sapiens
aaatggaggaaatcaactagactactcacagtaattgtccacctccacagctctagctcctagcacagttaagcatgcaataaatatttgttattattgaataagcactgggattaggaatgaattaatctactttccaaatctgctgtaatgagatcctatgtttcataacaaaaaaaattatgggctgggcatagtggctcatccctgtaatcccagccctttgggaggccaaggtgg

SEQ ID NO: 112146 - DNA, 1179 bp, Homo sapiens
catctgacatagacccggacaacagctgcaggaagtggtacaggaatcacccccgatcaagacagaggctggaaggtccagggccttgtcccaggtcagccggctgtcaagcagggagccaaaatccaagctggggtgtgagcccaggctggctgaacctagactccacgggctgtggaaacatctggaagatggttgcatgaagcactttgtaaaggatctctctgggctctgatggccccaagagactatggactaacttgtcaccacaggcctggcacactgaagcccacaagcatgttacacagaatcacatccaagatccgcaacctcagccccgctctccttcccatccccacaccctgggcgtctctcgcctccattacacatttcctacctccacatcttcatccatgttgtgtcctctggctggaccgcccttcccttcaattccacagttcacaatcttagccagactttcaaggccctgctcacccatcctctcctccatcacactgttcttcagttccccacttgcagaaaattataatcataattgcaacatgagctaatgcatgtaacagttagttctgtgccaggcacagaggcagatcccatatatgctaaaaattatagtcaacattgtttcatttaaccctcactgggacgtactgccaaacccactttatggataagggatctgaggctcctgagaagttaagtgactttcccgatactacacagggaagagcaaaactgggatgtgaaggcaagcctgcttctgttcgctgctcaaactgtgctggaagagagaagagctagaaccatttgctgactctctgctgggacattccttgctcgactggcagcttcccaggttggaatggtatcttgttcacttccgtatccctggtacctaacatggcgctggccttgggagaggagggtgggtttctcacagagacgggtatttctggagccatgcttaaaacaagaagcaaaccctgagctcagaacagcctctctgggcctcagtttccttatctgtaaaatgggtataatgtcatagtcctccaccaccacctcacaaggttgctagggcagggagcactcaggagatgttggcttttgttgctaacaccaggatagggctgcatgaaccctataagggcacatggc

SEQ ID NO: 112147 - DNA, 302 bp, Homo sapiens
gttgggaatgacttgctgccttggtgagtgaaagctgggggctccgggacatgcagcgccttacactaagcaggatttctcagactgtgttttgtgggacatgagtttcaggagaaattaacaggtatgctacaaaaagaaacatttttttaaattgaattagtatggaaaacatgacataataaatcccccctaggaaattctcccccctcaaattggtataataaaggcttgatatccttcaataaagaaactcattgattttagttcagcttaatattaatctctggtgggaaacaggt

SEQ ID NO: 112148 - DNA, 829 bp, Homo sapiens
gagggagaaccctctggggatggtggtcagggagaagtgttcacatctttggcaagaatacttcttcatctttgtacttctagcactggatagtttacttgatacctagtgggtattcctgtttacctgatatacctgaggaatactcgattggaggataaataacttaaattcaaggtagaaaataaatagtaaatgcttgtggcaagtcaataaaatactgtgggagtagactaaagagagagttctcttgaggtgatggcttctagtttcctggacacatttgaaatgctgctttaaagttttctttaatgaattcctaagattattctttctgtgcttgattttaaagataggatgctgcactaacatatttacttttattgcttcattatgtccaaaaccacgtattactgtattacatataatttcttttcttcttttcttttttttttctcttgagatgaggtctcaccctgttgctcaggctggagtgcagtcgtgcaatcctgatttactacagccttgacctcctaggctcaagtgatcctcccacctcagcccctgtggctaggactacaagcacgtgccaccacgcctggctaatttttgtatttttttgtggagacaggatctcaccatgttgccgaggccagtctcaaacttccagcccccattgatccacctgccttggcctcccaaagtatggggattacagttttgtaattccttgcagaagtttgtggtggaggtagtacttgttaaaggctgggctgttgttgtacttagcaagtttaaagggaaggcattttgcatttcctctggataa

SEQ ID NO: 112149 - DNA, 519 bp, Homo sapiens
accgcggcgacttggcggcgggtgccatgcgtctggagcttcacattctctgccccccacccaccgcgccggcgctcccttgtcacgcctcgggaagcgcgcacctgccaagcaggtgagttcgagctgactcccggttggcccagcccggtccagctggaccgagagccaaaccacgtccgccctcgaggtgtcctagaaccctgggtggtgtcctcgggtgtggcctgggggctttcgagggcagatgccttggagcaggagaaatgggcagtgctactggacctgatggatccagcggcatccttttcctgaaagagattctaatgttccacctgtgctcttcctccctgcggggtcaccaaagtaactcaaagctgaccatcattgcctctaaccattagagcaaatagctctatcattttcttatttctcaccacctatttcgtgcctggcactgtgtttaatgctagatcacaagtaagtacagaaactgagttgcaacttaagttctcattt

SEQ ID NO: 112150 - DNA, 620 bp, Homo sapiens
caaaaaacacagggacagagaaaagatcagaggttgccaaggattagagctagggaaaaggctgactacaaaagagcagactgaaggcattttcagagacaatggaaccctttagtatgttcattgtgatggtggttacaagattacatatttgtccaaactcatagacctgtacaccaaaaacagcaaattttattgcattttaacgtttttaaattttaaaacaaatttacctatttaaaaaaaaaaacaaagacagcaacaacttaggatcccatattaccatcactatttaatgtgatcttagacaaatcacttaatatagagctttggttcccccaatttttaaaatgaaaaatatagtatttatatctcataggtctttataaaaaagttttttaaaggtttcaagatcctgccttttcacattctatttcttctgaaatgtttcttcccatcctctcttccctactttgcttggctaaatgctatttgattttcaggtctcagcttaaacgttattttttcataaaagcttctcctaactcacattttaaatcagggcctcagctatgcctttactgcccagtgtactcttatttcatacactgtgaaatgtc

SEQ ID NO: 112151 - DNA, 364 bp, Homo sapiens
ttcatcttcctatgggcattcatgtgaggaatcgtgctagatgtggaagtgttaagtccacagccctgtagccaccgccctcgcaagacatcctgctctgtctttcttaaacataatattcaaatagggggctccaggctcaggcaacgactggtaaccatctctgaacagaaaggactacagataccgtctttttcatgcactgttatatgcataacatttacatgattaaatatggtgtttgaagtaatttttattcagtgttgaccatcagaaacatggtcatgtttctaaccatgttttcatggcttaatctctttttaaaaattgtcggctgggcacggtggctcacgcctgtaatccc

SEQ ID NO: 112152 - DNA, 280 bp, Homo sapiens
cacagacggtgtccctgcccagcaactgcgaatccccctctccttccagaaccctctcttccacatggctgctgatgggccaggtcccccaggcggccatggagggggcggtggccatggcccaccttcctcccatcaccaccaccaccaccatcaccaccaccgaggtggagagccccctggggacacctttgccccattccatggctatagcaagagtgaggacctctcttccggggtccccaagccccctgctgcctccatccttcatagccacagc

SEQ ID NO: 112153 - DNA, 477 bp, Homo sapiens
ctaggatctcagagatcatccagccccaatccatcattttcagattaggatgtgacttattgagtctggccatttggttagtagatcccatcctctgttgcatactgaaggcaattgaacttctgtctcctgtatcatcaagttttctctctcttttggaactttcccttcagcccaggtattaggacaggttaggctttgctgtgctaacagataaaacaccacatcttgagagattgtttggagcttctagcaggcagcacagctatgtatatacttgtgaatgaagaacggtcctcctctatcagggaaggtcgtcctcttcaaccaagcctgcagcttcaggagggacacacgtggagcagtgagggagggaaacgacacccactgagccagccagatcagcccaatcaacctggcgatgttggggtgacagatgttgcagccagattgccttcacatccagaaacaccaaat

SEQ ID NO: 112154 - DNA, 789 bp, Homo sapiens
acctgaatctggtcaggttctgccacctattagccatctgctcttaggcaaaggctcaatctctctgagcctgtttttccacttgtaaatattaactactaaatattctgagtgtactatatgctgggcactgtgccaaacacattatacattatcacatttagcctttacaaaaatcttgtatgaaatgtatcattctcttaagtttaccaatatggaaattgaggctgagacagacaaactgggtgacatgctcaaagctgcatagcagtgagcagcagagctgcaatatgaagctgggttgtcttctcccaaattttgtgttcttaatcactaagcattactttccgtacagaattgttatgcaggctaaatagataatgcatataagagtgctttgtaaaactataatccgctatttactttagtttgaactgcagagatgagcagggatgatacaaatataaacgtggtttgtgtcatttagaagctcagtttaatgaataatatttaaaatatactttagcgcaaataaatataactcctatgtatggctatattagaatacatcatattctatatggtaaaaatccattattatcattatcatccccaatttcagagagggagagttacttaacaagagggctttctagaagcttctcagatcactttactgtccatgagacagagcctgcccactcatctacaccatctgtcattaagctactctaagagactgcgcttaagagacaaatatttagagagtccacaatcataaattatttt

SEQ ID NO: 112155 - DNA, 317 bp, Homo sapiens
aaactttattttgccgtattcctatacccttggttgtgccaaattgtcctggtgtgaaaaatgagtcaagttaaatgctttaggtgcttcttggatgtgtagggaagaatggaataggtatgtgaagttatggtagtcatacagtttacttagtatgataatataaattgatttgggagcaaggaaacgaagaccttcatttaagaagatgattatgatactctaggaatgaagtgaatatattttggttaactttaaaaaaaaaaatcggtcttcaaagatcctgtttgatgaaattgcctatggttaaaattccc

SEQ ID NO: 112156 - DNA, 223 bp, Homo sapiens
gctcctgctgcgtatttaaaatgtagcataatacataattgaatatgcgagcaactttaatttataaaaaacgtattttgctctcccatgtgtagttacgtatttcatgttgacacaaaaatttgaagatgtagagcagaattccagtttttgctgatttgatctgggacttcattttctgtacagtgaaaaaaaactgcctttttaagaaaaaaatgcttct

SEQ ID NO: 112157 - DNA, 425 bp, Homo sapiens
ctcgccctgcttcggctcacgctcggtggcctgcacccactgtcttgcacacactgtccgacaagccccagtgagatgaacccggtacctcagttggaaatgcagaaatcacccgtcttctgcgtcactcacgctgagagctgtagactggagctgttcttatttggccatcttggaactgcctacagtcttttctttgagacaaggtctccatctgtcactcaggctggagtgcagtggtacaaacacagcttactgcagccttgacctccagggctcgagtgatctcacctcagcctcccgagtagctgggattatgggcacaccaccaagcccagctaattttttaatattttatagtgacaggataccagtatgttaccccagctagtctaaaattctaggctcaagcaatccgcccacct

SEQ ID NO: 112158 - DNA, 673 bp, Homo sapiens
ggggttacaggtgtgagccaccatgcccaacctcattgaacacttttatacaccctaccactagccaggctaaaaagtgaagttacaaattaaaacggttaattctttccctcaaggagttcacgatctagtggcaagatcaaagagtccagtaactcctttaagaagttttgtgataaaggggaaagggaactataattaagcagatgcctgttttctgttgatcacttttttgagaggggtgtgtgtgtgtgagagagagagagaaagagaaagttttttatacagaggagacttgatcatgcttatttattatagtaggagagaaaggagctggtatgatgctgttcactgcctggttactttaattgcccccaacaattcagacttatgaatgaactgatcattattatcctcagtccactgggtaggggtgtagagttagtcagggagagacacagtgaatttccaagataaggggaaaagagaggcacagaaatacatatatctttttccttgttcttctctaacttctgtgggtcaaggctttgcacgctggcttagaaaacctgttatttcttccacagccaagattgttttgttttgtgattgttgacttgcagtattatgaattaccaaaagaagagaacccaaaaagcatactccggtgcca

SEQ ID NO: 112159 - DNA, 320 bp, Homo sapiens
tgaaagtatactccacagagtgagaggggcttgagcaagcagctgatgagccccagttggggtttaagtacccttaggggtttcgtgttggttacaccctatgcaaatgaaggattggtctgtggcagatcagaggctgaagtgaagttacaccctatgcaaatgaagactgtgaccaatcagaggctgaagtgaaggctccctgtctttagaccgtattctgcctcagttaagaagcaaataaaggccctcagggaaatgaaattaaaaccataatgatggtggtgtgtgcctctagtgccagctactcagggggctga

SEQ ID NO: 112160 - DNA, 399 bp, Homo sapiens
aatagttgaatatttgtacaagaaaaattgttgattggggtgggggaaatgaggcttggtggtgggagttaaatcatcttaaaattatgacttaccccttggtcaattcccagcaatagctacgaagctaacttggttaagccttgcttcctattcaccctgggaatggtttgataatttacattcccaggaacaacaaaaagttaaaaaatactactttacatgtgtaataggtgccaaatttgcaacctttaggtaagaagtcaaaacctcaaaagcaaagaaaatatttgcttgtttggattttgaaacttacattcaaattgatgcacatttcctttttctgtaatcacatgattgaaattaatattttacttcccctaaatttttttagggaag

SEQ ID NO: 112161 - DNA, 313 bp, Homo sapiens
gaggcacagcaaggaggccaggatagctgcaaccaagagaaagaaagggtgagtgccagaggttgaggcttttgcactgaagggagtaggtggtaagaaggggaaggtggaagctggagactaattaggaagctattgcaacggccaggtgaggaaggaaggtgcctggaatgggtggaaatggaggagacggcaagagatggctgggtctccatggtgtttaaagccttgagactgaatgaggcagtgagtgcagaaagaggacaaaaaggctaagaaacttcaaggctaaaaacctccaagattgagaggc

SEQ ID NO: 112162 - DNA, 461 bp, Homo sapiens
actcagaaaagaggccagacaaccagaagcgtagtttcttcatctacctccagtcatgactcatgtgtcactctgaggcagggatgactgcaacagaaaagcagatcttgctgtgactatttctttctcctttctttggatagctaaagaattttggtagccaaaattcatgggttctgaaattcctagaattatacaagcagtgagagtagagcatctgaaaacagacgacattgctttgaaaaaggtagttttgtgctaggctgtcataacatgcaacctggtgtttgctggaacatcctcctcaaggaaaaggattaagagaagtctctttgttggttcttctcagtttgcataaatcaacacctacacatctgacccataatgaggctctttttaactaaacagcatgttaagtgtgactttacagaaatgaaatcaacttcttaataaattcacca

SEQ ID NO: 112163 - DNA, 127 bp, Homo sapiens
ctgagtgcccaaatggctttctagtcatgtaatttccagcttctcttagtaaatacatgcttcaaggaaagcaaactacaccacttcacacaagtgccaccaaaagggtctacagcaagtaacatgc

SEQ ID NO: 112164 - DNA, 884 bp, Homo sapiens
tgtaagccactgcacctggctagtcttttgtttttttaaagctcatgttatttccttcaaattttattgccaaattgaacataaaaatgtatttctgtgaagttagaacagagaaaattagaaaaagtcaatcagcaaggaaaagagttaaaatggtatgcacgcaatgatgtggaaaatttggggtaaaggagaaagatgtgagattgaaataaactagaagaaaataataatagagagaaagaacaatagtttggaactccactgtagctcaacagtgaatgtgcttccctaaataactgattgtctctccggcagtaatgtagaaattggcaaggttgtagcccattccataaatctgatatgacatgttcctaattaaatacaagtcttttaatataactaaaggatacaggctaatctttatgaatcagaaagcaaacagaccttgaaatgcaggagtgtaactaatgtgcaacactgacaaagactaattaactataaataaacaaaaagagaaattacatcacctttaaaggatcataacatattttgggcaatctttaaagtgtaaatcttcttagaataactacttttgataaccaaggatagaaaatatttagatgaaatcgtatatttaacttgtattgaacttagatatatctttactaagaagatactaaaatttttcaatattgtttatgttgccttatgaatacaagagtcagattttcacaatgtgatagattttaaaaatctactcccctctcccccttctctctcttactttcaccctcaccctcttttgaccctcatttcatctttccctcccatttttcctctctttagtaaagtttaggctctacagcagattatttttcttc

SEQ ID NO: 112165 - DNA, 627 bp, Homo sapiens
atttttgtatttttagtagagacggggtttcaccgtgttagccaggatggtcttgatctcctgacctcgtgatccgcccgcctcggcctcccaaagtgctgggattataggcatgagccactgtgcctggccacatcttgcttttttttttatgatcagaacaaagggcccactctagttctctacatgtcaatcaatcaagcatgttgaataagggacatagaggatttaacttttgttatcataaatggaacttgcaggcatatatcaagaaccctatgaagaattcctctcccatcattttgataaagaactacatcattttttatagaattggtgaatgttcctaaactgctgaagctacatgttttttgttttgttttacaaagtcaggtgtttgagagttcttttccactctactactactcatagagcttgttttttctttgggtgtgtgctgatcctgttactgagattaattacatggctctgcagtgtagtttacataaaaatgatgttttccacttgattgctgcagatatcaagagtttgttattttcaaatacccatccaacaagagagatggggaggtttttagttatatatgctatatatatatatataact

SEQ ID NO: 112166 - DNA, 335 bp, Homo sapiens
tctagttctcttgctgtttccaccacatctgcaattactttctcccctggagtcttgaactcctcaaagttatgcatgaagattggaatcaacttattccaaactcttgttagtgttgctattttgacctcttcccatgaatgatgaatgctcttaatggcatctagaatggtagatcctttctaaaaggttgtcaattgattttaacagatccatcagagaactgactgtggcagctattactgtataaaatgttttgtttcatttttgagacggggtcttgctttgctgcccaggctggagtacagtgtaccatggctcactgcagttttgac

SEQ ID NO: 112167 - DNA, 110 bp, Homo sapiens
atttaagagaggcagacataccgacaccgtgtggtgctgggtgtgggggaaggtggtgttcaggcaggcagtgcagagtggctgtaaactatggagctgctgtagccctt

SEQ ID NO: 112168 - DNA, 854 bp, Homo sapiens
aaactcctgacctcaggtgatccacccacctcggcctcccaaagtgctgggattacaggtgtgaaccaccgtgcccagcttcattttttatttttttgttttactttgctttctgggtcattttgaattttatttttaaatctgagacaaaatattaaacatctgggtcctattacatgtagacgttctttacaaatgttgtgattgggatcaaggaacagtctgaagttcccgggcaggagaatcagctgagggctaggatgaatgttgccatttgtgttgagagaccagcaaggttgatttttgccagcagaaatgtagaaagaatgatcttgctcaaaatgagttaatgcagtgggttaaaaatgaatttgtaaatactttcatctgcctcagttattgctgcctaatatttgtttcacccacggtttctcttttccctgcaaattatgtgtacagtgtgattgactttctaaaggtgttgatatatactaatatatcctaatattctaaaggtgatgatacatatattttttttcccatgaaaatatcttagaagtaggtgtattgtaatagttacctaaaggaaatgcttcttaatctgagacattttccggcccattgagaggaacagtagcttttttgagaggctggcatctcaagatagaaagatgtctctaagtattgccctggagtgctactgaatgatttctttactctgtcattgagcccttattgtgtcaaaaaacaaatctcttggagaccctcacagaaagatttgtttcctaaaacctgagtgctagctagagctcataatttttgtgtttttttgagacagagtctcactctgtcac

SEQ ID NO: 112169 - DNA, 359 bp, Homo sapiens
gcaatcatcactatgatcaattttgggacatttttatcaccccaaaaaagaaatcctgtacctattggcagtcacttccctttcacacctaaactcctgaggtctaatcaactactaatttttgtctgtgtagatttgcctattctggatatttcgtataaatggaattcaacatattgtcatttgtggctgacttctttctcttagataatgttttaaatatttatccatgttgggcccactgtgcccaggagtagtaaagatttgaaaaatggggagcatatgcatgcctttcttggaccagacttttaagtcttgttatttataataatatgtaataaagagtgaaatacttgctt

SEQ ID NO: 112170 - DNA, 397 bp, Homo sapiens
tctgcaggagcccgtcagacttgaccagcattgccaagagctcagccgggcaaggcacagagcacaagacttggctgccctgatctccgctgcctgcgggtcatgcagccctccgcctccctctgggaagtcctcacctctgggctgggctccttgcatccccagaggtgcctcctcagcacctccatccccagttgccctggctgctagggttggactggccactcagctagggtacaagtctgccaggtgtgactgagaacctttgccatttgctgtctcctgtgactaagacagacacaagccagacagaggcatgaggctctttcctgttgcccggcccttctcccaatttccctcccccaacacacatacgcacacacacatacacacacac

SEQ ID NO: 112171 - DNA, 587 bp, Homo sapiens
atggagttcgatcatggaaattaatggttaaagatatgttctacaaggcaaagcagttggaatggttttagtcaattactgaaggcaattacattttatattgtaaagggactctcttatggccaacctgactgcctgtatttaagagttattatctttgttatttgtatgataaaatatttaacagaataaggattagagggttaagaaaagtgaggagtggagactggtttggcaatttcaagaatcggaaagagaagacgagtatcttatgcttttatttccctgttcaaatgccagcagccacacactcaaattgcctgagtcatgatcatgcaaaattaaccttgcctatttctgggatgaaaaataatttgaaagtatgcttgtaatataagatttttatttaaacatatgtttaaatattgatattcacttgaaaacaaactataaaatgtttaaatgaaaaaaactatcagatttctaagcaataaaagtgagatattagtgctcttaatacaaaaaacgtgggaataggtcagaagtagtataataactctagtttttgtcaagggtttggcctataa

SEQ ID NO: 112172 - DNA, 700 bp, Homo sapiens
gtggaagactgaatgaaacccgggcggattcccagcttgctccgtctcagcttgggcactgctgtttacagcctgtgtactcccctcccgccctgccacccacaagtgtctcacctccttcctcgacagatcgaatgacacaacaaacatttatcttgggtgcacagcgtgtcaggcgtcaggctaagcactttgataaactggttctttcaaacatcacaggtgtctgacgcaggcaccattatccacgtcatagaaaaaaaacagtgttcagtgagcctgaggttagcaatgtgtgcacctccacacactgctaaatgacaaagctgaattttgaagtaggatgccatgaggtgtctggagtagacaaccaaaatgacttaattgaggtgtcaggggactgtcttactttctggtcacataagcaatatacgctcattgtgaggtttggttgttccattacaaaaaagactgttttaaaagccattagcggagggatgggaggagttctcttctgcctgtgtcttcctcctaaacagcaaaatgacggtgtcctcaaagggatgtataacgagcgagaggcgaaaaagaacgtctgtgattttaaatccagtgtccttcaccagtgagcaatagtagttctgtgagtgggagagcgggaccgtggtgcttgcaaacaacactttaaaacactggaacc

SEQ ID NO: 112173 - DNA, 415 bp, Homo sapiens
cagccattccaagagtgatctctgaaaaacgttaatcagagcatgccaccctctgtgtaaagctaatggctccctgttggtcttagaatatataatggagtagcgaggccctgtgtaatacggttccatgccctctccattttttgcagatgccttctttctttgcttgcttggctgactacattgaccttctagttccctgacctgttaatactttttttcctgcctgaggacttctgtacagtttgttcttgctacctagaatgcaagaacactctttgcccattccttttccatctttaaatcttaatgcaaaggtcagtttctccaggtagtatctatttctgattgtccagactggattgggatcccctgttggatttctcacagtagcctgtttttgataagaattcat

SEQ ID NO: 112174 - DNA, 262 bp, Homo sapiens
tggtctagggatcgtgacactgggttcgagtcaggacagtgtacttcgtgtgtgcaagttatgtgagcaccaagcagtcgggcaaatcccataggtcaggacttgagaaaccacggttccaggctgcaatccaggctgtacagccatgccactgaacttaataagcatctacttcttcactttatttatttatttattattattttctgagacagagactccctctgtcacccaggctggagtgcagtggcatgatcttggc

SEQ ID NO: 112175 - DNA, 374 bp, Homo sapiens
ctgctgggattacaggcgtgtgccaccacaccccgctaaattttttgtatttttagtagagatggggtttcaccatgttggtcaggctggtctcgatctcctgacctcgtgatccacctgcctcggcctcccaaagtgctgggattacaggcataagccaccgcgcctggcctatacttttcttaatgtagccaatgaccattctaatgttgcttcttttgcagtaacattacatcattgtctcatattgagttaggcctggattttagttcctgcttcaccattaccattatctgcctcaccattcgcaattgccattacagcaggtgatcagagccacctgccgtgtgggtctgagcaagtcactttccctc

SEQ ID NO: 112176 - DNA, 179 bp, Homo sapiens
tattcagggtagcactgggaacaggagacccacctgaggctcagccctagccctcagcccacctggggagtttactacctggggaccccccttgcccatgcctccagctacaaaacaattcaattgctttttttttggtccaaaataaaacctcagctagctctgccaatgtcaaaaaa

SEQ ID NO: 112177 - DNA, 472 bp, Homo sapiens
atcttcctaaaatctccttccctggccttgcccttcataaaccctgttctgccataactggttaatttgataaccaagaaacaacaagtcttaaaataagtgttagtgaagcaatgatcagtgcatgggtgactgaggggccgacttcggttacctaaaggctgccagaccacccattatctactgaccaccactcgagaccgtttcccaccctccctccgagactgtgcgtggctggggtggcctctcaccatcgccacgtcctaaggtggcaacgagactcaggccaagaacacacagcgcgaccaaagcactgccatttcccgcaggaatcagaggcgggtgctttgtttggctgtttttgttttgttcttttttgtgtttttaataggagcggagaaatcagaagcaggaaggagcatctgggttttttcctgcttctgctccagggaccccatgaaacctcagagtc

SEQ ID NO: 112178 - DNA, 342 bp, Homo sapiens
aactactctttttatagaaaaccttgtctttacctacagatatatagctttacccttgtaggtctcagaataataatgacattccctaaaaaacaccataatacacaaccttcgtacaatgtgacatatactaatgaagtaacattagggatcacttccccacagttggctccccattcactgcccttcatattccaatgcaaaatcacctctgtttatactgttatagttacagtacttatacaaagcgtactactcttaagtgtgctgcctaataattttttcttttttgagacgtagtctagttctgtcacccaggctggagtgcagtggcatgatctc

SEQ ID NO: 112179 - DNA, 404 bp, Homo sapiens
tccctgcttctcttcccactcctagcatcattctgcacctcgaagggtcttgtgtgtccatggatggatattatagtcacatatccaaattcaaactctgttcatctttcgcctttctccaacagccacctcacagctgcacctcaggactagcggtgcccagacaggtggtgctgtcagtttcctcaggataaaccaagacattgctattcagaccccagaagggggctccaggtcatttgagcagagtctagaaggatgactgcaggttctaaatggacatgtcttcttagcatggtctggaaggctagacacaggccccagatgacttgtcttagcagaaggtaccccttactctatgggaagctgcatggctggaggaaggcccggaggtgttctctgaa

SEQ ID NO: 112180 - DNA, 152 bp, Homo sapiens
  misc_feature (140)..(140): n is a, c, g, or t
  misc_feature (142)..(143): n is a, c, g, or t
  misc_feature (145)..(149): n is a, c, g, or t
  misc_feature (151)..(152): n is a, c, g, or t
gatctgactgtagggactatattcattactgctggactatgctgctttccccaaccccctaggattttaaaaatagcacgctgcacttgaaacaggggaagacactgtataacatccaaatgttcttcttccctagaggncnnannnnnann

SEQ ID NO: 112181 - DNA, 351 bp, Homo sapiens
ctccatggccaaggaagactccatcaccccgactgttcatttgagagcctccttagtgggggtgtcccccaagggttgctctccttaatcaatcctgaacattgaataatgtttgggctgagagcagtcgcggcagctaccctagtttaaatgtcccagcgcacactgcatggctgcttctcagctgatgctgagttctgtattgtgcacattcacaggcaggggtgcagctttaccatggagacagcacagcaacatgcctggtgcctgccctcatgacagcaagaggatgccattcggcgaggtgtccttgaaacttctcttggaaaatctcagcttacaaaaagacac

SEQ ID NO: 112182 - DNA, 161 bp, Homo sapiens
taaagccaccaatatggcatatgagggtgtccaagaaaatcaaacataactccatttgattaagagcttgaaacaaaccatcactttattctggtcagagaagaacagtacaactgacctcttcttcaatcagcccacatgagaggtcacctcatgtaggg

SEQ ID NO: 112183 - DNA, 620 bp, Homo sapiens
ctcgtgccacctctgctcacgagtggtctgatgcttattcattatctggttcagcaaatccagataccttaacttaaaatatgtttacaatccagtttctctggagacaaaaccctcatcaatttacttcttaaaacgctttactggctgacatccgaacgcctctgcatgagatttcaacaatgagctcaatgagctcatcccccaccccttccaaacacagcacttgaatgccttcaactcttttgtaaaatcacatctccttagcatgtgagcaaaatctgatccatatcatctttatcatagagatcctgtcttatagctgtgccaaaatgcacttgtttgagcatgtaacttctcaacttaaaacttctcgaggtttcttcattgcctgtaacataaagtcccaactacttaacacaaaatgcgacattttaccatgtagtttctctcaggatgatctattaaaaaaccccaaatctcatcctgttcctgctgtaagccctttattggcttaaatccaaagttattaacatgatataaaaatttgatcatgtcatcccttaaagtcaaattcacacttcctaggacaatatataaaatttgatcttataactcct

SEQ ID NO: 112184 - DNA, 321 bp, Homo sapiens
ttccacaaagatttattaagcacctatactatatgccaagccctgtgctagatgctttcaataggaaataaagattccataagataagttagactattttaggagtttccacctttttaccaccaagctacccctttgatagttgttccctaggaggcatgtgttttgaaagatcctgtctattacatattatgcttgtgctaggctttctcagaatattgaaaatagcttttgaatctccactgtaattttcagggagtcctagaggtctagagatcttcataagaaaactgatcacttttttaaaaaattttatttatt

SEQ ID NO: 112185 - DNA, 378 bp, Homo sapiens
actcccaatgtttaatgtgtgaaaaggcttaaggtttaagtgagaaaaaagcaggaaattacatgcaatatattcagtactgtttttttttttaaattacaagactacacagatgggaaaaagaaattggatgataaatctttaatcaacacactgtaactgtttgcccaaaaagtgtgaagaatatcagacatatacagttggagaaaagaagccatgaatagaactgagagtcaaaaataaatggtcaggctgggtgtggtagctcatgctcataataccagcactttgggagaccaagtcaggaggatcccttgaggtcaagagttcaagaccagcctgggcaacatagcgagatcccttctgtaaaaaaaaaaa

SEQ ID NO: 112186 - DNA, 723 bp, Homo sapiens
ctttatcttttaaacagggacacttataagaatgaaaaggggcactattaataattatggtgagctcccagcactttgggaggctgaggcgggcagatcacttgaggtcaggagttcaagaccaacctggccaatatggtgaaatcccatttctactaaaaatacaaaaattagccaggcatagtggtgcgcacctgtgatccctgctatccgggaggctgaggcagagaatcacttgaacctgagaggtggaggttgcagtgagccaaaatcacaccactgtactccagcctgggagacagagtgagactctgactcaaaaaaaaaaaaagaataaattgcggtgagctacagtttcaaccagaactgtaccaggctattcttaacacatacaatattgagatggtttcatgagtcatctcgtatcatgacatttcttcagaatttctaggagagacggaactgaaatctcttctgtttaaagtatttttttcttaacatgtttcttctttaaatagaataaattaccttctgtgggaaatattttttaatgtttaaattgtgctacgttgcatacatttcctggatatggattaaaggaccaaatttattgctgaaaaagaaatgctggaatgattctaaatatccatgagtattacttaaatggggtaagggctgctgaaaatgataacatcaatgataataatgcacctcttagactgt

SEQ ID NO: 112187 - DNA, 409 bp, Homo sapiens
gatattgagtgtgaggcgtataataccagtagcgctagtttaagagtactgcggcaagtactattgacccagcgaataaggcttctgctgttactgctgtcaggtctcctgcataggaagggcttattgtctgagcataaatggggaaacctggagttcatctatctgcgaggaagctttggcacccagttaaatttcactgtctcaagcttcccttgtgtgtcctagagcttttctttaacagttgtcatgaggaagtctcatttgtcaagttgaccaattgtccattttttccctgtcatgaggaaatcctttcttaagccagctttattttctaaatggaaatttccagccttgaatgcagtagctgttgctctgggtagtccaggtcctaaagttcagttcttca

SEQ ID NO: 112188 - DNA, 469 bp, Homo sapiens
ttctgggggatgggggagtctctggtgtgcccggcgggttctgggggatgggggagtctctggtgcgcccgggcttgtagacgcatcaccacgatctccgcctccctcttcacccagcgttctccctgcgtgcacagctcagtgtccacgtctgccctttgtagaaggaagctagttctgtggggtgagggcccaccctagcgatctcacctggatcatctgcaaagaccatgtttcccaggaaggccatcgtctgtggtgttggggggctaggacttcaacataccattcttgggggacacatttcaactcataacaccagtaaataaagcatagagaagaaagtaaaaatcgcctgtaatccttccacccaagataaaacatgtaaatctaaaatgttgaatatatcatgtactttttacaaaataaggattactctggatataaggcttcacattctgcattttaa

SEQ ID NO: 112189 - DNA, 390 bp, Homo sapiens
aggaaaatgttaccacgttcaagagaaagtagtcaataacaaaatatcttcaagatgaccaagtgttcatattcgaagtcaaagatgttaaagcagtcattataaatatgcttgaggactatgaaagaaaatatgtatagtaattgaacaagtaggaaacctcaaacagagaaagagaaattttttctttttttcttttttttttctttgagatggagtctcactctgttgcccaggctggagttcagtggtgcggttttggctcactgcaacctctgcctcccaggttcgagcaattctcctgcctcagcctcctgagtagctgggattacaagcatgcaccaccacgcccagctgatttttgtatttttagtagagtcggggttttgc

SEQ ID NO: 112190 - DNA, 613 bp, Homo sapiens
gtaagcactgaatcttaaaaactctttgtttaattgatcaccctattatggttgcaaaaaatctcttgtatctaaaatttaggataaaagtcttaatgcattaaaattggttttcttttaaattaccggtcagttcttccatgagtaacaacaaaaaagaaagcaattaaattgcttcttgatttaatacatatactgaaagaaataaaacacttaaattttatatactaaacactaatcattaaaatatatttagaagtttgttagaacacaactttttaggaagaatttaaattcagatgtcattttagaactagatgtgtaatcacatataataaagtatttttaaaaagtgtgtatcagtgattctcaagtggaaagcacacaataaatttttgtttatgaaaaaggcaatcactttttcttgagaagttcagaaaaacaatttccttacctcttgccaaataaaatttagaatcatggaatttataaaaattttattgaagtgtgtgttatattgctataagaaaaacagttgaaagtcaaggttacacagcttcactctgagtgtattatcttgtattgactcttagtgtattaccttgaacattga

SEQ ID NO: 112191 - DNA, 370 bp, Homo sapiens
atactgtattgaccagatataggcatactgaccaataagcatgcagagctggagcagaaagtaagcatgatttggacaatgtgctggattagaagaacaaatgcaatgctacagatgacatcaatgtcaaagacctagaaatgctgagccaaggctgtaccctcacacgtcagtctcagaggcaggtgacagcccttacaaaggcaagagatggcctagcttcagaccagaacgtaaattcagcttggaagccttggactcaagctcccaagcaaaaatggctcttcctactgcatttttgttacttctaactgcaggtctccccagtctttagaatccaagaggctgaacaatatgttatccatctgta

SEQ ID NO: 112192 - DNA, 677 bp, Homo sapiens
gggtttaagtatatggctaggagtccatatattaacaaggcttttccccagtatctgtagtcctacctgggatctagaatattgtaatagttagaactcagttttagtagccaggttacctatgtggaatctctgcccctaactaactgtgtgaccttgggcaagcaagctagttgacttctctggacttcattcaccttcctcatgtacagagtgatgatggcacaagtacctgtatcatagagctgtgtaaatgctaacagaacttggacatggaaggtacttaaaactggacttggtatgtagtaggtgctcaacaaacttcattcttattagacatgattttccaaatatctcagtcttggctttctggactggggaacacttgaaggtatgaagaaatccaactctacctgggtgcttccttggtgatgctgggcactttccttgtgccagcatgttttgccttcacaactaccctgagaagtgtgtatcgtcgcctgtacttcacaaaagagaaatctgagtttcagagagttgaaatgacttggtctaaagtcccacaggttctcagtggagagagcctagatgtgaacccaagtcctcgtttcctctgtcagcagtctttttggagagagaagaaattattcacatgctcttccttaacctttctgtgg

SEQ ID NO: 112193 - DNA, 789 bp, Homo sapiens
gtacaggaagttaccaactcacaatttttatgttcctgaaagtttgtttgtgagctggttacttggaacatgttttcccataggaataatgatacaaataatagagtctcacacaagtccatcaaaggctattaacccaatatctagctaacatgcaaatatttgccataaaatgtgtaaagaacagtatggttcccatagtaatcaaatagaagaaaattatggcattaaatgtgtttttaattttggatgttgctgtttgaaggaaagaagctttaattggaggacaatgaagagctggagaaaaaattagaaggtattttcagaataccatcaaatactttaggtattttcagaagttttagatactcatgacactggatttttcaattatgttcaattttaccctcatacttgtggcttatcttttctcaattcaattttatcatacaaactgcttttaaattatgagtaaagtcatgatgtaaactcacagactgaattaaaagtgggagagagaatttgctgagataattctaaaggagttggaagagagaaaaatgataagggattattatgaatttgggctcatgtgtctgagtaagtcccatttggagaaattaactgaataagaaagaggtcataggtagaacagaattgaggagcatagtaaaagcaggaaaaagtacggtgtgaggcagaggtattgggtctcacaggtttgtgtgctaactaccaaatgtaggtgtgggcacataatggcaagctttccatgggagagagactggg

SEQ ID NO: 112194 - DNA, 286 bp, Homo sapiens
aacgtctagggggtatgaaaagcagctcttagaagtgggagatacccatgtgagctctggctctgctgctggagtggatggctctggagagagtggacacacattctatcccagaggagggggcagaaatccactggaatgaagtgctgggattcctgcacagtgcagggaccattaccccgtaccactcacagactcaccagaatgtggccacattctgagtggggactgaagaattcatttggtgctgcctctatccgtcctcgatgacttcctggcaaaggat

SEQ ID NO: 112195 - DNA, 550 bp, Homo sapiens
atacatcattttctttccataaatagacaacataaacaccacctgttaacaatgattcaattaattcaatcaatagagtcagtcttgctttgaggatcaaaactaagccaaaaccaaacaaagctcaaaacaatgttttccccacaataatagaatatttgtaccttagcttgttataaacatactaaaagtaatatgccatattaattagtctatgatgtcacaattgttgatgactcattactttttaattttttttttactttggcctcatctttattcttacaagtctaaaactcaaaattaataagagagtggtaaatcaatgataaaaagaccaaaattataattgtttcttacatcatatacaaaaatcaactcaagatggatttaagacctaaatgtaaagcctaaactataaaaaccctggatgataacctaggacattctggacataagacctggcaaacatttcatgatgaaaatgccaaaagcaactgcaacaaaaacaaaaaaaattgacaaatgggacctaattaaagagcttctg

SEQ ID NO: 112196 - DNA, 264 bp, Homo sapiens
taagtgcagggatgagaggggatgctgggtgcatcgttctctgtcatgtacttctgaaaggaaactgttttaaaaggaaagccacctttttaaaaagttttatgcatttttaagcagggagttcttaagagacctgcttcattaatctgccatgaatacgcctctgggagagaagagttaacattagtttcctctagtgtgccaaaaagcatatcatttgctttgtttgaaaatatgtctcatacacacacgtgtgtagattgg

SEQ ID NO: 112197 - DNA, 567 bp, Homo sapiens
gaaatgaggtgtttttagcttttcttgtgacttgctcttaaaatagagattcagacacatgtattatataatcaggaatctgaagagaaaactgtatattgcttttgatccgtctcccttagcaaagtacatattttcatactctatttctttacataagaatatcgaggggcacacatttttgtacatttttaggtatggttttgaaaatatctcaatggaagaagctaggcattccctgaaagatcaaaagcatctaaggctgctggtggtgatgcattttctcgatggggttgttgtggtgggcagctggatttaggagtgtcctttattgcacctgctcccattgttaggctgttggaagaaacgtggtgcacagcatgaggggaggctaatcctgaatgttttatggagcattacgactgcaggtagagaagcaaaaatcgacctcataaaaaccttaagttgtttttactatgaaaacaatatacatacccagtgaagaaaactgaacattataggggggaagggaacaaataaccctaacattttttaaaaagtactttt

SEQ ID NO: 112198 - DNA, 203 bp, Homo sapiens
gaaatgaggtgtttttagcttttcttgtgacttgctcttaaaatagagattcagacacatgtattatataatcaggaatctgaagagaaaactgtatattgcttttgatccgtctcccttagcaaagtacatattttcaaaccagatttcagcaaagacgtgaatcgggagtcgcacagtccatgagcaagtcgaacgttgat

SEQ ID NO: 112199 - DNA, 478 bp, Homo sapiens
cacaccgtgctcagctaagagtatcatttgcattcagtgtgattgacatagcagaggagggatgaagggtacagaggggaggggttcctcggctgtgcacgtgaggtgcagctgggaattctgatctgaggatgctaaagcaaggagatatgatgggccaggaagtgcagtctttgggctaaggcagggcaggatatgcaagtggagatattgccttgcacagaagtttttactgtatcctgtaaagaatgaggaatgtttgaatagttttaaaacatttgggaatagatcttcagttttatagtctgaaaagataactggcagtttaaatgatggaaatatgggagggaacaatctccaaggcagctggaattctcttctttatctttttcatccacagcaagtagactttttcttttattatcaccaccacaatatagttgtcatatcttattcttgatatttagattctaaagcc

SEQ ID NO: 112200 - DNA, 345 bp, Homo sapiens
tggaactctccattcggctggcctctctccctcctcatcccactcattctcctatggtcactgatttggttaatagtccccattgttaccctagtgtttctaataattcactatcaaatatggtgtttgttatagttttctgatatattgtttataagttagagacatttctatctatttctagtatgacttttatatgaagtgaatttttttttagctgttgatgtagtaggttacatttgatatatttttaaaagttgaatcatctttgcattcctctgataaaccctgtttggttacaatatattatccttttaaagatagactgtaggattctatttggta

SEQ ID NO: 112201 - DNA, 173 bp, Homo sapiens
tggtctggaaatgctgagctcaagcagtcctcacctcggcctcctaaaatgttgggattacccgtgtgagccactgtgttaggcctagacaacagaaatctggtttctcacagttctagaaggcagaagtctgaaatcaaggtgttggcagggctgagcttccctcagaggct

SEQ ID NO: 112202 - DNA, 2968 bp, Homo sapiens
cagattaaagcgagcaccagagcaggggaaaacaaagcgtgctcaactccaggggctgcaccgcgctctaaagaaaagaccagatcctcttccttccttctttccttccttccacaccttgcaagggtcctctgtcccgcactgcgagtaaatcatacactttggaagtttagcattagagagcccagcaggggagaaaattgtctgcaagttaaaaaaaaaaaaaaaaaaaaagtagaactagggcagtccgaggagattgaaagggcaaaactatcaagcaagaaaactgtaagttctgattagttttatgactttgccttcatgcctcaggagctcaactgatcacggctttcacgacaggctaaggtacttactacaccattctttggcgaaggctattcagcagtggtgacctcttccaatccaacactctacagattattatctctggactcccagctgacaccctgccggaggcaagagctactaagccaactggaactgtgccttttctcttgtcaaggtttttttcttacacaggaaaaagaaagaaaaaaaaaagatgaagttgggcaaagtggagttctgccattttctgcagctaatagctcttttcctgtgtttttctgggatgagtcaagcagaactctcaaggtccagatcaaagccctatttccaatcagggaggtcccggaccaagcgcagctgggtgtggaatcagttctttgtgctggaggaatacatgggttcagaccccctctatgtaggaaagcttcactctgatgttgataaaggagatggttccatcaaatacatcttgtcaggcgaaggggcaagttccattttcattattgatgagaacactggggatattcatgccaccaagagactggatcgtgaggagcaggcctactacacgctccgagctcaagcgctggataggctcaccaacaaacccgtggagcccgagtcggagtttgtcatcaaaattcaggatatcaacgacaatgaacccaaatttttggatggcccatacacggcaggagttcccgaaatgtctcccgtggggacctcagtggtacaagtgacagcgacggatgctgatgatcctacatatggcaacagtgccagagtggtctacagtattctgcaaggacagccgtacttctcagtggagccaaagacaggagtcatcaagactgcccttccaaacatggatagagaggctaaagaccagtatttgcttgttattcaggcaaaggatatggttggtcaaaatggaggactgtcaggaactacatcagtcactgtgaccctaactgatgtcaacgataatccacctcgctttcctcgaaggtcttatcaatataacgtcccagagtcattacctgtagcctcagttgtggccagaattaaagctgctgatgcagatattggagctaatgctgaaatggagtacaagattgtggatggtgatggtttgggcatttttaagatttctgttgacaaagaaacccaggaaggaatcattactatacagaaggagctggattttgaagccaaaacaagttacacgctacggatagaagctgcaaataaagatgccgaccctcgctttctgagcttgggtccgttcagtgacacgacaactgtgaagataattgtggaagatgtagatgagccccctgtgttctcttcacccttgtaccctatggaggtgtcggaagctacccaggttgggaatatcattggcactgtagcagctcatgacccagattcttccaatagccctgtgaggtactcaattgacagaaacacagacttggagagatacttcaatattgatgccaacagtggggtcatcacaactgccaagtctttggatcgagagacaaatgctattcacaatatcacagtccttgcaatggagagccagaatccatctcaagtaggaagaggctatgtggccatcactatacttgacatcaatgataacgcccctgaatttgccatggactatgagaccaccgtctgtgaaaatgcccagccggggcaggttatccagaaaatcagtgctgtggataaagatgagccatccaatggacaccagttttacttcagcttaacaacggatgcaacaaataaccacaacttttcattgaaagataacaaagacaacacagcctcaatactgaccaggagaaacggcttccggagacaggaacaatcagtttactatctgccaattttcattgtggacagtggatctccctcacttagcagcaccagcaccctcaccatccgcgtgtgtgactgtgatgctgacggcgtagcccagacctgcaatgcagaggcctatgtcctacctgctggcctcagtacaggagccctgatagccatactcgcctgtgtcttgacattattggtgttgatcctccttatcgtcactatgagaagacggaaaaaagagccccttatttttgacgaagaaagagacatcagagaaaatattgtgagatacgatgacgagggcgggggagaggaggacacggaagcgtttgacatggctgcactgagaaacctcaacgtcatccgagacaccaagacccggagggatgtgactccagaaattcaattcctgagtcgaccagcttttaaaagcatcccagataatgtcatctttagggaatttatttgggaaagattaaaagaagccgatgttgatcctggtgctcctccttatgactccctgcagacatatgcttttgaaggaaatggctcagttgctgaatcactcagctctttagattccatcagctcaaactctgatcagaactatgactacctaagtgactggggacctcgctttaaacgactcgcggacatgtatgggactggccaagagagtttgtactcatagccttggaaccttaattcgaaatgtactgaagaaaaagtaacagca

SEQ ID NO: 112203 - DNA, 303 bp, Homo sapiens
gctgactgtttaaccggtaatttaattttcctaacgactttctttacaggagctggattttgaagccaaaacaagttacacgctacggatagaagctgcaaataaagatgccgaccctcgctttctgagcttgggtccgttcagtgacacgacaactgtgaagataattgtggaagatgtagatgagccccctgtgttctcttcacccttgtaccctatggaggtgtcggaagctacccaggttgggaatatcattggcactgtagcagctcatgacccagattcttccaatagccctgtgag

SEQ ID NO: 112204 - DNA, 2829 bp, Homo sapiens
gggcagggtccccgcgcaccgcggagtgggctgtgattggaggaggagcccgtgccgggcgggcccgagcgggtgtcgagccggttcctccagtctgccccgcgcgcggagctgcgcgcactgggtccccaagagcccgcgggcgtccggcagccgagcgcacgttctttcggatgcacacgcccgggtccctggcgtctgacgccgtggggagggcagcgaggccccaggtacttactacaccattctttggcgaaggctattcagcagtggtgacctcttccaatccaacactctacagattattatctctggactcccagctgacaccctgccggaggcaagagctactaagccaactggaactgtgccttttctcttgtcaaggtttttttcttacacaggaaaaagaaagaaaaaaaaaagatgaagttgggcaaagtggagttctgccattttctgcagctaatagctcttttcctgtgtttttctgggatgagtcaagcagaactctcaaggtccagatcaaagccctatttccaatcagggaggtcccggaccaagcgcagctgggtgtggaatcagttctttgtgctggaggaatacatgggttcagaccccctctatgtaggaaagcttcactctgatgttgataaaggagatggttccatcaaatacatcttgtcaggcgaaggggcaagttccattttcattattgatgagaacactggggatattcatgccaccaagagactggatcgtgaggagcaggcctactacacgctccgagctcaagcgctggataggctcaccaacaaacccgtggagcccgagtcggagtttgtcatcaaaattcaggatatcaacgacaatgaacccaaatttttggatggcccatacacggcaggagttcccgaaatgtctcccgtggggacctcagtggtacaagtgacagcgacggatgctgatgatcctacatatggcaacagtgccagagtggtctacagtattctgcaaggacagccgtacttctcagtggagccaaagacaggagtcatcaagactgcccttccaaacatggatagagaggctaaagaccagtatttgcttgttattcaggcaaaggatatggttggtcaaaatggaggactgtcaggaactacatcagtcactgtgaccctaactgatgtcaacgataatccacctcgctttcctcgaaggtcttatcaatataacgtcccagagtcattacctgtagcctcagttgtggccagaattaaagctgctgatgcagatattggagctaatgctgaaatggagtacaagattgtggatggtgatggtttgggcatttttaagatttctgttgacaaagaaacccaggaaggaatcattactatacagaaggagctggattttgaagccaaaacaagttacacgctacggatagaagctgcaaataaagatgccgaccctcgctttctgagcttgggtccgttcagtgacacgacaactgtgaagataattgtggaagatgtagatgagccccctgtgttctcttcacccttgtaccctatggaggtgtcggaagctacccaggttgggaatatcattggcactgtagcagctcatgacccagattcttccaatagccctgtgaggtactcaattgacagaaacacagacttggagagatacttcaatattgatgccaacagtggggtcatcacaactgccaagtctttggatcgagagacaaatgctattcacaatatcacagtccttgcaatggagagccagaatccatctcaagtaggaagaggctatgtggccatcactatacttgacatcaatgataacgcccctgaatttgccatggactatgagaccaccgtctgtgaaaatgcccagccggggcaggttatccagaaaatcagtgctgtggataaagatgagccatccaatggacaccagttttacttcagcttaacaacggatgcaacaaataaccacaacttttcattgaaagataacaaagacaacacagcctcaatactgaccaggagaaacggcttccggagacaggaacaatcagtttactatctgccaattttcattgtggacagtggatctccctcacttagcagcaccagcaccctcaccatccgcgtgtgtgactgtgatgctgacggcgtagcccagacctgcaatgcagaggcctatgtcctacctgctggcctcagtacaggagccctgatagccatactcgcctgtgtcttgacattattggtgttgatcctccttatcgtcactatgagaagacggaaaaaagagccccttatttttgacgaagaaagagacatcagagaaaatattgtgagatacgatgacgagggcgggggagaggaggacacggaagcgtttgacatggctgcactgagaaacctcaacgtcatccgagacaccaagacccggagggatgtgactccagaaattcaattcctgagtcgaccagcttttaaaagcatcccagataatgtcatctttagggaatttatttgggaaagattaaaagaagccgatgttgatcctggtgctcctccttatgactccctgcagacatatgcttttgaaggaaatggctcagttgctgaatcactcagctctttagattccatcagctcaaactctgatcagaactatgactacctaagtgactggggacctcgctttaaacgactcgcggacatgtatgggactggccaagagagtttgtactcatagccttggaaccttaattcgaaatgtactgaagaaaaagtaacagca

SEQ ID NO: 112205 - DNA, 309 bp, Homo sapiens
aatgtttccagacattgccaaatgtctcctggggggcagtcacctccagttgagaactactgatctatgcatgtgtatgtttgtggcatgtgtgtatgtcagtctgtcagtagaagttagactccatcgttttgctttactcagctttaattaaacaggtgcaactgagagctcccacctgaattacatgtacacctggtgattttatcttccctgctagtggcctattctttaccaatgcttctcacagtgtaaagtgcatttgaatcacataggaatcttgttaaactgcagactccaattcagtag

SEQ ID NO: 112206 - DNA, 330 bp, Homo sapiens
gcttcttttagaagtgtcaatagcattgccatagtttaaagtcccacatcaatatttgtttattctccagccatgcagattatagccaccaccacctttcccttgccacatagctgctgcaagatatctggctcatacctgctgtttacatacagatttcccatccaacagaatcctgttgctctaagcaacactattagcctaacagaaacagccattctaagtaacctttgaatcttactgagcttcacagtattgtgcaccctggtccagattcagatttgacatttgaggctaactgtgactattgctattgaaacttctaaaata

SEQ ID NO: 112207 - DNA, 447 bp, Homo sapiens
cgggcatggtggcatgcgtctgtggtcttggctactcgggaggctagggtgggaggatcacttgagcctgggaggcagaggttgcattgagctaagatcgcaccactgcactccagcctgggtagagtgagactccatctaaaaaaaattaatgaataatttttaaatacttatgaattgtttatttctcaaactttccattaatattttccagccaaggttgatcctgggtaattgagacagggaaagagaaaccacagataaggagagactactgtataatgatattaattagtaaggtttaagtaagtatagaatttgattgtctgtacataatttaaaaagataaagctggttattcagaattatgttgtgtgtaaaggtgtaatgagaaaatgaaaatcatcaattccaaaaatgatcattaactttttcgtacctatggaa

SEQ ID NO: 112208 - DNA, 394 bp, Homo sapiens
ggtcttctggaagccctggtttcaccacaaattgtgactgtcaggacacagtgctgctatggtcaggattcctttccatatgctgcttcagcctcagacctcggtgggccttaagagtaggggctgctcagccaggcgcagtggctcacgcctgtaatcccagcactttgggaggccgaggcgggtggatcacctgaggtcgggagatcgagaccagcctgaccaatatggagaaaccctgtctctactaaatatacaaaattagccaggtgtggtggcatgtgcctgtaatcccagctacttaggaggctgaggcaggagaatcgcttgaacccaggaggcggaggttgcggtgagccaagatcgcaccattgcactccagcctgggcaacaa

SEQ ID NO: 112209 - DNA, 347 bp, Homo sapiens
cttttgccaccagggtggggggaaaagagtgcttctttgccccaaatgctggtttcataaaacctaaagatgtcacatggaaacacaccattcccccaatccccctcaaaaaactacttgcacttaaatgaaagagtaaagctgtaggactttactgagcagtgtcctgtggggtccttgcactgccatgctcttgaggggctcgaggtgtatgaattccccagcattacttctccttagaggtttcagatgagcagtatgagctccaaactcatgctagacccaagtatttcatgaaagaacaatccttgaatgactttatacagcaaagctatatttcactgtgt

SEQ ID NO: 112210 - DNA, 371 bp, Homo sapiens
agagtaaaaagacaatctaccaaatgtgagaaaatatttgcaaatcatatatctgatcaagaattaatatccagaatatataaagaactgtaacctaacaataaagacactccaatttaaaagtgggcaaagagctctctcgctctctctccttctcacattcaaatttacaaaaaggcaaagaactctagtagacatttcttcaaagtaaatacacaaatgaccaataagaagatgaaaagatgtgcaatatcagtagtcattcaggaaatgaattctgtcagaaagggactccccacaccaaaaaaaaaagaaatgaaaatcaaaccataacgagacaccactttacacctgctaggatggctacaatt

SEQ ID NO: 112211 - DNA, 324 bp, Homo sapiens
ctcacattaagctcaaagagagacctggccttcagccatttgatgtccttcccaagaggaccatctgggaaagccagtttggctccaagagcaagagttggtagggatggaaccactagaaaaccaaggccttgatgggggtgctggttaatcagcagcaattggaaaacaaggctcttgcttgagtcaaaggagttgcagccagaggacccagcagggataccaattatgaacccacaaaagtaccatgagacaaagaggcagctttcaacatctgccaggtctccaacatgtgatgccatcttacgatggcactaattcagg

SEQ ID NO: 112212 - DNA, 254 bp, Homo sapiens
tccgccctcctgggcttcccaaagtgctgggattacaggcgtgagccatcgcgcccagccattcctacttttgagaaacagtctagtgttgggtaaggcttataggcaattgtactatagtgtgataagtgttgtaatagtttaatttataaagtgctgtgtgaacacgggagagagtgattatttttgctaagagatttcacagacttttaagctggatcaaagtatgaggagagtttgctgggcgttaaagg

SEQ ID NO: 112213 - DNA, 416 bp, Homo sapiens
ccatgtttacttggctgccaccctcccctcctaccacgtgtacacacaaaactcctttgcgccaccccccgccaacttacccctaccaagaccttgacctggccttcctttggccctccatctcagcctgccccttgggcccttagaaattattaacctcgggccaggcacagtggctcacgcctgtaatcccagcactttgggaggccaaggcaggcagatcacctgaggtcaggagtttgagaccagcctgaccaacatggagaaaccccatcttggccgggcgcggtggcttacccctgtaatcccagcactttgggaggccaaggcaggcggatcacaaggtcaggagatcaagaccatactggctaatacggtgaaaccctgtctctactaaaaatacaaaaacaaaatta

SEQ ID NO: 112214 - DNA, 465 bp, Homo sapiens
ggcaggagaatcgcttgaacccaggaggcggaggttgtagtgagccaagatcacaccattgcactccagcctgggggcgacagagtgagactctatcgccaaaaaaaaaaaagattattgggacaattgatgaagtatggttacagactgtggatttgacaacaacattggattaatgctaagtgacctcattttgacaactgttctgtggttacataagggaatgcccttgttcttaggaaatatgctgatatatttaagggtaaacagacatggtatctcaaacttactcttctaatggcacaggaaaaaatatgcatatatactatcacacgtaaagagaagtagaacaaatggagccaaatgcacacagttggtaaatctggtaaagaatatattggagttccgggggttttctgcagttttttagtaaatttgaaattttatcaaaataaagttacagaa

SEQ ID NO: 112215 - DNA, 660 bp, Homo sapiens
gggcatgccaccatgcccggctaatttttttgtatttttggtagagagtgggtctcaccatgttggccagactggtctcaaactcctgacctcaggcaatctgcccgcctcagcctcccaaagtgctgggattacaggcgtgagccactgcacctggcccccactcttaatttcattccaacctcagcaatgtctcccacatataatctcatcatttgaattcccatgaacaatcctcgaatgcagagtgtttccacttgtttggaaggctataccacatttctaacatatttcgccctttcttccccgctatccttttgcccagcaacaattccaccagaggcagtttggctgttctctaccctccacacctgtcctgttatcagccctccctcaccccagcaccctaagttcttgcaacattaagttactcaacatcctaaagtagaacccatgttctcccatcgctataccttttcgatccagcttttctctcaagatggatgccagacacatttcaaatccctatgccccttgcagctctgacacttactcttctaagaaattgtaccaggttttctcctcattcacccctatggcccagtcccatctccagggcctgaattactcagcccttttgcactttgtgcttctatctat

SEQ ID NO: 112216 - DNA, 527 bp, Homo sapiens
catgagagatccatgcaccccaggtggagtggggagaacttggggagatcagataagaaatgaggacagaccaggccctcggctcatacccgtaaccccagcactttgggaggctgggattacaggcagatcccttgagtctaggagttcaagaccaacctgagcaaggaaacctcatctctacaagaaaaaactcagaaagaaatgaggagaagggctggcttctggatgctcctgacggaggcaggattcatccctggggaggaggcatcagggcctctgtgaatctcaggggtcgtgggttctcgagaagggatgaggggaccagtgttcttcctctgccaaggacagaccaagagagcgtcttgtcagatggtggctggagaggaggaaggtggcagtggacgagcttcaggaaccatctgtcagggagactggaaggagccacccacgggaagggtcaaactcaggggttcccgcctcttagaaactggggccagggctggtctggggctttttattctggg

SEQ ID NO: 112217 - DNA, 228 bp, Homo sapiens
agagttaatcatactttgatgttgtttacatatctgctttcccaccagactgaaggtctatgaggacaggagtcatgcttgaccatttgtactcccggcactagcatagaattgcaggtgcaaacaaaggtgagattaataatccctgacctgccagatcctgtcagaggacacattctaaaattaagtacttgcaactcaaagccctaaggaagacagcaggaaatg

SEQ ID NO: 112218 - DNA, 389 bp, Homo sapiens
tctcttccattgatttttctctttaatgtttcctttcttccaactactttggatttatagtgctttgctcttcattttgtagcttcttcaagtgaaaccttaggtaattgattttagatatttcttcttttctagtataaacatttaaaactataaatttctccctaaacgttgctttatctgcatcccacaaattctcatatgttgtatttttcattttcattcagttcaaaatatttttaaatttcctttgtgctttcttactttactcatggattatttaaaagtggattatttggtttccatatatctggaggttttctgtatgtcttattgttaaattctaatttaattctgttttggtcagagaaacatgttctgcatgattt

SEQ ID NO: 112219 - DNA, 398 bp, Homo sapiens
ggacaacttcaaatattatatttaaatctttcaatatgaggcaaaaaaaaaaaaagttcaaaaataacaaaaatgatatctgaaaggcaaaattttagccatcatatatttttaaaagttctggacacaaaaaatctgatgtatgaaacagaaattgaatcaaatttcttttcaaaggtttaaaatgcactctgcttatttggcagtgcctggaaaaagacaatgaactgtgtactgtggctatttgcccaagtccaagttgtgccctaaaatcaagttcaggagatgacagtgttccaaaacaagtcaaattagatccctgtggcttacacaaaccataactacaaagaaattcaaaatgttaaagctgaaaacagcctaattctagcctcctcaat

SEQ ID NO: 112220 - DNA, 779 bp, Homo sapiens
catgatcacgaaggtggttttccctgggcgaggcttatccattgcactccggatgtgctgacccctgcgatttccccaaatgtgggaaacttgactgcataatttgtggtagtgggggactgcgttcgcgctttcccctgaatttttgtaatgaaaaaatagacggcaagggttattcttaaaactgcagttttgtagcttgggtggcatgttaagtgttctccttacagtcgcaacgatgggaaacagaaagtaacgtgttatcctctccgccgccgtgagctcttttaacactagctaagtggccgcagggctcttctctttcctttccacttggggctgctttttgcagatcgcttcatagtctccagtcttttgggttctcatgctctgtgaaaaccttcgtgttttttcatagcccccagagtcacccttcacacagcctctgcttctaaccgcagcctccgcaggagtttgtaggatgtctgtgctagcggggaatgtgttctcacctcctagagccagggaagaaactacgcagtcgggtgctgttctttgggatgaaagcagggtccccgttcggttgttaacataacacgcttgctttctgtaggggaagggaggtctctcccggcgcccaggtgcccttgctcatgttcaccgaggcctgcaggtcagaaccgcagtctcacctgtcgccagaatgtgctgcgatctaccccaactacccgaactacccagcaataaaataggacacattacggaaacatgaaatagcg

SEQ ID NO: 112221 - DNA, 348 bp, Homo sapiens
agcctcctgagtagctggagttacaggtgcatgacaaaatgcccagctaatttttatatttctagtagagacagggtgtcaccatgttggtcaggctggtctcaaacttctgacctcaagtgatccacccgccttgcctcccaaagtgctgggattacaagcatgagccactacaccaggccagctttagcatagttaatgaggagattatatctctgaatcacaaatgcatattatttatcatgtctagccgtcttttcccagaagcccaactaatatatatttacagatttaattttacgtacatggtgatgttaatgagttgatgttacagattacgtgctatcc

SEQ ID NO: 112222 - DNA, 412 bp, Homo sapiens
agatgctgacaccttcagaaagacgtgtttgtggcatcagcgtcatttctttctgtggctaccaaggccgagaacttctctgtgctccatctcatggccagggttcttacagccgcaggccttctgtgtgcattagctagctaacttgtttcttctttcattcatccaataagtatgactaaactcctgcagtatcttcagcatcggcaattccacactaaataagtaaaacccttgccttcacagagatcgaaaacaaacaggaaaactgtaatgtcatgttgggtgtctggagctgtggagagaaatgaagggggccctggagagccatggctgtgccaaggccagggtggcgtcctggagaacctgccttggagtggagtgctggatctggggaggggggagtgctgct

SEQ ID NO: 112223 - DNA, 194 bp, Homo sapiens
ccagggatgctgccagacaccctacaatgcacaggatagccctgcacaacaaagaattcttcagcccaaaatgtcaatagtactgatgttgagaatccttgctctagaaataaggaagtggcaaaagaaagagtaagacaagaaaatccaagaaaaatctcacctactctgaatccccttaagagtccaactgg

SEQ ID NO: 112224 - DNA, 363 bp, Homo sapiens
gtaatcaccacaggaatccagacggggagtggggtcagttcactggtacaaggatcttgatcaaaggaactcatttcccacctgatccctattcactccagggtccacatctaggagtcccaaagaccggcatgcatgggttgggtcaacaggctgcctggaggtttacctcattccaggagttggagaagcactgtgggaggaactggggttcaaatctgcaaacctccaaaacataggagggatcttctaaaagtttctgagagttctaaccacagattaggggaaaaaaaagatgccctttcatcaacatgggatgaaatgctaggatttagacatggtttttttgtgtgtttttgtttt

SEQ ID NO: 112225 - DNA, 572 bp, Homo sapiens
tgttttattttgaaataattgaaatattaatttccttgaattttcttctcgttgactgtgctatagtgctattatatgaaaatataaatagaaggaaaagatatcaggattatctctctctctctttctcttaaagaatcaagtttatttatgaatgaaatgacgtgaggcctgggatttgcttcaaaataatctcggaagtagggggaaggagtggatagggatatagaagaaacaagattggctttggggtgataattattgaagctgggtgataagtacaaggggattttattgtactgttgctacatatgaaattttccataataaagaaacgttcttaaaaaggcaaactgggccgagtgcagtggctcacgcctgtaatcacagcactttgagaggccaaggcgagtggatcacttgtcaggagttcgagaccagcctggtcaatatggtgaaacccggtctctactaaaaatttaaaaattagctgggcatggtggtatgcatctatagtcccagctacttgggaggttgaggcattgcgccactgcactacagcctgggcaaca

SEQ ID NO: 112226 - DNA, 383 bp, Homo sapiens
atgggcacctccagcatcttcctctgcgtgctgttcctctgtggggcactgggtctcaccatgtcccctgcccggggaaggctccgctgctacatctgtggcttcaccaaaccctgccaccctgttcccaccgagtgtcgggacgatgaagcttgtggcatcagtattggcacttcaggaaaaagctgcctctcaagggcccagtgccctctgccaggctatgccacctactggctgcactcctacactctgtggcaccactgctgcgagcaggacctgtgcaacatagccgcttccccacagcagctcaccagcctcctcgcctccctgcccctctttgtggccagcttcgctgggagaggacacctcctccactagcttcc

SEQ ID NO: 112227 - DNA, 348 bp, Homo sapiens
gagtagaacaggtatttccattgctgtagcaaggtctgccagacaccaagctgctctcagcccatcccctgaggagcccagaagggatatgaacttccacccacctctcccctttcccagttctcagtgccactccttgcctaagtgcacggtaacactcgccactatttcatgtgttgatacctgcagctcccaattttcttaagaggatctgaccctgggaactgatgagggcaccaggagtgccctctcctttgacatgagaccttgagtcttgtccatggggccctggcctggcccttttcatccccaaggctgtaacattctcctgcacaacacaacacacgt

SEQ ID NO: 112228 - DNA, 566 bp, Homo sapiens
ataagacatgtagaaacactatggagaattgtctcccagcatatcttggaagcaagagctcatgctgtctagagcagacaaaccacacacataggtgtgcccaagcatctgtaatttttctgtttgtgagaggctatttttctctcatgttcgagaggccactcgatacactggaaagattcaatgtcgagataaaggacatttaagttctgattcttattctgcttctccttcaccatgagaccttaagcagcactccttgtctccagacctctgtttgtttatctgtgaagtgggcacaccatctgtcctgcctccctttaacttgctaattgtgaggcttaaaaagaatccttgaccaaaatggctttataatctaataggaaatctgggggtagaattggttcagtggttcaacatgagaactctggtcatcttccctgcaattccttaggtcagcagtggacaatgggaacataatgtgagccacatatgtcatttaaaatattcggttgcctcattttttaaagtaaaagtaaaaataaaaataaatgattaaaattaat

SEQ ID NO: 112229 - DNA, 554 bp, Homo sapiens
ggacttttcccaggagctgtcaccacagggagttaactggaaaccaagccttggggatgctttaggaacaggggcctcatcctcaagacatgactgatttcagtcacccctgaaaggctttgccttcccacctagccctctgcctcttccagatgccacatcgccatttctcaactgcctgttttgtgcccagcaatttcacacgtgttgtcttggctaagctccctgctccccaaaaaatcttcgcagcctgggcattcagccatgagggagccacggctgtagccagtggaatgacgtaccctcagtccaggatgtgcacccgggcagccaggtcccacagccactactttcttgcccccaccactgctcccacagttcccagaactcagtctccagatctgggctccaggatgcagaggctgtcctcagggtgaggggcaggtgttctgcacagtgcctcttccctgcagaggaaagtgcccccaaggcattcccagccccatcttccctccaccgcagagcctgaagcccacatcctgtgctggggccac

SEQ ID NO: 112230 - DNA, 243 bp, Homo sapiens
ctggcaagatagatagggcagaaatgcttgtgacgccagaggaaaccctgttttataaccagtgcattctggttctgctgtcagttttagaatcataaaacaggaaagaatcctgagatgtgttatcccagccttcattcatacctccagagagctgttatgaccagaattatctgttgtggagagggaaacaccttgacatttgaccttatttcttctgtctgggtagctgggcatgccact

SEQ ID NO: 112231 - DNA, 278 bp, Homo sapiens
gcatagtaaaaaacggccgcggggcaaccggaggctgattctgaatccattgctaggaatggcgtgctggatgtcttgattggctcgatcagcgggagtcccagcgtagctctatgtcaaattacgctgggttactctgcatttgcatagggcgtgaatttcttgtatccccaccctaatcttttttatgcaggcaggttctctgcctgagctgtgccatgttgcccttttctctattactgcacatgtggtaacaaaaaaaaggaagatgaagcctc

SEQ ID NO: 112232 - DNA, 332 bp, Homo sapiens
cttttttccatcttctatttcagtgttgctcttaagatagtacctactcagtctctcaggatctcgaatatgttcatacatatgagtttgcaaaccaatgagattaaaagagtgagcaaatcttagcatcctctggaaaataccacagtgtcacgtctacatgctaaagggttgggagctgtactgggaatatcttaagcagtttgttaagtggctgccatctcttactgccattgagattgaaactgtctttgcagcctgataaatcacctatggtaacagcaaaagagaggcaaggcgaggcaaggtgacttatgaatggctaaccagaa

SEQ ID NO: 112233 - DNA, 252 bp, Homo sapiens
cacctgcctcagcctcccaaagtgttgggattacaggtgtgagccaccacacctggccaatttcttataaaggtaaatatacattgatcattcaacttagaaattctacttttagaattttttatccaagagaaaaatatatcttcacaaaaagctttgtagaggaatgttcatagaatctctattcttagtggtcccaaaccagtagtaacaatccaaatgttcatcaactggtgaatgtatgaacagact

SEQ ID NO: 112234 - DNA, 316 bp, Homo sapiens
aagtatactgatttcctactattacagtagttctcagccctggtattaaaaatttgactttaggccaggcatggttggctcacacctataatctttgggaggccaaggtgggcagattgcttgagcctggaagtttgagaccagcttgggcaacatagcaaaaccctgtctctacaacaatacaaaaaattagctcagtgtggtggcatgcacctgtagtcccagctactcaggaggctaaggtagaagaatcacctgagcatggggaggtcaaggctgcagtaggccaagactacaccattgccctccagccgag

SEQ ID NO: 112235 - DNA, 976 bp, Homo sapiens
ggcacaacgacggaaagaacgagaagaactggcccaacagtatgaagccatcctacgggagtgtggccacggccgcttccagtggacactgtattttgtgcttggtctggcgctgatggctgacggtgtggaggtctttgtggtgggcttcgtgctgcccagcgctgagaaagacatgtgcctgtccgactccaacaaaggcatgctatggccctcatcgtctacactagggcatgatggtgggacgccttcctctgagcggacggtctgagctgacctggctgaggtcaggaagagccaagtgtcatgcatcattcatcagccttctccaagtcaaacaagcagtcatatcggcccgttacttcctcaatcatatattagtccaagaggtataacagtgcaacttttttccatcattcattgccagccatactcttcatagggaggcttagaggacttgagacgaggtccaaatccacccaatctggctcattttctcgctaatattttactccgaaggataatagtggagcacccagggaaggacaaacgacgaggagaagacaacttctgaagacctgtgactctttgacagtgatacataagggaactgacattgggatgagagcattgataacggcaacaacatggactcaatggagagcgttgggatggcccaacttccaatgtctacctcccaaaacgttaataggggcatatggcaacgattactaccaaggagattaggggagctctccgtagagacgttaacaccaaaggttatcccaatctaagcgtaggagaagagagatgagctgttaagggagccatcccgctactctaagagcacgttattacagcattacacattggtagagttaaatgccactattaggggtggattcttggaccgccacgagcaagcacgtgacacgaaagcgccacgcagtggaagattagcgtaaagaagaacatg

SEQ ID NO: 112236 - DNA, 439 bp, Homo sapiens
tgctgggattgcagttgtgagccactgcactaagcctgagtcgacttttttggattccacacttaagtgagatcatgcagtatttgtctttgtatgcctggcttatttcatttaagataatattttccaggtttatctgtgttgtcttaaatgacaagatttattttgttgttgttaaggctgaatagattctgttgtatatatatgctacattatctttatctcctcatctgttgatggatacttaggttgattccctatcttggctattgtgaatagtcttgcaataatcatgagagttcagatatctcttcaacatattgacttcattttttggggatatatacctagtagttggttttatatccatctcattaataactacatgaaagacaaaaagagaaaagaagaataatccagctatctaaagtcacgaaaa

SEQ ID NO: 112237 - DNA, 516 bp, Homo sapiens
tctctccatgtctctccctccctccttcgcctctttctttccttccccccatctccaagtctgtaagcagttggacaaggctatttagaaaggcttggagagacaccctagggggattgaaggtcctcagcctcagtggttagacattatcaatgacacacatcgagtgtactgaggtatattggtgctctcttaaaacacatttatttcctttcctcatgcaactaccagtgtcttttaaaaagagaggcagacgatgtctactgaaggcaaaatagagaattgaattaatcacttggataatccaggcgttgttgctctcccttctagctgctaaaaaaaaaaaaaaaaaagtgaaatttgaacaatttggactggctatctatctgtgattaaatttgtaagatatcaactaatcctataagctgttgcttgacttttcattctaccggtgttaacaaagatggatgcgcacacctgaatgggcctccagtggaggtcgttatatgggttaag

SEQ ID NO: 112238 - DNA, 762 bp, Homo sapiens
aatagaaatgttattgaatataacatacataaagaaagtggcacaaatcataaggatagaatcctaatgaattttcacaaagtgaactcccatgtaactactatgaagatcaaggaggagtactggcactctagaaggccccttatgctctcacccagttattaccttctgtcaggtaaccacaatcttgacatctattaccataacttaatgtcttctgttttttgttttttttgttttgtcttgttttgttttttgagatggagtctcactctgtcaccaggctggagtgaagtggtgcgatctcagctcactgcaacctctgcctcttgggttcaagctattctcctgccttagcctcctgagtagctgggactacaggcacgtgccaccacgcccagctaatttttgtatttttagtagagacagggtttctccatgttggccaggatggtctcgatctcttgacctcatgatctgcccacctcggcctcccaaagtgctggtattacaggcgtgagccactgcgccaggccctgctttctaactttaaataaatgtacccttttgtgtatggtttctttcactcagtattatgtttatatgctccttccatgtcatatgtagcagtaattcattcattctcatcgctgtgtagtattgcattgcacagatttacaaccatttatttatcctttctactggttcccaaattttgactacaaacagaactagaattacccagtcatagtttatgcacgt

SEQ ID NO: 112239 - DNA, 417 bp, Homo sapiens
aatagaaatgttattgaatataacatacataaagaaagtggcacaaatcataaggatagaatcctaatgaattttcacaaagtgaactcccatgtaactactatgaagatcaaggaggagtactggcactctagaaggccccttatgctctcacccagttattaccttctgtcaggtaaccacaatcttgacatctattaccataacttaatgtcttctgttttttgttttttttgttttgtcttgttttgttttttgagatggagtctcactctgtcaccaggctggagtgaagtggtgcgatctcagctcactgcaacctctgcctcttgggttcaagctattctcctgccttagcctcctgagtagctgggactacaggcacgtgccaccacgacacagtgcaccatgacacag

SEQ ID NO: 112240 - DNA, 387 bp, Homo sapiens
attttatggttagtatctgaaaaattaaactttataataggacttagtgtttgcgaagattttaggaaacaaatattttatatagaagaaatccctgtatttttaacatcacaagaaatgggtaaattactagatgagagtttttttttttttcctagattccagatggaaacattatttccataattagaattaaaaattgatcccgatattttaattttattattttattctgtatttgattttaaacattcttaagttcttggtcccaggaagtagagattattgaacataatttatagacagtaaatggcaatcatcgtatatattggattgaaagaaaaatacagcatacactgcttcaaaagtaaatgttttctttaaagg

SEQ ID NO: 112241 - DNA, 698 bp, Homo sapiens
tgcagtggctcacacctgtaatcccagcattttgggaggccaaggcagccggattgcctgaggtcaggagttcgagaccagcctggccaacatggtgaaaccccatctctactaaaaatacaaaaattagctgggcgtggtggcacacgcctgtaatcacagctacttgggaggctgagacagaagaattgcttgagcccaggaggcggaggttgcagtgagctgagatcatgcccctgcactccagcctagccaacagagtgagattctgtttcaaaacaaaacaaaacaaaacaaaattatttgttttcttttcttttcctacactaggatttcagtgtttaggtttacagagaagaagatacttgaggaggcaaaaaggagtaaaattgcagttccttttttttctaatagttacttttttaattaaagaagaaaatagttctatagtcattgttccatttgggaaatcaatgtttgataataaaagttctgttggtggctcattttttaaatctgggttgaaccctgtttctctcctagttgataatttgatcctcccatctcagagtttagtggttgatccgtaaaatgaaaaagatgtattgatccaattacctaatcattcattttgtcattctacaagtttctatttgaaataagccataatctcagcctcacgtatctgataaaggagg

SEQ ID NO: 112242 - DNA, 177 bp, Homo sapiens
ttgtggctaaaagtaaatactctggagacagaatacacctaaccagctgggtgaccctggacaaattacataaaatcttcatgctgcagtttcctcatctgtaaaatgaagataaaaacagtaactttagaagattgctgtgaggattaaccaagataatgcctgtcccatggtaaa

SEQ ID NO: 112243 - DNA, 542 bp, Homo sapiens
aagccccagacaccactgtcaacaacactatctgccaggtgacagccactagaattgcaggcacaggacttgggtagaagcatccaggtctcaaatcgaccctaacctcctctccagctcactaccgtgggtggaatgctgttctccccagaggtggccacattcgggatgtgggaaaactgaggggcccaggggcctcagtgctgacctagcattgctgctccagcattgctgctcccagtccctcccatcccagccctctccttccagacagatggaaagattgctggagcggggcacattgacctgtgtcattcaagtacaatttatagagcaaggaagggagggaggaaagtgatggagtgagggcatccagggcccaggctggactcccgttctatgcttggggtctcagtttggtctgctcaccccagcctttctccaggccccatccatgatcctgcctccacctgccctggttcccttatacccagactccagccacagccatgtgagaagatgtcacacacatactcaggcac

SEQ ID NO: 112244 - DNA, 274 bp, Homo sapiens
acaagtcttgcacattttctgtttaatttattaactaaatgtttcataatttttgatgatgttataagtatttttaattgcattttttggattacaggctgccgccactgcacctgcctaatttgtatattttttttttagtagagacagggtttcaccttgttggccaggctggtctcgaactcctgacctgaagtgatctgcctgcctcggcttcccaaagtgctaggttcacagacgtgagctaccacacctggcggatctgtagtttttt

SEQ ID NO: 112245 - DNA, 564 bp, Homo sapiens
actgaaatagctatttctgatcacagtatgccattaaaaggtattaaacagaaggtttaaggcattttagatcttcaactcttattataacctctagcctttcaaggaccaaaataagtgtttgtgcatttactgatttatttaggttcattgtgtaccttatcagaggccaactgaaacttatgggattgttatctgaagactaacagacctttagataccaacacattctaatctcttcaaggctggtcctactatggcccacatctatgggagcttattagagatgcagacttaccagcctcacctcgcacctacgagtcagaacctgcattttaacaagatccctaggggatgagcattcacatcaaagtctgaacatcaccactcttgcactgttctaacaattattcaggaatatctatctgaatttttatttttgagaaaataagatttaagctttctgagaagaggatcattccttttttttttttttttttgagacagtggctcactctgtcacctaggctggagtgcagtggcacaatcatggctcactgcagc

SEQ ID NO: 112246 - DNA, 894 bp, Homo sapiens
cctgcctcagcctctcgagtagctgggactgtaagcatgcaccaccagcctggctagtttttgtgtttttagtagagccggtgtttcaccaggttggctgggctggtcttgaactcctgacctcaggcaatcctcccacctcagcctcccaaagtgctgggattacaggcgtgagccaccatgcctgactggtagtttgtgtctttcaaaatatttgtctttatcatgtaagttgttaaaattatgagtataacattgttcataatattcccttatttttaattttggatggttctataatgctgttttgttttgtttcattatttatattggtaatttgtgtcttatttcttggtcagtctggctagaggtttgacaattttattgatcttttcaaaatacctacttttgttttcagtgacattctttattctgttttctgtttcattgatttctgctcttattttaatattttcatccttttgtttaccttgagtttaagctcttttgatagttttttttactggaagcgagattattcattagagaccacagatgcaatttgctattaccacattacatctttccttactaccttttcagttttttcaataagcaaaataacataagacacctttaaattagctaaagtatgtttccctttgtatgctcttgcttggttttgttaggaattcatgtgtaggaaaatactaaatgtatttgccacagacctgtgtctcattagctcagggaaagtgggaaagatcctcaatattaagaaaacagaatctgatttttctgaccttgttagaagtgtcataccaattcattgtggtaagtaatggctcaggcaagtctgttatgataatgccgttttagatgattaatgtaggt

SEQ ID NO: 112247 - DNA, 378 bp, Homo sapiens
aatcggacatctctgtacgctattcttacagagaatacccctgggagtaggattgtctcaaacaattccacatgtctgcttctcagggacctgtacccaccaccctgtccttccacaaagaatgtaactaagcaaaaaccctagttctgtagcaatgaccgcatttgagaacgagcccacaccccgcacttagttcaccatcatttctcttggcactgcaagaaggaggtcagaatgcagttatgttgcggggaggtcactgccacattgcagatcttttgctcataatgaagcttggcaagttaggctgggagacggcagggctgtctcatcggtgttggtttagtcgctatgggtgggtcagaacataaggggtac

SEQ ID NO: 112248 - DNA, 762 bp, Homo sapiens
taattttaaatatatgcattaatttggggcaggtaaccacgtttgctgaatgcctgcctgtcactgataaaatcaacaactttccacaaaatatcaactaaaaatgctatagtaggaaagcctgaattgaccgataactgaggaagaaatggaaagctattaaagaactgcctgttccctcaaagggtagcaggattggatggattttttcatacattcttccaaggatcagataatccccatgttgtatgaactgtttaaaaacatataaaaatcagtctcagaggcaaaatgattcggtttcctaaatccattgccgtctccccccaactccctcatgtgcagtgattatgtcttattcaacatcgaatctctgtgcctggcttgtaggaggtgcacaacgtgttgattaatctgagaggaacgtggcacaaccaaagacagcttgcagagcagccagccccagcctctgatgttataaatgtagatgtgctggtggtgggccagttctgtcgtgggcttgggtcagacctcacttgaggactgtgattactcttgggctttaagctttgagaggggagaggagaaattagaaaaggaaatggcgggcctcgtatacaggatttatgagcaggttgtctgaaaataggatgagttgcctcacataatagtatttttcctatcatcacacaagcttaagcagagtcttgggtgatactgtaggggggcagtcacatgcttcgtagtggattgggctggatt

SEQ ID NO: 112249 - DNA, 283 bp, Homo sapiens
tagtaagagcagcgtcagacaggacagtctaaaaaggactcaccattcccaaccccagggggctttcctgctacactaaaggagaacacatccatccacatttcaccttaaccttcctctactaagttctggataaaataccttacttatgaataaataataacaacaatcataactcctttagagagagggacctgtcaaatgtactctactagagatgccatcttttcccagccctccacatgcagtgcacctgcacactctgtcccaatggaagagcagg

SEQ ID NO: 112250 - DNA, 495 bp, Homo sapiens
ttagtatacatggggttttgcgacgttggccaggctggtctcaaactcctggcttcaagtaatccgcccacctcgacctcccaaagtactaggattacaggcatgagccaccatgcctggcctctatgattatgttttaaattttgagtagtatcccctttaccttgaattataatagaatgtaatatataaagcttttattataaattaagtcagaggaacgctagtttgaattgtatagttatggtttacatgagtaaagggttagtactaaaaggaagaatgcttaggtagaagtaaaaaatcatgaatatatcttgcttagtgcttatcttaaatccttagctgagaattatgtgactctgcctttaacattttttcacaatctataccaagaaagtataccattacattcatgggaaacgattgctccaataataaatatatattaagaaaatctgtcataaatcaccatactgtttgcaaaaaaaaaaa

SEQ ID NO: 112251 - DNA, 391 bp, Homo sapiens
ttgagattttttgtttgtgattcttttttttagttcatcagctattgttagtgtattttctgtgtagcccaagacaattcttccattgtggcccagggaagacagaagattggacacttctgatctagaatattcttcccctctccattgatacatttatattcacacttgaggttttagcctaaattttactttctcagtaaaccttcattgactacttctaacataagatccgcctctgccactcctatcaaggctttatcaaacagcttccgactaagctaaaagaaacactctatgcattttaaaagtagtgtatttaatagatctgattcattgcactggtgatggaagagttgaaatgccaaataggggactgtgaggcaactta

SEQ ID NO: 112252 - DNA, 391 bp, Homo sapiens
gtttcctttattataaaactgtagcactctcagtgagttctgtgagccattctagtgaattactgaacctgagggaggtcatgagatcccccaaatttgtagtcagctaggcagaagtacaggtagcttgggatacctgagattggtggctgatgtcagatgtgaaggcaatttggggactgagcccttcgcatgtggggtctgtgctaactccaggtgtttagtatcagagaggaattgaagtgttgggcacccagttgaagtcatagaatcagtgtcagagcatacacaccattatcacaatccaatatgaggaacctttgtggagtgatggaaatctgaaatctttcagttctttacttacctgatctctttgcagcactggacatgg

SEQ ID NO: 112253 - DNA, 918 bp, Homo sapiens
gctaggggctgacacttaataaatccatgtgaatggatgcaggaactctgctccgatctgttctatctgcttagtttttgcatacaattttgtttgaacaaagaaccacgtggtttatctatcagtcagggctcagcaggaaacacatggcacatatataattgggataatttgaggagagtttagtaaaggaattgtttacaaaggtgtgggcagggtgtagggaacccacacaggagggtataactggggtctagtgtcagcgggcgccatcatcattcctaggccagatgagggaaggttaagagttaatggccgggcgcagtggctcaagcctgtaatcccagcactttgggaggtcgaggagggcggatcacaaagtcaggagatcgagaccatcctggctaacatggtgaaaccccgtctctaccaaaaatacaaaaaattagccgggcatggtggcgggcgcctgtagtcccagctactcgggaggctgaggcaggagaatggcgtgaacccgggaggcggagcttgcagtgagccgagatcgcgccactgcacttcagcccgtgtgacagagcgagactccgtctcagagaaaaaaaaaaaaaaaaaaaagagttaaggggagaaggtgacgaggtagacaagatccttggctgagaccttcagtgaagggatgcagccaatcctcagagaccctggcaggcaggagcagggggaataagtacgctgactccatctccccttcccctgatttccttctgggcctccagttggcagaaccaaatcggaaggcggagggcaagacagtccattgaagtccacatggggagaagggtggagaggcaatgtgggggttgcggggagcaccaaaagaagatgcccgacagagatggctagcacccccgcccccac

SEQ ID NO: 112254 - DNA, 893 bp, Homo sapiens
gctaggggctgacacttaataaatccatgtgaatggatgcaggaactctgctccgatctgttctatctgcttagtttttgcatacaattttgtttgaacaaagaaccacgtggtttatctatcagtcagggctcagcaggaaacacatggcacatatataattgggataatttgaggagagtttagtaaaggaattgtttacaaaggtgtgggcagggtgtagggaacccacacaggagggtataactggggtctagtgtcagcgggcgccatcatcattcctaggccagatgagggaagtggctcaagcctgtaatcccagcactttgggaggtcgaggagggcggatcacaaagtcaggagatcgagaccatcctggctaacatggtgaaaccccgtctctaccaaaaatacaaaaaattagccgggcatggtggcgggcgcctgtagtcccagctactcgggaggctgaggcaggagaatggcgtgaacccgggaggcggagcttgcagtgagccgagatcgcgccactgcacttcagcccgtgtgacagagcgagactccgtctcagagaaaaaaaaaaaaaaaaaaaagagttaaggggagaaggtgacgaggtagacaagatccttggctgagaccttcagtgaagggatgcagccaatcctcagagaccctggcaggcaggagcagggggaataagtacgctgactccatctccccttcccctgatttccttctgggcctccagttggcagaaccaaatcggaaggcggagggcaagacagtccattgaagtccacatggggagaagggtggagaggcaatgtgggggttgcggggagcaccaaaagaagatgcccgacagagatggctagcacccccgcccccac

SEQ ID NO: 112255 - DNA, 265 bp, Homo sapiens
caccatgttgctcagactagtcttgaactcctgcaatcctcccacaaagtgctgggattacaggcgtgagccactgcacctggccacaatcttccattttaacttgtcaaatttattagcataaacttgtttaaatattcctttattatccttgcatgtctgtagtacttgtagtgaaagaattccctttcatttctgaaactggtcatttgtgttttttctgaatcagactagctagaagtttatcaattttattgatcacact

SEQ ID NO: 112256 - DNA, 473 bp, Homo sapiens
tacgaaatcccagggctttcccttgccacccttctcattgtctcctgctatcatcaggaagttatttatgattttaaaaagaaaaagcccagcctgggcaatatagtaagagttggtctctactatacttttaagaaaattaaaaaatgttcttaaaattagccaggtgtggtggttcacactgtgtaatcccagctacttgggaggctgaggtgggaggattgcttgagccctggagacagaggttgcagtgagccgacatcatgccactgcactccagcatgggtgacagagtgaggccttgcctcaaaaaaaagaaaaaaaaaaaaaagaaaaaaccctctgttatattgcacttaatcccattttcttttattccagctatcctggactgcaggtcagttcatcagttataatccctccctctgttcctatcctcctttctttgagtgaaacaattctacttccttaaa

SEQ ID NO: 112257 - DNA, 379 bp, Homo sapiens
cttcgaatcttttgtgtttcaaggagtttattggagatctgggctgggatgggctgggcttcctgacctgaatgttctctgagactgaaaaaagagaaacacatccttccaaatcaacctaccatttcaactcctttatctcttggtaatttgagtcctgaaccccaccacaaatacctctttgtgtgtatatgtgtgtgtatgtgtattttgctgctttcacattttttccatatcaaataaattggctcttatacaagttctatataaagactgttttggagaaaaagaggagagggaaaaaatgctttctttttctttcctgactcaacccattacatgattccctttgacctttgtcttcattttttttctctca

SEQ ID NO: 112258 - DNA, 273 bp, Homo sapiens
taaagtgaagataaaatatccaatttcgctggattattatgaggattaaatgtacataacaccattaacacagcacctgtgtcataacgatacactcattaaatggtaatactaaaaacaaagctttgttgatgaccatcaaactctccagcctctcttgaatcctggcctcaagctgcagtattctcttaacagactctgcacgtcaatgatttgtggctttgaaaatgcaataccttgtttttttcctgcaatgctcttctggcaaactcc

SEQ ID NO: 112259 - DNA, 446 bp, Homo sapiens
ttcttccaatccatgagcatgggttttgtgttccatttgtgtcatctatgatttctttcagcagtgttttgtagttctccttgtggagatctttcaccaccttggttaagtatattcctaggtattttattttattttattttattttattttcatttttgcagctgttgtaaaagggattgagttcttgatttgattttcagcttgcttgttgttggtgtataaaactgtatgttctcatttataagtgggagctaaactgtgagtacctaaaggcatacagggtgatataatggacttagaagagaccttgaaagggaaggttgggaagggggctagggataaaaaactactcgggtgacaggtgcaccaaaatctcagaatctaccactatagaattcatccatgtaacaaaaaaccacttgtacccccaaagctattgaaat

SEQ ID NO: 112260 - DNA, 1201 bp, Homo sapiens
acacaccaagttgccatctcttcaaaaaaggaatctagagacatcagtgtgtgcacaagcatggtttgtgaatttggaagtgtgtatgtgcatagttgtgctcaagaatgtgttgatgattataccttctcagaatgaaggtaattttttttttttctttttttttgagatggagtcttgctctgttgccaggctggagtgcagtggtgctctcagctcactgcaacctctgcctcccggcttcaagcagttctcctgcctcagcctcccaagtagctgggactacaggcacacaccaccactcccggctaattttttgtgttttagtagagacggggttttaccatgttggccaggatggtctcgatcccccgaccttgtgatccacccgccttggcctcccaaagtgttgggattacaggtgtgagccaccgtgcctggcctgaaggtcatttttataaagatctctccacgtcttagatttgattcttcctttaaatatttttctcattgacatttgaaagcacctgaccttatataaaatgaacaattttcataactccataaaaggagaattatggcatcatctatttctttctcttgtctcataaatctaaaccatcaacctgcttatttttgtatactgtcacactgtgtattccctgcattgaatgcctgtctgttgacattatctgtaaaaattgtgggaagttttctgcaccctgaaatttctgttatgcggattaaatatccactatccatgtttttccaagtcttacagtagaaagggtaaatgcagccctcacagcagcctgttgttcgtcctgcaaatgtgtttccatcacattacacaaagcctctttgtcttcgtggttctaccctactaataagttttttaaaaaattatgtaatgtgtgtatatacaaatacctatatgtatgtgtgtacacatacagctgatatctgctgagattatgtatgcatgaactatagaattaacttgtaattttaagaaaataaattattttgtaaagataaatctcatgtttaagaagaggaattacagttgaatcatttagggatgcctcagcctaaacataatatggaaaaagccataaccaaaagtcattttagagtactgctaggttactcaacctatcatcacatttaattaaaatgtcagtttgaaccatgaaaaatc

SEQ ID NO: 112261 - DNA, 216 bp, Homo sapiens
cgtcgactctgacatcccgtatgcatctgtgctcaaatgtcttctagtcccaaatgttcagcattcctcaaccttggcaccaccaacacgtggaacaaagaattctctgctgggtgtggggttgggaggggcccatcctgcacacagtaggacattcagcagcatccctgggctccacccacgggatgctgggagcacagaccccagcccagtcat

SEQ ID NO: 112262 - DNA, 216 bp, Homo sapiens
cagtttcagtttcgcaaaatgaaaagcattctacagactgattgcacaacaatgtaaacagttaatgctactgaactgtacacttaaaaatggtgaagacggtaaatttcattttacgtatattttactacaattaaagtttttaaagatgttttttaagaagtaatgtgggaggctgggtacagtggctcacggttgtaatcccagcactttggg

SEQ ID NO: 112263 - DNA, 380 bp, Homo sapiens
cctacgtttagaagttcaatagcacctagttttagaagtttcaatagcatttcataaggctcaaactcaagtaatcattcacattgttatctgacccagtctattcagtatctagtggtgaatgattacttgagtttgagccttatgaaatgctattgatcactgtatttagataacacccaacctttgggacttcaagaaattttaaagcatacaatgtaaattctatgtatattctaacttggagaaaacttggaacatggtaattgggggtcatgagttaggtataaagatgaacattcactttgtttattactgtttttcactgacactactctagctacatccaatttcttgctgtatttcagacataccacagc

SEQ ID NO: 112264 - DNA, 327 bp, Homo sapiens
caccgtaagtgatggcgtgtgagcagtgacgcatccacagccagctaatctgtattgtgtaaaaacacacaaaccacaaattatttttaaaagggaagaaagcagaagaacagatgcagcaaactccttgtatcacgtgaattgaggagaaaaactccaccagatgcgtttctgagcaacagcagagggaacactagcatgcccagatggggcagggagttctgtctgcctgcttctctggggaagacacctttctttgtgtccaatttccaggacagtgacactgtctatttttgtgtgcatgtatttcttctttctctttcttta

SEQ ID NO: 112265 - DNA, 755 bp, Homo sapiens
tgaagaaatctgagttctgatcttaacctagcctcttgtcagctgtgtgaccatgattcctctagatccatatttcctaattgcaaaacaagaaaattgtgttatttgactttcttccaaatagtctgaggcattaataatttcaaaagtcttttatagtattatttcttcaaaacagcatattttggtttctttcattcttctctcctattgctatgcaataaaaaaaaattcagcctgaaagaagtaccatttaattttcttttgtttaaggggctgtgggaaattgaagtagaacatttatcaggtgcccttaggctacaaactaataatggaggaaatggccctgaatcttcctagcacctgtgggccttgccttagaagatgcctgacaaggacagttgaaatatttagtggtacttgatgtgctagagtatgaaaccaagtgtaatttcagcaatttcgagcccatcgaacttgcctagctagtgcagttagtatagcccacaaatggttatgaaggaagcagttaatagtaatggtttcctgtattacttggcatattttgaaagcaaattaattttaaaattttacttttaatgctagcttatttgtgattgtctttcctcccaaacttgatacttgaatttgtattaggtttccacttttaaggcaattctatatattttgtttcatattattgccagtgaaagctatcttatagtattgttagaacagtgaaacagaggtgaaag

SEQ ID NO: 112266 - DNA, 532 bp, Homo sapiens
ataaacaacagacatttatttcttatagttctggaggccaggatgtccaagatcaaggtgccattagattccgtgtctgctgagggcccacctcctggctcatgaatgatgccttctagctgtttcctcacacagtggaagtggcaaggcagctctctgggactctttcaaaaaggcactaatcccattcaggagggctctcccctcacgacctaatcacctctcaagggccccaccttctaacaccatcacattgatgattaggtttcaaaatatgaatttgaaggaggacatacacattcataccatagcagaggagaagaaaaattaagcatgttttgccttaaactcttaagaattctacacacacacacacacacacacacacacacacactacactacactacagcttatatttaatgctgaaagtctgaatgctttccccctaagagcaggaataaggcaaaggtgtccattctcaccatttcttttgaatatctcactggaaacctgggccagtgcaacagggc

SEQ ID NO: 112267 - DNA, 284 bp, Homo sapiens
agacaccattggctggcaatctaacagtcatttctccctttcttccttgctaagagaatcccaatttgtccaacctcctttgggtgaccacatccttcagggaggctgggttattccaaaaagtcttgagtattcttatcaaggtagttttattatcctaggcaaattaactgctttaggcttagactcgtgacccaatttttgccaatatgatataaagtacagtctgtttggggacttctagaaatgtcttcccattctaaataaaggaaaaaaaaaactgg

SEQ ID NO: 112268 - DNA, 456 bp, Homo sapiens
tttgcttgttcacgcatggatgtggtcattaatcccccagatttgagcctctagaaaaatctgggcagcaagataagtgttctgagttctgccaagctcatcaacttctagaactctcttttgagaggatgtggtagtgactatggctccctttacatataactgttttcaaatctaaacatctaactagaaataatttgttccacagtgatagaaaagtgttgctgttactcactggggcagtctccagcattattccactggtgtccccatttaaaattacctttaatacacctcagttttatttacttgccagtttataacatccttaggaaaagagattctaggattaagcaaaacaagggatgtttttaaatactgtaactttttttttttttttttttttttcctttggagacagagtcttcattctgtcgcccatgcttgattggccag

SEQ ID NO: 112269 - DNA, 433 bp, Homo sapiens
gcctcagacaggccacagtctcccactggactgagcacctgggagtacaggccacgctcacggttcacagaacaggctcaggagtaacaagtgaccatgggcctgctgctggggctcatagtcccccgtggggaccctgattcctctgattgtgggtgatttcaaatctccttagagttctgcatttcatgacatttctgcatggaatatgctttatttttaaagtaaaaaaaaacctaagtgctcccctccctttcattttttgagatactctgtcaccgaggctggagtatagtgccgcagttacaggtcactgcagcctcgaactgccaggctcaaagaatcctcccacctcagactcccaagtagctgggactacaggtgcacaccacctgcctggcttacttttttttttttttttttaacttttttt

SEQ ID NO: 112270 - DNA, 1692 bp, Homo sapiens
  misc_feature (392)..(392): n is a, c, g, or t
atgaaaattgggttaccctgaggactcttgcttaactgaaatcacaaatggagcagacagaaaaatcaaaagtatatgctgagaacggactcttagaaaagataaagctttgcctttcaaagaaaccactgccatctcccactgagcgaaagaagtttgaccatgactttgccatctccacttcctttcatgggatacacaatattgttcagaaccggagcaaaattcgcagggtgctctggttggtggtggttctgggctcagtctcacttgtgacatggcagatctacattcgcttgctcaactacttcacatggccaaccacaacgtccattgaggttcaatatgtggaaaagatggagttcccagctgtgacattttgtaatttgaanaggttccaaacagatgctgtagccaaatttggtgttatttttttcttatggcacattgtatccaaagtcctccatcttcaagaaattactgccaattccactggctctagagaggctactgattttgctgcaagtcaccaaaacttcagcattgtggaatttatcaggaacaaaggtttttatctcaacaatagcactttgttggactgtgagttttttggaaagccatgtagcccaaaggattttgcacatgtcttcactgaatatggaaattgttttacttttaatcatggtgaaactctccaagcaaagagaaaagtgagtgtctctggaagaggtttgagcttactcttcaatgtgaatcaggaggcattcactgataacccagcccttggtttcgttgatgctgggatcatctttgttatccattcaccaaagaaggtgccacagtttgatgggttaggcttgttgtcacctgtgggaatgcacgcaagggtaaccatccgccaagtgaagacagttcatcaagaatacccttggggagaatgcaatcctaacatcaagctgcagaattttagcagctacagcacttctggttgcttgaaggaatgcaaagcccagcacataaaaaagcaatgtggatgtgtgccttttcttcttcctggatatgggatagaatgtgacctacaaaagtacttcagctgtgtttctcctgtacttgaccacattgaatttaaggatttatgtacagtaggaacacataactctagctgccccgtttcttgtgaagaaatagaatacccggccactatttcttattcctcttttccaagtcaaaaagctttgaaatatctttccaagaagttgaatcaaagccggaaatacatcagggagaatcttgtaaaaattgaaattaactatagtgacctaaactataagataacccagcagcaaaaggcggtgagtgtgtctgagttacttgcagatcttggtggtcagctgggtctattttgtggggccagtctgatcacgatcatagaaattattgaatatctattcaccaatttctactggatatgcattttctttttgctgaagatatctgaaatgacccagtggactcctccacctcagaatcatctgggaaataaaaataggatagaggagtgttaatggtcacttagaataaaatagtttccttttcatgataccttcagatttatcttgactaattcattgttacgtcacttttctatagttttgagagttcgataaaagccattaaagatatgtatctctt

SEQ ID NO: 112271 - DNA, 162 bp, Homo sapiens
caccatcactgcagcctcaacctcccaggctcaagtgatcctcccacctcagcctcccaagtggctgggactacaggcacacaccaccacactcagccatctaaaaaaaatattttgtagagacaggttctctctatgttgtccaggctggtctcaaactcc

SEQ ID NO: 112272 - DNA, 783 bp, Homo sapiens
caaacgtgaaaggaataaaggagaaaacaaaagcaacagtgattctgagggttgtagcatggatggctggaaggatggtggtgccattgacagagaagggacacagatgaggaggaacaaacctgcctaggagttccatcgtgaaggtgggtttagacacagtgaatgtgcctgcaggtggaatgcccagtggataggcacacttaaaagatctggtacttggaaaataaatctgggctgtacatatctatctgagagttaacagtatatatatattgatagtatcagaagctggagaagggccttgaggaagtgaggttgtccagggagaatatggagagtgaaaaggaagagagaaaagagtggagcctgtggaacatcagcatccagggtgcatatgctttggaaaaggtctggaaagctctgctgaaaagaggaaattctaaggatggctgaaaatacttggttagagagggaggaggaaaaccaggaaaaagcaatattgccaaaactaaggaaagttttaagcaaggagggaatggtcaataacggctatgaagtagagcctgaaacgctggacttgactgtcatgaggacattagttgtcttgtggaatcatttcctggggatgaggtggggcagaagataagagtgcagtgagtcaggagtgcgtgaagcaggaggaagtgaagctaagtagacaactctttcaggaactttggctacacacagaagaagagagatggggtgagagctaaaggttagaagtggttgggaagtgtg

SEQ ID NO: 112273 - DNA, 413 bp, Homo sapiens
tcactctgtagccaggctggagtgcagtggcttgatctcggctcactgcaacctccacctcctgggttcaagcaattctcctgcctcagcctcccaagtagctgggagtacaggtgtgtgccaccatgcccagctaatttttgtatttttagtagagacggggtttcaccatgttggccaggacggtctcaatctcttgaccttgtgatccacctgccttggcctcccaaagtgctgggattacaggcgtgagcaccacgcctggctagtggcatagaggaaggtctaatgaaaatgatcaaaggtctgacaagtgactctacctttaatgataaaaagatggttccttgatgggcagaacatacagtacaccagaatgaaagcaggaactgacggctccacttcctgcagtt

SEQ ID NO: 112274 - DNA, 350 bp, Homo sapiens
tcactctgtagccaggctggagtgcagtggcttgatctcggctcactgcaacctccacctcctgggttcaagcaattctcctgcctcagcctcccaagtagctgggagtacaggtgtgtgccaccatgcccagctaatttttgtatttttagtagagacggggtttcaccatgttggccaggacggtctcaatctcttgaccttgtgatccacctgccttggcctcccaaagtgctgggattacaggcgtgagcaccacgcctggctagtaagtaaatattaatttatttttaaatatttgatattataaaatacctaaaagcagtaagattgatcattaactataatag

SEQ ID NO: 112275 - DNA, 450 bp, Homo sapiens
tttatgtgtcctacaatatatttgcaatcatagtcaaccatcttaaagacgacagaggaattgaatgcatcttcttctccctcaaactattttgttactatcatctgatttctattctttcaggtgatttgccactttaaaaggcagtaagtttataaaagaaattctcaattaacaatctagttaaaggaacctagacattggcacataaagcaattttatgtcattgtttcaagatgctaaagaattcccttggctgggcatagtggctcactgaggcctataatcccagcacttctgagaggctgaggtgggcggatcacctgaggtcaggagttcgagaccagcctggccaacatggtgaaaccctgtctctactaaaaatacaaaaattagctgggtgtgttggcacacacctgtaatcccagctactcaggagcctaagacaga

SEQ ID NO: 112276 - DNA, 287 bp, Homo sapiens
tcattccagggaggtccatggggggtggccatgaataaactcccatgcccatgctaccctctgaagtggcagacaagcagctttcccaggtgggattacagccaaccacagttgagagcggcttctaaccagccctacctgaggtgggactcgaactcagattctcagcaaaatccacattctgaaacagcctgagtttccctgtccttatgatcccaactcttcttttgggtgtggggttcacatggagggcatgggagctctgaatgagtttttccaagcaggta

SEQ ID NO: 112277 - DNA, 202 bp, Homo sapiens
caccacacccacctgctttttaaaagtattgcacaaagacattatttatcatgatcactgagcttttgggagacccttaaattttgcactggaggtatgcgtcttgttgacctcaccccagtgctggcccctcatgtaaccccaggagcatcagacactgttactgccagcccccagccacggggcctggagtaaggagagt

SEQ ID NO: 112278 - DNA, 726 bp, Homo sapiens
attccaagtgatttctgtcacccgccggcggaccgagagtctagggttcggggcgcgcaggctgcctcggcgcagacctcttcccctcagggaggccgtctcctgaccagacccactcctgcctcccacccgggtgccgtgtttagggttattttaggctgctcacctgacagattgtacacaagcccttaattgcccccctctgtttgaggtcgtggtgaggtttcatatttcgcagccacgctcaaattgtgccgtcatgttacagttgtaggtgatgaaataccggctgcttagacgcgggatcggtttttataccggggcaaacgctagtggtcccagaatgcagagttgggggcctcaaggaatccgggtgtgctgagataattggttaattgcttgattaaaattggggattaattttagagttcttccactcggagctcgcttctgtgctgaagatgctttgcaacgccttgaggaaaacgcgccaaagaagtttctgttagacttgagttacaagattgcagatttttcttgatttgctagtatgtttttttttacgttcgtagagttttataggtagatagataactttggttcgggtagttttccttttaaaatttgtagagaactgaaagtggctgatatgttagcttttttagggggacggggtcggggaatggagtctcagtctgttgcccaggctggagtgcagtggcgcga

SEQ ID NO: 112279 - DNA, 308 bp, Homo sapiens
cgtatttgggtacttataggacactatttgtaaaaacatttatttcttcagacattgatggtcttgtcccagttattaacaacatttacttgtttaagaataaattttcttttctatctacttctttttccattgaaaattacctttctatcctcctactctggaagtctttatgattctgtcctaataattagtgtcccattgcttcttcaagagatgtctatcagaatttctccattaatataagttgatacttctatgaaaactttaaatctcaagtctacagtatttctagttctaaaaaatat

SEQ ID NO: 112280 - DNA, 435 bp, Homo sapiens
ggcctagagttttaatgtgtggtcagactgtttattgattaattggttttcaagagggaaacatgttctttcaggacatagggtctctaggacaaaaataactttaaaagaagaggtggagatgttagagaacactctaataactcctatcacttcacagctgggaaacctgaacccccaaaggggtaagagattttagaaagtttcaccaaattccccatttctctggacagaattggactctagatggaggactagacattttcccctagagccgtgtttccccagggcattgagaggtgttaggagatgcaagggctccatggccgtacatgtggcaactcctaaattaaacattccctaaatgcaggacttctcagagcatttactctgctaacaagtggtctgcttttctaagagctggttaaggtaggt

SEQ ID NO: 112281 - DNA, 466 bp, Homo sapiens
acacaaagaaaacttgttttactgaatataacacacatgaagaaaactgcacaaatcatcttcaccaaatatttattaagcaggccctctcacctacttaatcgtagataagatcttcactgtcttgatcctataataggagagtgagacaataaacaaattaataaattagacggctcaaatgccaaatagttatttgtattgtgtggatttaagataggattatatgatagtgactgagttgccactttaaattgagtagatctggaagacttctgaagaagaggcctttaacctgagatcttattgtcgtaagaaaagcttgtcagaggaagaacattctagtctaggtatcagttggtagaaaagccttgtggtaaaagcagctttgatactgaaaggaggccagcatggctgaagcatagggagtaagaggagagtggtttgagataaagttggagaaata

SEQ ID NO: 112282 - DNA, 403 bp, Homo sapiens
cagccacctacaaggaagggggtgttgttactgtatgcttatacacactgaggaaactgaggctcagagggttcgacccattaagctgttgggaactgaagtctggccttcctactctaccccaacacattgtgagctgagcagaaaaaaaatggctgcttcctttttcactataggaagcattctcactgtaggaggtaagatcattcacatttgaagaggcttccattccctagtctcttttccattcatctcatctgtaaaatgcagacaacacttctcactttgcagggcatgtaaggataagtgataacatgtatgagtgaccagctgcatgctggtcacggtcaaaactgagaccatggcagtcccagctgttggtggctggcaatgtgtcctcttc

SEQ ID NO: 112283 - DNA, 865 bp, Homo sapiens
  misc_feature (499)..(499): n is a, c, g, or t
cagggtggttcatttcccagccctgggtcaagggcctgccttcgcctcagggactctcttcctttggatgagggggtccttgggtttcccagctgcttcctgctcagctgggccaccccctcccaccctggggttggggaggagcagggagtgggtgcccacagttttcctttgcttctcccagagctggtttgcacagcccttgtgtgtggggctagaatgtgccttagtcctgaatcctagcccttacccccatcctctctagacggtatgtcctgacataacagcagagtctggtgtggtgctggtgagggttcgccagccctcccctccccagggtcatagagggggccatgaggctggaattggccagtgactgaatcttggagatgtcggccaggtgctcccattggggtttctagcctgccctagggggaggtggtgatgttgggagtgggatctcctgagtccttgttgggcagaattggtgaggccaggnatggcagggaaaagtggtaacaagcctctctgcccatctacttccaatccctctctcccttactgattttttgatgccctgtcttctgggcccctaggagggatgagagaggagtagccccctttttcagagagtttggggtctacctcagagctctccctgtcaaaaagcagctgcaagcctcgcaagggtggagtggggggagactgaggaccagtagtacctgcagggtgcccgtggctgtggccagtgtcccttagccaacctgctgggctcaccagttccccgtctgatctgcctgtgcgcctcccattcttctctacccagaacctgtcatgggctggggctcagattttcctggctttg

SEQ ID NO: 112284 - DNA, 415 bp, Homo sapiens
tggggttgtcaatatggctgcgttgggatctgttcaccttcaggctgagtcgagactgaggtgaaaaagcggaaaaacgcgagaaaaggtttccccgttgtacagaggctagagtgaggctcggctgaatcggttgcaggcgttggtgcctctgtcagcgtccaggtcactgccgctcccgccccgctcttccctggctgtgctggcggaggctgcgccgatgaacctgactgagggttcatagcagtggcagcaatgcttatggatgctggacaggattatatggtttttgaggacgtggccatacatttctcccaggaggagtggggaattcttaatgacgttcagagacacctgcacagcgatgtgatgctggagaactttgcacttttgtcctcagtaggtaaggccctga

SEQ ID NO: 112285 - DNA, 417 bp, Homo sapiens
cttatatttgatgcccatataagccctattagttggcaatccttttaatctctattttacacataagggcaccgagacttaaggaagttcagtcctcatcaagacactgaaccctgaggacttactgtgtaccctcagataactttgctctagttgcagggccagaggtggttgtacagtcagcctgtaggatgctgcaatgctgtcttaatcctcatggcctgcctcttcccacagggttcatagcagtggcagcaatgcttatggatgctggacaggattatatggtttttgaggacgtggccatacatttctcccaggaggagtggggaattcttaatgacgttcagagacacctgcacagcgatgtgatgctggagaactttgcacttttgtcctcagtaggtaaggccctga

SEQ ID NO: 112286 - DNA, 364 bp, Homo sapiens
aattaagagaacctattgtttttgagagcattctgaagcttgaacttctctaccctctgtttcaaaaaaaaaagtaagcttatttggggagagttttagagctctgttcttatgaactgcctctccccttgggtaaattctttaagtcactcttctggaagctggatggggaagtctttttactcggagttggagggtgtgagaaatgctctgacctatgctgtgggtaagaaactgtatcccttgactggaggctgaggggagagggagccctgaaatggtagccacatccacctagagtggagcttttgtcaagctaagttgagattaggagaaagggaaggaatgggtttacctcaaaagt

SEQ ID NO: 112287 - DNA, 448 bp, Homo sapiens
ggtttatcggccaagcaggttcgaaggaagagctaaatccttatgaaaccctccactatacctcatggaaagttcccagagacttaaaaagcagcacgtgcaaaaattaggagtggtggtttcctattgctcaattgtaaggcagaagccaatgcatgaagatggaaatgtgactaagagggctttgaagacaaggtataaatagccagtgtgctcaatcccacctcttcccttctcacctaccacttggcagataaagccagaactctggggcttcttgtggtgtattgtcacctcctcctgtggttaaccgagacaagggtgtggctaagaagtccaaattattcatcgcattaaaagatggctgcctgtttaacccctgcatgtgatagcttcacatagaagaaaacatttctgtaacctccagatgcaatccttactctgctca

SEQ ID NO: 112288 - DNA, 196 bp, Homo sapiens
tttttttttttaggaaagagcatactttcagaacaaggatctctaataatcaatttatcttttttttaacaaggatattatattatcattatttttgctacttgaatgtagaataatttttaagaattgaccgtatttgggagctgatgatctactctccggacaccatttagccccctgaaaactggctcttcct

SEQ ID NO: 112289 - DNA, 588 bp, Homo sapiens
tacgaaatgccaatggaattggttttagctctgaaaattttgagactatatatgaacggacagaaaagtagtaagtgatttccagttggccaaatctaagaggtggttggtacacactaaagattatttattgggattgttaattgccctctgctattgtattctgaaatacagtatagccaaaaatgtaaataaatacttaaaatatttacataaattagtagatagtaaggaatccaagatatatggatttggcctaacctttgaggtttatataaaggcgaacagtcggtgtttttcacagtgcgatttttattttaattttaacttttaaaatttgttttgatttgatacagtactgctctggataggttttggatcagacttgctgtgacagttcttgcactccctaaggtgctgtaccaagggcatgctattttctgtgtgaggagccctatcagatacataaaaacaaacaacatcctttgagatatatctaaaaataggatatgaattttgtaaaaagcatagcaataaattccaagtgtgtgatcatagtagagcattagtaatgagagaaaggatttg

SEQ ID NO: 112290 - DNA, 376 bp, Homo sapiens
gaaagcccagatgccccatgcagagagaaagaggagcaccatcccccactgcatgggaccaggacaattaaacgagacaatgtgtgcagcgaagaacagcgaatgacactgggcccaacatcttctgaagctttggtggccatcagtgaggaagggaggctgttttccagcaagaattgttttctctagacccgtggttctcaatggaagtgccagggtatccccactcccaatgtgaggacatgtggcaatttctgcagacattttgggttgtcacaggtggtctgggggtggtgtgctactgacattactatttggaggaaaactgttaaaaagaaagaaagggcctggtgcgctggctcacgcctgtaatccc

SEQ ID NO: 112291 - DNA, 812 bp, Homo sapiens
agttcaagcagttagtcttaatatcactatttgattaaatatatgcaagttttggaagctttctatgtttatggacaagtgatcctctcaggctttgccttatttctgtgactcagagataacaaaatataaattctaagtcctttctattttttatgaaacctatttgtagggatttgagttacagaaaaatacatactttctttacatttatgaccataactaacaacagggctactaaataggaaatttagtgaaggtcactcagccatgaaccaatgtgagtttgtttttaatattttattaaattttattcatgtgccaggttgttaggacacaaaaagggaaccagaaatcagacagttgtttaaaaacattaaacaccctgatgaggtttgcatccttgtggttttctctgctgccctgatagttctttaaggttctgtcattttcaatcaacagagagtacatgtgatcagtatatctgataaacttgtcaatgcctctttgaagcagtattccctgacctattcaagtcagacccccctgcttcatttcaagtatcatcttgataagacagagctatgtcacaggcagctgtgtatagccagctctgtgtacaactaatttgtgcaggaaaaaattaaatcaggaggtaaattatttcatgattgctcattcccaacagagttgggcatcattctgaagaaaatatcaaataattggtttcagaccgtgtcagacacatgcaattcccttctctaatggctgtgtgtggtagcaccaggcctcaggggtcagcaaggaactgg

SEQ ID NO: 112292 - DNA, 1039 bp, Homo sapiens
ctggtgtctgccacaagcctgatcactccaaaaagcacatttttaactaccacaaaacccgtatcactcttagaatccaccaaaaaaaccatccctgaacttgatcagccaccaaagctccgtggggtgctccaagggcatttggagagctccagaaatgacccttttctccaccccgacttttgctgcctcctccccctgggcttctatgtcttgggtctcttctggctgctctttgcctctgtggtcctcatcctgctgctgagctgggttgggcatgtgaaaccacaggccctggactctggccaaggtgctgctctgaccacagccacacaaaccacacacctggagctgcagaggggacggcaagtgacagtgccccgggcctggctgctcttccttcgaggttcgcttcccactttccgctccagcctcttcctgtgggtacggcctaatggccgtgtggggcctctagtggcaggaaggaggccctcagctctgagtcagggtcgtggtcaggacctgctgagcacagtgagcattaggtactctggccacagcctctgagggtgggaggtttggggaccttgagagaagagcctgtgggctctcctattggaatctagttgggggttggaggggtaaggaacacagggtgataggggaggggtcttagttcctttttctgtatcagaagccctgtcttcacaacacaggcacacaatttcagtcccagccaaagcagaaggggtaatgacatggacttggcggggggacaagacaaagctcccgatgctgcatggggcgctgccagatctcacggtgaaccattttggcagaatacagcatggttcccacatgcatctatgcacagaagaaaatctggaaagtgatttatcaggatgtgagcactcgttgtgtctggatgttacaaatatgggtggttttattttctttttccctgtttagcattttctagttttccactattattgtatattatctgtataataaaaaataattttagggttgggagtga

SEQ ID NO: 112293 - DNA, 391 bp, Homo sapiens
atcgtatgaaaactttttaatttagagacatcatactataaaataaaattttgtaagcacattcacagtaaaggtgagttagcattatctgtgtgaccttgggcaaattgcttacaggtgtcttcacctgtaaaaatgagagtttaggactaggtaaagtttcaggggacttctagctgtataatgctatgaattgataatcaagtaccttaggggtcagaagacttcggttatctttcagtttcatatttgatctattagacaatatcaacaaagcataagctactgatgctggtgttgccaggttgggttaccagcctgcttggtgccaggtggggtccccttaggttagtatacttaccctcagaatgtcctgtgatcacttcttata

SEQ ID NO: 112294 - DNA, 184 bp, Homo sapiens
taagcagaaaaattatcttaaagttcaccatgttccttctattttttaagataaagaaacgaagattcggattgggttagtgtggcatccgtgattgaataggtactcagtagtaaaaccagtatcagacattatttataaaaaattagaagctgaaacttaatcattccgctgcttctttatg

SEQ ID NO: 112295 - DNA, 724 bp, Homo sapiens
cttgataaactcacaagataggtcgtattcttgtccctatttttgagacggtgagatgcaatggagtcagccaacccagttccaccacataccagtagccttggccaaatcatgtgcttcatctttaagcctcagacaagacctaccccatcaggttgttgttgcaaggaacaagtgaagtaacctggcacccagctgttgcccagcacatgttaggggctgacttgcctaaggctgcactgagagtattttgcaagtggactaaagttgaactgctttgggaagatatttggcttcttactttgtaagttggagtaaagattgtttctaaatctagttcttttcctttttgtctctagattaaactcttactatatcattcagttaggagctctcatgtttagccaacgttctcagaaagtgatcagttcaagggctgtggcatggaggggaagtgatgcaagctttattatgatacagatgagtaaccatataaaatggaaaataatatttgttctccccacattcccatcccctcttaccaacctaatatttatctatctatctattttgaaatatttgaggcagagtctctctctgtcacccaggctagagtgcagcggtgcaatcatagctcactatagcctcaacctcctgggctcaagcagatcctcccacgttggcctcctgagtagctgggactacaggtgtgcactaccatgcc

SEQ ID NO: 112296 - DNA, 536 bp, Homo sapiens
ccctatgaacgcatctaatatgatttctgcctacagtagatgcacgctagttttctctcttccttatttcttggtcacaaattctactctctcatcacaacgttatttggtgaatgaatgaaggaaggtctttacatacccaaatcctccctgctcttgatgatcccctacttctctcaagtcgacagttcaagtgcctgcatcgaatagccactgagcatcactctgggcagagagcagagctaggcctcacagactccctgatgaccacagtccctgttgcaaaggattttctggtctaatgagggaacaggcaccgtgagagaaacaagaggatggataaaatgttgtcagctggagagatgttcagaattattttgctcacccacttacacattttccttcatttccgaagtaagcatttactgcaggaagaggacgtggccacccctcacccctggtgatgggtctggggacttctaaaggaagccctttttgtttgacatccttgtttctatttgctgtgaagtgatcta

SEQ ID NO: 112297 - DNA, 462 bp, Homo sapiens
acctcatagcagcatagtcaatagtggagcatgactgagtagtgtccacagcttccacccatgaaatagcctcttgggtgggggtggccaatgaaggcatttccatgcagtagctcatccatatcaccagtccatccccatgatggaggtccatgacaagacagttctgagccatcaggagcatttactcaaggagaacggggtgtgtatatcacagtgtttccaaagtacgttgcactgaactttaatccaatgagaataaatgattctctggagaagtacataatatactccctttagatatgtgcagtacacattagtttttaaagggctccaaggtgttctatagttaaagaaacctatttaacttttcaactcattgtttcccaaacttaccatgggatctccctacttttttgcataactcttattaatattcataagaaccatggtctgtgcctt

SEQ ID NO: 112298 - DNA, 309 bp, Homo sapiens
agttggtggtggtaagagtgaagaggaaaacttcttgcgatggtgggtcgtggagggcaggtgcagaggaagtgagagagctggagggctgggatatgtgagtgaaggatttctagtgaagtctttctgggtgatgatgaaaatcggggtgtgcgcctgagggtgggggtgaaagtctgttgagtgtagcaagcaggggaactggggtatttgtatttgatggattgtccttcttgacattgacggtacccaggttgcactgagctgagatcacgccactgcactccagcctggacgacagtatgagac

SEQ ID NO: 112299 - DNA, 873 bp, Homo sapiens
ttagagagttatgaagcagctgccaggggatgaagtggcattctgtattacatgatgaaaacatgctgatgaaccaagggaatgcagagatctcatttgaacttaatcacacatgtatacactatactgctagtatatgtgcattttaaatctattatataattttgcattcagccttcatataatcttcttcaggcaatgcagtattacctgactgaaaatatggggagaatgatatagtaaaattgagtgtttttctatccgtgtagtatcaattacctaaagcctttaagtttgaagggcaacacactatgaatgcaaccaaaaaagcacaatatatgcatgtgaagtagtccatacattgtagtgttaccttatttggatggctgtagatgttctgtttcaatgtcaccccaagaataatttcatcagcattcaatgtcatattactgatcatctgctgtccactcagcaccacactatgcattttatttttaagtgtaatcctcagaacagctctcagaatatcggtattactttcttcattaaacagatatggaaattgaagccaccatggttaagtaacttgtcccgggttcacacagttggcatgctgtagaggtaagatttaagcaaaagcctgtctgaatgaagcacctgttttttcactctaccccatggtttctcagttgctggagggatgtagaaaacaacggaggggggaagggcctcctgacatcatgcacatgtgagatccactagtcagcttgctcctgctgaatactctttctggaccgagctaaatttgcagatatttgctcagttaaagcctcttcaggatttaatctcaagcgtctaccattttgctagatc

SEQ ID NO: 112300 - DNA, 850 bp, Homo sapiens
cacgggttttttgtttgttttggggtttttaggttatttctttttagagagggagtctcgctatgttgcccaagctgatctcaaacttctggcctcaagtgatcctcctgccttgaccttccaaagtggagagattacaggcatgagcccgtgtgcccagcctagtcataggttttaatggatttaatttcccaccaaattaccaactccactcttatgaaaatctagagagtttattactaataaaaaagaattgattacatgttttatttcacacctagactgaactcctagtacagtgaattagagacaaattcataatttattgaaattccccttgctgtgggcacatatgtccatagtagatgtagcatttggtaggagtttcaagaaaagcagggtaaatatttcagtgaattctcatacagagttaagaaaaaacttacatgaaatataaaatcttagacaggatacacttatagacaactaaggataatgatgagtatcaggtagcaaggaatatattcttcagctaggttcataagatattacccattaaagctaggcgcggtgggtcatgcttgtaatcctagcactttaggaggccaaggaaggtggattgctggagctcaggaatttgagaccagcctgggcaacatggccaaaccccatctctacaaaaaattcaaaaattagctggatgtggtggcaatgcctgtagtccaagctactcaggggttggggggttaaggcaggaggatcgcttgaacccgggacatcgaggatgcagtgagccgagatcgtgccactgcattccagcctagttgacaaagtgagactttatctcaaa

SEQ ID NO: 112301 - DNA, 297 bp, Homo sapiens
ctgaaatgccactctctcaatgaggcttcctggacttccctatttaaaattgcaccccctcctgacattctccattccttttcctacttatttttttctcgcttaacacttaccaccttcagacaagctatgtaatatactcctacaataccttcattgtcttcctttgccagaatatcagccccttgagggcagagatgcttatctctttggttcatagctgtatctccagcacctagaccagtactgggtgtatagtaggtgctcaataaatatttgcatatttggccaggcacg

SEQ ID NO: 112302 - DNA, 326 bp, Homo sapiens
ctgaggctggggctgggacccaggaataggcagtccccaggaaatacaggcagagctgggctgagagagcatggctgaagccaggaccaggtgaggagagagtgaggcagaggttagaggcagtgggggttcccaaggacatcaggacattagaggacaaccgcacagctgagggagtgtcagagcatccaggagcatgcagggctcgagggcaagcctcaaggagtgggtcggcgtgttcaggggcgtttctgtgaacactggggtgctagaaatgcatcactcagagaaattgtgtcaaggggtcaaggagaatctgggggtgt

SEQ ID NO: 112303 - DNA, 388 bp, Homo sapiens
cgaatgttcttaaactgattgtggtgatggtagcacaattctgtgcatatactaaaaaccactgatttgtatgctgtaacaggtgaattgtatgctctgtggattatatctcaaaaaagctgttgcagacataaaatggctaggaatgtttggcaggggaaaaagcgatttccaagagaataggtatcaggttcttcaattataatgctctttgctttccatttgcttttatgctcatttccaacaaaaagaaggcagtcaacacattaggattacacactggaaatccacagtatcctcagaaaataataaactgctgatttgcttttacgtggctttatgaaattagaatctaaacgaagaaggcatttcattttatcatttaaag

SEQ ID NO: 112304 - DNA, 348 bp, Homo sapiens
atctgcccacctcggcctcccaaagtgctggtattacaggcgtgagccaccgctcccggccaaacatgattactatgattttaaatggaaacaaatgattcatgaaataccgtttaattactactactaataaaatagctttagcgtataaatctttgagtcaaatgtgtatgtactttttaatctccttttaatatcaaacctatttatggaacacttgtcccatttaaatgtatgttttctgttgatcagtttgacttacttacctaccgaggtcagactttggatattataggtattctcctgaaagtatccctccactattttctcagcacaccgggctgtatg

SEQ ID NO: 112305 - DNA, 463 bp, Homo sapiens
aggaattatactaggaagtagcggtaaaggaagtgagaaggcttagtaaatagaagaaatgtgaacttatcaaagtggctagagtagacccctggagattcttgattaagtgaattaactagattttagaaaggtaatgaggcagtcatatgcaaggaagatttcaaagtctggagacaagaagtcaagcaatactttgagaagtggttgagctttatgggaatggagagaattacactattgagagatgttaaaaataatgaagagggtttcaccatgtgaaattgtgtttttcatttgaatctgagaaacaaatgagcagagagagaggctggagataattatgtctaaaagacagtggggtacagggagcataaaggccagggagaaagggaactgcaggaattagtgctgagaagcaggagttagtggaggaaggaggagatccagtcccagatacagg

SEQ ID NO: 112306 - DNA, 724 bp, Homo sapiens
ccaaaagagcacatcttgcttcatcccatttatatgaaatgttcagagtaagcaaatctacagagacagaaaatagattagtgtttgctgagggctggggatgctgtgaacaggaaatggaaagtgattgctaggagtacagagtttattttggagatgataaaaattttctaagctcaggttgtggtgatggtgaattacacacttttaaagggtaaatttcattcattgacgtttgatgtgattgttggtgtgtttggattaacatctgtcatttttgctgttttctgtatgcctcacatcttttttcctccttttattctccctttattgccgtctttctgataagcagatattttctagtgtttcatttttattttgttgggttttaaaaaactttcttttttttttttttttaattgggtctctagggatcacagcatgcgtctaaatttatcacagcctacttcagattaatattaaaacttagttctagttaaatatagaaattttgctctaatatagtttcattttcttttccctcttttgtgttattattgtcacatgttacaagccccacagtatggttttataattattttatgaaatcttacatcttttaaatcagtcgagaagaaaagaaaaaatgtatttatgccatcttttatatttgcccatgtatttaccttttctcatgttttttctttcttattgtaaattggag

SEQ ID NO: 112307 - DNA, 324 bp, Homo sapiens
ggctaattttttgtgtttttagtagagacagggtttaaccatgttggccaggctggccttgaacttctgacctcaggtgatcagcccaccttggcctcccaaaatgctgggattacaggtgtgagccaccgcgcctggccatgtgttgttataaggcagtaaatttgtggtaatttttgtggagtaatggataatgaatacaattgtatattagtcatttttgtataagcctcacttctttgggtgagcagggatcatattctgtctgtgtcctcatgtctagaacagtgtctggctcatagctggtgtccagtaaaattttaa

SEQ ID NO: 112308 - DNA, 338 bp, Homo sapiens
ctggtcataccaaggtaaatacagaattggggaataagtgttaggaaacctttaaagcaatgtgacgctgcagtgtgtctaaatgtgtgagaatggactcccttggagcagggcataggccagttatgtgtgagtcatacgtggtgcttgctgagtgctgaccaggcaaactatggtcaggtccatgacagactggaaatttaggaagaaagccaacaacaggtcattcactgcaaattcacgccctggccaccacaagggttcatgtgtgggcatccattcttacattgaaactctgtgattttgatactctgatgcaaattaaaggatgttaaaat

SEQ ID NO: 112309 - DNA, 616 bp, Homo sapiens
ccattctgtagcctatgctcggagggcacatgagcaagagcttgaccatctgtaccgttggttgacttgctctattaagggctatgatttcaggtcgtcctgcgtgtttagaggaggcgagtggaatcttgagtctcggctggagaaggcagagcacgggcatgcagacctcaaagcctcaaacctgcgtgtgagaggagaagttggcgagctccagcgtatggtccacggttggtactctaggaagatacaagacaacagcttctgcgaaccagtaagagtggcctcattagacattggatttgccagtgacttgatcatggacttcccagtctccaggactgtgagttataaaggtctttcaccatatttgctgtccttgggcaagatcagagtcatctttggaaggaaaagcatctctggattttgttaaataccatcttaggaaagtactctctgctcttcaaagtcagcgacgacatgagtcactgttacagaacccacagaatgtgtcccttaaaatactgagaatgaacactattttactgcctgcataattagcactagacaggtgaatttattactacttcattaaatagatgagtttattaactca

SEQ ID NO: 112310 - DNA, 342 bp, Homo sapiens
ccattctgtagcctatgctcggagggcacatgagcaagagcttgaccatctgtaccgttggttgacttgctctattaagggctatgatttcaggtcgtcctgcgtgtttagaggaggcgagtggaatcttgagtctcggctggagaaggcagagcacgggcatgcagacctcaaagcctcaaacctgcgtgtgagaggagaagttggcgagctccagcgtatggtccacggttggtactctaggtgcgagctgaggacaggggcttttgtttttcgcgctcccaggtagcgccagcacctatagtagctccaggagcacagaaggcgttaagtgtgcattgg

SEQ ID NO: 112311 - DNA, 3036 bp, Homo sapiens
gcccagttggagccagacagcggggtggacaagtggcgtgtgtgctgcgaccccgagggaagatgaacgggacgcggaactggtgtaccctggtggacgtgcacccagaggaccaggcggcggcgggcaggaagacctatgccatggtgtccagccactcagctggtcattctctggcttcagaactggtggagtcccatgatggacatgaggagatcattaaggtgtacttgaaggggaggtctggagacaagatgattcacgagaagaatattaaccagctgaagagtgaggtccagtacatccaggaggccaggaactgcctacagaagctccgggaggatataagtagcaagcttgacaggaacctaggagattctctccatcgacaggagatacaggtggtgctagaaaagccaaatggctttagtcagagtcccacagccctgtacagcagcccacctgaggtggacacctgtataaatgaggatgttgagagcttgaggaagacggtgcaggacttgctggccaagcttcaggaggccaagcggcaacaccagtcagactgtgtggcttttgaggtcacactcagccggtaccagagggaagcagaacaaagtaatgtggcccttcagagagaggaggacagagtggagcagaaagaggcagaagtcggagagctgcagaggcgcttgctagggatggagacggagcatcaggccttactggcgaaagtgagggaaggggaggtggccctagaggaacttcggagcaacaatgctgactgccaagcagaacgagaaaaggctgctaccctggaaaaggaagtggccgggttgcgggagaagatccaccacttggatgacatgctcaagagccagcagcggaaagtccggcaaatgatagagcagctccagaattcaaaagctgtgatccagtcaaaggacgccaccatccaggagctcaaggagaaaatcgcctatctggaggcagagaatttagagatgcatgaccggatggaacacctgatagaaaaacaaatcagtcatggcaacttcagcacccaggcccgggccaagacagagaacccgggcagtattaggatatccaagccgcctagcccgaagcccatgcctgtcatccgagtggtggaaacctgagctgcctggagatggttgctgccattgctgctgcctctgcctcggagaagcccactgcccctgttggctgttaacactgcctttgacttcctgactgtcccctggctgcacccaggacttcgggctcctgtgtctcaccattcccaagcccctggccactctaagctgggcagacggagcacgagcacctattcaaggcactgcagccctttggaagacattgtcctgcaagcaggagccagggcaatatctatattcctacagtgactatttttctctgtagagagcctcccttctgttgtagactggactctggctgcgccataagccaggccttcatcagattgggagaggtgacaagatttgcctcagccctaaaagctggagacacagatgtccagagtgattggagaatgtcctgggggaatgaagttccttccacaaacacagctcagttcttagcaacaaactgtttgtttttctacttgctccatctgcagcctacgctgccctggcctcctgcagacagatagtggggttacctggcaaggcctggtgagagccagtgaacctaagctttgactgggtggccttgtctttctggggaggagggaatgtacattcagggagtagccttttgcggaaaaattctctagggctacagacagtcatgtgtgacttctctctgctgtgaaaactcccagagtctctttagggattttccctaaggtgtaccaccaggcacacctcagtcttcttgacccagagcctgaaaactgttttcactgggttccaccagtcccagcaaaatcctctttgtatttattttgctaagttattggtggttttgcttacatctcatgattgatataataccaaagttctatagccttctcttgcagtatttggatttgcttgaaaccgggaaaactgttcccattaggcttgttaatgtcagagtgacactattatgaatctttctctccctttcctctgcctgtttcttctctctttctccttcaaacttgctctgcagctaaggaaggtgagtctactttccctgaggctttggggtcagagtatatgttgtttggagaaagagggcaatcaggactcttctgggacccagatgagttcttcactagcccttctgaaccccttgctccataattggtcttttatcctggctctgaatgaccctgcaggtcatcatggttttctttttttattgtttttttttttttctgagacagagtctcactctgtcacccaggctggagtgcagtggcgcgatctcagctcactgcaacctctgcctcccggatttaagcgattcttctgcctcagcctcccgagtagctgggactacaggtgtgccaccacgcctggctgatttttgtatttttagtagagatggggtttcaccatactggctaggctggtctcgaattcctgacctcaggtgatccacccacctcggcttcccaaagtgctaggattataggcttgagctactgtgcccggcccatggtgtttttctttagggctcttcctacagccttgagaagtagataggcatcagagtatggtactataggaatcagaaaaattcaaaacaaatgtggattaagtgtttaggctctatgtggctcacgcagccagaatccttaagtctgtgtgtttctgtgtctcaagactgggctcacattctggctttgtccataacaatgctctgggatttcagggagttccctcatttgtaaaatgagggggtcagagcaggtgatatccatgtttcttccctttctgatattgttgtctgtggcatattctttgtatggcgaatttaataaattatattaatgtgtctctttga

SEQ ID NO: 112312 - DNA, 761 bp, Homo sapiens
caggagttctgggcttgccatgtggtgtctgagccatctctctctctctctctctctctcatctctcttgggccaggcgggcaggaagacctatgccatggtgtccagccactcagctggtcattctctggcttcagaactggtggagtcccatgatggacatgaggagatcattaaggtgtacttgaaggggaggtctggagacaagatgattcacgagaagaatattaaccagctgaagagtgaggtccagtacatccaggaggccaggaactgcctacagaagctccgggaggatataagtagcaagcttgacaggaacctaggagattctctccatcgacaggagatacaggtaataggaaatggtccatggttgggtccccaccgaggaggtggggttgtgccaggcagtctcatttaccaattacccagtgtgtgctaaatctagcatccctgccaggaatggagaaaatagaggtgatgctggcttctctggagcactcacaatctggttaggactctccagccgatgagcacttacatttacacatgtcagcttaaacataagtacacctgctcctgaaacactgtacagaaattgaacttatataaattaaatatcatcagttgttagcaaacctcttatctataaggattctgtgatcaagcttcttataataatagaattttgtaaagcagacaatcacctgtaaatccacacttctcataagctgatcttgcttagtttgggtgatacc

SEQ ID NO: 112313 - DNA, 297 bp, Homo sapiens
gtctggtactactcggcctcacgacctcttcaacctgcactgtggccttcagtgtttaggctctatgtggctcacgcagccagaatccttaagtctgtgtgtttctgtgtctcaagactgggctcacattctggctttgtccataacaatgctctgggatttcagggagttccctcatttgtaaaatgagggggtcagagcaggtgatatccatgtttcttccctttctgatattgttgtctgtggcatattctttgtatggcgaatttaataaattatattaatgtgtctctttga

SEQ ID NO: 112314 - DNA, 2900 bp, Homo sapiens
caggagttctgggcttgccatgtggtgtctgagccatctctctctctctctctctctctcatctctcttgggccaggcgggcaggaagacctatgccatggtgtccagccactcagctggtcattctctggcttcagaactggtggagtcccatgatggacatgaggagatcattaaggtgtacttgaaggggaggtctggagacaagatgattcacgagaagaatattaaccagctgaagagtgaggtccagtacatccaggaggtggtgctagaaaagccaaatggctttagtcagagtcccacagccctgtacagcagcccacctgaggtggacacctgtataaatgaggatgttgagagcttgaggaagacggtgcaggacttgctggccaagcttcaggaggccaagcggcaacaccagtcagactgtgtggcttttgaggtcacactcagccggtaccagagggaagcagaacaaagtaatgtggcccttcagagagaggaggacagagtggagcagaaagaggcagaagtcggagagctgcagaggcgcttgctagggatggagacggagcatcaggccttactggcgaaagtgagggaaggggaggtggccctagaggaacttcggagcaacaatgctgactgccaagcagaacgagaaaaggctgctaccctggaaaaggaagtggccgggttgcgggagaagatccaccacttggatgacatgctcaagagccagcagcggaaagtccggcaaatgatagagcagctccagaattcaaaagctgtgatccagtcaaaggacgccaccatccaggagctcaaggagaaaatcgcctatctggaggcagagaatttagagatgcatgaccggatggaacacctgatagaaaaacaaatcagtcatggcaacttcagcacccaggcccgggccaagacagagaacccgggcagtattaggatatccaagccgcctagcccgaagcccatgcctgtcatccgagtggtggaaacctgagctgcctggagatggttgctgccattgctgctgcctctgcctcggagaagcccactgcccctgttggctgttaacactgcctttgacttcctgactgtcccctggctgcacccaggacttcgggctcctgtgtctcaccattcccaagcccctggccactctaagctgggcagacggagcacgagcacctattcaaggcactgcagccctttggaagacattgtcctgcaagcaggagccagggcaatatctatattcctacagtgactatttttctctgtagagagcctcccttctgttgtagactggactctggctgcgccataagccaggccttcatcagattgggagaggtgacaagatttgcctcagccctaaaagctggagacacagatgtccagagtgattggagaatgtcctgggggaatgaagttccttccacaaacacagctcagttcttagcaacaaactgtttgtttttctacttgctccatctgcagcctacgctgccctggcctcctgcagacagatagtggggttacctggcaaggcctggtgagagccagtgaacctaagctttgactgggtggccttgtctttctggggaggagggaatgtacattcagggagtagccttttgcggaaaaattctctagggctacagacagtcatgtgtgacttctctctgctgtgaaaactcccagagtctctttagggattttccctaaggtgtaccaccaggcacacctcagtcttcttgacccagagcctgaaaactgttttcactgggttccaccagtcccagcaaaatcctctttgtatttattttgctaagttattggtggttttgcttacatctcatgattgatataataccaaagttctatagccttctcttgcagtatttggatttgcttgaaaccgggaaaactgttcccattaggcttgttaatgtcagagtgacactattatgaatctttctctccctttcctctgcctgtttcttctctctttctccttcaaacttgctctgcagctaaggaaggtgagtctactttccctgaggctttggggtcagagtatatgttgtttggagaaagagggcaatcaggactcttctgggacccagatgagttcttcactagcccttctgaaccccttgctccataattggtcttttatcctggctctgaatgaccctgcaggtcatcatggttttctttttttattgtttttttttttttctgagacagagtctcactctgtcacccaggctggagtgcagtggcgcgatctcagctcactgcaacctctgcctcccggatttaagcgattcttctgcctcagcctcccgagtagctgggactacaggtgtgccaccacgcctggctgatttttgtatttttagtagagatggggtttcaccatactggctaggctggtctcgaattcctgacctcaggtgatccacccacctcggcttcccaaagtgctaggattataggcttgagctactgtgcccggcccatggtgtttttctttagggctcttcctacagccttgagaagtagataggcatcagagtatggtactataggaatcagaaaaattcaaaacaaatgtggattaagtgtttaggctctatgtggctcacgcagccagaatccttaagtctgtgtgtttctgtgtctcaagactgggctcacattctggctttgtccataacaatgctctgggatttcagggagttccctcatttgtaaaatgagggggtcagagcaggtgatatccatgtttcttccctttctgatattgttgtctgtggcatattctttgtatggcgaatttaataaattatattaatgtgtctctttga

SEQ ID NO: 112315 - DNA, 3499 bp, Homo sapiens
gcccagttggagccagacagcggggtggacaagtggcgtgtgtgctgcgaccccgagggaagatgaacgggacgcggaactggtgtaccctggtggacgtgcacccagaggaccaggcggcggcgggcaggaagacctatgccatggtgtccagccactcagctggtcattctctggcttcagaactggtggagtcccatgatggacatgaggagatcattaaggtgtacttgaaggggaggtctggagacaagatgattcacgagaagaatattaaccagctgaagagtgaggtccagtacatccaggaggccaggaactgcctacagaagctccgggaggatataagtagcaagcttgacaggaacctaggagattctctccatcgacaggagatacaggtggtgctagaaaagccaaatggctttagtcagagtcccacagccctgtacagcagcccacctgaggtggacacctgtataaatgaggatgttgagagcttgaggaagacggtgcaggacttgctggccaagcttcaggaggccaagcggcaacaccagtcagactgtgtggcttttgaggtcacactcagccggtaccagagggaagcagaacaaagtaatgtggcccttcagagagaggaggacagagtggagcagaaagaggcagaagtcggagagctgcagaggcgcttgctagggatggagacggagcatcaggccttactggcgaaagtgagggaaggggaggtggccctagaggaacttcggagcaacaatgctgactgccaagcagaacgagaaaaggctgctaccctggaaaaggaagtggccgggttgcgggagaagatccaccacttggatgacatgctcaagagccagcagcggaaagtccggcaaatgatagagcagctccagaattcaaaagctgtgatccagtcaaaggacgccaccatccaggagctcaaggagaaaatcgcctatctggaggcagagaatttagagatgcatgaccggatggaacacctgatagaaaaacaaatcagtcatggcaacttcagcacccaggcccgggccaagacagagaacccgggcagtattaggatatccaagccgcctagcccgaagcccatgcctgtcatccgagtggtggaaacctgagctgcctggagatggttgctgccattgctgctgcctctgcctcggagaagcccactgcccctgttggctgttaacactgcctttgacttcctgactgtcccctggctgcacccaggacttcgggctcctgtgtctcaccattcccaagcccctggccactctaagctgggcagacggagcacgagcacctattcaaggcactgcagccctttggaagacattgtcctgcaagcaggagccagggcaatatctatattcctacagtgactatttttctctgtagagagcctcccttctgttgtagactggactctggctgcgccataagccaggccttcatcagattgggagaggtgacaagatttgcctcagccctaaaagctggagacacagatgtccagagtgattggagaatgtcctgggggaatgaagttccttccacaaacacagctcagttcttagcaacaaactgtttgtttttctacttgctccatctgcagcctacgctgccctggcctcctgcagacagatagtggggttacctggcaaggcctggtgagagccagtgaacctaagctttgactgggtggccttgtctttctggggaggagggaatgtacattcagggagtagccttttgcggaaaaattctctagggctacagacagtcatgtgtgacttctctctgctgtgaaaactcccagagtctctttagggattttccctaaggtgtaccaccaggcacacctcagtcttcttgacccagagcctgaaaactgttttcactgggttccaccagtcccagcaaaatcctctttgtatttattttgctaagttattggtggttttgcttacatctcatgattgatataataccaaagttctatagccttctcttgcagtatttggatttgcttgaaaccgggaaaactgttcccattaggcttgttaatgtcagagtgacactattatgaatctttctctccctttcctctgcctgtttcttctctctttctccttcaaacttgctctgcagctaaggaaggtgagtctactttccctgaggctttggggtcagagtatatgttgtttggagaaagagggcaatcaggactcttctgggacccagatgagttcttcactagcccttctgaaccccttgctccataattggtcttttatcctggctctgaatgaccctgcaggtcatcatggttttctttttttattgtttttttttttttctgagacagagtctcactctgtcacccaggctggagtgcagtggcgcgatctcagctcactgcaacctctgcctcccggatttaagcgattcttctgcctcagcctcccgagtagctgggactacaggtgtgccaccacgcctggctgatttttgtatttttagtagagatggggtttcaccatactggctaggctggtctcgaattcctgacctcaggtgatccacccacctcggcttcccaaagtgctaggattataggcttgagctactgtgcccggcccatggtgtttttctttagggctcttcctacagccttgagaagtagataggcatcagagtatggtactataggaatcagaaaaattcaaaacaaatgtggattaagtgtttaggctctatgtggctcacgcagccagaatccttaagtctgtgtgtttctgtgtctcaagactgggctcacattctggctttgtccataacaatgctctgggatttcagggagttccctcatttgtaaaatgagggggtcagagcaggtgatatccatgtttcttccctttctgatattgttgtctgtggcatattctttgtatggcgaatttaataaattatattaatgtgtctctttgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaagaaaacaaaaaaaaacaaaaagaaaaaaaaaaataaaaaaaagcgaagaaacaaaaacagacagagaggggggggggggacaccaacactccgagcgacgaccccaaaacagcgggaaatgagagcagggacgacccacaggggacagagggaagacaaccgacagaggggggaggagcgtaagatataaacgagaaggtgggaggagagaagaagtacggagaggagaggaagagggaagaacggagaaagacgaacaagcaggggggcgaaaatgagggaggagcggaagagggacgaaggaaggagacagagggggagggaagaaaaaaaagagacggagccagaagggagcgaaaggaggcg

SEQ ID NO: 112316 - DNA, 405 bp, Homo sapiens
ttatattaatgtgtctctttgacctcctggtctggtttcctttcacttttcagggaggatgaaagaagaacattttagtgcttcttggaagatgggcaccctgttatccacatgtgggaggtgtggtccaaacatcccaaatgccatgatatgaggactttgtggcatttatagaggtattagaagaagctcacctccgtgctctgagtcgtgattgtaggaggcagcccctaactttagctttgaccctctctggagcaatggccttgtaggatccctaagcctggccgcattgtgtctcatttggaagagatagaggtagagtcctgtgattacatagagatagaacagcagcactggaggtagatgagtaactgcatgccttctgcagaaatgaaaagcact

SEQ ID NO: 112317 - DNA, 615 bp, Homo sapiens
tgtgatgacagttcttttttgagggtggtctggacgagatggtccaaaccagtgtgtgcctgggaggggggaccttttcttactgagtcagaaacttgagggcttccccttcccttccttgttctggctgtaggtggacacctgtataaatgaggatgttgagagcttgaggaagacggtgcaggacttgctggccaagcttcaggaggccaagcggcaacaccagtcagactgtgtggcttttgaggtgagatttgggatttggggagaaggtgccctaagggatgggctactgaacacaggtgccagtgatgtctcagcttggacttcctgtctttctggctgagtgccacaaactggaaaggcaaggctgtgaagcctggaacgcttgtctgcttttccctctcctggacgtttacactgtttactgtccaaggccagcccatagttcaaaggtcagctcgggattctctgctctgatgagtttgagggtggtgcccatctggggcagccggtgattcagaagtcatttctgtctgtgtcgtggtaagaatccctgggctcttgagactccgtgcaggcaaggactgctgctgacatgtcacccccgagtct

SEQ ID NO: 112318 - DNA, 3111 bp, Homo sapiens
gcccagttggagccagacagcggggtggacaagtggcgtgtgtgctgcgaccccgagggaagatgaacgggacgcggaactggtgtaccctggtggacgtgcacccagaggaccaggcggcgggcagcgtggacattctcaggctgactctccagggtgaactgacaggagatgaacttgaacacatagcccagaaggcgggcaggaagacctatgccatggtgtccagccactcagctggtcattctctggcttcagaactggtggagtcccatgatggacatgaggagatcattaaggtgtacttgaaggggaggtctggagacaagatgattcacgagaagaatattaaccagctgaagagtgaggtccagtacatccaggaggccaggaactgcctacagaagctccgggaggatataagtagcaagcttgacaggaacctaggagattctctccatcgacaggagatacaggtggtgctagaaaagccaaatggctttagtcagagtcccacagccctgtacagcagcccacctgaggtggacacctgtataaatgaggatgttgagagcttgaggaagacggtgcaggacttgctggccaagcttcaggaggccaagcggcaacaccagtcagactgtgtggcttttgaggtcacactcagccggtaccagagggaagcagaacaaagtaatgtggcccttcagagagaggaggacagagtggagcagaaagaggcagaagtcggagagctgcagaggcgcttgctagggatggagacggagcatcaggccttactggcgaaagtgagggaaggggaggtggccctagaggaacttcggagcaacaatgctgactgccaagcagaacgagaaaaggctgctaccctggaaaaggaagtggccgggttgcgggagaagatccaccacttggatgacatgctcaagagccagcagcggaaagtccggcaaatgatagagcagctccagaattcaaaagctgtgatccagtcaaaggacgccaccatccaggagctcaaggagaaaatcgcctatctggaggcagagaatttagagatgcatgaccggatggaacacctgatagaaaaacaaatcagtcatggcaacttcagcacccaggcccgggccaagacagagaacccgggcagtattaggatatccaagccgcctagcccgaagcccatgcctgtcatccgagtggtggaaacctgagctgcctggagatggttgctgccattgctgctgcctctgcctcggagaagcccactgcccctgttggctgttaacactgcctttgacttcctgactgtcccctggctgcacccaggacttcgggctcctgtgtctcaccattcccaagcccctggccactctaagctgggcagacggagcacgagcacctattcaaggcactgcagccctttggaagacattgtcctgcaagcaggagccagggcaatatctatattcctacagtgactatttttctctgtagagagcctcccttctgttgtagactggactctggctgcgccataagccaggccttcatcagattgggagaggtgacaagatttgcctcagccctaaaagctggagacacagatgtccagagtgattggagaatgtcctgggggaatgaagttccttccacaaacacagctcagttcttagcaacaaactgtttgtttttctacttgctccatctgcagcctacgctgccctggcctcctgcagacagatagtggggttacctggcaaggcctggtgagagccagtgaacctaagctttgactgggtggccttgtctttctggggaggagggaatgtacattcagggagtagccttttgcggaaaaattctctagggctacagacagtcatgtgtgacttctctctgctgtgaaaactcccagagtctctttagggattttccctaaggtgtaccaccaggcacacctcagtcttcttgacccagagcctgaaaactgttttcactgggttccaccagtcccagcaaaatcctctttgtatttattttgctaagttattggtggttttgcttacatctcatgattgatataataccaaagttctatagccttctcttgcagtatttggatttgcttgaaaccgggaaaactgttcccattaggcttgttaatgtcagagtgacactattatgaatctttctctccctttcctctgcctgtttcttctctctttctccttcaaacttgctctgcagctaaggaaggtgagtctactttccctgaggctttggggtcagagtatatgttgtttggagaaagagggcaatcaggactcttctgggacccagatgagttcttcactagcccttctgaaccccttgctccataattggtcttttatcctggctctgaatgaccctgcaggtcatcatggttttctttttttattgtttttttttttttctgagacagagtctcactctgtcacccaggctggagtgcagtggcgcgatctcagctcactgcaacctctgcctcccggatttaagcgattcttctgcctcagcctcccgagtagctgggactacaggtgtgccaccacgcctggctgatttttgtatttttagtagagatggggtttcaccatactggctaggctggtctcgaattcctgacctcaggtgatccacccacctcggcttcccaaagtgctaggattataggcttgagctactgtgcccggcccatggtgtttttctttagggctcttcctacagccttgagaagtagataggcatcagagtatggtactataggaatcagaaaaattcaaaacaaatgtggattaagtgtttaggctctatgtggctcacgcagccagaatccttaagtctgtgtgtttctgtgtctcaagactgggctcacattctggctttgtccataacaatgctctgggatttcagggagttccctcatttgtaaaatgagggggtcagagcaggtgatatccatgtttcttccctttctgatattgttgtctgtggcatattctttgtatggcgaatttaataaattatattaatgtgtctctttga

SEQ ID NO: 112319 - DNA, 3039 bp, Homo sapiens
  misc_feature (42)..(42): n is a, c, g, or t
  misc_feature (49)..(49): n is a, c, g, or t
tctagaggatcttgaagtactggttctcgtgcaccagagganaggcggngggcagcgtggacattctcaggctgactctccagggtgaactgacaggagatgaacttgaacacatagcccagaaggcgggcaggaagacctatgccatggtgtccagccactcagctggtcattctctggcttcagaactggtggagtcccatgatggacatgaggagatcattaaggtgtacttgaaggggaggtctggagacaagatgattcacgagaagaatattaaccagctgaagagtgaggtccagtacatccaggaggccaggaactgcctacagaagctccgggaggatataagtagcaagcttgacaggaacctaggagattctctccatcgacaggagatacaggtggtgctagaaaagccaaatggctttagtcagagtcccacagccctgtacagcagcccacctgaggtggacacctgtataaatgaggatgttgagagcttgaggaagacggtgcaggacttgctggccaagcttcaggaggccaagcggcaacaccagtcagactgtgtggcttttgaggtcacactcagccggtaccagagggaagcagaacaaagtaatgtggcccttcagagagaggaggacagagtggagcagaaagaggcagaagtcggagagctgcagaggcgcttgctagggatggagacggagcatcaggccttactggcgaaagtgagggaaggggaggtggccctagaggaacttcggagcaacaatgctgactgccaagcagaacgagaaaaggctgctaccctggaaaaggaagtggccgggttgcgggagaagatccaccacttggatgacatgctcaagagccagcagcggaaagtccggcaaatgatagagcagctccagaattcaaaagctgtgatccagtcaaaggacgccaccatccaggagctcaaggagaaaatcgcctatctggaggcagagaatttagagatgcatgaccggatggaacacctgatagaaaaacaaatcagtcatggcaacttcagcacccaggcccgggccaagacagagaacccgggcagtattaggatatccaagccgcctagcccgaagcccatgcctgtcatccgagtggtggaaacctgagctgcctggagatggttgctgccattgctgctgcctctgcctcggagaagcccactgcccctgttggctgttaacactgcctttgacttcctgactgtcccctggctgcacccaggacttcgggctcctgtgtctcaccattcccaagcccctggccactctaagctgggcagacggagcacgagcacctattcaaggcactgcagccctttggaagacattgtcctgcaagcaggagccagggcaatatctatattcctacagtgactatttttctctgtagagagcctcccttctgttgtagactggactctggctgcgccataagccaggccttcatcagattgggagaggtgacaagatttgcctcagccctaaaagctggagacacagatgtccagagtgattggagaatgtcctgggggaatgaagttccttccacaaacacagctcagttcttagcaacaaactgtttgtttttctacttgctccatctgcagcctacgctgccctggcctcctgcagacagatagtggggttacctggcaaggcctggtgagagccagtgaacctaagctttgactgggtggccttgtctttctggggaggagggaatgtacattcagggagtagccttttgcggaaaaattctctagggctacagacagtcatgtgtgacttctctctgctgtgaaaactcccagagtctctttagggattttccctaaggtgtaccaccaggcacacctcagtcttcttgacccagagcctgaaaactgttttcactgggttccaccagtcccagcaaaatcctctttgtatttattttgctaagttattggtggttttgcttacatctcatgattgatataataccaaagttctatagccttctcttgcagtatttggatttgcttgaaaccgggaaaactgttcccattaggcttgttaatgtcagagtgacactattatgaatctttctctccctttcctctgcctgtttcttctctctttctccttcaaacttgctctgcagctaaggaaggtgagtctactttccctgaggctttggggtcagagtatatgttgtttggagaaagagggcaatcaggactcttctgggacccagatgagttcttcactagcccttctgaaccccttgctccataattggtcttttatcctggctctgaatgaccctgcaggtcatcatggttttctttttttattgtttttttttttttctgagacagagtctcactctgtcacccaggctggagtgcagtggcgcgatctcagctcactgcaacctctgcctcccggatttaagcgattcttctgcctcagcctcccgagtagctgggactacaggtgtgccaccacgcctggctgatttttgtatttttagtagagatggggtttcaccatactggctaggctggtctcgaattcctgacctcaggtgatccacccacctcggcttcccaaagtgctaggattataggcttgagctactgtgcccggcccatggtgtttttctttagggctcttcctacagccttgagaagtagataggcatcagagtatggtactataggaatcagaaaaattcaaaacaaatgtggattaagtgtttaggctctatgtggctcacgcagccagaatccttaagtctgtgtgtttctgtgtctcaagactgggctcacattctggctttgtccataacaatgctctgggatttcagggagttccctcatttgtaaaatgagggggtcagagcaggtgatatccatgtttcttccctttctgatattgttgtctgtggcatattctttgtatggcgaatttaataaattatattaatgtgtctctttga

SEQ ID NO: 112320 - DNA, 948 bp, Homo sapiens
ggtgacagaggacgtagggaatcggctggtgctgacactattatgaatctttctctccctttcctctgcctgtttcttctctctttctccttcaaacttgctctgcagctaaggaaggtgagtctactttccctgaggctttggggtcagagtatatgttgtttggagaaagagggcaatcaggactcttctgggacccagatgagttcttcactagcccttctgaaccccttgctccataattggtcttttatcctggctctgaatgaccctgcaggtcatcatggttttctttttttattgtttttttttttttctgagacagagtctcactctgtcacccaggctggagtgcagtggcgcgatctcagctcactgcaacctctgcctcccggatttaagcgattcttctgcctcagcctcccgagtagctgggactacaggtgtgccaccacgcctggctgatttttgtatttttagtagagatggggtttcaccatactggctaggctggtctcgaattcctgacctcaggtgatccacccacctcggcttcccaaagtgctaggattataggcttgagctactgtgcccggcccatggtgtttttctttagggctcttcctacagccttgagaagtagataggcatcagagtatggtactataggaatcagaaaaattcaaaacaaatgtggattaagtgtttaggctctatgtggctcacgcagccagaatccttaagtctgtgtgtttctgtgtctcaagactgggctcacattctggctttgtccataacaatgctctgggatttcagggagttccctcatttgtaaaatgagggggtcagagcaggtgatatccatgtttcttccctttctgatattgttgtctgtggcatattctttgtatggcgaatttaataaattatattaatgtgtctctttga

SEQ ID NO: 112321 - DNA, 5549 bp, Homo sapiens
  misc_feature (1464)..(1464): n is a, c, g, or t
  misc_feature (2013)..(2013): n is a, c, g, or t
caggtgatcctctacgatcccgccgccggtcccccaggcagcgcaggcccccggcgagccgccactgctgcagttcccaagatgtttgccttcgatgccgtcttcccccaggactccgagcaggccgaagtctgctcggggaccgtggccgacgtgctccagtcggtggtcagtggggctgatggctgcattttttcctttggccacatgagcctgggcaagtcgtacaccatgatcgggaaggacagctcaccccagagcctgggcatcgtgccctgcgccatctcctggctcttcaggctcatcgaggagcgcagggagaggacgggcacccgcttctccgtccgggtctcagccgtggaggtgtgcgggcgcgaccagagcctgcgggacctgctggccgaggtggcccctggcagcctccaggacacccagtctccgggagtgtacctgcgggaggaccccgtgtgtggggcgcagctccagaaccaaagcgagctgcgggcacccacggccgagaaggcggctttctacctggatgcggccctggcggcccgcagcaccagccgagcgggctgtggcgaggacgcccgacgcagctcccacatgttgttcacgctgcacgtctaccagtaccgcatggagaagtgcggccggggaggaatgtccggaggccgcagccgcctgcacctcatcgacctgggcagctgtgaggcggcggctggcagggccggggaggctgctgggggtcccctgtgtctgtccctgtcggccctgggcagcgtcatcttggccctggtcaacggagccaagcatgtgccgtatcgggaccacaggctcaccatgctgctgcgtgaatccctggccaccgctggctgccgcaccaccatgatcgcccacgtgtcggatgcgccagcccagcacgcagagacactcagcaccgtgcagctcgccgcccgcatccaccgcctgcgcaggaagaaggccaagtacgcctccagctcctctggcggggagagctcctgtgaggaaggccgggcccgtcggcccccgcacctgcggcccttccacccacgcactgtggccctggaccccgaccgcacgcctccctgcctgcccggtgaccccgattactcctccagcagcgagcagtcctgtgacacggtcatctacgtggggcccggtggggcggcgctgtcagaccgggagctcaccgacaacgaaggtccgcctgacttcgtgcccatcatccctgccctgagccgccaccggccctccaagggtccccgagacgcagaccacttccgctgcagcaccttcgcggagctgcaggagcggctggaatgcatggacggcaacgagggtccctcaggaggtccaggtggcaccgacggagctcaggccagccccgcccgagggggccggaagccctcgccaccagaggctgcatcccccaggaaggcngtgggcaccccgatggctgccagcacccctcgaggcagttctggtccagacacccaccagggtacccctgagccctgcaaggccattgtctggggtgaccagagagaggacagcagcgcttggcctgagctgctggtcccggaaaaggctgcagtgagtggaggcaggaggccactgcccagcccggctcccccacctcctcagttgctggaagcctgcagagccccagaagagcctgggggagggggcactgatggagtggcacggacccctcccgtgggcatgagtgggcaggtggctgggtccccgatgcttcctggggccacctgcccccgcctggctgctggcagtcgctgtccggagcggggcctgctcaccaccacagtgaccctgcagcggccagtggagctcaacggcgaggacgagctggtgttcacggtggtggaggagctgtccctgggggcgcttgccggagctgggcggcccaccagcctggctagcttcgacagtgactgctccctgcgggccctggcctcggggtcccggccngtcagcatcatcagcagcatcaatgatgagtttgacgcctacacctctcaggcccctgagggggggcccctggagggggcagcctgggccggcagcagtcacggctcctccatcagctcctggctcagcgaggtcagcgtctgcactgccgacagccgtgaccccacgccgcagccccgcttcagccccgactcgctggcagggcttgaccctgggggcccccctgccctggatggttccctgggggatggaagctctgggttcctggggccagacagacctgacagtcctgggccaacctggggtccgtgccctggggaagtggctgcagtggccccatcccgacccggcagggagccccaggccgggccctcgcggtgggcatccgcagcccagaccatccactccagcctcccccggaaaccgaggactgcctctgccaccacccgtgtgggctgtgctcgcctgggccagagcccacctggccgtggaggcctgtttgaggacccatggctgctccgggtaggggagtgtgatacccaggcagcttctgctggcagggcccccagccccacacttggctccccccggctgcctgaggcccaggtgatgctagcctgtgcccagagagtggtggacgggtgtgaggtggcagccagggcggcccgcaggccagaggctgtggctcggatcccaccgctgcggaggggtgccaccacgctgggtgtgacaacgccagctgtgtcctggggagatgctcccacggaggtggtggcctgctcggggagcctgaaggcctcccccaccagcaagaagggtctggctcccaaggcgggcttcctcccgaggcccagtggggcggcccccccggccccacccacgcggaagtccagcctggagcagaggagcagcccggcctcggcccctccgcatgctgtgaacccggcgcgggtcggggctgctgctgtccttcgaggggaggaggagcccagacccagcagccgggctgaccactctgtccccagggccacgtccagcctgaaggcccgggccagcaaggtagaagcagcacaccgtcttgccggacacgcgtctctggagcggtacgaaggcctggcgcacagcagcagcaagggccgggaagcccctgggcggcctccccgggctgtacccaagctgggtgtgccaccctccagccccacacacggtccagctcccgcctgtaggagcggcgcagccaaggctgtgggggcccccaagccccctgttggtggaggcaagggccgtggcctagtggctggtgggtcgcgggctctggggccttcggtgaagctgtctacggcctctgtgacgggcaggagccctggcggccctgtggccggtcccagagcagccccacgggccgggcccagtgtcggggcgaaggctggccggggtaccgtcatgggcacaaagcaggcgctccgggctgctcacagccgcgtccatgagctgtcagccagtggagccccgggccgaggtggctcctcgtggggctcggcggactcagacagcggccatgacagcggcgtgaacgtgggggaggagcggccacccacgggcccggccctgccctccccctacagcaaggtgaccgccccacggcggccccagcgctacagcagcggccatggcagcgacaacagcagcgtgctgagtggagagctgccgcccgccatgggccgcaccgcccttttccaccacagcggtggcagcagtggctatgagagcctgcggcgcgacagcgaggccaccggcagcgcctcttccgcccctgactccatgagcgagagtggggctgcctccccaggcgcccgcacccgcagcctcaagtcccccaagaagagggccacaggtctgcagcggcggcgcctgattcccgccccactgcccgacaccactgccctgggccgtaagcccagcctccccgggcagtgggtggacctgcccccgcccctggctggctccctgaaggagccgttcgagatcaaggtgtacgagatcgatgacgtggagcgccttcagcggccccgccccaccccgagggaggcccccacccagggtctggcgtgcgtcagtacaaggctgcggctggcggagcgcaggcagcagcggctgcgggaggtgcaggccaagcacaagcacctgtgtgaggagctggccgagacccagggccggctgatgctggagcctggccgctggctggagcagtttgaggtggacccggagctggagcccgagtcggccgagtacctggcggccctggagcgagccacggcggccctggagcagtgcgtgaacctgtgcaaggcgcacgtcatgatggtcacctgcttcgacatcagcgttgcagccagtgctgccatcccggggccgcaggaggtggacgtctgaggctgggcgccggacaagaggagggggcgtgcagcgggctggaggacgggacgtgggacggagcgaggatgtggtgggggctgcggggggaggatgcggaggggtttctgtgcaggacgggagtctcagagaggagacggagtgtgggggagggagggccggccacgcggtggacagagcgagggtgccagggtgaccagaagaccgtcaccacccgacagcaacgcaagtgcctttgaccttgatttggacttttctcccttttgcatttggtgctacagacttgagacaccagcagaagttgtgttcagcccggccccgctgcgcctgtccgggccggggctggcgccggttgtgtttgtgtccaccttgccttctttgcagccaagcagtttttgtggagtgggacttacctgcacgccccaggggtctttcaggattcaggatgacttttcttttacaatggtttcctctcggcagagcccgggttgtgggggatctgtgtggggttctcaacgcagatccatcctggggtctcccgggcagggatggctgacctcgagtcccctcccttcccgagaacctgctctgtcccgagggcagctaacaagggctgagccccaggtacaggttgcctcttccacggcaggaatttttaccaaaaccacaagcaaaaaacaaaacagaccaccacgaccaacaacaaagatggggggtagggttttgtaaaggttctgttaggttcatatttttatatcattttgcccataaatgcggaatttgccgtgggaatttgaagacaaatgatctatgtttttatggttttctagggaaggtgttctgggggccgggctctctccagctgtgggaggcctgctccctctggggggcaccctgggcagggtgggggggccttgggaggcgcttcttgccaaatgcagacgaggggtgagcctgccagcgtttgcgacgtccccgcacgacaggctcatactttctgaggatcgtgcatagcataggacgtctgaacctttgtacaaatgtgtagatgacatcttgctacagcttttatttgtgaattaaagatgcatcgatggttccca

SEQ ID NO: 112322 - DNA, 4331 bp, Homo sapiens
  misc_feature (1464)..(1464): n is a, c, g, or t
  misc_feature (2013)..(2013): n is a, c, g, or t
caggtgatcctctacgatcccgccgccggtcccccaggcagcgcaggcccccggcgagccgccactgctgcagttcccaagatgtttgccttcgatgccgtcttcccccaggactccgagcaggccgaagtctgctcggggaccgtggccgacgtgctccagtcggtggtcagtggggctgatggctgcattttttcctttggccacatgagcctgggcaagtcgtacaccatgatcgggaaggacagctcaccccagagcctgggcatcgtgccctgcgccatctcctggctcttcaggctcatcgaggagcgcagggagaggacgggcacccgcttctccgtccgggtctcagccgtggaggtgtgcgggcgcgaccagagcctgcgggacctgctggccgaggtggcccctggcagcctccaggacacccagtctccgggagtgtacctgcgggaggaccccgtgtgtggggcgcagctccagaaccaaagcgagctgcgggcacccacggccgagaaggcggctttctacctggatgcggccctggcggcccgcagcaccagccgagcgggctgtggcgaggacgcccgacgcagctcccacatgttgttcacgctgcacgtctaccagtaccgcatggagaagtgcggccggggaggaatgtccggaggccgcagccgcctgcacctcatcgacctgggcagctgtgaggcggcggctggcagggccggggaggctgctgggggtcccctgtgtctgtccctgtcggccctgggcagcgtcatcttggccctggtcaacggagccaagcatgtgccgtatcgggaccacaggctcaccatgctgctgcgtgaatccctggccaccgctggctgccgcaccaccatgatcgcccacgtgtcggatgcgccagcccagcacgcagagacactcagcaccgtgcagctcgccgcccgcatccaccgcctgcgcaggaagaaggccaagtacgcctccagctcctctggcggggagagctcctgtgaggaaggccgggcccgtcggcccccgcacctgcggcccttccacccacgcactgtggccctggaccccgaccgcacgcctccctgcctgcccggtgaccccgattactcctccagcagcgagcagtcctgtgacacggtcatctacgtggggcccggtggggcggcgctgtcagaccgggagctcaccgacaacgaaggtccgcctgacttcgtgcccatcatccctgccctgagccgccaccggccctccaagggtccccgagacgcagaccacttccgctgcagcaccttcgcggagctgcaggagcggctggaatgcatggacggcaacgagggtccctcaggaggtccaggtggcaccgacggagctcaggccagccccgcccgagggggccggaagccctcgccaccagaggctgcatcccccaggaaggcngtgggcaccccgatggctgccagcacccctcgaggcagttctggtccagacacccaccagggtacccctgagccctgcaaggccattgtctggggtgaccagagagaggacagcagcgcttggcctgagctgctggtcccggaaaaggctgcagtgagtggaggcaggaggccactgcccagcccggctcccccacctcctcagttgctggaagcctgcagagccccagaagagcctgggggagggggcactgatggagtggcacggacccctcccgtgggcatgagtgggcaggtggctgggtccccgatgcttcctggggccacctgcccccgcctggctgctggcagtcgctgtccggagcggggcctgctcaccaccacagtgaccctgcagcggccagtggagctcaacggcgaggacgagctggtgttcacggtggtggaggagctgtccctgggggcgcttgccggagctgggcggcccaccagcctggctagcttcgacagtgactgctccctgcgggccctggcctcggggtcccggccngtcagcatcatcagcagcatcaatgatgagtttgacgcctacacctctcaggcccctgagggggggcccctggagggggcagcctgggccggcagcagtcacggctcctccatcagctcctggctcagcgaggtcagcgtctgcactgccgacagccgtgaccccacgccgcagccccgcttcagccccgactcgctggcagggcttgaccctgggggcccccctgccctggatggttccctgggggatggaagctctgggttcctggggccagacagacctgacagtcctgggccaacctggggtccgtgccctggggaagtggctgcagtggccccatcccgacccggcagggagccccaggccgggccctcgcggtgggcatccgcagcccagaccatccactccagcctcccccggaaaccgaggactgcctctgccaccacccgtgtgggctgtgctcgcctgggccagagcccacctggccgtggaggcctgtttgaggacccatggctgctccgggtaggggagtgtgatacccaggcagcttctgctggcagggcccccagccccacacttggctccccccggctgcctgaggcccaggtgatgctagcctgtgcccagagagtggtggacgggtgtgaggtggcagccagggcggcccgcaggccagaggctgtggctcggatcccaccgctgcggaggggtgccaccacgctgggtgtgacaacgccagctgtgtcctggggagatgctcccacggaggtggtggcctgctcggggagcctgaaggcctcccccaccagcaagaagggtctggctcccaaggcgggcttcctcccgaggcccagtggggcggcccccccggccccacccacgcggaagtccagcctggagcagaggagcagcccggcctcggcccctccgcatgctgtgaacccggcgcgggtcggggctgctgctgtccttcgaggggaggaggagcccagacccagcagccgggctgaccactctgtccccagggccacgtccagcctgaaggcccgggccagcaaggtagaagcagcacaccgtcttgccggacacgcgtctctggagcggtacgaaggcctggcgcacagcagcagcaagggccgggaagcccctgggcggcctccccgggctgtacccaagctgggtgtgccaccctccagccccacacacggtccagctcccgcctgtaggagcggcgcagccaaggctgtgggggcccccaagccccctgttggtggaggcaagggccgtggcctagtggctggtgggtcgcgggctctggggccttcggtgaagctgtctacggcctctgtgacgggcaggagccctggcggccctgtggccggtcccagagcagccccacgggccgggcccagtgtcggggcgaaggctggccggggtaccgtcatgggcacaaagcaggcgctccgggctgctcacagccgcgtccatgagctgtcagccagtggagccccgggccgaggtggctcctcgtggggctcggcggactcagacagcggccatgacagcggcgtgaacgtgggggaggagcggccacccacgggcccggccctgccctccccctacagcaaggtgaccgccccacggcggccccagcgctacagcagcggccatggcagcgacaacagcagcgtgctgagtggagagctgccgcccgccatgggccgcaccgcccttttccaccacagcggtggcagcagtggctatgagagcctgcggcgcgacagcgaggccaccggcagcgcctcttccgcccctgactccatgagcgagagtggggctgcctccccaggcgcccgcacccgcagcctcaagtcccccaagaagagggccacaggtctgcagcggcggcgcctgattcccgccccactgcccgacaccactgccctgggccgtaagcccagcctccccgggcagtgggtggacctgcccccgcccctggctggctccctgaaggagccgttcgagatcaaggtgtacgagatcgatgacgtggagcgccttcagcggccccgccccaccccgagggaggcccccacccagggtctggcgtgcgtcagtacaaggctgcggctggcggagcgcaggcagcagcggctgcgaggggtgagcctgccagcgtttgcgacgtccccgcacgacaggctcatactttctgaggatcgtgcatagcataggacgtctgaacctttgtacaaatgtgtagatgacatcttgctacagcttttatttgtgaattaaagatgcatcgatggttccca

SEQ ID NO: 112323 - DNA, 672 bp, Homo sapiens
ctgtgcttgggctgggccccgcctctgttcaccctgtgcccggctctccgttccaggtctgcagcggcggcgcctgattcccgccccactgcccgacaccactgccctgggccgtaagcccagcctccccgggcagtgggtggacctgcccccgcccctggctggctccctgaaggagccgttcgagatcaaggtgtacgagatcgatgacgtggagcgccttcagcggccccgccccaccccgagggaggcccccacccaggtagggcctttggtgggctggggtctatgacccctggtggggagcctgccgcggatggcagagtgagccatttgatgggctcgccaggcctctgggggtgtggctgggcagcccctgacctcactttctgtccacgttcctcccaggacgcaaaggtaggagcggccctgcccagcccaagcctgttgcagctccgacactccccttgggcagtgggtgggtggctggggggtcctgaggccactgctgctgtccgctggaattctcccctgtcgtggggagggtggtcctagagccgagccaggacccagacgggcatgggtgggctgccccaggtccgccccctgcccgcccttggagccccactgtgtgcctgccaaggcctggcaggtgaagggaggcgggggcca

SEQ ID NO: 112324 - DNA, 747 bp, Homo sapiens
atggggtaggacgctaggccggcactgccaaggtgggccgggcggtgcgagggtcgcctttcagcctttacctctacccactgaaatggagtaggtcggtgagcgccgatctgctggagaatctcattatcccatcggcgctctgcctgctcctggcctccaagcctctgaagcccctcgggtttcagctgccggctaccctcgagcccgtggtgcccacgagagaggcgactttacgtcagcggccctgggctgagatttgagaacgcgaccaagtggagaatgttggagccagattttaaaatccttgtcttccttctgcttgctacttgatctaaatgagatacggcaaagtcacagaacctgtttttatgtttttgcctgattcatacgggcttctccggtgaagatgggcctgaagtaacgcttgggttgcttctgacgttataactcatcctgtagctgcagcaaccgtggtccttgcaacctcataaaaatgttgccagcattgtttcgatagtgctgcttaattcttggaaggttcttcggacttcacacattccagcagtagctctctcagctcctgtcctggacagctttgaagtgctgaaacagagaagagtatgagaagtgttacggaacatgaagatacctctggtggcttcaaacatacttatttttaaaaactctaaaggtctaaatgggtctgtatcgggtatattttcagtcaacttatgctgtgttggg

SEQ ID NO: 112325 - DNA, 1040 bp, Homo sapiens
atggggtaggacgctaggccggcactgccaaggtgggccgggcggtgcgagggtcgcctttcagcctttacctctacccactgaaatggagtaggtcggtgagcgccgatctgctggagaatctcattatcccatcggcgctctgcctgctcctggcctccaagcctctgaagcccctcgggtttcagctgccggctaccctcgagcccgtggtgcccacgagagaggcgactttacgtcagcggccctgggctgagatttgagaacgcgaccaagtggagaatgttggagccagattttaaaatccttgtcttccttctgcttgctacttgatctaaatgagatacggcaaagtcacagaacctgtttttatgtttttgcctgattcatacgggcttctccggtgaagatgggcctgaagtaacgcttgggttgcttctgacgttataactcatcctgtagctgcagcaaccgtggtccttgcaacctcataaaaatgttgccagcattgtttcgatagtgctgcttaattcttggaaggttcttcggacttcacacattccagcagtagctctctcagctcctgtcctggacagctttgaagtgctggtgatgtcattgaactcttaagtgcaagatgaaacaagtctttctggggttctaagtagattgcatggtggatagagcacatgctgcccacatcacgggtgtccttaccattttcgtacaatccggtttgacttccaattgctgatgactgtgtctctggccagtggggcctgcagcagtctgggagtactggaggaaagagtgccatcaaagagcagccctcaattacagacccagaagattaggtctgtgggtctcagtggatgaaccaacacggaggagcaccacgttgagcgtccatcttacagtttcccagggcacaaagttatagtcatctgaggggcaacttgcttgacaaagtagcttttcccgacttccttcccatctttacctcactccccgactttctaaccagtgtttcttgggatcaa

SEQ ID NO: 112326 - DNA, 1167 bp, Homo sapiens
atggggtaggacgctaggccggcactgccaaggtgggccgggcggtgcgagggtcgcctttcagcctttacctctacccactgaaatggagtaggtcggtgagcgccgatctgctggagaatctcattatcccatcggcgctctgcctgctcctggcctccaagcctctgaagcccctcgggtttcagctgccggctaccctcgagcccgtggtgcccacgagagaggcgactttacgtcagcggccctgggctgagatttgagaacgcgaccaagtggagaatgttggagccagattttaaaatccttgtcttccttctgcttgctacttgatctaaatgagatacggcaaagtcacagaacctgtttttatgtttttgcctgattcatacgggcttctccggtgaagatgggcctgaagtaacgcttgggttgcttctgacgttataactcatcctgtagctgcagcaaccgtggtccttgcaacctcataaaaatgttgccagcattgtttcgatagtgctgcttaattcttggaaggcctctttgctttcttccctgaggttcttcggacttcacacattccagcagtagctctctcagctcctgtcctggacagctttgaagtgctggtgatgtcattgaactcttaagtgcaagatgaaacaagtctttctggggttctaagtaggacacagccctggtgatggctttctgaggatgacacgatggaggcttctccaatagctctaaaactgcggtgtggaaaacattcggcagcctcaaagagcggtcttgttgaccccaactatatcatttttcatcaaaatcattcttgtaaagaatgaccaggcaacactctttgaaaattggaggccatttgcagctgctctctgttgaggaaagtgaataatagggtgccctcaaggaattgcaaaggtatcactcaacagaaactttcgtgtctgaagaaaactagatcattttatcatggtaggcatgctgatatgtttgctttaataaaatgccatatttctgcctttaatctcttgtcaacccgctattaaaaagccccaaagtgcatgtgtgcagcgcatgtaaacacttgtggttttgaggttaccacagaacatactaataaagcatgtaatttgtgttttgtgcaca

SEQ ID NO: 112327 - DNA, 366 bp, Homo sapiens
acaatgtgagattttttccagaaacaagtcatacccactcattcctaagttaaccaacaggacacagccctggtgatggctttctgaggatgacacgatggaggcttctccaatagctctaaaactgcggtgtggaaaacattcggcagcctcaaagagcggtcttgttgaccccaactatatcatttttcatcaaaatcattcttggtaagtcttatgcccaaggagttattttccttagcaacatcatggtatggagggatttgctataggataggtcctgaatattcttgctttttttctgacttaactttgaaaagaagtcctagactaaattcaaccctgctctttcaaatagcttcctca

SEQ ID NO: 112328 - DNA, 279 bp, Homo sapiens
atacgagcgcagtgctcagcctgtaagtcccagcacttagggagaaaaaagaagagaaagattacgtacaacatgcaggcacaggaaagaatgcagggcctgtaccataccacaccagctgactgcgcagaacgtcgggtggagactaggagacccgggagccttttgccctatctagcgcctgccacaacagacattttataactagaaaaccaaatatgcttttaaattatatttacaaaaaaattgccggtcacggtggctcacgcctgtaatccc

SEQ ID NO: 112329 - DNA, 645 bp, Homo sapiens
ggagtctagttctagaaaagagaacataaaggatcttgttagggaatgtagcagggatgactaactttgtccagtgggtccagataggcttctcagagattctacgatttaagttgagcctgaagagtgtatagttagtagccaagtgaaaaaagggaaaaaaaagggtaagagtgtttctggcagagttgtaggatatgtgaaagcccagaagtgggagagggaagaaatggcatagtcaaggaaatgaaaggaattgactggagcattgagtttttcttccataagctttgcaagtaactaccattagctttaattagatcataaaggagcaggttcaaagaacattgctccagtaataacgtatgctcagatacattcagctcataggaagtaagaagactggaacactcagataatctcctggatagttttaactatatttatgtattcattttgcatttggattatgttcctttgacctcttaagaaaggtgatgtgaatactattcatgcctcacatttcttaattaagcactggcttattttctgagccacgtttaaaaactgaaaatggcaaatacctaaaaatacatcttatcacagacatgtgagacttctatactaaaactgcaaaacattgct

SEQ ID NO: 112330 - DNA, 489 bp, Homo sapiens
ctggcagtccacgcatggtgctgtgtcaaggatggggagagatgaggtgtgagtcctaaacgtgatgccacgaggtgtgcatgtgttggggtgacagtcagggacacagacacttacatcatgggggatgctgcgatcgtgttaggggatcccaaacttgctcctctccccatattccccatctcagcgaagggcacccctcccctaactccatcccagccagaaacctcggagtgagagtcatccttgattcctaccgcctccaaaccaatccagtcactaggtttgctctggaatttgttctctcctctctatgcgtgctgcctctggttcggtttttatcacttcttttctgggctgtggccccaggctcctccctgcctctagctctcttgctgctccaagtgccctgcacagcagctgcagtgattgttctaaagggcagatgtataaatgcttccccctgactctcccccatgcgtggattgc

SEQ ID NO: 112331 - DNA, 604 bp, Homo sapiens
tgtctactatgtgtctgaccctggattaggtactagatacaaagctgtgaacaagaaagataactgtcctcagttatttgaggaacatgaaaaaaaggcaaaaacaaaaccctacttgcattcatacactagtcaattcttcattgcatgaatataaacttagagatacacattttaataaaactgtcattttactgcaaaaagtgttttacaatttgtaaccccctacccatttaactattttttccagagtacagctttttgatgactcattatgatggacaataggttgaaaaaactcagcaggatgctaaaaatgcagctgtgtatatacgcagaccaaggtggtgcaggacattggggtgaacagatactgatcaacagctagtctgaaacttacaagcttggaaaaagtcttgagatcaactactgtgggacatttctcctatggcaacataacctctaggccaacataatgtgactgcctttttaattttttttaggaaaaggcaaaaacagctcttttctcaagtggttttctctaattttagaattatgctatctactacagtggccaatagcacgtgaaatgtgactagtccaa

SEQ ID NO: 112332 - DNA, 434 bp, Homo sapiens
atttaaggtatcttttgtaagcctcatggtaatgacaatccaaaaacctgtaatagttaaactaaaaagcaagaaattaaaacatactaccagagaaaaatcacttaaccacaaaagaagacagtaagaaggaaccaagaagttacaaaacaactagaaaatagttacctccttacctattagtagtaacactaaatgtaagtggactaaattctccaattaaaagacatagagcagctgaatgtaggccaggtatatggctcacacttgtaatcccagcactttgggaggttgaggtgggaggggtacttgagccagaagtttaagaccagctgggcaacatagtaagaccctgtctctacaaaacaataaaaaaattagccgggtatggtggcatatccctgtagtcccagctacatgtgaaactgagttgg

SEQ ID NO: 112333 - DNA, 712 bp, Homo sapiens
gggtccccgccccgcgaggtccttcgccgggcggcgggagctagacgagcacgcagggcacccctcgggctcccgggaggcggccctgggcgtcccctttctgccgccgccgcggccccggctgctttctgcgtagctgggcagggcccgggcccccacatcgcctctcccgggaatgcgggcgctctggagccggggagccggggcgaccgcagggagggcagctctccggggtggaggtcctcgggcgccgcgccctcgcctggaaaccagccgtcgcccccgcaggagtcagccggcgtggacgccccagcacgctccttcttggtgctgccggtcgccctgcaattccgagaagaaagtcagagacgccgtggcccacagaggcgcttagttttcctcgctcacacgttgcctcctcatcgcgttcttctttttctccctgggtgctttctctcctctccaggaaagcggatttggaggaacaggtttcgtgactgtcatccaactggaaaaggccccgcgagctggaagggggggcggggggggacgggtgcaccctcagagttattgctggaggctgtggccaggccgggcaatgtggtgacttccgctggcaggctgaggcccaccccagccctcccacctgggccacggggctctcagcgggagccccagttatgaccggacaccagcgcaccgccaaggagac

SEQ ID NO: 112334 - DNA, 515 bp, Homo sapiens
gaattgcagctcccttaattcccacatgtgggagggacctggtgggagataacttgttttggctatgtccccacccaaatctcatcttgaattgcagctcccacaattcccacatattgtgggagggacccagtgggagataactgaatcttgggagtggtttccctgatactgttctcatggtagtgaataagtctcatgagatctggtgatttgacaaggggtttcctttttgcttggtgctctgattctctcttgccaccagcatgtcagaagtgcctttcacccaccatgattatgaggcctccccagccacatggaactgtgagtccattaaacctcttttactttataaattactcagtcttgggtatgtctttatcagcagcgtgaaaatggactaatacagtaagtatatgaaaaatttgatttatacaatgaatacggtgggtttaactgatataggacaccacacaaaatgggatataatctaaagtggcacttactggaaaatg

SEQ ID NO: 112335 - DNA, 260 bp, Homo sapiens
aactggcataatctttttggtaggcaatttggccatgtataacacaactgttaaagatgggcaacccaggcgtggtggctcacaaatataatccaaacactttgggaggccgatgtgggaggatagcttgagccccgacgtttgagaccagcctgggcaacatagagagacatggtctctacgacaaaaaaaaaaaaatttaattagctgggcatggtggcatgtgcctgtggtctcagctactcagaaggccgaggtgg

SEQ ID NO: 112336 - DNA, 319 bp, Homo sapiens
ccttagtaggtgctaggaaatgtaggatgaatgagtgaattcattctgctgcctgccctccgtgggattcatctttgtatcacatcagacggtgtaggtccttttattcctcttcctaaggaggccagcttgggccctctgttggcaacagaagactttgatttcttcactttcttgttttaaacacagccccattaatgtttaaaatgcttgtctgagctctccagtctgtcttaggtgtttcgagggctttcaacagggattctaaagcggcccagggatacttggttattatttcctctttatagaattgaatgag

SEQ ID NO: 112337 - DNA, 200 bp, Homo sapiens
ctagagcaagagtatacataagaggctgagagggagaataataggatgcaggggagctctctgcatcctatagggtgtttggggagcccctctcggagaaattgacatttaaacaatgaccttcacatttaagctatgaacagtttaggagtagggcagggacaatgccagtcaaagcagtggcttaccatattttaatg

SEQ ID NO: 112338 - DNA, 273 bp, Homo sapiens
ggtcaggcactgaagcctggtcaggcactgaagcctggtcaggcactgaagcctggtcaggcactgaagcctggtcaggcactgaagcctgggaggttttgtatgataaaaacgaatccaggggctgtgtggtccctgcatctgattgtgtcctgtctcggggagcttaaggaaaggttatatcgaagctggaaataccgcagtcagggtcaccagccttcattctcaaaaagcagacggaaactctgtgttaggcttcatgtggtttccccg

SEQ ID NO: 112339 - DNA, 472 bp, Homo sapiens
gccttcattggccacatagggactgcagctgtcagcacagagagagagagggaaagagagagaaatagagtttggaaattgttcagcaagagctgggaaatgcagtcacacagaagaatgactggtccatcatcaaatcctaatgaaattacctccaaatatctcggtgcctttcagcttctgttagtggagctggacaaatctgatttgagacaagtaattttaagcgtgttcttaaaggtaagactccactgtatctcttgtcctatttcctggcagtggaagaggggccagctttttcttgtccttggagaacttgagaaacagcgtatctgccatttgggcgttggctgagtacctccatccctgacattgctttccaagtgctgtggaactggggacaagctatgtggtttgaaaggagttgacaggctgggagccagtgtcctcctttcctcaagaagggaggagg

SEQ ID NO: 112340 - DNA, 415 bp, Homo sapiens
gtgattataccgcaattaaagctagagggaacgctgtcagttcctgggccttcatttgctgacacagaagtgaggtgtagctctctagaagcaactcacagtgtccatatcattaataacacaagttacagcaaggacggcactttcctgccctccacacacacagccaacagtacagtcaacacagactcgcagcatgcagggccatctctgataactcagaaaatgcacgccattaacagtgacagcaaaaaatcatccactaaaagcaattctagaccaggcacagtggctcatacctgtaaacctagcattttgaaaggccgaggtgggctgatcgcgtgagcccaggagttcgagaccagcctgggcaacatggtaaaaccccatctctacaaaaaatacaaaaattagc

SEQ ID NO: 112341 - DNA, 144 bp, Homo sapiens
cttattgtttcctaggatctcagggagatcaggccacgtggtctgtggattaattaaggcacccagataattggctattaatagatggccaattgatggctgccagctgggtgctgaattgactaatgtccttatggtgggcag

SEQ ID NO: 112342 - DNA, 659 bp, Homo sapiens
aattcaacaaaaacaaagaagacatctcagtattttatacttttaaaattaagaatgatgtcgacacattaattttcatttactatccttgactcatagataactttttaggatatttctagtctgtagtttcaatgagttgtttgcacattgttgtattctattacagataatatgcatgctcagaggcatttcctcccttctttatcttttccttgatccaaattcagtacttttcttttctattttttttttttttttggaaagagtctcgctctgttgcccaagctggagggcaatgatatgatctcggcttactgcaaccttcgcctcccgggttcaagtgattctccggtctctactaattttacaaaatttagtggggtgttatggtgcatgcctgtaatcccagttactcgggaggctgaggcaggagaatggcttgaactcgggaggtggagattgcagtaagccgagatcgtgccatggactccagccgtgggtgatagagcaagattgttctcaaaaaagaaaacaaaggaaagatttttaagttgtaatccttctgtagaacacggtttcagaaccattccattgatcttaataaagctgctctttactgtttctagtcacaaattgagacttcgatcacccataag

SEQ ID NO: 112343 - DNA, 409 bp, Homo sapiens
cagactactacttttacaggctaaatctagcctgtcacctgtttttgtaaataaatttttaccataacacagctatactcatttaatttcatgtgctctgcagctgctttcatgctacaatagcagagttgagtcaaagctacagtggagattgtatttggcctgcaaggttataatatttactatctagcttggacctctgaagaggataaagcagagttacttttcaatgcagtgaaattataaagagaaataaaggatgaaaatataagaaacttggaagattatagacacacacatgttcaaatgtccacataggcaggaactccagaaatagcaaaatgaacacatggagcaattatcaaggaactaacagaataaaacttttctaagatacagaaaacctgtg

SEQ ID NO: 112344 - DNA, 461 bp, Homo sapiens
gcatgtgatcaagcagggcccatcagaatccttccctaagatttttataaaaagctggacctattctttttccatttgagtggcaaatatttgaagatatgaggtctaaagctgtgatggcttattctccatccctgtgtaaattctggtctatagtaagcgaaaacaaggccattaggcagagggcagcagagacataaggtgagaaagagtgtggtctctggttttctagaccctgattctggtttggaggcttggctgatcacctcttcctttgattctgatagaaagctcaatgtatctttctaataaaacccccctttgctttgcttgttggagttaggttcttatcccttgcaaccaaaaatatattgtctcttcttttgttctcagttttctcatttatatatccttctagctccaaagcacagaaattctaaaacaaacaaacaaacaaacaa

SEQ ID NO: 112345 - DNA, 349 bp, Homo sapiens
aaaatctataagcctaagttatggcccataggttttgttaagggttttcagagtgattttcaggtttaatttcactgcctttcataagggtaaagtttcacagctgacattagcctgaggattagcactaaagagctgtgttttcatagcaggggctattgtacagacagtgataaccaaatagtaatatgccagttctttcttctttttttagcttcagtagtagctaagccattaatacagtttgcatcaatttccccatttatttataatcagcctttcttttagtcctagtgcctgaatcaatgagtgagaatactagtactgattctttacaataataatatct

SEQ ID NO: 112346 - DNA, 381 bp, Homo sapiens
tctcctgagttcaagcgattctcctgcctcagccttcctggtagctcagattacagatgtgtgctcccatgtccagctaattgttttgtatttttagtggagatgttggccaggctggtctcgaactcctgacctcaaatgatccgcccaccttgacttcccagagttctggaattacaggcatgagtcactatgcctggccaaaaaatatatttatagttttaaaaaattacctacgtcattacctttactggtccttcatttcttcatgtgaaaatgagttagtgactagtattccttaatttccatttaaagaactgcgcttagtatttcttgtacagcaggtctggctgatggtgttttttgttttttcttttgtgt

SEQ ID NO: 112347 - DNA, 341 bp, Homo sapiens
ctgggggtaacccccttagggagtgaggagaatcatggaagttaggagtggtcatttattacatatgtggataataataatgttttgtgtatattaggttaaatagtataaacattgtaattgctagatttacataaattgataggttaggattgtgaaagaaggattagatgttaaaattgtgattattcaatttgttgtgagcaattgccaaataggccaagatatttcacagctgtgtttggttaaggtccccttaaccaatctcccatagtgttgcaatctcccatagtatgtttaagtctgttgatgagtagacttgaaataaaatggagatcagt

SEQ ID NO: 112348 - DNA, 463 bp, Homo sapiens
ctgaaggctccatgtcatgtgaaacttttagactaaataaaattgttatgtttctctcttgttaacctgtatttgttacaggagccatgacccttatgatggggagggcacggatgaactcagaacccagggcttgcagcccagacaccgagcaactggcccggcagtcaggcacatacccataagcctggggcaggccacggtgttagaagactctaaagcggcactgccaggtcttggacccacactaatggctgtgactgtggtgacaacagaagctgcagtagccatggttgtgggtgataggggagaggagagaggagggactctggtagctccaggaaccagggtgggaggccagtttgcccatcagtcaccggagcctgtccctatagagtctgcacagatatttaactctatgacctgagcaccaggacagtaaattatcacaaagtaaaagcct

SEQ ID NO: 112349 - DNA, 197 bp, Homo sapiens
tcgatacaactttgctactattaaaaatagagaacagaagtggaaaatttctggtcaattattttaagttcagaacaacaaagctacctgaaacagaatttgggtaagaaattcctgctttttttttttttttttcaattaagacagggtctgggtctggctttatcacctatgctggagtacagtgatgcaatctc

SEQ ID NO: 112350 - DNA, 370 bp, Homo sapiens
ctcatttcagaacaaggatgacagaggtgtggggtgcaaacatacacttagggaacagggcagaccaagtgaatgacaactctctttccatcacacctatctatcctcaaatcatgagatacttatccacttttacctctgaatacaggactgtggttctcctatgcaaagacagcagggagtggacactaggagggtaaaacaacgctctgaataaagctcaagagatctcccacggaatttcattaaaccactactggagaccatatactaaactagtaatcccttaaggcatgagacacattaaaaccactttattgagccataattcatatacaattcacccatttaaagtgtacaattcaatgga

SEQ ID NO: 112351 - DNA, 340 bp, Homo sapiens
tggggagcagaagaaaattatagtagggagcaggaggcctaattcaccctaaaattatattctaaaggcttccaagagttaaactctggtccatttgactcccataaagtttcctgtagaagcagcttttaagggctgatgtggtgtggccaacaacacttattcagcccatacatgcaaggcaaaccacagagacctggagttggagaaccagagaaaatccctgcttcctcccctcactgcgtggcttcaggaaagttacttaatctaggtcctaggctgtctcacttgtgaaatggaaatacttgcaaatccaaaaaagaccctcctctgggaaaat

SEQ ID NO: 112352 - DNA, 391 bp, Homo sapiens
ctccacttgggttaggtatccacccctaattcaatcagctgtggctagatggagttcctgagccaaaaggcttctcccagtgggttctactacaatgaacaattgttgtttaagacacacatggattcttgattgtcaattcagaaagcagacagtgggttttaaaataacaaggcatagttgagttcattcagtcaccttgagagcacccattttttctaggagactggatgttctcaaggagcagcctgtccatcttgcatcccccaggttctccggattctccatttccaagcagaagaagcaggactggagcacccttccatatcatcagccttctcctcgcaccagaccttactcaccagggcctgggactgtgggttggacttct

SEQ ID NO: 112353 - DNA, 388 bp, Homo sapiens
taataattaaactccttccaggtaattcaaatgtaggggtgaacccaggttgtgaggatcctgaagctaatatggttttgctggttctcttcagaaacaaagaatataaaattatgaatacaaaattaggtatgacctttggcctttccttattcatttcacaatgctgagttagttagtgcattgcaggtacccttccttctttgggatagctagcaataacctcactatacattatatgactgtaagccccataaaaataacctgctagacctaacttcccttagccaagttccaaaatgcctgcagccagcctctctgatgccactgaacgagaaggggacagacggtggagaagtcctagtggaaacagacagcaaactgggat

SEQ ID NO: 112354 - DNA, 391 bp, Homo sapiens
agactgtagcaatgaatctaactgtattacaaacgtatgacagaagcataccaaagaggattgtaaagaaaggagctgacctatacagccttgttttaggtcaacaagccaaaaacaaataaccccattcaaaagtgggcaaaagacatgaacagacacttctcaaaagaagacagacaagtggccaaaaggcatgaaaaaaagctcaacatcactaatcgttagagagatgagatattatctcacaccagtcagaatggctactattaaaaagtcaaaaaataatagatgctggtaagactgcagagaaaagggaatgcttatacactgtgggtaggaatataaattagttcaaccactgtggaaagcagttgggaaatttcccaaagaa

SEQ ID NO: 112355 - DNA, 243 bp, Homo sapiens
tttgaggctgcagtgagccatgattgcagcactacactgcagcctggataacagagcaagaccctatctcaaaaataaaataaaataataaataaataaaagtctcatcttaaatttgatggggaaaggaattttctggatccacaactgaattgtctatgcttggcaggcagatgttttctcaaatggtgaatggattcaccttctttctcttccctagtttagctactttcactcccttct

SEQ ID NO: 112356 - DNA, 338 bp, Homo sapiens
attccttttaggaacaaaccagatatatttagttaaatggctaaagcttttggtttatttctagatgtttgctgaatttatttgaactcttagtagcttaaaccatgggaggctcacataacaaaataagcctccatttgtatcctattaactcataaaatatcatttaattactgtattgttttattaaaaatctaaaataattataataaatattaatatttgatagaatctactagtgagtattcaattgttcattacactattcttgacgtattcattggttttaatacattttataataaaataaactgacttcgatttccatctcagatgta

SEQ ID NO: 112357 - DNA, 489 bp, Homo sapiens
cgatatggtttgaacctctgttcctgccaaatctcatgctgaaatgtaattctcagcattggaggcagagcctggcaggagatgtttgcatcatgggggtgaacggctcagtgacatccccttggtgtattctgaagtgtgtggcacctgcgcctctcactctctctctgttgctcccactcctgccttgtgaaatgcctgctccaccctcaccttctaccatgattggaagcttcctgagatctcaccaggagcagatgcctgtgctatgcttcctgtacagcctgcagaactgtgagccaattaaacctcttttctttacaaattacccggcctcaggtattcctttacagcaatgtaagaacagactaatacaatgcccttaaagagacccaagacagctaccttgccccttccaccatgtgaagacacagcaagagattgccctctatgaaccaggaagcaagctctcaccagacatcaaatctg

SEQ ID NO: 112358 - DNA, 364 bp, Homo sapiens
tccatctgaataactaaaatagaactggatgtgtccaaaaagcaaagcctagaaaaagcaatcatatggcccccagtgaatgtcaaggtatctattaatgcatagatttgattactcgtcttaacgggaaaatagggtcaggagactgcattgtgtgaactggaatggctaccatgaattactatgttttaggagtccatcaactttttattttgcaaatcaaagatcttgaattgaagtcacgttgggctgcacccatgtgctgacacggcagacagtccagctggccctcttgcagccttttgggcctgtctgcccacttggctctgcccctctgccctcaatggggcttgtatcactgctt

SEQ ID NO: 112359 - DNA, 347 bp, Homo sapiens
gcactagcagtgtaagttggaggcctgttttctcatctagaagatgaggacataaggttgtataaccaaactccttttctactaatattaaaaccacatttcatctaatctaagatgccactgactatgagaggtatgttcatataacagcaaagaagatgacattttaaaatgtgccatcagttaaataatccccaaacaccaaagatatccccatgatgcatagattggtgaactagactcttgtggctttgaaatccattcagatgaatttggcagcttctcctgcccttggttgtgttgcttggcatgaaataggcaatcctttttgaatgttctcaataaca

SEQ ID NO: 112360 - DNA, 1060 bp, Homo sapiens
aatagcaagagaagttagtttaaccatctagaaacattgctaatctccttgaaagccaattctcttactcattgcaccaacaagaaacactccaaggtgggcaaggaaagacgtgaattctgatattggcgccataactcgatatgtacccagaaacagttatgttctaaattaatggctttaacctgttcattgtaaaaagtgccttggacttcaatctaaagaggtcagtataaatatgtatgtgtgtgtgtgacgtgtatgtaggcaaatatttacagatttatacatacataggtgcacacacatatacccgcacattcatatataatatatacatacatatataaatgcttcataatatatcatattgctattcacagctccatttcttttgtctggtcctatgtttatttgtttagtgagacctttacatagagaggttctattcggaacattgatgtattttttgtttgttttttactttttattaaaaaggtaaaggatattaaaaaaaaaaaaaaaagtcaagtgcctgaaggttttgaatggagttacggtaaactttctcaggtcaccaaagaggaaacatttttcctttggaaaacatttttctgtttcagtgactttgttttcccttggtggtaatgcataaataagagtggttaaagtgattttgtaagttttatttcaatccatttctgtggttcccataaggcaatagctaccggtcttcacatgctctgtgtggttttgttcgcgttgttactgtgttccttactaaggaaaggcaaatgaaattgcaggggctggagcttagaccagctccaaatatggcttccttttggtaacacacacagaaggtggactagtgggaagtctctctccctgaagcaggtgggaacctgtgtcttagaaggcagaggagtcccagtgaactctccacagctccatgggccctgcctgtctacagttatacaactgcctgtatgagtcagcctttctctaccttagccaaaggtcttctctttctgtggtgtgacagcttgtaatgaaccaa

SEQ ID NO: 112361 - DNA, 326 bp, Homo sapiens
gtcaagtgcctgaaggttttgaatggagttacggtaaactttctcaggtcaccaaagaggaaacatttttcctttggaaaacatttttctgtttcagtgactttgttttcccttggtggtaatgcataaataagagtggttaaagtgattttgtaagttttatttcaatccatttctgtggttcccataaggcaatagctaaaaatttgttcagtctagtgcccagttttctccacacatcagcatcagaagggcccggtcttcacatgctctgtgtggttttgttcgcgttgttactgtgttccttactaaggaaaggcaaatga

SEQ ID NO: 112362 - DNA, 387 bp, Homo sapiens
gcaggaacaacacaaaggaaaaattggaggcaggaaagttggatcctggatgtgaagggaggtaataaaagagaagactgaaaaagtagaatagcctctgcatagcggacttaggatgccaggcctgagagtggacttcctttggtaaagcaagaggaagccattaaaaagttatcttttttacatagctgtcaaataataataagttaacatgtattgaaaggttaccatactgagaggtgaagccagctggacttctgggtagagtggggacttggagaacttttctgtcttacaagaggattgtaaaacacaccaatcagcactctgcagctagcaaggggattgtaacatgtaccaatcagcactctgtagctagcaaaggat

SEQ ID NO: 112363 - DNA, 599 bp, Homo sapiens
tactccacaggctgacttgatcacagcatgattaaatgcacttcctctagaagttagggaaaagaggactcagtgagcataggaagaggaacaagtttctctttgcaaaaacataaaaaaataaaaaattttcaaagaaaacatccaagtctcaaacctcaaacctcaaaccacttcatccaagaagaaacccccacatttgtcatttgcagaagctacagtagagacaatgcaaacaggagctagttctgggtgtgcaaatctgtgacaggtgtgcaaggcacaaccagtccttgcgtgatttcttccaaccgcagactccacgagtgcttatgtacatgagaagacgtgtgtggcccctgggagaagggagcaaccattaggacacaatatttaatgaagtgctaaactgtgcatggctgggtttaaatggtgacctttgagtaaagccagtttgatctcaggacatttccttttcaggaattacttgtatagctacctgatgcagtcaagataaagatctaaatcactgagtaaggcctatgaggcccacgtgctttcaccctgacctctctctaccctcttcccctgtgaaagta

SEQ ID NO: 112364 - DNA, 456 bp, Homo sapiens
acctaaatttaaattgatgtgcctaccgatttaaataagcgctcaatcccagataccttattgtggctggctaaggttaggagttcatgtgaactgtacattagtatcgctgagacaagcctcgttctttctacaaagaactggcgtacgtcacgtgtaggcacccagatataattggttccacatttcgcctgcctttgttggaagggctgtgctttcatgcagtgaactgtaggtcgtcctccttactctaaaagttacacagattcagtgccttatggaaaagtcaggatttccattaaagaggtccatggacagagagtgaaacttggtgtgggggtctttcggggctgccgtgataaatcaccacagaccaggagctttcacagcaaggatctgttctcccacggctctgagaccaagctgtctgcagggccggttccttctgcggtgctg

SEQ ID NO: 112365 - DNA, 289 bp, Homo sapiens
gagtaagattttgtctcgaacaataacagcgacaacaaaacactgagatactacatgctacaccatagatgaaccttgaaaactgctaagtgaaagaaaccagacacagagggccacatactgtgtggctgccgagggacagaaggtgaagggataaggaatgattgctgaatgggtactagatgttcttctgggaagacgaaaatgttctgaaaacagagacaggtggtggttacacaacattgtgaatgcactaaatgccagtgaattctatactttaaaattattg

SEQ ID NO: 112366 - DNA, 223 bp, Homo sapiens
agagagcatgatacacccaggcacagtggtccatgccttctaatcccaacactttgggaagctgagatgggaagatcctttgaggccagcagttcaaaactaggctgggaaacatactgtctttacaaaaaaatgtttaaaaattagccaggcatagtgccacgcacttaccgtcccagccactcaggaggctgaggtgggatcgcctgagcccagtagtttg

SEQ ID NO: 112367 - DNA, 147 bp, Homo sapiens
cactgcactccagcctgggtgacagagcgagactctgtctcaaaaaagaaaagctactacataagatttcagctttaatttatcaaggaaaataaacacatctaatcttgaatatttctaataatgcagttgcaaaatatataaata

SEQ ID NO: 112368 - DNA, 862 bp, Homo sapiens
ttttttttaaaaacggagtcttgctgtgttgcccaggctggagtacagtggctcaatctcaactcattgcaacttctgcctcctgggttcaagcaatcctcgtgcctcagcctcctgagtagttgggatttcaggtgtgggcaatcacgcccagctaaatgttgtatttttagtacagacagggtttcaccatgctggccaggctgatctcaaactcctgacctcaagtgatcctcccaccttggcctcccaaagtgctgggattacaggtgtgagccactgcatttggcctgcaactcaggtttttaaacggggaataaaaacaatattttgttatctggcagtattatataagactaaaaagagaaagagaacccagtgaggtttttattgaaataggttaagtatttgatgtgtttaacataaagccatagaaatagagagaaaaaagataaactggaacaatatcttaaagctataataggtctctggtgactgacacatatagagaataaaggaaacagagaagttaaagtgtctctaaagtcaaaaggtataaaaaactgtggtgccactggtctaaccaagggaagcaatttggttgagtttgatgagataagtgaaatgtgtgagagggaaacacaactgtgagatctgggtcagtagacatgtccagggatatggatctatctatagattatatactgtacacctaaaatcacttaagtcctgagcatggccaggttttcagggggctggggaagagcagagaatgaagtaacaaccataattagaaaatatgggctgggcgtggtggctcacgcctgtaatcccagcactttgggaggctgaggcgggcgga

SEQ ID NO: 112369 - DNA, 710 bp, Homo sapiens
ggtccctagactgagaagcaggtgaggtaatcacaagagaaagtaaagcggggaggagctcgcactggcgatgaccaccagactttgcccaggttgctctgatggaggtttgctacccacatcaccagcaccagagttcctctcttcagttctgccctaacacttttcactccattttaagtggcatgctgggactgtcaaagaaaacagcttaaccaagacctggatgatatgatggcagaacagtgaggagatggcagagcaagatctctacagcaaagagtaggaaatacatctgaatagatcatgaccttctgcttcctgaaaactactactcatcattcaagactgctcccatgtcacctcttctgggaagccttccctgaccactataagctgttgacttcctttgttctgtttcattttccctgcttgaagaacctatttagttcttaaaatattaatgtgtaaataagtacttatgcctctggctgcacttagttctaagaatcttacctacactgatttcaaggctagtatacaagaagtaatcaatagttgctgttgactgagaaagacaaaaagaaaagaaggaaggaaggagggaaacagggaaaggaaggaagaaagcaaagaaggaagggaggcaggagggagggaggacagaagacggggaggagggaaggagggagggcaaaggtaggttggct

SEQ ID NO: 112370 - DNA, 642 bp, Homo sapiens
gcattgttaaagtctctcttcaccctgccgtcatgtctaagtcagagtctcctgaagagcccgaacagctgaggaagctcttcattggagggctgagctttgaaacaactgatgagagccttgaggagccattttgagcaatggggaatgctcacggactgtgtggtcatgagagatccaaacaccaagcaccccaggggctttgggtttgtcacatatgctactgtggaggaggtggatgcagccatgaatgcaaggccacacaaggtggatggaagagttgtggaaccaaagagagctgtctcgagagaagattctgaaagaccaggtgcccacttaactgtgaaaaagatatttgttggtggcattaaagaagacactgaagaacatcacctaagagatgattttgaacagtatggaaaaattgaagtgattgaaatcatgactgaccgaggcagtggcaagaaaaggggctttgcctttgtaaattttgacgaccatgactccatggataagattgtcattcagaaataccatactgtgaatggccacaactgtgaagttaggaaagccccgtcacagcaagagatggatagtgcttcatccagccaaagaggtcgaagtggttctggaaactttggt

SEQ ID NO: 112371 - DNA, 643 bp, Homo sapiens
agggtctgagtctggcgggtaccggagagccccaatttcactgagacttgtcaggcatcttcttacagcaagtgactgattcctcatgttcatcgcccccatttgggcagaggcttcaggggcatctttctgtttgtggttccctcttaagcataattcaagggagtcaccaagactttgttgaggaagttgctttgtgagtgtgtaatgacagaaaccaaggatctgtacacaaagtcaaagtactaaccgataggaaatgaaatattgcaaaactcaagatactaacatgtgtgtctctccaaaagggaggccaccctaaaaagtaatatgttcctagtcactaaaggtgtctgagaggaagcacagtaattgtttgctggacatttggggcaaggatttccttcttagggtataaggttgggccaagggcctatagatgccttctgtttccaacatttcacaagccctgatcgctatgctgggccacacgctgggtgactttcagacagtgagtttggcaggagactgatgtgcaactgagtggccttcgtgttttctcactctcaatgaactcatagccatagaaaatgcactgtgtgtctaatttaccctgatcatcagatgggcacaaatacattag

SEQ ID NO: 112372 - DNA, 519 bp, Homo sapiens
tgacactttgtatggcaagtggaaccactggcttggtggattttgctagatttttctgatttttaaactcctgaaaaatatcccagataactgtcatgaagctggtaactatcttcctgctggtgaccatcagcctttgtagttactctgctactgccttcctcatcaacaaagtgccccttcctgttgacaagttggcacctttacctctggacaacattcttccctttatggatccattaaagcttcttctgaaaactctgggcatttctgttgagcaccttgtggaggggctaaggaagtgtgtaaatgagctgggaccagaggcttctgaagctgtgaagaaactgctggaggcgctatcacacttggtgtgacatcaagataaagagcggaggtggatggggatggaagatgatgctcctatcctccctgcctgaaacctgttctaccaattatagatcaaatgccctaaaatgtagtgacccgtgaaaaggacaaataaagcaatgaatacat

SEQ ID NO: 112373 - DNA, 778 bp, Homo sapiens
tgacactttgtatggcaagtggaaccactggcttggtggattttgctagatttttctgatttttaaactcctgaaaaatatcccagataactgtcatgaagctggtaactatcttcctgctggtgaccatcagcctttgtagttactctgctactgccttcctcatcaacaaagtgccccttcctgttgacaagttggcacctttacctctggacaacattcttccctttatggatccattaaagcttcttctgaaaactctgggcatttctgttgagcaccttgtggaggggctaaggaagtgtgtaaatgagctgggaccagaggcttctgaagctgtgaagaaactgctggaggcgctatcacacttggtgtgacatcaagataaagagcggaggtggatggggatggaagatgatgctcctatcctccctgcctgaaacctgttctaccaattatagatcaaatgccctaaaatgtagtgacccgtgaaaaggacaaataaagcaatgaatacataaaaaaaaaaaaaaaaaaaaaaaaaaaaaaaaaaaaaaaaaaaaaagaaaaaaaaaaaaaaaacactaaccagaagaggacaacaacgaaaaacacgcaccaacaagaaataacggaacacaaaatgagaccacaaaacacggagaacaaggctcaagacgaggaacaaacgcaacgcaaaacaaacacaaaaaaccgagaaggaagaaaacagcaaaaggaaaaaaagagaagaaaaaaacacaaacacaaagaagaa

SEQ ID NO: 112374 - DNA, 568 bp, Homo sapiens
aatgggggaattgtaaggagattttataggttttaaaaggccatcctctagcagtgtgagagttacccgaagctccgcgtccgtgatggtctagggggcttccgaggtgatcgggcagtgtcggtcttcagccgctaagccgagaaggagtcagagagacttaggccagagttccgggggctctgcgagtggctgccagctactgccttcctcatcaacaaagtgccccttcctgttgacaagttggcacctttacctctggacaacattcttccctttatggatccattaaagcttcttctgaaaactctgggcatttctgttgagcaccttgtggaggggctaaggaagtgtgtaaatgagctgggaccagaggcttctgaagctgtgaagaaactgctggaggcgctatcacacttggtgtgacatcaagataaagagcggaggtggatggggatggaagatgatgctcctatcctccctgcctgaaacctgttctaccaattatagatcaaatgccctaaaatgtagtgacccgtgaaaaggacaaataaagcaatgaatacat

SEQ ID NO: 112375 - DNA, 361 bp, Homo sapiens
agcatccggctctgcctcctcatttggacttctgggtcccgagttcctcctgtccctctgctctctctgatgccacggttaatcaactgaactttctcactcttatctttgattcccttttactttcagtcccagactctttgaaagatgagattttaggctgggcatggtggctcacacctgtaatccgagcactttgggaggccaagatgggtggatcacctgacgtcaggagtttaagaccagcctggccaacatgatgaaacactgtctctactaaaaatgcaaaaaattagctggacgtggtggtggcagcctgtaataccagctacttgggaggctgaggcaagagaatcacttg

SEQ ID NO: 112376 - DNA, 902 bp, Homo sapiens
ggggcacatagaaacagaagagagacatagtgtttttttactagcttcaaaatggtctggcttctttctgaaacatagcagcagttgagaaaatgtttattgaatgatgtttcaattttacattttaaaataatttaagtatgcctgaagacattgtacaatctcattatttttgggtccatctgagcaaagacaatgaatatatatgttggtaaggtataaggcagagaagtactctcatgcgaataagagttgcactttagaatatataaacatctgtctgtgtacagaatggtgagagcaatagtcactagaacaggtctaactagatgattgatgtatgtgaaagtatttcatatgcatatccttatgatggaatcccagattagcttatctgatggcagtatgaaatgtataaggtctgtgaatgtccttactaaattacgtaaatatggagcattgtcacgggagtggcttatggtactgagtaaccatgtatgttgcttgtctgatacgtttcacttagatctatggggacttattcatgtgattagtcatctttgtgtgcataatcactgtctcccaacactcactcatttgtttgcacatatagagacatcgtcttcttgtagacaagtcatgcttatcataattcattcaccgtcaccagctctggtattactgaaattgaaaacagtcttactggtgtatctgctgcagtatctacaagatatctcatttcaaaatctacaaaatttttcttggcccttctgcttacttgcttaatcttcctgataatttattttatcaaccatgttctgccagtgctagattttgtttgatttgatattggtggctttgtaagaaatcctagtaccaatgtttctcattatttttcctgg

SEQ ID NO: 112377 - DNA, 239 bp, Homo sapiens
aagtgacttcatcttacctccaatgtccttcctccatctatatctgttatctctagctattttcatcttttctctctgccaggcagttagtagaatagttgaagaatgattttatcagctctcattggactacaggataaaagacctaaaaatatgggataatttaatccaatggctagcaaatacattttgtgttatgtttatggttttcaaaggcattgataaaatcaaactatcat

SEQ ID NO: 112378 - DNA, 265 bp, Homo sapiens
tagtttttaaattcttcctcttctttttattattattctaattattattattttattatttacaagactttttttttcttctaacccacaagatatttggggaataaaaataacagcttggtgtgtagcatctgcagccacttggcaaatgagtttacagtattgtctcctttaagtgaatatattttgtctacaaagtgtatttggatttaaaaaaattaattaggtctttcagttggtaaggagagtttttgaataattctaa

SEQ ID NO: 112379 - DNA, 389 bp, Homo sapiens
actccctgcagtgcaaacaagcatggggcagggatgcagtgatgcagagaaaggctggcttccctggatccatccagtatttaaactccatccagtctttaaacccccaatcatcagtactctggtccctttcatctgagggctaacccaagtcagctgctcatcctcagccctcctccaaagggacggaggaggccagcagcaagccaatggcatatctaagaagcagcccaattttacaggctgaaaaactgaggcaccggtttaggtgtggagaaacaaaaaaaaaaaaaaatgaagccaggcttctacaaatctcaaacctgcatgacgttcttgtcacaaagtggcctagtgtgaggcacttgtgcccacactaggggtgcagg

SEQ ID NO: 112380 - DNA, 552 bp, Homo sapiens
gtagcggttctcatacagtgcgctggactggatggccggccagatgaactcctccacaaactccctgctggcatcctcaatgaacacctttttggtcccaagcttcagtgccttcttccaggcttcctcgaagtcttccttctggccagtgttggccaggtaggcaatgatgtcatagccttgttccttcagccacacgaggatgcaagaggtgtccgggctgccactgtaggccagaaccactgagcctttgctggacatagcatctgggattggaggctcgagttcctggcatctgccatctgtcttcatggtgcggtgaaccactcgggctcagggagcggtggcaggcgacagagcagggagtataatttcaaaataccaaaccatccacaaaaacccagagaatagtacccataaccagcttcaacaatcgtcaatattctgcccttctcgtttcatcctgcctctccaccttacctactgtagtactactttaaagcaaatttcagaaatcaaaatagtttcaccttgacagtaaaattaataaga

SEQ ID NO: 112381 - DNA, 358 bp, Homo sapiens
tttcctggcttaacacatgaggttttctattcagtaatctcatctgttaaggaaaaatttaaatttaaaagcctggctggtatggtggctcatgcctataatcccagcactttgggaggccagggcaggcagattgctagcactcagaagtttgaaacacttgggcaatgtgagaaaaccccatctgtacaaagaatacaaaagaaaaaaaattagttggttgcagtggtgtgcacctgtagtcccagctacttgagaggctgaggtaggaggatcacttgagcgtgggaggcggaggttgtagtaagtggagattgtgccactgccctccagcttgggtgacagagccagaccctgt

SEQ ID NO: 112382 - DNA, 555 bp, Homo sapiens
tgtcttgttcactggttgctccctggcacctggcacctggcactaggtggccttagtcaatactgagtgaataaatgaatgagtgaaaggggtttaggggaaaggccctgactctgtacgtgatctgcagatgttcaggctctttgttttaacacctgaagatttgagggttggactaggtgagctctgatgtttgtcatctttgtaggcttcaccctctgcctgtcccttttgctcctggatgatggtgggttgtatggtggggcttgagattaacgggagaggctgtggatgaagggagttaaaggtcactgctacttagttagcagcaggacggagtatacctaaagcaatctagccaattctttcagttccaaaatccagattccaacagccatcagaacaacacagccctgtacttggccgtgcaagatctcccagctattatgtcatgacagccagcccagcccagagctgtctctgaaagtctaggatatagccttgctcggccaatgagttctgcctgggaagttaactaatgatagtagttctcat

SEQ ID NO: 112383 - DNA, 295 bp, Homo sapiens
cactcacccacacacatgctcacgtgcacacacacatacacatacagaaacacacaggtatctgctcatttctcctttttaatggaaggataatccaccaaaataacttgttttaatttagcattgcctcaagggggagaatacaagaagaggaagtagaagagagagagtagcaggttcaattttggaattgagtaaatatttcacgtaattgtaaaacagtcaaaatttcaaaaatctcaaaatccaaaacaaaataatagaaatgaacataactgctaattaaattaatggc

SEQ ID NO: 112384 - DNA, 274 bp, Homo sapiens
cagagtccaaacagtgctcagagtccaaacagtgcccagagtccaaacagtgcccagagtccaaacagtgcctaaaatcactggagaccaggttagcactccaactctaccacttagttgtgggaccagagaccaggtactttctaaattttggtttccttatccgtaaaatgggaatagaaatgtctacacttcacagggtttcagtgtttcactggaagagataacctatgcagtgtttagcatagtgcctgacacattgtttaacaaatgt

SEQ ID NO: 112385 - DNA, 719 bp, Homo sapiens
agagtaaggaaagcaaatctattattgaagactatatgaagaaaaccacagtctggtttgaactttgttaatttgggttacaatatttcatataataattttgaagcaaagcaatttaaatatgtgaataatattccagtgcacattagactatcatacacttcaaatggcattttcctgtgccttttttcaaagtccattcagtgttcttaatttctaaaggtaattcattagcatttaaagatattagtagaaaaaattgaccaatttcaggagaacctttatttgaattgtattcagttttaattaattctttgctatgttcgtgatataattggaggcttttatgggataactttatccctgttactgttcattagcacttataattgatgttgagaaaacacagaaaattaagcccagataagtttattttgctgtttattatggtcaatggtaaaatacccagtttaaaaaaatatgatggatagcaggtgtaatagaaaagaaatccacaaagaaggaggtggtcagtaattcacaagagaaaacattaagggttcagcagaatacttacaaatattaggtatgaagtaacaaagtaaactagaagctttaacatgaagagttatagaaacttgatgcaggattagtgtttaatatatagtaagagtggctattcttggtcttaaacaaatagatttaattggaaggtgagg

SEQ ID NO: 112386 - DNA, 3499 bp, Homo sapiens
  misc_feature (1653)..(1653): n is a, c, g, or t
cgcggtcccgcctcccgcccgctccgcagcgccagctcggcaggcgcggggcgtgagtgtggagtgagacccgccgggctccaactccgcagcgtcggagcgcggcgggcagcaactttctccccggagcggccgtggcggcggctgctgccgtggcagccggagcggaagccgggaggaagaaagcggcggcagcggcggttgctcccgccggctcgggctgtctagctcgccgagactgccggcccgcggagccgcgtccccccgggcagccccgggcccctgccctatgtcccgcaaggcaagcgagaatgtggagtacacgctgcggagcctgagcagcctgatgggcgagcggcgcaggaagcagccggagccggacgcggcgagcgcggccggggagtgcagcctcctggctgccgccgaatcgagcaccagcctgcagagcgcgggcgcgggcggcggcggcgtcggggacctggagcgcgcggcgcggcggcagttccagcaggacgagacccccgccttcgtgtacgtggtggccgtcttctccgcgctgggcggcttcctgtttggctatgacaccggggtggtgtcaggggccatgctgctgctcaagcggcagctcagtctggacgcgctgtggcaggagctgctggtgtccagcacggtgggggcggctgccgtctcggcgctggccggaggcgccctcaacggcgtcttcggccgccgcgctgccatcctcctggccagtgccctcttcaccgccggctccgcggtgctggctgcggccaacaacaaggagacactgctcgccggccgcctggtcgtgggactcggcatcggcattgcttctatgacagtgccagtgtacattgcggaggtctcaccacccaatttaagaggccgattagtcaccattaataccctcttcatcacaggagggcagttctttgcaagtgttgttgatggagccttcagttatctccagaaggatggatggaggtacatgttgggacttgcagcagttccggcggttatacagttttttggctttctctttttgcctgaaagccctcgatggcttattcagaaaggacagactcagaaggcccgtagaattttatctcagatgcgtggtaaccagaccattgatgaggaatatgatagcatcaaaaacaacattgaagaggaggaaaaagaggttggctcagctggacctgtgatctgcagaatgctgagttatcccccaactcgccgagctttaattgtgggttgtggcctacaaatgttccagcagctctcaggcattaacaccatcatgtactacagtgcaaccattctgcagatgtctggtgttgaagatgatagacttgcaatatggctggcttcagttacagccttcacaaatttcattttcacacttgtgggagtctggcttgttgagaaggtgggccgcagaaagcttacctttggtagtttagcaggtaccaccgtagcactcattattcttgccttgggatttgtgctatcagcccaagtttccccacgcatcacttttaagccaatagctccgtcaggtcagaacgccacttgcacaagatacagttactgtaatgaatgtatgttggatccagactgcggtttctgctncaagatgaacaaatcaactgtcattgactcctcctgtgttccagttaataaagcatctacaaatgaggcagcctggggcaggtgtgaaaatgaaaccaagttcaaaacagaagatatattttgggcttacaatttctgccctactccatactcctggactgcacttctgggccttattttatatcttgtcttctttgcacctggaatgggaccaatgccttggactgtgaattctgaaatatatcccctttgggcaagaagtacaggaaatgcatgttcatctggaataaactggattttcaatgtcctggtttcactaacatttttacacacagcagagtatcttacatactatggagctttcttcctctatgctggatttgctgctgtgggactccttttcatctatggctgtcttcctgagaccaaaggcaaaaaattagaggaaattgaatcactctttgacaacaggctatgtacatgtggcacttcagattctgatgaagggagatatattgaatatattcgggtaaagggaagtaactatcatctttctgacaatgatgcttctgatgtggaataattttcagctgctcatatatttagttatttaaacaaactggggggagaagaacagcaattggtgacttcactgccctgcttctaatctggttctttccacagcctagttttgattgacttcatattctagaatacttgattaggaggaagatacaaccatgatgactttttttttccacaaggaacaatattttaaaaaatatttacagagattttaatctaataattcttaagcaaatgtgtgtaatgccttcctgaaatagtctaaaatgaatattgtacccagtgacttcagtggtatccttttttcctaagaccatttataattattagtggcaacagagtcagtgctaatctagccaaattacatatgtataatatatttataaaggattctgggagatggtccaagggtgttctgtgtcaaaagatggcctattggccctcagttttcctacagagtagtggcttatctctgatcagctgttacaaactaaattccatgtaagctttcatcaacaaattccaaagtgcctcctacaagggcacagctgtccgtatctcctttggattccatatttttgtttctctccaattcagatattgggagttcttcagatactgactctgcacactatcttttgaacattatgaaaatataatctgtcgggttgttttcatacttcctttttttgcatcagtgataaggcatacatttgcgcagatgagctaggaagttttgagaagtaccttttatgttcagaaagtaacagattaaaggtttttatgggttccaaattggttagtcacttaggtatgcaattataaatgcaaaatagtgccagatctttaactgtatatcagggtcagtttttgttcatgcccaaatcactacaccttcctcattggccttggagtcctactattttgtgccttcatttgtgttacatacatagctgcaagcaaaccatttttcccctttcttttattcaaacaataatttttgaaacaaaaaagaggaaggaaatcagtggcagaaataatcctgctgttattggtgtttgtttaataaaaataatgggacttttttcttaactttttattagctcttcctaagggaaatgtcacatattattatttaattgtacttgtctttttttactttaagagcataaactcgtttttattttgcacacttttctcattttcctgagaatttaccagaaaaaaaaagatacatagatttgtctctgtgtttttctta

SEQ ID NO: 112387 - DNA, 1643 bp, Homo sapiens
cgcggtcccgcctcccgcccgctccgcagcgccagctcggcaggcgcggggcgtgagtgtggagtgagacccgccgggctccaactccgcagcgtcggagcgcggcgggcagcaactttctccccggagcggccgtggcggcggctgctgccgtggcagccggagcggaagccgggaggaagaaagcggcggcagcggcggttgctcccgccggctcgggctgtctagctcgccgagactgccggcccgcggagccgcgtccccccgggcagccccgggcccctgccctatgtcccgcaaggcaagcgagaatgtggagtacacgctgcggagcctgagcagcctgatgggcgagcggcgcaggaagcagccggagccggacgcggcgagcgcggccggggagtgcagcctcctggctgccgccgaatcgagcaccagcctgcagagcgcgggcgcgggcggcggcggcgtcggggacctggagcgcgcggcgcggcggcagttccagcaggacgagacccccgccttcgtgtacgtggtggccgtcttctccgcgctgggcggcttcctgtttggctatgacaccggggtggtgtcaggggccatgctgctgctcaagcggcagctcagtctggacgcgctgtggcaggagctgctggtgtccagcacggtgggggcggctgccgtctcggcgctggccggaggcgccctcaacggcgtcttcggccgccgcgctgccatcctcctggccagtgccctcttcaccgccggctccgcggtgctggctgcggccaacaacaaggagacactgctcgccggccgcctggtcgtgggactcggcatcggcattgcttctatgacagtgccagtgtacattgcggaggtctcaccacccaatttaagaggccgattagtcaccattaataccctcttcatcacaggagggcagttctttgcaagtgttgttgatggagccttcagttatctccagaaggatggatggaggtacatgttgggacttgcagcagttccggcggttatacagttttttggctttctctttttgcctgaaagccctcgatggcttattcagaaaggacagactcagaaggcccgtagaattttatctcagatgcgtggtaaccagaccattgatgaggaatatgatagcatcaaaaacaacattgaagaggaggaaaaagaggttggctcagctggacctgtgatctgcagaatgctgagttatcccccaactcgccgagctttaattgtgggttgtggcctacaaatgttccagcagctctcaggcattaacaccatcatgtatgtatttctttctggctttttactgaaaagattgtgaaaggattattttatgtgaaatagtgaaaagtatttcatgtaaatactagactcagtgatttgttctgattaaatgtatgaattctccttttgggagatactgactttacaattttttaattccagtaatttgttactagataaaggtgatttattttgtttgttatatgattggctttatttgattccataaaatttctcttttacgccatccaatacctccttgtattctgagcttaaatgtgtcattttttctaagccatttcttgatgctggttgga

SEQ ID NO: 112388 - DNA, 781 bp, Homo sapiens
gggaaaagttctcaacccagaatcggggcttaggttctagttcctggtttgctataaatggcactttgactttggaatgtctctggcttccgtttatccattagtcagagaatgatgggacagattacttctgaagaccccttatgtcctataaatctcatagttctcaacaagagggaaacgggaacaacaggggcagaaaccaacgagaggctgaggaaaccaaaccaatgagttttggattgtagctaaccgaggagaaccaggtgtgtcaaaggtgatgaaagtcagatgtgtaaaaagcaagaaggaaacaaaatgaagaacatgagccctaagaattcagtgtctttccctggtaaaactaagaacatcaggaaagccacactcgatgaggcacacatttttccaagccagttttcactctgacagggttacctcaagtgattgtttgagagagggtagaggggttgactacactcattcaatctgccaaattagaaaagtcacccagaataccctgtgctttttgagtgattttcatgtttatctcccgtagcttgctattttgttattcaaaaggagtgtaaacttagggcattcatgtataatacctttcataactcatgttaaaatgctgatgttattggatttctcaggaacactactgttctatttctccattcaaaaaggtaaaaaaaaaattaattactctattttcatcattaatcccatttcccccattgtctttgtattctacataggaagcatgccatagatc

SEQ ID NO: 112389 - DNA, 454 bp, Homo sapiens
aagagggaggaagaaactataaaccgaaaaagaaactgacaaacttctctaattgggaatttacatgcagagagtgagagaagatacatctccccataaaaggattgagaggctgtcagattctctggctgtgctgtttggtgaaggtcttcccctatagaaagccagtatgtaaagattgggagaggtggctgtttttcaaatgcaaaaatcacaacaaaaaataacaaggcacacaaagaaacagggaaatcagtcaaagaaacaaaataaatctccattaactgactccgaagaaacagagatctattagttacctgaaaaagaatttatgataatcttaaagaagctcaatgtgttacaagagaatacagatagacagctaaatgaaatcaggcaaacaaagcatgaacagaatgaggatatgaacaaagatatagaaactataaaaaag

SEQ ID NO: 112390 - DNA, 353 bp, Homo sapiens
taagacaagttgctggtttctatttgcacgcttctctcatctcctttccatcccaccctaactccaatgtcaagaggccttggttcagccaggcgaggtggctcacctgtaatcccagcactttgcgaggccaaggcaggaggctcttttgagtccaggagttcaagaacagtctgggcaacaaagttgagaccccgcttctacaaatgcctctacccccaccaaagactagcatggaggcaggcctgtgttcccagccatactggaggctgaggaaggaggaccgcttgaccccaggaggttgaggctacagtgagccgtgtttgcatcactgcactccagcctgggcaaca

SEQ ID NO: 112391 - DNA, 292 bp, Homo sapiens
caaggatttccttaaggactaattgggtaagatttctgaacagataagcacttttccaaagttaaatacaaatactagaaaaagaatatcattttcacagtattttatgatagggataattcaggtcctaattttggtgttatttaaagggaccttattttctgccccttttcaatccccttagtaaattatttttattgtaattttaacttatgctgaatacattttattttttgaggcagagtctctgtcacccagggtggagtgcagtggcacgatctcagttcactgc

SEQ ID NO: 112392 - DNA, 335 bp, Homo sapiens
tggaaacaatctggtcactgcaacttctgcctcccgggttcaagtgattctcctgcctcagcctctcgagtagctgggattataggcatgcaccaccacgcttggtaatttgtatttttaatacagatagtcagatatcttatatttttacaagatagtcaggtattttgtatttttagtagagatagtcagatatttgtagtagagacagtcaggctggtctcgaactcctgacggctgagatgagatgggggttaagcctgggagggttgcaaggttgcagtaaactatgatctatacttccagcctaggcaaacagtggcctaggctggagg

SEQ ID NO: 112393 - DNA, 385 bp, Homo sapiens
tgagacagagtttcactctgttgctcagtgcagtggtgcaatctcagctcactgcaacctctgccttctgggtttaagcaattcgcatgcctcagcctcctaggttagctgggattacaagtacccaccaccatgcccggctaacttttggattttcagtagagacagggtttcatcatgttggtcaggctggtctcaaacacctgaccaagtgatctgcccacttcggcctgccgaagtgctgggtttacaggcatgagccaccacacctggcccacacacagctttaaattggttactttagtgtctcattcttaagaaagccatggatggccacacatttgcccaaatatacaatatgataagcagacatcttaaaagagac

SEQ ID NO: 112394 - DNA, 604 bp, Homo sapiens
ggacacagcttgcacaggtttattatgcaggtgatgggaaggtttctgatatgacacgtgctctggaccaagggccttgcattttaataagtggagtgaataaaaatttatagccaaatgtcatgttggcagcaatggaagtgtgctccggaggtgacaaatgctttgaggaatatagagtgtctgacagcacaatgtgaagaaatgacagctgccatctttgcctgtctttttctctgtgctgcatttgctttgctcttgtcacctttcttaggctggttactgggcagttggaagagactgtggagaattcaattcagttgtttggcttagggacataaaattgaactgcataattcatggataggtatctgcagcatcgtcttcgtgccctgtagaatgggttgactgccaaaggattttacgattctaaaatcctaacagattttaacagttgcttaaatattatttcttggcatatatagctttttaagtctgtgggtcaaagatagatgtactcatttgagacttagtgatttgttttataagtatgttgaataagttgagccagtttgaaatgtgtccttctcttttaaagaaaaga

SEQ ID NO: 112395 - DNA, 446 bp, Homo sapiens
atatctaaccgtgactgtcaactccacaacatgggccctttgcaaacaattgcatatcggcagccttacacactgaaactaaaactaaatcacctcactccttccagtgctctgggctgcatatccagaacaaattattaaatgccttgacttcttttatagcttaagcaatctgcaagttaaggggttatcctacttctagagaatgctggaaagcttaatgatttctcctaaaaagagatgatccatctcgaaggaagtggatgagaaagggaacaggtgtttaaaaagtatttttatattaaaactgggagctgtggctgggtgtggtggctcacgcctgtaatctcagcactttgggaggccaaggcaggtggtctcaaactcctggccttgagcgatcctcctgcctcggccttccaaagttctgggattatagatgtcgg

SEQ ID NO: 112396 - DNA, 358 bp, Homo sapiens
agctgggactaggcgtgcacaaccatacccagctaatttttttaatttatgttagagatggagtcttgctatgttgcccaagctggtttcacactgctggcctcaagtcattctcctaccttggcctcctgaagtgctgagattataggcatgagccatcgctcctgaccaaaatttactttttaaagcaatttatacaccaaataacgttaattggattacagccaggtgaaaagttccctgagaaccgacaccctacagatatgttaccagaaaccactgttaaaactaaagaaataaaagtaatcctgtacactagcaatgctgtacttggctcattgtcaaagattcctactga

SEQ ID NO: 112397 - DNA, 171 bp, Homo sapiens
ccagatgattgaccagttaatctacaaaataaaccctataggtgaagaaagttaaagacaaatgactggcccagtgcggtggctcacgcctgtaatcccagcactttggggggccgaggcaggtggatcatgaggtcaggagttcaagaccagcctggccaagatggtgaa

SEQ ID NO: 112398 - DNA, 339 bp, Homo sapiens
gctggtctcgaacttctgacctcagctaatccacctgccttggcctcccaaattcctgggattacaggtgtgagccaccgcacttggcccccataaaatggtttttaataataaaagatttcatagaaattaaaaacttatgctcatcaaaaaaaggaaatagacatgttaaaacttgaaataaaatacttgcaaaacgagacaaaagactggaatcaggatatataaagaattaaaaaaaatagattaggaaatgggtgagacatttgaataggcacttcacagttgaccattaagcacatgaaaaagtgttcaacctctagcaattcgattatgatg

SEQ ID NO: 112399 - DNA, 505 bp, Homo sapiens
gtgagccactgcacctggctgattttttatatttttagtagagacgggtttcaccatgttagccaggatggtcgcaatctcctgacctcgtgatccacccaccttggcctcccaaagtgctgggattacaggtgtgagccactgcgcccagccaggaatttatttttaaattaaatttgatttatttagtttcctaacccttttattgtttttaggcaattttttgaagtataatatgaataagaaaattatggtgaattgttacagcatcgagacctccaagaccaggacatagaacaatcccagcccccagaaacctccaccccataaggctccacaacccctcttctaacacacagattaccttcagctcttcttgaacttcatataagtgtgaaactcacccatgctgttgaacacagcactgtttcattcatgtaagcggccttatagtattccattatgtgaacgcagtttattatccgttctgttaatcacagtagtt

SEQ ID NO: 112400 - DNA, 261 bp, Homo sapiens
aattctcagaagacaaggatcttaccttttcaacttgttctgctggaggtacagcacacctgggagtggggagggggcagtgtatgtgtgtgtgtgtgttgcttagtgacactaacaatttgagtcacatttattcacgtgacccttttgagtctacatagctgtctcatctgggattacctgtatcatggatttttaccccctctctccactggttcgttttctaaccactcccaccctccaaagtagtatgagccatag

SEQ ID NO: 112401 - DNA, 381 bp, Homo sapiens
atgcctgggtcccagtctgcaggactctctgctgatctagacacaaagttagcactcttcaaaatcatctggtttatctcataatgataacagtgagaatgatgaattaaaggcagttgactcttccaagaaccacttaccccccactgcctgtagataaaggggataccagggctccatagatgggatgtgctttcaatatcaacttctaagtcagctttctgagtgtgataatcatcccacccttccaagctaagatttcataacaattgtatttattctttggatttgctagctataagataaaaatatggcttaaaatgtgctccaaaagaaggctgccacaaaccatgaggcccacccttgtgagaagaacctagg

SEQ ID NO: 112402 - DNA, 496 bp, Homo sapiens
tctcaagagtgtgactgtaatggctctatgttctgcctgtttccctttaacttacttgaccttcagaggtccacaggttggttctgtgctgcatttcttacatcccttttcgtatttccccaactctgaaattcttgtgaggagagcgctcatctaaaacctcttccatcattgtcttccctttatcttttaacaacttaatcagttctaccgtataccatctttattcacatatttttactcatcccctttgatatattttattattcctgctagcctctaagttttgccctttatcagaggaaaattactctcagttttcatcagatgcagtaaatatagagaaagagactttgaactttgacctgagattgaaactcagttctactgcttaactaggagaccttgggtgcaatttttttacttgtaaagcagggctagtaataacctttctcacaaggtaataagattagctaagattatgcgccaaagccac

SEQ ID NO: 112403 - DNA, 483 bp, Homo sapiens
tacttttccacaggagggaaaacatggttcggaaatttaagacctggtcgtattaaaaaagatcaaataaggatcctgaggcttgtgcctgggacatgtgcctttagtgtgaagaaagaccccaactctccaacggacgcctgattacttttatagaaagagatagtctgcaaagccgacagcaaaaatggctcagacaaaagctgaaaacactggaaactgcagagatttgtgcacaaaagctggtttcattaatttgcatcttcagcacgtttatctacatctcttttcttatttttaaaagtgttttgcaacatgaatgtaaaacactttgaaaaagaatctctaaagctgtagtcatgttctgtatccggattgtggtggtggttacataaacctatacaacgtgttataactcatagaactttgtaaaccaaaagagtcaattttactgtatgataagtttaaaaataaaattaatta

SEQ ID NO: 112404 - DNA, 671 bp, Homo sapiens
gtgtgtatatatgtgtgcatgtatgtgtgtatatgcatgtgctgtgtataaaatgggtcatgatgtttttcttactgagtttctaaaatgtttgaaagccactgatttaggcctctgcttctcaagaaggcatgcatctattacaggccttattgggtaaattttcttcaactattaattttacttcaacattttagcagaaacaaaccagaaaaacaaacatataaacatacaaaccacacattagttttataacaaatacaatcacaaaggtagcatatagaagataaataaaattcacaaattttaaggaaaaaaattagctgggcatgctggtgggtgcctgtaatcccagctactcaggaggctgaggcaggagaattgcttgaacccaggaggcggaagttgcagtgagccaagatcacaccattggactccagcctgggggacagagtgagactctgactcaaaaaaaaaaaaaaaaaaaacgcggggtaactcatttaaggggtaacccccaaatttttaaggcaaaactttgccctcttgtggaaagccctgaggaaaacccccaaggatttaaacttctcctcggcggttccccttcggtgaaaatttcgggaagtccggcccttaggtggaatttccaaaatttccccaatgggtgtttc

SEQ ID NO: 112405 - DNA, 120 bp, Homo sapiens
gtctttgagaggctctggagtcagacagacttgcatgtgaatgcattctgacttcactacatcctacttgtatgatactgggtaaattaccataaaatggagataagaatagttggttaa

SEQ ID NO: 112406 - DNA, 450 bp, Homo sapiens
ccaaagtgctgggattacaggtgtgagccacagtgcctggctggttctctaatttttgaaggaatgctttggtgcaggaacaaagccttgtctcccctgcagctcttggtaggagtgaggaagtgtccaacctgaaatggggtggtattttgtagctcaacaggaaatgtccagatgtaaggccagttttggtttgacacattgaccatactgataggcctcctgacaggtcattctaccttcgggacctggagttccccggtacacgaggtgtaggtgtaatttacttaccagctcacatgtgcccctcatgaaaacccatggcccattcttgtccatgtagtgttgtagttatcaaaattatttctgttcttatatgtttctaatttttgcttgttcctctttcttttctttttctttttctttttttctgtcatactgccctgtgag

SEQ ID NO: 112407 - DNA, 685 bp, Homo sapiens
ttttttctgccattaactttttcttatattttactaaaactgaccttatcatttcaaacctgtgaacctagttctatcctgttttttttttccctacgtatttcgcttgtatacacactcacattatatatatgtaattttttttttttttggttgggaagaaaagatgcctcattttgaaacctaaaggggggaataagaaaagccctttgtaatatattgccatattatcactaaatcccctgacagttgtgacacagaagcaagtcacctgtcacttaagcttgaggtctctttaattttctcctggaattcgcaccaggctgtctttaatttgaggcctttattggaattctgaaacctctctgcctccctggctctcagatctattctgagagctgttacagaatgtatacaataaccaacagagggattcggagagggctggagctctgtttatttaacactctagagggatttttgtgcttattcggtcctggctgcccggctttcaatattgctttgacaaccattctgcccttctcattaattttaaacagttaaaacacaagaaaaagaggaaaaagttttcattattaaagtgctttactttttaataacagaggattctgtccgccaggggaaagggcatcctcgctaatttcacattcatattaaaaaaaaa

SEQ ID NO: 112408 - DNA, 271 bp, Homo sapiens
taagccaagattcaagccgaaagtagtgttttatcacagcagttttctttccacaatatataagagtgtgggcaatactctctcaatttaccttgtcccttttgcctgctacttaaaaataacacaattcataacccttgaaatataaaaatgttgctcttctttccaattctaactggcaatagcaatcatagactgtggtgggcagaatctgaaatgacccccagtgatctctgtctgctgtataatctcctcgccttgagtgtggttg

SEQ ID NO: 112409 - DNA, 709 bp, Homo sapiens
ctttcagggcctgctatctgtcatgtgatgctacactagagtcacattggaatttggtctcttatgctacaaagagcctgttttgtcagtcttaagatctctgttttaacgtcagctggtcggttgtgctgaattccaaagggaaggagggtatcatgaggcatgtctgaccctctcttcttatcatggcctgaactagtttttcaggtttactttggaatgccattggctgaaaaagggggattcgttcagtcagatgggggacttagaattttatatttggttgacatgtttttatgatttttctccattcaccctttcattattcctctgagagtggttggagtctattagggctggccttggaataagtgggctagttatctactggcatttgatagtttcaggtctgctaggaggtcaatcccctctgaccgcaaaggggatttccatcttaaacacatctaccacatgtcaaacattccagtattagaaattcattctgctggatcttggagatgtctttggtacctcactgaaatgtatgtacctttggtcagggcaggttgtcgcccaaactaaatttagcacagcagaagacaattcattaatgggatgcttctggtgaagtggcaagaaacaaggctagcagaaagttgagcaggtattgagaaccattttaccatatgactacattaataaatgtatg

SEQ ID NO: 112410 - DNA, 1543 bp, Homo sapiens
  misc_feature (153)..(153): n is a, c, g, or t
gtggtgaaggtactgccgctggtgttcctgtctgcagtccagctgctgggtgctagtgcactaagccctgttgccattgagacgtgggcggggcagtgcctccttccctccggtgtcccgctgctgcactgcgcccacggccacggatgtccngccgcgagagggggcggagcgagcgtgcgcggcgggcgcgcgcaggctccgtaaccgaaccctgagccgcctgcgcggatcggcgtccgcagcgggcggctgctgagctgccttgaggtgcagtgttggggatccagagccatgtcggacctgctactactgggcctgattgggggcctgactctcttactgctgctgacgctgctggcctttgccgggtactcagggctactggctggggtggaagtgagtgctgggtcaccccccatccgcaacgtcactgtggcctacaagttccacatggggctctatggtgagactgggcggcttttcactgagagctgcagcatctctcccaagctccgctccatcgctgtctactatgacaacccccacatggtgccccctgataagtgccgatgtgccgtgggcagcatcctgagtgaaggtgaggaatcgccctcccctgagctcatcgacctctaccagaaatttggcttcaaggtgttctccttcccggcacccagccatgtggtgacagccaccttcccctacaccaccattctgtccatctggctggctacccgccgtgtccatcctgccttggacacctacatcaaggagcggaagctgtgtgcctatcctcggctggagatctaccaggaagaccagatccatttcatgtgcccactggcacggcagggagacttctatgtgcctgagatgaaggagacagagtggaaatggcgggggcttgtggaggccattgacacccaggtggatggcacaggagctgacacaatgagtgacacgagttctgtaagcttggaagtgagccctggcagccgggagacttcagctgccacactgtcacctggggcgagcagccgtggctgggatgacggtgacacccgcagcgagcacagctacagcgagtcaggtgccagcggctcctcttttgaggagctggacttggagggcgaggggcccttaggggagtcacggctggaccctgggactgagcccctggggactaccaagtggctctgggagcccactgcccctgagaagggcaaggagtaacccatggcctgcaccctcctgcagtgcagttgctgaggaactgagcagactctccagcagactctccagccctcttcctccttcctctgggggaggaggggttcctgagggacctgacttcccctgctccaggcctcttgctaagccttctcctcactgccctttaggctcccagggccagaggagccagggactattttctgcaccagcccccagggctgccgcccctgttgtgtctttttttcagactcacagtggagcttccaggacccagaataaagccaatgatttacttgtttcacctgga

SEQ ID NO: 112411 - DNA, 1576 bp, Homo sapiens
cgcggatcggcgtccgcagcgggcggctgctgaggtgagggccgggccagaggagaggcatacccactggggcgtaggtctgggactccccctgtccgccctggcgcgacctcaggactctccgtgtcccctccgtgacccccgcggcccgggccgctctttgcatcttgtcttgcccacagctggcctcggccaggtccgagggcctggatgcgaccttggggcagcccctactcttccgggcagcccacttccgcggccaccggtgcagggcatgccccggggccgtggagctgccttgaggtgcagtgttggggatccagagccatgtcggacctgctactactgggcctgattgggggcctgactctcttactgctgctgacgctgctggcctttgccgggtactcagggctactggctggggtggaagtgagtgctgggtcaccccccatccgcaacgtcactgtggcctacaagttccacatggggctctatggtgagactgggcggcttttcactgagagctgcagcatctctcccaagctccgctccatcgctgtctactatgacaacccccacatggtgccccctgataagtgccgatgtgccgtgggcagcatcctgagtgaaggtgaggaatcgccctcccctgagctcatcgacctctaccagaaatttggcttcaaggtgttctccttcccggcacccagccatgtggtgacagccaccttcccctacaccaccattctgtccatctggctggctacccgccgtgtccatcctgccttggacacctacatcaaggagcggaagctgtgtgcctatcctcggctggagatctaccaggaagaccagatccatttcatgtgcccactggcacggcagggagacttctatgtgcctgagatgaaggagacagagtggaaatggcgggggcttgtggaggccattgacacccaggtggatggcacaggagctgacacaatgagtgacacgagttctgtaagcttggaagtgagccctggcagccgggagacttcagctgccacactgtcacctggggcgagcagccgtggctgggatgacggtgacacccgcagcgagcacagctacagcgagtcaggtgccagcggctcctcttttgaggagctggacttggagggcgaggggcccttaggggagtcacggctggaccctgggactgagcccctggggactaccaagtggctctgggagcccactgcccctgagaagggcaaggagtaacccatggcctgcaccctcctgcagtgcagttgctgaggaactgagcagactctccagcagactctccagccctcttcctccttcctctgggggaggaggggttcctgagggacctgacttcccctgctccaggcctcttgctaagccttctcctcactgccctttaggctcccagggccagaggagccagggactattttctgcaccagcccccagggctgccgcccctgttgtgtctttttttcagactcacagtggagcttccaggacccagaataaagccaatgatttacttgtttcacctgga

SEQ ID NO: 112412 - DNA, 2909 bp, Homo sapiens
  misc_feature (911)..(911): n is a, c, g, or t
  misc_feature (1968)..(1968): n is a, c, g, or t
aggcttaagctgtcctcccacctcggcctcctgagtagctgtgacaagaggcgtgtaccaccatgcttggctagtttttgtattttttatagagatggtgtttcgccatattgcccaggctggccttgaacttgttagctcaagtgatcctgcctcagcctcccaaagtgttgggattctagggatgagccaccatgcccagctggattcctttttttagtttgtttgtttttaaagacagttttccttttttgcccaggctggagtgaaatggcatgatcttggctcactgcaacctccacctcgtgggttcaagcgattctcctgcctcagcttcctgagtagctgggattacaggtgcctgccaccatgcccggctaatttttgtatttttagtagagatggggttttgccatgttggccaggctggtctggaactcctgacctcatgtgatccacctgcctcagcttcccaaagtgctgggattacaggcgtgagccaccgtgcctggcctccagctgaattcctttgctttaagtgtatatatgtctccaggggctgtcttcatttcagcaggctgtcctggcctgaaggaggcacccctaggctccttcctctgaacattcctagcctaggagctgggtggtaggaggtagcatgctgggaagcaggcacattcctatacctggggtcccaagagagccattgggtgggtgggcagacagaacatacagtttaatagggccagggagaaactgtctccctcctttgctcttttcaggcctgcggtccctggggcactgatcattatttaaggagcagtgagggcctggcatcctgtcccctggtcagaagaaactacccaaaacttaaagctcccccagctccctgaccacctcattcacaggcntctgtcctgggagccacacctggggcctcagcaagaggagggccctgggccagcagcctgggcttctagggctcacctcacctctgccagtagcgcccagagggcatattctgggggctgagtgggtggtgggggtagggagagaccccaaattcccccctctcctaattctcccacccccaacctaggccccatttgaggctcaaggaaagccccaggctgagtccaggcgccaagcagaccccagctgcacctggcttggctccaacaccatggagacagtggctggggaagctggctaacccctcaccttctgtgatgtttgacagctgaccctctccccatcatacaggaagggtagcagatccactttctcccagtctggattcctgcacacagcgagcctgagccatgtgttcctccttgccaccccagcctgcattcagtgcctctgatccagggagatgaacccaggggttgctcctggacagggcagatgaaggggctgcttgcttggaggatgtattgggggtggaaggagcaggttagaaggagtttgggccatcaacctggctcagcactggtttggggcaccccaaccaccagcagagtgctctcatcatccccttttgctatcttgtggctcaggaagcaccagtcattgggggtggggtgggtaagggtttctcagggtcgacccaggcatagggagagaaaacccttaacatgtttcatcccagcaccctcctccttgcagctggttgagtatttctcaggccttctccatcctcctcgtacttcagctccctcctcaactgggacttggtgtgtaccagaggcaggggcctgctgactccctggatgctgctcctgggagccctgcacgggggagggctgcagaggggcctcctgctgcattctgcagtcctcgtgccctgtgggtgatgttctgtagctggccctggacacatctctttccaagcttgaagtgggggtgggggaaggtggagaggacactacttgtgtctctttgttctacctcagctcctcacctcanggctgagtggcccttaataaatgtggggggagggcagcaggctttgtggaagtgcagggagctgaggctaatttagagtggggagaagagtgcacagctgcctcctcccaccctctctccctccctccctccttccctccctcccttcctcccagctctttccctctgccctgtctgtgcagccccagtcagggtagagggcagagggcagctggagcaagccccctgagcccgggaggctgcattattcatgagtgcactgcgtgctgagttgcctctccctggaggagggggtggggtggtcctagctaacctgtgctcccttttcctggtcataggaggagctgacacaatgagtgacacgagttctgtaagcttggaagtgagccctggcagccgggagacttcagctgccacactgtcacctggggcgagcagccgtggctgggatgacggtgacacccgcagcgagcacagctacagcgagtcaggtgccagcggctcctcttttgaggagctggacttggagggcgaggggcccttaggggagtcacggctggaccctgggactgagcccctggggactaccaagtggctctgggagcccactgcccctgagaagggcaaggagtaacccatggcctgcaccctcctgcagtgcagttgctgaggaactgagcagactctccagcagactctccagccctcttcctccttcctctgggggaggaggggttcctgagggacctgacttcccctgctccaggcctcttgctaagccttctcctcactgccctttaggctcccagggccagaggagccagggactattttctgcaccagcccccagggctgccgcccctgttgtgtctttttttcagactcacagtggagcttccaggacccagaataaagccaatgatttacttgtttcacctgga

SEQ ID NO: 112413 - DNA, 485 bp, Homo sapiens
gggcgctctagaggatctcaatcgcacgaacaaggagcctttcgagcatgagtcattgctcttgaaccgaaaggatcacaagctaaccaaggctgagaaaaaagcagcaaagaaaagctatgaggaagacaaacgcacatcagtcccctatacccgcccatcgtatgcgcagtattaccctgccagcgatcagagcctgaccagcatccccgccttcagccagagaaactggcagccaactttgaagggtgatgaaaagcctgtggccagtgttcgtcctgtgcagtccacccccatccccatgatgccccggcatgtcccattgggaggaagtgtaagctctgcctccagcacaaatccatccatgaactttcccatcaactacttgcagcgtgcaggagtccttgtgcagaaggtggtcaccacgacagatattgttattcctggactcaacagctccttgtcgtggcgattgaatcctctag

SEQ ID NO: 112414 - DNA, 4477 bp, Homo sapiens
gcagctataggcgccaccaatggcaagaacctagcctccgggaccccaaaaagaagagagctcagaagccctcccacatgagaagaaacatacgaaagctactccgggaggatcaattggagcctgttaccaaagcagcacagcaagaagagttggaaagaaggaagcgcctggagcagcagaggaaagattatgcagcccctattcctactgttccgctggagttcctccctgaggaaattgctttaagggcaagtgacggtccccaactgcctcctcgggtcttggcccaggaagtcatttgtttggacagtagcagtggcagtgaggatgaaaaaagcagtcgagatgaggtgattgaactgagctctggagaggaggacactctgcacattgtggacagcagtgaatctgtcagtgaagatgatgaggaagaagagaagggtggcacccatgtcaatgatgtcttaaaccagcgtgacgcccttgggcgggtccttgtcaacctaaaccaccctccagaggaggaaaatgtcttccttgccccacagttggcacgggctgtgaaacctcatcagattggcgggatccggttcctttacgataacctagtggagtctctggagaggtttaagaccagcagtggctttggctgtattctggcccacagcatgggtctggggaaaactttgcaagtgatctctttcatcgacgtcctcttccgccacacgccagccaaaacagtccttgccattgtgccggttaatactcttcagaattggctggcagagttcaacatgtggcttccacctcctgaagccctcccggctgacaacaagcctgaagaagtccagcctcggttctttaaagttcacatcttgaatgatgagcacaagacgatggcatctcgtgctaaagtgatggctgattgggtgtcagagggtggcgtgctgctgatggggtacgagatgtacagactcctcactctgaagaaatcatttgccacaggtagaccgaagaaaaccaagaagcgttctcacccagtcatcattgatctagatgaggaagatcggcagcaggagtttcggagagagtttgagaaggctttatgccgccctggccctgatgtagtaatctgtgatgagggacaccgcatcaaaaactgccaggccagcacctcacaggctctgaagaatatccgctctcgccgccgggtggtgctgactgggtaccctctgcaaaacaacctcattgagtactggtgcatggtggactttgtgcgcccagacttccttggcacccggcaggagttcagcaacatgtttgaacgccctatcctgaatgggcaatgtattgacagcacacctcaggacgtccgcctcatgcggtaccggagccatgtcctgcacagtcttctggagggctttgtgcagaggagaggccacactgtgctgaagattcatctccctgccaaggaagaaaatgtgatccttgtgcggctctccaagatccagcgagatttgtatacacagttcatggatcgcttccgggactgtggtagcagcggttggctggggctgaacccccttaaggcattctgtgtgtgttgcaagatctggaatcaccctgatgtgctgtatgaagcccttcagaaggagagcttggccaatgagcaggacctagacgtggaagaacttggctctgcagggaccagtgcccgctgtccaccacagggaacaaaaggcaagggagaggatagcaccttggcttcctcgatgggagaggcaaccaatagcaagttcctacagggcgttggcttcaaccctttccaggagcgaggcaacaacattgtcacatatgaatgggccaaggaccttctgactaattaccagactggagtcctagaaaactctcccaagatggtactgcttttccacctgattgaggaaagtgtgaagcttggggacaagatccttgtgtttagccagagtctttccaccttggctctcatcgaggaattccttggaaaacgagaagtaccctgtccacctggtaccgaggggcaaggagcacagaagtgggttcgaaacatcagctacttccggctagatggtagcacccctgcctttgagagggagcggcttattaatcagttcaatgatcccagcaacctcaccacctggctgttccttctctctacaagggccggatgcttgggtgtgaatctgattggtgccaaccgagtggtggtgtttgatgcttcctggaacccttgccatgatgcccaggcagtatgtcgggtataccgttatggccagaaaaagccctgttacatctatcgccttgtggctgattacactctagaaaagaagatctatgaccgtcagatttccaagcagggcatgtcagatcgggtggtggatgatctaaatccaatgctgaacttcacacggaaagaggtggaaaacctactgcactttgttgagaaggagccagctccccaagtttccttgaacgtaaaggggatcaaggagtcagtcctgcaactggcctgtctgaagtaccctcacctcatcaccaaggagcctttcgagcatgagtcattgctcttgaaccgaaaggatcacaagctaaccaaggctgagaaaaaagcagcaaagaaaagctatgaggaagacaaacgcacatcagtcccctatacccgcccatcgtatgcgcagtattaccctgccagcgatcagagcctgaccagcatccccgccttcagccagagaaactggcagccaactttgaagggtgatgaaaagcctgtggccagtgttcgtcctgtgcagtccacccccatccccatgatgccccggcatgtcccattgggaggaagtgtaagctctgcctccagcacaaatccatccatgaactttcccatcaactacttgcagcgtgcaggagtccttgtgcagaaggtggtcaccacgacagatattgttattcctggactcaacagctccacagatgtacaggcaagaattaatgctggtgagagcatccacatcatccgtgggacaaaagggacgtacatccgtaccagtgatggacggatctttgctgtccgggcaactggcaaaccaaaggttcctgaagatggtcggatggctgcctcaggttcccagggaccttcttgcgagtccacaagcaacggcagacacagtgcctcatcacccaaagcccccgaccctgaggggctggccaggcccgtctctcctgacagcccagagatcatcagtgagcttcagcagtatgcagatgtggctgctgcccgggaatcccgtcagagctccccaagcaccaatgccgccctgcctggccccccggcccaacttatggacagcagtgctgttcccgggacagctctcggaactgagcctcgactagggggtcattgcctcaatagttccctcttggtgactggccagccctgtggtgacaggcacccagtgctggacttaaggggccacaagcgaaagttggccacaccacctgctgcccaggagtcatcccgccggcggtccaggaagggtcatctgccagcccccgtgcagccgtatgaacacgggtatccagtctctggcgggtttgccatgccacccgtctccttaaaccataacctcaccacccccttcacctcccaggctggggagaactccctgtttatgggcagtaccccctcctactaccagctgtccaatttgctggcagatgcccgcctggtgtttccagtgactactgaccctctggtgccagcaggccccgtcagttcctcttccacggctacctcagtcactgccagcaacccctccttcatgctcaacccttctgtgccagggatactacccagctattcactcccattctcacagccactcctgtccgagccgaggatgtttgcgccttttccttcccctgtcttgcccagcaacctttcgcggggcatgtctatctatccaggctacatgtccccacatgcaggctacccagctggtggcctcctacggtcccaggtgcctccatttgactctcatgaggttgccgaggttgggttcagctccaatgatgatgaggataaagacgatgatgtgatagaggtcactgggaaatagctagggagcccctccccacctcacttggggcccccagcaggttgcccaccaagctggaaggcagtgatttagaccttttgagaataggacacttggcaggagggaaaaggaagaggacaaaggagggtggttggccaaagtggcagagctctgttgctgtttaacaaaagaggcaaaaaaaaaaaaaaaaaaaaaaaaagtccaacacagcagcaatagcgggaaatcagggacccaaaacagggatggaggggcagtgcagcctcttttccttcctgccttgcttatgctgtctgcttgcttgctcgcccatctgagtg

SEQ ID NO: 112415 - DNA, 5573 bp, Homo sapiens
  misc_feature (1720)..(1720): n is a, c, g, or t
  misc_feature (1791)..(1791): n is a, c, g, or t
  misc_feature (2090)..(2090): n is a, c, g, or t
gcagctataggcgccaccaatggcaagaacctagcctccgggaccccaaaaagaagagagctcagaagccctcccacatgagaagaaacatacgaaagctactccgggaggatcaattggagcctgttaccaaagcagcacagcaagaagagttggaaagaaggaagcgcctggagcagcagaggaaagattatgcagcccctattcctactgttccgctggagttcctccctgaggaaattgctttaagggcaagtgacggtccccaactgcctcctcgggtcttggcccaggaagtcatttgtttggacagtagcagtggcagtgaggatgaaaaaagcagtcgagatgaggtgattgaactgagctctggagaggaggacactctgcacattgtggacagcagtgaatctgtcagtgaagatgatgaggaagaagagaagggtggcacccatgtcaatgatgtcttaaaccagcgtgacgcccttgggcgggtccttgtcaacctaaaccaccctccagaggaggaaaatgtcttccttgccccacagttggcacgggctgtgaaacctcatcagattggcgggatccggttcctttacgataacctagtggagtctctggagaggtttaagaccagcagtggctttggctgtattctggcccacagcatgggtctggggaaaactttgcaagtgatctctttcatcgacgtcctcttccgccacacgccagccaaaacagtccttgccattgtgccggttaatactcttcagaattggctggcagagttcaacatgtggcttccacctcctgaagccctcccggctgacaacaagcctgaagaagtccagcctcggttctttaaagttcacatcttgaatgatgagcacaagacgatggcatctcgtgctaaagtgatggctgattgggtgtcagagggtggcgtgctgctgatggggtacgagatgtacagactcctcactctgaagaaatcatttgccacaggtagaccgaagaaaaccaagaagcgttctcacccagtcatcattgatctagatgaggaagatcggcagcaggagtttcggagagagtttgagaaggctttatgccgccctggccctgatgtagtaatctgtgatgagggacaccgcatcaaaaactgccaggccagcacctcacaggctctgaagaatatccgctctcgccgccgggtggtgctgactgggtaccctctgcaaaacaacctcattgagtactggtgcatggtggactttgtgcgcccagacttccttggcacccggcaggagttcagcaacatgtttgaacgccctatcctgaatgggcaatgtattgacagcacacctcaggacgtccgcctcatgcggtaccggagccatgtcctgcacagtcttctggagggctttgtgcagaggagaggccacactgtgctgaagattcatctccctgccaaggaagaaaatgtgatccttgtgcggctctccaagatccagcgagatttgtatacacagttcatggatcgcttccgggactgtggtagcagcggttggctggggctgaacccccttaaggcattctgtgtgtgttgcaaggtgcattggggcctcagggaagattgagatggggactaaggatacacatggtcccaagggagttactcctactgagagtcttcaataaagggagaataaagtgaganggggccacctcagttcactgcactggaggtttgggggctccaaggagagaggtgatggtttgtaccacatnactcctgggggtgccattcacacagtgtaatataactgatgccccctgcagtgtgcaactcagctgcacaacttgttattccaaggggattaatggaaaaatactgtggggcagcgtttttgactgctagcataatcagaattcaagagatatatagcttagacaagttattaggggtaccttccattggattccatacttaatcagattgagacctctctcattcttttcttgagggacctgtttcattgacttcatacctctacccctggctactcttcagcagacctgttaggtantattcttaattgaccactgctttaataagtcagcagaaggtatgtgtctggggacaagaggggtttccaaatatttcttttatagccacagtcctgggtcaaggccaggaaactaaggcaagcgtggtctgtgatgatgctttggtatcactgcatccttccttcttcctttcctctcttctcctgggagttctcaactcttgctaggaatactctgtgaaatgatatgtgattggtctactataagtcagatacattttgtctatagttttatacagtagcagactgtagccacactgtgaaactggaacattcttactcttatttgaataagaatgtcaaaaaggcttgtgacagcttttttgattatgtatcaaacatacttactggcatggctcctggtatgcatgctgccattcatgtgtcatggtgaccagaactgataatcaaaacaaatatgcaggccctttggctgtgaagggctctgactttaatttttggtgtgacagtgtttattgtgggacgtgtgtgtttgagcaagtatgtgtttccagactccctgggacacccttggaatgttttttgtcctgtgtctcctctccctttccttgaacctcagatctggaatcaccctgatgtgctgtatgaagcccttcagaaggagagcttggccaatgagcaggacctagacgtggaagaacttggctctgcagggaccagtgcccgctgtccaccacagggaacaaaaggcaagggagaggatagcaccttggcttcctcgatgggagaggcaaccaatagcaagttcctacagggcgttggcttcaaccctttccaggagcgaggcaacaacattgtcacatatgaatgggccaaggaccttctgactaattaccagactggagtcctagaaaactctcccaagatggtactgcttttccacctgattgaggaaagtgtgaagcttggggacaagatccttgtgtttagccagagtctttccaccttggctctcatcgaggaattccttggaaaacgagaagtaccctgtccacctggtaccgaggggcaaggagcacagaagtgggttcgaaacatcagctacttccggctagatggtagcacccctgcctttgagagggagcggcttattaatcagttcaatgatcccagcaacctcaccacctggctgttccttctctctacaagggccggatgcttgggtgtgaatctgattggtgccaaccgagtggtggtgtttgatgcttcctggaacccttgccatgatgcccaggcagtatgtcgggtataccgttatggccagaaaaagccctgttacatctatcgccttgtggctgattacactctagaaaagaagatctatgaccgtcagatttccaagcagggcatgtcagatcgggtggtggatgatctaaatccaatgctgaacttcacacggaaagaggtggaaaacctactgcactttgttgagaaggagccagctccccaagtttccttgaacgtaaaggggatcaaggagtcagtcctgcaactggcctgtctgaagtaccctcacctcatcaccaaggagcctttcgagcatgagtcattgctcttgaaccgaaaggatcacaagctaaccaaggctgagaaaaaagcagcaaagaaaagctatgaggaagacaaacgcacatcagtcccctatacccgcccatcgtatgcgcagtattaccctgccagcgatcagagcctgaccagcatccccgccttcagccagagaaactggcagccaactttgaagggtgatgaaaagcctgtggccagtgttcgtcctgtgcagtccacccccatccccatgatgccccggcatgtcccattgggaggaagtgtaagctctgcctccagcacaaatccatccatgaactttcccatcaactacttgcagcgtgcaggagtccttgtgcagaaggtggtcaccacgacagatattgttattcctggactcaacagctccacagatgtacaggcaagaattaatgctggtgagagcatccacatcatccgtgggacaaaagggacgtacatccgtaccagtgatggacggatctttgctgtccgggcaactggcaaaccaaaggttcctgaagatggtcggatggctgcctcaggttcccagggaccttcttgcgagtccacaagcaacggcagacacagtgcctcatcacccaaagcccccgaccctgaggggctggccaggcccgtctctcctgacagcccagagatcatcagtgagcttcagcagtatgcagatgtggctgctgcccgggaatcccgtcagagctccccaagcaccaatgccgccctgcctggccccccggcccaacttatggacagcagtgctgttcccgggacagctctcggaactgagcctcgactagggggtcattgcctcaatagttccctcttggtgactggccagccctgtggtgacaggcacccagtgctggacttaaggggccacaagcgaaagttggccacaccacctgctgcccaggagtcatcccgccggcggtccaggaagggtcatctgccagcccccgtgcagccgtatgaacacgggtatccagtctctggcgggtttgccatgccacccgtctccttaaaccataacctcaccacccccttcacctcccaggctggggagaactccctgtttatgggcagtaccccctcctactaccagctgtccaatttgctggcagatgcccgcctggtgtttccagtgactactgaccctctggtgccagcaggccccgtcagttcctcttccacggctacctcagtcactgccagcaacccctccttcatgctcaacccttctgtgccagggatactacccagctattcactcccattctcacagccactcctgtccgagccgaggatgtttgcgccttttccttcccctgtcttgcccagcaacctttcgcggggcatgtctatctatccaggctacatgtccccacatgcaggctacccagctggtggcctcctacggtcccaggtgcctccatttgactctcatgaggttgccgaggttgggttcagctccaatgatgatgaggataaagacgatgatgtgatagaggtcactgggaaatagctagggagcccctccccacctcacttggggcccccagcaggttgcccaccaagctggaaggcagtgatttagaccttttgagaataggacacttggcaggagggaaaaggaagaggacaaaggagggtggttggccaaagtggcagagctctgttgctgtttaacaaaagaggcaaaaaaaaaaaaaaaaaaaaaaaaagtccaacacagcagcaatagcgggaaatcagggacccaaaacagggatggaggggcagtgcagcctcttttccttcctgccttgcttatgctgtctgcttgcttgctcgcccatctgagtg

SEQ ID NO: 112416 - DNA, 4896 bp, Homo sapiens
gcagctataggcgccaccaatggcaagaacctagcctccgggaccccaaaaagaagagagctcagaagccctcccacatgagaagaaacatacgaaagctactccgggaggatcaattggagcctgttaccaaagcagcacagcaagaagagttggaaagaaggaagcgcctggagcagcagaggaaagattatgcagcccctattcctactgttccgctggagttcctccctgaggaaattgctttaagggcaagtgacggtccccaactgcctcctcgggtcttggcccaggaagtcatttgtttggacagtagcagtggcagtgaggatgaaaaaagcagtcgagatgaggtgattgaactgagctctggagaggaggacactctgcacattgtggacagcagtgaatctgtcagtgaagatgatgaggaagaagagaagggtggcacccatgtcaatgatgtcttaaaccagcgtgacgcccttgggcgggtccttgtcaacctaaaccaccctccagaggaggaaaatgtcttccttgccccacagttggcacgggctgtgaaacctcatcagattggcgggatccggttcctttacgataacctagtggagtctctggagaggtttaagaccagcagtggctttggctgtattctggcccacagcatgggtctggggaaaactttgcaagtgatctctttcatcgacgtcctcttccgccacacgccagccaaaacagtccttgccattgtgccggttaatactcttcagaattggctggcagagttcaacatgtggcttccacctcctgaagccctcccggctgacaacaagcctgaagaagtccagcctcggttctttaaagttcacatcttgaatgatgagcacaagacgatggcatctcgtgctaaagtgatggctgattgggtgtcagagggtggcgtgctgctgatggggtacgagatgtacagactcctcactctgaagaaatcatttgccacaggtagaccgaagaaaaccaagaagcgttctcacccagtcatcattgatctagatgaggaagatcggcagcaggagtttcggagagagtttgagaaggctttatgccgccctggccctgatgtagtaatctgtgatgagggacaccgcatcaaaaactgccaggccagcacctcacaggctctgaagaatatccgctctcgccgccgggtggtgctgactgggtaccctctgcaaaacaacctcattgagtactggtgcatggtggactttgtgcgcccagacttccttggcacccggcaggagttcagcaacatgtttgaacgccctatcctgaatgggcaatgtattgacagcacacctcaggacgtccgcctcatgcggtaccggagccatgtcctgcacagtcttctggagggctttgtgcagaggagaggccacactgtgctgaagattcatctccctgccaaggaagaaaatgtgatccttgtgcggctctccaagatccagcgagatttgtatacacagttcatggatcgcttccgggactgtggtagcagcggttggctggggctgaacccccttaaggcattctgtgtgtgttgcaagatctggaatcaccctgatgtgctgtatgaagcccttcagaaggagagcttggccaatgagcaggacctagacgtggaagaacttggctctgcagggaccagtgcccgctgtccaccacagggaacaaaaggcaagggagaggatagcaccttggcttcctcgatgggagaggcaaccaatagcaagttcctacagggcgttggcttcaaccctttccaggagcgaggcaacaacattgtcacatatgaatgggccaaggaccttctgactaattaccagactggagtcctagaaaactctcccaagatggtactgcttttccacctgattgaggaaagtgtgaagcttggggacaagatccttgtgtttagccagagtctttccaccttggctctcatcgaggaattccttggaaaacgagaagtaccctgtccacctggtaccgaggggcaaggagcacagaagtgggttcgaaacatcagctacttccggctagatggtagcacccctgcctttgagagggagcggcttattaatcagttcaatgatcccagcaacctcaccacctggctgttccttctctctacaagggccggatgcttgggtgtgaatctgattggtgccaaccgagtggtggtgtttgatgcttcctggaacccttgccatgatgcccaggcagtatgtcgggtataccgttatggccagaaaaagccctgttacatctatcgccttgtggctgattacactctagaaaagaagatctatgaccgtcagatttccaagcagggcatgtcagatcgggtggtggatgatctaaatccaatgctgaacttcacacggaaagaggtggaaaacctactgcactttgttgagaaggagccagctccccaagtttccttgaacgtaaaggggatcaaggagtcagtcctgcaactggcctgtctgaagtaccctcacctcatcaccaaggagcctttcgagcatgagtcattgctcttgaaccgaaaggatcacaagctaaccaaggctgagaaaaaagcagcaaagaaaagctatgaggaagacaaacgcacatcagtcccctatacccgcccatcgtatgcgcagtattaccctgccagcgatcagagcctgaccagcatccccgccttcagccagagaaactggcagccaactttgaagggtgatgaaaagcctgtggccagtgttcgtcctgtgcagtccacccccatccccatgatgccccggcatgtcccattgggaggaagtgtaagctctgcctccagcacaaatccatccatgaactttcccatcaactacttgcagcgtgcaggagtccttgtgcagaaggtggtcaccacgacagatattgttattcctggactcaacagctccacagatgtacaggcaagaattaatgctggtgagagcatccacatcatccgtgggacaaaagggacgtacatccgtaccagtgatggacggatctttgctgtccgggcaactggcaaaccaaaggttcctgaagatggtcggatggctgcctcaggttcccagggaccttcttgcgagtccacaagcaacggcagacacagtgcctcatcacccaaagcccccgaccctgaggggctggccaggcccgtctctcctgacagcccagagatcatcagtgagcttcagcagtatgcagatgtggctgctgcccgggaatcccgtcagagctccccaagcaccaatgccgccctgcctggccccccggcccaacttatggacagcagtgctgttcccgggacagctctcggaactgagcctcgactagggggtcattgcctcaatagttccctcttggtgactggccagccctgtggtgacaggcacccagtgctggacttaaggggccacaagcgaaagttggccacaccacctgctgcccaggagtcatcccgccggcggtccaggaagggtcatctgccagcccccgtgcagccgtatgaacacggctgccttgaggtgcagtgttggggatccagagccatgtcggacctgctactactgggcctgattgggggcctgactctcttactgctgctgacgctgctggcctttgccgggtactcagggctactggctggggtggaagtgagtgctgggtcaccccccatccgcaacgtcactgtggcctacaagttccacatggggctctatggtgagactgggcggcttttcactgagagctgcagcatctctcccaagctccgctccatcgctgtctactatgacaacccccacatggtgccccctgataagtgccgatgtgccgtgggcagcatcctgagtgaaggtgaggaatcgccctcccctgagctcatcgacctctaccagaaatttggcttcaaggtgttctccttcccggcacccagccatgtggtgacagccaccttcccctacaccaccattctgtccatctggctggctacccgccgtgtccatcctgccttggacacctacatcaaggagcggaagctgtgtgcctatcctcggctggagatctaccaggaagaccagatccatttcatgtgcccactggcacggcagggagacttctatgtgcctgagatgaaggagacagagtggaaatggcgggggcttgtggaggccattgacacccaggtggatggcacaggagctgacacaatgagtgacacgagttctgtaagcttggaagtgagccctggcagccgggagacttcagctgccacactgtcacctggggcgagcagccgtggctgggatgacggtgacacccgcagcgagcacagctacagcgagtcaggtgccagcggctcctcttttgaggagctggacttggagggcgaggggcccttaggggagtcacggctggaccctgggactgagcccctggggactaccaagtggctctgggagcccactgcccctgagaagggcaaggagtaacccatggcctgcaccctcctgcagtgcagttgctgaggaactgagcagactctccagcagactctccagccctcttcctccttcctctgggggaggaggggttcctgagggacctgacttcccctgctccaggcctcttgctaagccttctcctcactgccctttaggctcccagggccagaggagccagggactattttctgcaccagcccccagggctgccgcccctgttgtgtctttttttcagactcacagtggagcttccaggacccagaataaagccaatgatttacttgtttcacctgga

SEQ ID NO: 112417 - DNA, 1360 bp, Homo sapiens
cgcggatcggcgtccgcagcgggcggctgctgaggtgagggccgggccagaggagaggcatacccactggggcgtagctgccttgaggtgcagtgttggggatccagagccatgtcggacctgctactactgggcctgattgggggcctgactctcttactgctgctgacgctgctggcctttgccgggtactcagggctactggctggggtggaagtgagtgctgggtcaccccccatccgcaacgtcactgtggcctacaagttccacatggggctctatggtgagactgggcggcttttcactgagagctgcagcatctctcccaagctccgctccatcgctgtctactatgacaacccccacatggtgccccctgataagtgccgatgtgccgtgggcagcatcctgagtgaaggtgaggaatcgccctcccctgagctcatcgacctctaccagaaatttggcttcaaggtgttctccttcccggcacccagccatgtggtgacagccaccttcccctacaccaccattctgtccatctggctggctacccgccgtgtccatcctgccttggacacctacatcaaggagcggaagctgtgtgcctatcctcggctggagatctaccaggaagaccagatccatttcatgtgcccactggcacggcagggagacttctatgtgcctgagatgaaggagacagagtggaaatggcgggggcttgtggaggccattgacacccaggtggatggcacaggagctgacacaatgagtgacacgagttctgtaagcttggaagtgagccctggcagccgggagacttcagctgccacactgtcacctggggcgagcagccgtggctgggatgacggtgacacccgcagcgagcacagctacagcgagtcaggtgccagcggctcctcttttgaggagctggacttggagggcgaggggcccttaggggagtcacggctggaccctgggactgagcccctggggactaccaagtggctctgggagcccactgcccctgagaagggcaaggagtaacccatggcctgcaccctcctgcagtgcagttgctgaggaactgagcagactctccagcagactctccagccctcttcctccttcctctgggggaggaggggttcctgagggacctgacttcccctgctccaggcctcttgctaagccttctcctcactgccctttaggctcccagggccagaggagccagggactattttctgcaccagcccccagggctgccgcccctgttgtgtctttttttcagactcacagtggagcttccaggacccagaataaagccaatgatttacttgtttcacctgga

SEQ ID NO: 112418 - DNA, 1346 bp, Homo sapiens
gggcaagtgggcacattgtcagagtaggctaccagcctcctctcccttctttctcctttgcagctgccttgaggtgcagtgttggggatccagagccatgtcggacctgctactactgggcctgattgggggcctgactctcttactgctgctgacgctgctggcctttgccgggtactcagggctactggctggggtggaagtgagtgctgggtcaccccccatccgcaacgtcactgtggcctacaagttccacatggggctctatggtgagactgggcggcttttcactgagagctgcagcatctctcccaagctccgctccatcgctgtctactatgacaacccccacatggtgccccctgataagtgccgatgtgccgtgggcagcatcctgagtgaaggtgaggaatcgccctcccctgagctcatcgacctctaccagaaatttggcttcaaggtgttctccttcccggcacccagccatgtggtgacagccaccttcccctacaccaccattctgtccatctggctggctacccgccgtgtccatcctgccttggacacctacatcaaggagcggaagctgtgtgcctatcctcggctggagatctaccaggaagaccagatccatttcatgtgcccactggcacggcagggagacttctatgtgcctgagatgaaggagacagagtggaaatggcgggggcttgtggaggccattgacacccaggtggatggcacaggagctgacacaatgagtgacacgagttctgtaagcttggaagtgagccctggcagccgggagacttcagctgccacactgtcacctggggcgagcagccgtggctgggatgacggtgacacccgcagcgagcacagctacagcgagtcaggtgccagcggctcctcttttgaggagctggacttggagggcgaggggcccttaggggagtcacggctggaccctgggactgagcccctggggactaccaagtggctctgggagcccactgcccctgagaagggcaaggagtaacccatggcctgcaccctcctgcagtgcagttgctgaggaactgagcagactctccagcagactctccagccctcttcctccttcctctgggggaggaggggttcctgagggacctgacttcccctgctccaggcctcttgctaagccttctcctcactgccctttaggctcccagggccagaggagccagggactattttctgcaccagcccccagggctgccgcccctgttgtgtctttttttcagactcacagtggagcttccaggacccagaataaagccaatgatttacttgtttcacctgga

SEQ ID NO: 112419 - DNA, 1635 bp, Homo sapiens
  misc_feature (153)..(153): n is a, c, g, or t
gtggtgaaggtactgccgctggtgttcctgtctgcagtccagctgctgggtgctagtgcactaagccctgttgccattgagacgtgggcggggcagtgcctccttccctccggtgtcccgctgctgcactgcgcccacggccacggatgtccngccgcgagagggggcggagcgagcgtgcgcggcgggcgcgcgcaggctccgtaaccgaaccctgagccgcctgcgcggatcggcgtccgcagcgggcggctgctgaggggtgactgttctttcagctcccagcactggagcgctcggcccctgccgcactggatgccagcagttactaaaagtgagcctggcatttcagctgccttgaggtgcagtgttggggatccagagccatgtcggacctgctactactgggcctgattgggggcctgactctcttactgctgctgacgctgctggcctttgccgggtactcagggctactggctggggtggaagtgagtgctgggtcaccccccatccgcaacgtcactgtggcctacaagttccacatggggctctatggtgagactgggcggcttttcactgagagctgcagcatctctcccaagctccgctccatcgctgtctactatgacaacccccacatggtgccccctgataagtgccgatgtgccgtgggcagcatcctgagtgaaggtgaggaatcgccctcccctgagctcatcgacctctaccagaaatttggcttcaaggtgttctccttcccggcacccagccatgtggtgacagccaccttcccctacaccaccattctgtccatctggctggctacccgccgtgtccatcctgccttggacacctacatcaaggagcggaagctgtgtgcctatcctcggctggagatctaccaggaagaccagatccatttcatgtgcccactggcacggcagggagacttctatgtgcctgagatgaaggagacagagtggaaatggcgggggcttgtggaggccattgacacccaggtggatggcacaggagctgacacaatgagtgacacgagttctgtaagcttggaagtgagccctggcagccgggagacttcagctgccacactgtcacctggggcgagcagccgtggctgggatgacggtgacacccgcagcgagcacagctacagcgagtcaggtgccagcggctcctcttttgaggagctggacttggagggcgaggggcccttaggggagtcacggctggaccctgggactgagcccctggggactaccaagtggctctgggagcccactgcccctgagaagggcaaggagtaacccatggcctgcaccctcctgcagtgcagttgctgaggaactgagcagactctccagcagactctccagccctcttcctccttcctctgggggaggaggggttcctgagggacctgacttcccctgctccaggcctcttgctaagccttctcctcactgccctttaggctcccagggccagaggagccagggactattttctgcaccagcccccagggctgccgcccctgttgtgtctttttttcagactcacagtggagcttccaggacccagaataaagccaatgatttacttgtttcacctgga

SEQ ID NO: 112420 - DNA, 4925 bp, Homo sapiens
gcagctataggcgccaccaatggcaagaacctagcctccgggaccccaaaaagaagagagctcagaagccctcccacatgagaagaaacatacgaaagctactccgggaggatcaattggagcctgttaccaaagcagcacagcaagaagagttggaaagaaggaagcgcctggagcagcagaggaaagattatgcagcccctattcctactgttccgctggagttcctccctgaggaaattgctttaagggcaagtgacggtccccaactgcctcctcgggtcttggcccaggaagtcatttgtttggacagtagcagtggcagtgaggatgaaaaaagcagtcgagatgaggtgattgaactgagctctggagaggaggacactctgcacattgtggacagcagtgaatctgtcagtgaagatgatgaggaagaagagaagggtggcacccatgtcaatgatgtcttaaaccagcgtgacgcccttgggcgggtccttgtcaacctaaaccaccctccagaggaggaaaatgtcttccttgccccacagttggcacgggctgtgaaacctcatcagattggcgggatccggttcctttacgataacctagtggagtctctggagaggtttaagaccagcagtggctttggctgtattctggcccacagcatgggtctggggaaaactttgcaagtgatctctttcatcgacgtcctcttccgccacacgccagccaaaacagtccttgccattgtgccggttaatactcttcagaattggctggcagagttcaacatgtggcttccacctcctgaagccctcccggctgacaacaagcctgaagaagtccagcctcggttctttaaagttcacatcttgaatgatgagcacaagacgatggcatctcgtgctaaagtgatggctgattgggtgtcagagggtggcgtgctgctgatggggtacgagatgtacagactcctcactctgaagaaatcatttgccacaggtagaccgaagaaaaccaagaagcgttctcacccagtcatcattgatctagatgaggaagatcggcagcaggagtttcggagagagtttgagaaggctttatgccgccctggccctgatgtagtaatctgtgatgagggacaccgcatcaaaaactgccaggccagcacctcacaggctctgaagaatatccgctctcgccgccgggtggtgctgactgggtaccctctgcaaaacaacctcattgagtactggtgcatggtggactttgtgcgcccagacttccttggcacccggcaggagttcagcaacatgtttgaacgccctatcctgaatgggcaatgtattgacagcacacctcaggacgtccgcctcatgcggtaccggagccatgtcctgcacagtcttctggagggctttgtgcagaggagaggccacactgtgctgaagattcatctccctgccaaggaagaaaatgtgatccttgtgcggctctccaagatccagcgagatttgtatacacagttcatggatcgcttccgggactgtggtagcagcggttggctggggctgaacccccttaaggcattctgtgtgtgttgcaagatctggaatcaccctgatgtgctgtatgaagcccttcagaaggagagcttggccaatgagcaggacctagacgtggaagaacttggctctgcagggaccagtgcccgctgtccaccacagggaacaaaaggcaagggagaggatagcaccttggcttcctcgatgggagaggcaaccaatagcaagttcctacagggcgttggcttcaaccctttccaggagcgaggcaacaacattgtcacatatgaatgggccaaggaccttctgactaattaccagactggagtcctagaaaactctcccaagatggtactgcttttccacctgattgaggaaagtgtgaagcttggggacaagatccttgtgtttagccagagtctttccaccttggctctcatcgaggaattccttggaaaacgagaagtaccctgtccacctggtaccgaggggcaaggagcacagaagtgggttcgaaacatcagctacttccggctagatggtagcacccctgcctttgagagggagcggcttattaatcagttcaatgatcccagcaacctcaccacctggctgttccttctctctacaagggccggatgcttgggtgtgaatctgattggtgccaaccgagtggtggtgtttgatgcttcctggaacccttgccatgatgcccaggcagtatgtcgggtataccgttatggccagaaaaagccctgttacatctatcgccttgtggctgattacactctagaaaagaagatctatgaccgtcagatttccaagcagggcatgtcagatcgggtggtggatgatctaaatccaatgctgaacttcacacggaaagaggtggaaaacctactgcactttgttgagaaggagccagctccccaagtttccttgaacgtaaaggggatcaaggagtcagtcctgcaactggcctgtctgaagtaccctcacctcatcaccaaggagcctttcgagcatgagtcattgctcttgaaccgaaaggatcacaagctaaccaaggctgagaaaaaagcagcaaagaaaagctatgaggaagacaaacgcacatcagtcccctatacccgcccatcgtatgcgcagtattaccctgccagcgatcagagcctgaccagcatccccgccttcagccagagaaactggcagccaactttgaagggtgatgaaaagcctgtggccagtgttcgtcctgtgcagtccacccccatccccatgatgccccggcatgtcccattgggaggaagtgtaagctctgcctccagcacaaatccatccatgaactttcccatcaactacttgcagcgtgcaggagtccttgtgcagaaggtggtcaccacgacagatattgttattcctggactcaacagctccacagatgtacaggcaagaattaatgctggtgagagcatccacatcatccgtgggacaaaagggacgtacatccgtaccagtgatggacggatctttgctgtccgggcaactggcaaaccaaaggttcctgaagatggtcggatggctgcctcaggttcccagggaccttcttgcgagtccacaagcaacggcagacacagtgcctcatcacccaaagcccccgaccctgaggggctggccaggcccgtctctcctgacagcccagagatcatcagtgagcttcagcagtatgcagatgtggctgctgcccgggaatcccgtcagagctccccaagcaccaatgccgccctgcctggccccccggcccaacttatggacagcagtgctgttcccgggacagctctcggaactgagcctcgactagggggtcattgcctcaatagttccctcttggtgactggccagccctgtggtgacaggcacccagtgctggacttaaggggccacaagcgaaagttggccacaccacctgctgcccaggagtcatcccgccggcggtccaggaagggtcatctgccagcccccgtgcagccgtatgaacacggctgccttgaggtgcagtgttggggatccagagccatgtcggacctgctactactgggcctgattgggggcctgactctcttactgctgctgacgctgctggcctttgccgggtactcagggctactggctggggtggaagtgagtgctgggtcaccccccatccgcaacgtcactgtggcctacaagttccacatggggctctatggtgagactgggcggcttttcactgagagctgcagcatctctcccaagctccgctccatcgctgtctactatgacaacccccacatggtgccccctgataagtgccgatgtgccgtgggcagcatcctgagtgaaggtgaggaatcgccctcccctgagctcatcgacctctaccagaaatttggcttcaaggtgttctccttcccggcacccagccatgtggtgacagccaccttcccctacaccaccattctgtccatctggctggctacccgccgtgtccatcctgccttggacacctacatcaaggagcggaagctgtgtgcctatcctcggctggagatctaccaggaagaccagatccatttcatgtgcccactggcacggcagggagacttctatgtgcctgagatgaaggagacagagtggaaatggcgggggcttgtggaggccattgacacccaggtggatggcacaggagctgacacaatgagtgacacgagttctgtaagcttggaagtgagccctggcagccgggagacttcagctgccacactgtcacctggggcgagcagccgtggctgggatgacggtgacacccgcagcgagcacagctacagcgagtcaggtgccagcggctcctcttttgaggagctggacttggagggcgaggggcccttaggggagtcacggctggaccctgggactgagcccctggggactaccaagtggctctgggagcccactgcccctgagaagggcaaggagtaacccatggcctgcaccctcctgcagtgcagttgctgaggaactgagcagactctccagcagactctccagccctcttcctccttcctctgggggaggaggggttcctgagggacctgacttcccctgctccaggcctcttgctaagccttctcctcactgccctttaggctcccagggccagaggagccagggactattttctgcaccagcccccagggctgccgcccctgttgtgtctttttttcagactcacagtggagcttccaggacccagaataaagccaatgatttacttgtttcacctggaaaaaaaaaaaatcggcctccgtgggctca

SEQ ID NO: 112421 - DNA, 5574 bp, Homo sapiens
gcagctataggcgccaccaatggcaagaacctagcctccgggaccccaaaaagaagagagctcagaagccctcccacatgagaagaaacatacgaaagctactccgggaggatcaattggagcctgttaccaaagcagcacagcaagaagagttggaaagaaggaagcgcctggagcagcagaggaaagattatgcagcccctattcctactgttccgctggagttcctccctgaggaaattgctttaagggcaagtgacggtccccaactgcctcctcgggtcttggcccaggaagtcatttgtttggacagtagcagtggcagtgaggatgaaaaaagcagtcgagatgaggtgattgaactgagctctggagaggaggacactctgcacattgtggacagcagtgaatctgtcagtgaagatgatgaggaagaagagaagggtggcacccatgtcaatgatgtcttaaaccagcgtgacgcccttgggcgggtccttgtcaacctaaaccaccctccagaggaggaaaatgtcttccttgccccacagttggcacgggctgtgaaacctcatcagattggcgggatccggttcctttacgataacctagtggagtctctggagaggtttaagaccagcagtggctttggctgtattctggcccacagcatgggtctggggaaaactttgcaagtgatctctttcatcgacgtcctcttccgccacacgccagccaaaacagtccttgccattgtgccggttaatactcttcagaattggctggcagagttcaacatgtggcttccacctcctgaagccctcccggctgacaacaagcctgaagaagtccagcctcggttctttaaagttcacatcttgaatgatgagcacaagacgatggcatctcgtgctaaagtgatggctgattgggtgtcagagggtggcgtgctgctgatggggtacgagatgtacagactcctcactctgaagaaatcatttgccacaggtagaccgaagaaaaccaagaagcgttctcacccagtcatcattgatctagatgaggaagatcggcagcaggagtttcggagagagtttgagaaggctttatgccgccctggccctgatgtagtaatctgtgatgagggacaccgcatcaaaaactgccaggccagcacctcacaggctctgaagaatatccgctctcgccgccgggtggtgctgactgggtaccctctgcaaaacaacctcattgagtactggtgcatggtggactttgtgcgcccagacttccttggcacccggcaggagttcagcaacatgtttgaacgccctatcctgaatgggcaatgtattgacagcacacctcaggacgtccgcctcatgcggtaccggagccatgtcctgcacagtcttctggagggctttgtgcagaggagaggccacactgtgctgaagattcatctccctgccaaggaagaaaatgtgatccttgtgcggctctccaagatccagcgagatttgtatacacagttcatggatcgcttccgggactgtggtagcagcggttggctggggctgaacccccttaaggcattctgtgtgtgttgcaagatctggaatcaccctgatgtgctgtatgaagcccttcagaaggagagcttggccaatgagcaggacctagacgtggaagaacttggctctgcagggaccagtgcccgctgtccaccacagggaacaaaaggcaagggagaggatagcaccttggcttcctcgatgggagaggcaaccaatagcaagttcctacagggcgttggcttcaaccctttccaggagcgaggcaacaacattgtcacatatgaatgggccaaggaccttctgactaattaccagactggagtcctagaaaactctcccaagatggtactgcttttccacctgattgaggaaagtgtgaagcttggggacaagatccttgtgtttagccagagtctttccaccttggctctcatcgaggaattccttggaaaacgagaagtaccctgtccacctggtaccgaggggcaaggagcacagaagtgggttcgaaacatcagctacttccggctagatggtagcacccctgcctttgagagggagcggcttattaatcagttcaatgatcccagcaacctcaccacctggctgttccttctctctacaagggccggatgcttgggtgtgaatctgattggtgccaaccgagtggtggtgtttgatgcttcctggaacccttgccatgatgcccaggcagtatgtcgggtataccgttatggccagaaaaagccctgttacatctatcgccttgtggctgattacactctagaaaagaagatctatgaccgtcagatttccaagcagggcatgtcagatcgggtggtggatgatctaaatccaatgctgaacttcacacggaaagaggtggaaaacctactgcactttgttgagaaggagccagctccccaagtttccttgaacgtaaaggggatcaaggagtcagtcctgcaactggcctgtctgaagtaccctcacctcatcaccaaggagcctttcgagcatgagtcattgctcttgaaccgaaaggatcacaagctaaccaaggctgagaaaaaagcagcaaagaaaagctatgaggaagacaaacgcacatcagtcccctatacccgcccatcgtatgcgcagtattaccctgccagcgatcagagcctgaccagcatccccgccttcagccagagaaactggcagccaactttgaagggtgatgaaaagcctgtggccagtgttcgtcctgtgcagtccacccccatccccatgatgccccggcatgtcccattgggaggaagtgtaagctctgcctccagcacaaatccatccatgaactttcccatcaactacttgcagcgtgcaggagtccttgtgcagaaggtggtcaccacgacagatattgttattcctggactcaacagctccacagatgtacaggcaagaattaatgctggtgagagcatccacatcatccgtgggacaaaagggacgtacatccgtaccagtgatggacggatctttgctgtccgggcaactggcaaaccaaaggttcctgaagatggtcggatggctgcctcaggttcccagggaccttcttgcgagtccacaagcaacggcagacacagtgcctcatcacccaaagcccccgaccctgaggggctggccaggcccgtctctcctgacagcccagagatcatcagtgagcttcagcagtatgcagatgtggctgctgcccgggaatcccgtcagagctccccaagcaccaatgccgccctgcctggccccccggcccaacttatggacagcagtgctgttcccgggacagctctcggaactgagcctcgactagggggtcattgcctcaatagttccctcttggtgactggccagccctgtggtgacaggcacccagtgctggacttaaggggccacaagcgaaagttggccacaccacctgctgcccaggagtcatcccgccggcggtccaggaagggtcatctgccagcccccgtgcagccgtatgaacacggctgccttgaggtgcagtgttggggatccagagccatgtcggacctgctactactgggcctgattgggggcctgactctcttactgctgctgacgctgctggcctttgccgggtactcagggctactggctggggtggaagtgagtgctgggtcaccccccatccgcaacgtcactgtggcctacaagttccacatggggctctatggtgagactgggcggcttttcactgagagctgcagcatctctcccaagctccgctccatcgctgtctactatgacaacccccacatggtgccccctgataagtgccgatgtgccgtgggcagcatcctgagtgaaggtgaggaatcgccctcccctgagctcatcgacctctaccagaaatttggcttcaaggtgttctccttcccggcacccagccatgtggtgacagccaccttcccctacaccaccattctgtccatctggctggctacccgccgtgtccatcctgccttggacacctacatcaaggagcggaagctgtgtgcctatcctcggctggagatctaccaggaagaccagatccatttcatgtgcccactggcacggcagggagacttctatgtgcctgagatgaaggagacagagtggaaatggcgggggcttgtggaggccattgacacccaggtggatggcacaggagctgacacaatgagtgacacgagttctgtaagcttggaagtgagccctggcagccgggagacttcagctgccacactgtcacctggggcgagcagccgtggctgggatgacggtgacacccgcagcgagcacagctacagcgagtcaggtgccagcggctcctcttttgaggagctggacttggagggcgaggggcccttaggggagtcacggctggaccctgggactgagcccctggggactaccaagtggctctgggagcccactgcccctgagaagggcaaggagtaacccatggcctgcaccctcctgcagtgcagttgctgaggaactgagcagactctccagcagactctccagccctcttcctccttcctctgggggaggaggggttcctgagggacctgacttcccctgctccaggcctcttgctaagccttctcctcactgccctttaggctcccagggccagaggagccagggactattttctgcaccagcccccagggctgccgcccctgttgtgtctttttttcagactcacagtggagcttccaggacccagaataaagccaatgatttacttgtttcacctggaaaaaaaaaaaaaaaaaaaaaaaaaaaaaaaaaaaaaaaaaaaaaaaaaaaaaaaaaaaaaggggggggccaaaaaaaatccccggggggccccagaaaatacgacccaccccccccatatgttggttgaaacagagggggcccccctaatagggcggcgcacataactaaaaacagcaagagccacagcgcagcgaccgcgattaaacacagcacggcgaatgacggggaaaaaagcctggccactgagagaatcaattggggagaaggaaccccacccactctcgcgggcggggggacaaacataatgggccaacaccacaatccctcaaggagaattgtacacaggccacgaggggaaattaaaccaacctcggggaggcgaccgaaagggcggcctccccccccacgagcacaattaagccgcggcaggcgcaagaaaaaaacgtctgagccaacaccgagcacgaagcatcaggaacacaacatattctacgcgccagcccccgtacaaacaacaaacagagagacagacagcaaacagcacaacaacaacgcgagacgaagacacaagcagaagagccgacacggactcagcagagacaacaaaacgaaggcaggaaacgagagcagcgacgagcacgcaccataatgacaaaacaacaaacctgacagacac

SEQ ID NO: 112422 - DNA, 1092 bp, Homo sapiens
tctggaggagcagctttttaaaaggtcattgtaattttaacacattcttactaaagaaatacatactatcagtgaccgatctgaaactctgtaacaggtgaagggagacttacgatgaatatctgagcataggttcgctagcatcttcacactcatacataaacattcttaaagggaataagaatgatttcaaattcaaaacaacaacaacaacaaaaaaacaaatttggtcaaactttcttcatcataccattcattgctatcacaatcctagtttgctggtaggtttaagaaaggaatagaaagtttttgaaatccttttaatttctaccagtcttagggcctcttgagtaggccactttggaagcaaactgattaaacagcaccatcaagtccgtatctcaacaaaccattgcataatttctgtcaatgttctcaaaggttaaaacaagttgtatagaagaatatctttcctccaggtggatggcacaggagctgacacaatgagtgacacgagttctgtaagcttggaagtgagccctggcagccgggagacttcagctgccacactgtcacctggggcgagcagccgtggctgggatgacggtgacacccgcagcgagcacagctacagcgagtcaggtgccagcggctcctcttttgaggagctggacttggagggcgaggggcccttaggggagtcacggctggaccctgggactgagcccctggggactaccaagtggctctgggagcccactgcccctgagaagggcaaggagtaacccatggcctgcaccctcctgcagtgcagttgctgaggaactgagcagactctccagcagactctccagccctcttcctccttcctctgggggaggaggggttcctgagggacctgacttcccctgctccaggcctcttgctaagccttctcctcactgccctttaggctcccagggccagaggagccagggactattttctgcaccagcccccagggctgccgcccctgttgtgtctttttttcagactcacagtggagcttccaggacccagaataaagccaatgatttacttgtttcacctgga

SEQ ID NO: 112423 - DNA, 1097 bp, Homo sapiens
cgcggatcggcgtccgcagcgggcggctgctgagctgccttgaggtgcagtgttggggatccagagccatgtcggacctgctactactgggcctgattgggggcctgactctcttactgctgctgacgctgctggcctttgccgggtactcagggctactggctggggtggaagtgagtgctgggtcaccccccatccgcaacgtcactgtggcctacaagttccacatggggctctatggtgagactgggcggcttttcactgagagctgcagcatctctcccaagctccgctccatcgctgtctactatgacaacccccacatggtgagcggaagctgtgtgcctatcctcggctggagatctaccaggaagaccagatccatttcatgtgcccactggcacggcagggagacttctatgtgcctgagatgaaggagacagagtggaaatggcgggggcttgtggaggccattgacacccaggtggatggcacaggagctgacacaatgagtgacacgagttctgtaagcttggaagtgagccctggcagccgggagacttcagctgccacactgtcacctggggcgagcagccgtggctgggatgacggtgacacccgcagcgagcacagctacagcgagtcaggtgccagcggctcctcttttgaggagctggacttggagggcgaggggcccttaggggagtcacggctggaccctgggactgagcccctggggactaccaagtggctctgggagcccactgcccctgagaagggcaaggagtaacccatggcctgcaccctcctgcagtgcagttgctgaggaactgagcagactctccagcagactctccagccctcttcctccttcctctgggggaggaggggttcctgagggacctgacttcccctgctccaggcctcttgctaagccttctcctcactgccctttaggctcccagggccagaggagccagggactattttctgcaccagcccccagggctgccgcccctgttgtgtctttttttcagactcacagtggagcttccaggacccagaataaagccaatgatttacttgtttcacctgga

SEQ ID NO: 112424 - DNA, 2600 bp, Homo sapiens
  misc_feature (911)..(911): n is a, c, g, or t
aggcttaagctgtcctcccacctcggcctcctgagtagctgtgacaagaggcgtgtaccaccatgcttggctagtttttgtattttttatagagatggtgtttcgccatattgcccaggctggccttgaacttgttagctcaagtgatcctgcctcagcctcccaaagtgttgggattctagggatgagccaccatgcccagctggattcctttttttagtttgtttgtttttaaagacagttttccttttttgcccaggctggagtgaaatggcatgatcttggctcactgcaacctccacctcgtgggttcaagcgattctcctgcctcagcttcctgagtagctgggattacaggtgcctgccaccatgcccggctaatttttgtatttttagtagagatggggttttgccatgttggccaggctggtctggaactcctgacctcatgtgatccacctgcctcagcttcccaaagtgctgggattacaggcgtgagccaccgtgcctggcctccagctgaattcctttgctttaagtgtatatatgtctccaggggctgtcttcatttcagcaggctgtcctggcctgaaggaggcacccctaggctccttcctctgaacattcctagcctaggagctgggtggtaggaggtagcatgctgggaagcaggcacattcctatacctggggtcccaagagagccattgggtgggtgggcagacagaacatacagtttaatagggccagggagaaactgtctccctcctttgctcttttcaggcctgcggtccctggggcactgatcattatttaaggagcagtgagggcctggcatcctgtcccctggtcagaagaaactacccaaaacttaaagctcccccagctccctgaccacctcattcacaggcntctgtcctgggagccacacctggggcctcagcaagaggagggccctgggccagcagcctgggcttctagggctcacctcacctctgccagtagcgcccagagggcatattctgggggctgagtgggtggtgggggtagggagagaccccaaattcccccctctcctaattctcccacccccaacctaggccccatttgaggctcaaggaaagccccaggctgagtccaggcgccaagcagaccccagctgcacctggcttggctccaacaccatggagacagtggctggggaagctggctaacccctcaccttctgtgatgtttgacagctgaccctctccccatcatacaggaagggtagcagatccactttctcccagtctggattcctgcacacagcgagcctgagccatgtgttcctccttgccaccccagcctgcattcagtgcctctgatccagggagatgaacccaggggttgctcctggacagggcagatgaaggggctgcttgcttggaggatgtattgggggtggaaggagcaggttagaaggagtttgggccatcaacctggctcagcactggtttggggcaccccaaccaccagcagagtgctctcatcatccccttttgctatcttgtggctcaggaagcaccagtcattgggggtggggtgggtaagggtttctcagggtcgacccaggcatagggagagaaaacccttaacatgtttcatcccagcaccctcctccttgcagctggttgagtatttctcaggccttctccatcctcctcgtacttcagctccctcctcaactgggacttggtgtgtaccagaggcaggggcctgctgactccctggatgctgctcctgggagccctgcacgggggagggctgcagaggggcctcctgctgcattctgcagtcctcgtgccctgtgggtgatgttctgtagctggccctggacacatctccctcccttcctcccagctctttccctctgccctgtctgtgcagccccagtcagggtagagggcagagggcagctggagcaagccccctgagcccgggaggctgcattattcatgagagctgacacaatgagtgacacgagttctgtaagcttggaagtgagccctggcagccgggagacttcagctgccacactgtcacctggggcgagcagccgtggctgggatgacggtgacacccgcagcgagcacagctacagcgagtcaggtgccagcggctcctcttttgaggagctggacttggagggcgaggggcccttaggggagtcacggctggaccctgggactgagcccctggggactaccaagtggctctgggagcccactgcccctgagaagggcaaggagtaacccatggcctgcaccctcctgcagtgcagttgctgaggaactgagcagactctccagcagactctccagccctcttcctccttcctctgggggaggaggggttcctgagggacctgacttcccctgctccaggcctcttgctaagccttctcctcactgccctttaggctcccagggccagaggagccagggactattttctgcaccagcccccagggctgccgcccctgttgtgtctttttttcagactcacagtggagcttccaggacccagaataaagccaatgatttacttgtttcacctgga

SEQ ID NO: 112425 - DNA, 4462 bp, Homo sapiens
gcagctataggcgccaccaatggcaagaacctagcctccgggaccccaaaaagaagagagctcagaagccctcccacatgagaagaaacatacgaaagctactccgggaggatcaattggagcctgttaccaaagcagcacagcaagaagagttggaaagaaggaagcgcctggagcagcagaggaaagattatgcagcccctattcctactgttccgctggagttcctccctgaggaaattgctttaagggcaagtgacggtccccaactgcctcctcgggtcttggcccaggaagtcatttgtttggacagtagcagtggcagtgaggatgaaaaaagcagtcgagatgaggtgattgaactgagctctggagaggaggacactctgcacattgtggacagcagtgaatctgtcagtgaagatgatgaggaagaagagaagggtggcacccatgtcaatgatgtcttaaaccagcgtgacgcccttgggcgggtccttgtcaacctaaaccaccctccagaggaggaaaatgtcttccttgccccacagttggcacgggctgtgaaacctcatcagattggcgggatccggttcctttacgataacctagtggagtctctggagaggtttaagaccagcagtggctttggctgtattctggcccacagcatgggtctggggaaaactttgcaagtgatctctttcatcgacgtcctcttccgccacacgccagccaaaacagtccttgccattgtgccggttaatactcttcagaattggctggcagagttcaacatgtggcttccacctcctgaagccctcccggctgacaacaagcctgaagaagtccagcctcggttctttaaagttcacatcttgaatgatgagcacaagacgatggcatctcgtgctaaagtgatggctgattgggtgtcagagggtggcgtgctgctgatggggtacgagatgtacagactcctcactctgaagaaatcatttgccacaggtagaccgaagaaaaccaagaagcgttctcacccagtcatcattgatctagatgaggaagatcggcagcaggagtttcggagagagtttgagaaggctttatgccgccctggccctgatgtagtaatctgtgatgagggacaccgcatcaaaaactgccaggccagcacctcacaggctctgaagaatatccgctctcgccgccgggtggtgctgactgggtaccctctgcaaaacaacctcattgagtactggtgcatggtggactttgtgcgcccagacttccttggcacccggcaggagttcagcaacatgtttgaacgccctatcctgaatgggcaatgtattgacagcacacctcaggacgtccgcctcatgcggtaccggagccatgtcctgcacagtcttctggagggctttgtgcagaggagaggccacactgtgctgaagattcatctccctgccaaggaagaaaatgtgatccttgtgcggctctccaagatccagcgagatttgtatacacagttcatggatcgcttccgggactgtggtagcagcggttggctggggctgaacccccttaaggcattctgtgtgtgttgcaagatctggaatcaccctgatgtgctgtatgaagcccttcagaaggagagcttggccaatgagcaggacctagacgtggaagaacttggctctgcagggaccagtgcccgctgtccaccacagggaacaaaaggcaagggagaggatagcaccttggcttcctcgatgggagaggcaaccaatagcaagttcctacagggcgttggcttcaaccctttccaggagcgaggcaacaacattgtcacatatgaatgggccaaggaccttctgactaattaccagactggagtcctagaaaactctcccaagatggtactgcttttccacctgattgaggaaagtgtgaagcttggggacaagatccttgtgtttagccagagtctttccaccttggctctcatcgaggaattccttggaaaacgagaagtaccctgtccacctggtaccgaggggcaaggagcacagaagtgggttcgaaacatcagctacttccggctagatggtagcacccctgcctttgagagggagcggcttattaatcagttcaatgatcccagcaacctcaccacctggctgttccttctctctacaagggccggatgcttgggtgtgaatctgattggtgccaaccgagtggtggtgtttgatgcttcctggaacccttgccatgatgcccaggcagtatgtcgggtataccgttatggccagaaaaagccctgttacatctatcgccttgtggctgattacactctagaaaagaagatctatgaccgtcagatttccaagcagggcatgtcagatcgggtggtggatgatctaaatccaatgctgaacttcacacggaaagaggtggaaaacctactgcactttgttgagaaggagccagctccccaagtttccttgaacgtaaaggggatcaaggagtcagtcctgcaactggcctgtctgaagtaccctcacctcatcaccaaggagcctttcgagcatgagtcattgctcttgaaccgaaaggatcacaagctaaccaaggctgagaaaaaagcagcaaagaaaagctatgaggaagacaaacgcacatcagtcccctatacccgcccatcgtatgcgcagtattaccctgccagcgatcagagcctgaccagcatccccgccttcagccagagaaactggcagccaactttgaagggtgatgaaaagcctgtggccagtgttcgtcctgtgcagtccacccccatccccatgatgccccggcatgtcccattgggaggaagtgtaagctctgcctccagcacaaatccatccatgaactttcccatcaactacttgcagcgtgcaggagtccttgtgcagaaggtggtcaccacgacagatattgttattcctggactcaacagctccacagatgtacaggcaagaattaatgctggtgagagcatccacatcatccgtgggacaaaagggacgtacatccgtaccagtgatggacggatctttgctgtccgggcaactggcaaaccaaaggttcctgaagatggtcggatggctgcctcaggttcccagggaccttcttgcgagtccacaagcaacggcagacacagtgcctcatcacccaaagcccccgaccctgaggggctggccaggcccgtctctcctgacagcccagagatcatcagtgagcttcagcagtatgcagatgtggctgctgcccgggaatcccgtcagagctccccaagcaccaatgccgccctgcctggccccccggcccaacttatggacagcagtgctgttcccgggacagctctcggaactgagcctcgactagggggtcattgcctcaatagttccctcttggtgactggccagccctgtggtgacaggcacccagtgctggacttaaggggccacaagcgaaagttggccacaccacctgctgcccaggagtcatcccgccggcggtccaggaagggtcatctgccagcccccgtgcagccgtatgaacacggctgccttgaggtgcagtgttggggatccagagccatgtcggacctgctactactgggcctgattgggggcctgactctcttactgctgctgacgctgctggcctttgccgggtactcagggctactggctggggtggaagtgagtgctgggtcaccccccatccgcaacgtcactgtggcctacaagttccacatggggctctatggtgagactgggcggcttttcactgagagctgcagcatctctcccaagctccgctccatcgctgtctactatgacaacccccacatggtgccccctgataagtgccgatgtgccgtgggcagcatcctgagtgaaggtgaggaatcgccctcccctgagctcatcgacctctaccagaaatttggcttcaaggtgttctccttcccggcacccagccatgtggtgacagccaccttcccctacaccaccattctgtccatctggctggctacccgccgtgtccatcctgccttggacacctacatcaaggagcggaagctgtgtgcctatcctcggctggagatctaccaggaagaccagatccatttcatgtgcccactggcacggcagggagacttctatgtgcctgagatgaaggagacagagtggaaatggcgggggcttgtggaggccattgacacccaggtggatggcacaggagctgacacaatgagtgacacgagttctgtaagcttggaagtgagccctggcagccgggagacttcagctgccacactgtcacccctgttgtgtctttttttcagactcacagtggagcttccaggacccagaataaagccaatgatttacttgtttcacctgga

SEQ ID NO: 112426 - DNA, 687 bp, Homo sapiens
tcgcccacctccgcgccccgtccccccacccgctcgtcgttcgcgtttctctcctctcttttcctataaaacaccccactgtagtgtgagctgacacaatgagtgacacgagttctgtaagcttggaagtgagccctggcagccgggagacttcagctgccacactgtcacctggggcgagcagccgtggctgggatgacggtgacacccgcagcgagcacagctacagcgagtcaggtgccagcggctcctcttttgaggagctggacttggagggcgaggggcccttaggggagtcacggctggaccctgggactgagcccctggggactaccaagtggctctgggagcccactgcccctgagaagggcaaggagtaacccatggcctgcaccctcctgcagtgcagttgctgaggaactgagcagactctccagcagactctccagccctcttcctccttcctctgggggaggaggggttcctgagggacctgacttcccctgctccaggcctcttgctaagccttctcctcactgccctttaggctcccagggccagaggagccagggactattttctgcaccagcccccagggctgccgcccctgttgtgtctttttttcagactcacagtggagcttccaggacccagaataaagccaatgatttacttgtttcacctgga

SEQ ID NO: 112427 - DNA, 4348 bp, Homo sapiens
gcagctataggcgccaccaatggcaagaacctagcctccgggaccccaaaaagaagagagctcagaagccctcccacatgagaagaaacatacgaaagctactccgggaggatcaattggagcctgttaccaaagcagcacagcaagaagagttggaaagaaggaagcgcctggagcagcagaggaaagattatgcagcccctattcctactgttccgctggagttcctccctgaggaaattgctttaagggcaagtgacggtccccaactgcctcctcgggtcttggcccaggaagtcatttgtttggacagtagcagtggcagtgaggatgaaaaaagcagtcgagatgaggtgattgaactgagctctggagaggaggacactctgcacattgtggacagcagtgaatctgtcagtgaagatgatgaggaagaagagaagggtggcacccatgtcaatgatgtcttaaaccagcgtgacgcccttgggcgggtccttgtcaacctaaaccaccctccagaggaggaaaatgtcttccttgccccacagttggcacgggctgtgaaacctcatcagattggcgggatccggttcctttacgataacctagtggagtctctggagaggtttaagaccagcagtggctttggctgtattctggcccacagcatgggtctggggaaaactttgcaagtgatctctttcatcgacgtcctcttccgccacacgccagccaaaacagtccttgccattgtgccggttaatactcttcagaattggctggcagagttcaacatgtggcttccacctcctgaagccctcccggctgacaacaagcctgaagaagtccagcctcggttctttaaagttcacatcttgaatgatgagcacaagacgatggcatctcgtgctaaagtgatggctgattgggtgtcagagggtggcgtgctgctgatggggtacgagatgtacagactcctcactctgaagaaatcatttgccacaggtagaccgaagaaaaccaagaagcgttctcacccagtcatcattgatctagatgaggaagatcggcagcaggagtttcggagagagtttgagaaggctttatgccgccctggccctgatgtagtaatctgtgatgagggacaccgcatcaaaaactgccaggccagcacctcacaggctctgaagaatatccgctctcgccgccgggtggtgctgactgggtaccctctgcaaaacaacctcattgagtactggtgcatggtggactttgtgcgcccagacttccttggcacccggcaggagttcagcaacatgtttgaacgccctatcctgaatgggcaatgtattgacagcacacctcaggacgtccgcctcatgcggtaccggagccatgtcctgcacagtcttctggagggctttgtgcagaggagaggccacactgtgctgaagattcatctccctgccaaggaagaaaatgtgatccttgtgcggctctccaagatccagcgagatttgtatacacagttcatggatcgcttccgggactgtggtagcagcggttggctggggctgaacccccttaaggcattctgtgtgtgttgcaagatctggaatcaccctgatgtgctgtatgaagcccttcagaaggagagcttggccaatgagcaggacctagacgtggaagaacttggctctgcagggaccagtgcccgctgtccaccacagggaacaaaaggcaagggagaggatagcaccttggcttcctcgatgggagaggcaaccaatagcaagttcctacagggcgttggcttcaaccctttccaggagcgaggcaacaacattgtcacatatgaatgggccaaggaccttctgactaattaccagactggagtcctagaaaactctcccaagatggtactgcttttccacctgattgaggaaagtgtgaagcttggggacaagatccttgtgtttagccagagtctttccaccttggctctcatcgaggaattccttggaaaacgagaagtaccctgtccacctggtaccgaggggcaaggagcacagaagtgggttcgaaacatcagctacttccggctagatggtagcacccctgcctttgagagggagcggcttattaatcagttcaatgatcccagcaacctcaccacctggctgttccttctctctacaagggccggatgcttgggtgtgaatctgattggtgccaaccgagtggtggtgtttgatgcttcctggaacccttgccatgatgcccaggcagtatgtcgggtataccgttatggccagaaaaagccctgttacatctatcgccttgtggctgattacactctagaaaagaagatctatgaccgtcagatttccaagcagggcatgtcagatcgggtggtggatgatctaaatccaatgctgaacttcacacggaaagaggtggaaaacctactgcactttgttgagaaggagccagctccccaagtttccttgaacgtaaaggggatcaaggagtcagtcctgcaactggcctgtctgaagtaccctcacctcatcaccaaggagcctttcgagcatgagtcattgctcttgaaccgaaaggatcacaagctaaccaaggctgagaaaaaagcagcaaagaaaagctatgaggaagacaaacgcacatcagtcccctatacccgcccatcgtatgcgcagtattaccctgccagcgatcagagcctgaccagcatccccgccttcagccagagaaactggcagccaactttgaagggtgatgaaaagcctgtggccagtgttcgtcctgtgcagtccacccccatccccatgatgccccggcatgtcccattgggaggaagtgtaagctctgcctccagcacaaatccatccatgaactttcccatcaactacttgcagcgtgcaggagtccttgtgcagaaggtggtcaccacgacagatattgttattcctggactcaacagctccacagatgtacaggcaagaattaatgctggtgagagcatccacatcatccgtgggacaaaagggacgtacatccgtaccagtgatggacggatctttgctgtccgggcaactggcaaaccaaaggttcctgaagatggtcggatggctgcctcaggttcccagggaccttcttgcgagtccacaagcaacggcagacacagtgcctcatcacccaaagcccccgaccctgaggggctggccaggcccgtctctcctgacagcccagagatcatcagtgagcttcagcagtatgcagatgtggctgctgcccgggaatcccgtcagagctccccaagcaccaatgccgccctgcctggccccccggcccaacttatggacagcagtgctgttcccgggacagctctcggaactgagcctcgactagggggtcattgcctcaatagttccctcttggtgactggccagccctgtggtgacaggcacccagtgctggacttaaggggccacaagcgaaagttggccacaccacctgctgcccaggagtcatcccgccggcggtccaggaagggtcatctgccagcccccgtgcagccgtatgaacacgggtatccagtctctggcgggtttgccatgccacccgtctccttaaaccataacctcaccacccccttcacctcccaggctggggagaactccctgtttatgggcagtaccccctcctactaccagctgtccaatttgctggcagatgcccgcctggtgtttccagtgactactgaccctctggtgccagcaggccccgtcagttcctcttccacggctacctcagtcactgccagcaacccctccttcatgctcaacccttctgtgccagggatactacccagctattcactcccattctcacagccactcctgtccgagccgaggatgtttgcgccttttccttcccctgtcttgcccagcaacctttcgcggggcatgtctatctatccaggctacatgtccccacatgcaggctacccagctggtggcctcctacggtcccaggtgcctccatttgactctcatgaggttgccgaggttgggttcagctccaatgatgatgaggataaagacgatgatgtgatagaggtcactgggaaatagctagggagcccctccccacctcacttggggcccccagcaggttgcccaccaagctggaaggcagtgatttagaccttttgagaataggacacttggcaggagggaaaaggaagaggacaaaggagggaggagaggaagaggtgggaggagaggaagaggtgggaggagaggaagaggtgcgaggagaggaa

SEQ ID NO: 112428 - DNA, 2938 bp, Homo sapiens
  misc_feature (911)..(911): n is a, c, g, or t
  misc_feature (1968)..(1968): n is a, c, g, or t
aggcttaagctgtcctcccacctcggcctcctgagtagctgtgacaagaggcgtgtaccaccatgcttggctagtttttgtattttttatagagatggtgtttcgccatattgcccaggctggccttgaacttgttagctcaagtgatcctgcctcagcctcccaaagtgttgggattctagggatgagccaccatgcccagctggattcctttttttagtttgtttgtttttaaagacagttttccttttttgcccaggctggagtgaaatggcatgatcttggctcactgcaacctccacctcgtgggttcaagcgattctcctgcctcagcttcctgagtagctgggattacaggtgcctgccaccatgcccggctaatttttgtatttttagtagagatggggttttgccatgttggccaggctggtctggaactcctgacctcatgtgatccacctgcctcagcttcccaaagtgctgggattacaggcgtgagccaccgtgcctggcctccagctgaattcctttgctttaagtgtatatatgtctccaggggctgtcttcatttcagcaggctgtcctggcctgaaggaggcacccctaggctccttcctctgaacattcctagcctaggagctgggtggtaggaggtagcatgctgggaagcaggcacattcctatacctggggtcccaagagagccattgggtgggtgggcagacagaacatacagtttaatagggccagggagaaactgtctccctcctttgctcttttcaggcctgcggtccctggggcactgatcattatttaaggagcagtgagggcctggcatcctgtcccctggtcagaagaaactacccaaaacttaaagctcccccagctccctgaccacctcattcacaggcntctgtcctgggagccacacctggggcctcagcaagaggagggccctgggccagcagcctgggcttctagggctcacctcacctctgccagtagcgcccagagggcatattctgggggctgagtgggtggtgggggtagggagagaccccaaattcccccctctcctaattctcccacccccaacctaggccccatttgaggctcaaggaaagccccaggctgagtccaggcgccaagcagaccccagctgcacctggcttggctccaacaccatggagacagtggctggggaagctggctaacccctcaccttctgtgatgtttgacagctgaccctctccccatcatacaggaagggtagcagatccactttctcccagtctggattcctgcacacagcgagcctgagccatgtgttcctccttgccaccccagcctgcattcagtgcctctgatccagggagatgaacccaggggttgctcctggacagggcagatgaaggggctgcttgcttggaggatgtattgggggtggaaggagcaggttagaaggagtttgggccatcaacctggctcagcactggtttggggcaccccaaccaccagcagagtgctctcatcatccccttttgctatcttgtggctcaggaagcaccagtcattgggggtggggtgggtaagggtttctcagggtcgacccaggcatagggagagaaaacccttaacatgtttcatcccagcaccctcctccttgcagctggttgagtatttctcaggccttctccatcctcctcgtacttcagctccctcctcaactgggacttggtgtgtaccagaggcaggggcctgctgactccctggatgctgctcctgggagccctgcacgggggagggctgcagaggggcctcctgctgcattctgcagtcctcgtgccctgtgggtgatgttctgtagctggccctggacacatctctttccaagcttgaagtgggggtgggggaaggtggagaggacactacttgtgtctctttgttctacctcagctcctcacctcanggctgagtggcccttaataaatgtggggggagggcagcaggctttgtggaagtgcagggagctgaggctaatttagagtggggagaagagtgcacagctgcctcctcccaccctctctccctccctccctccttccctccctcccttcctcccagctctttccctctgccctgtctgtgcagccccagtcagggtagagggcagagggcagctggagcaagccccctgagcccgggaggctgcattattcatgagtgcactgcgtgctgagttgcctctccctggaggagggggtggggtggtcctagctaacctgtgctcccttttcctggtcataggaggagctgacacaatgagtgacacgagttctgtaagcttggaagtgagccctggcagccgggagacttcagctgccacactgtcacctggggcgagcagccgtggctgggatgacggtgacacccgcagcgagcacagctacagcgagtcaggtgccagcggctcctcttttgaggagctggacttggagggcgaggggcccttaggggagtcacggctggaccctgggactgagcccctggggactaccaagtggctctgggagcccactgcccctgagaagggcaaggagtaacccatggcctgcaccctcctgcagtgcagttgctgaggaactgagcagactctccagcagactctccagccctcttcctccttcctctgggggaggaggggttcctgagggacctgacttcccctgctccaggcctcttgctaagccttctcctcactgccctttaggctcccagggccagaggagccagggactattttctgcaccagcccccagggctgccgcccctgttgtgtctttttttcagactcacagtggagcttccaggacccagaataaagccaatgatttacttgtttcacctggaaaaaaaaaaaatcggcctccgtgggctca

SEQ ID NO: 112429 - DNA, 1595 bp, Homo sapiens
  misc_feature (153)..(153): n is a, c, g, or t
gtggtgaaggtactgccgctggtgttcctgtctgcagtccagctgctgggtgctagtgcactaagccctgttgccattgagacgtgggcggggcagtgcctccttccctccggtgtcccgctgctgcactgcgcccacggccacggatgtccngccgcgagagggggcggagcgagcgtgcgcggcgggcgcgcgcaggctccgtaaccgaaccctgagccgcctgcgcggatcggcgtccgcagcgggcggctgctgaggggaaattcacgttacctctccacgtgccgaccaaggctctgagacccccagctgccttgaggtgcagtgttggggatccagagccatgtcggacctgctactactgggcctgattgggggcctgactctcttactgctgctgacgctgctggcctttgccgggtactcagggctactggctggggtggaagtgagtgctgggtcaccccccatccgcaacgtcactgtggcctacaagttccacatggggctctatggtgagactgggcggcttttcactgagagctgcagcatctctcccaagctccgctccatcgctgtctactatgacaacccccacatggtgccccctgataagtgccgatgtgccgtgggcagcatcctgagtgaaggtgaggaatcgccctcccctgagctcatcgacctctaccagaaatttggcttcaaggtgttctccttcccggcacccagccatgtggtgacagccaccttcccctacaccaccattctgtccatctggctggctacccgccgtgtccatcctgccttggacacctacatcaaggagcggaagctgtgtgcctatcctcggctggagatctaccaggaagaccagatccatttcatgtgcccactggcacggcagggagacttctatgtgcctgagatgaaggagacagagtggaaatggcgggggcttgtggaggccattgacacccaggtggatggcacaggagctgacacaatgagtgacacgagttctgtaagcttggaagtgagccctggcagccgggagacttcagctgccacactgtcacctggggcgagcagccgtggctgggatgacggtgacacccgcagcgagcacagctacagcgagtcaggtgccagcggctcctcttttgaggagctggacttggagggcgaggggcccttaggggagtcacggctggaccctgggactgagcccctggggactaccaagtggctctgggagcccactgcccctgagaagggcaaggagtaacccatggcctgcaccctcctgcagtgcagttgctgaggaactgagcagactctccagcagactctccagccctcttcctccttcctctgggggaggaggggttcctgagggacctgacttcccctgctccaggcctcttgctaagccttctcctcactgccctttaggctcccagggccagaggagccagggactattttctgcaccagcccccagggctgccgcccctgttgtgtctttttttcagactcacagtggagcttccaggacccagaataaagccaatgatttacttgtttcacctgga

SEQ ID NO: 112430 - DNA, 1732 bp, Homo sapiens
cgcggatcggcgtccgcagcgggcggctgctgaggtgagggccgggccagaggagaggcatacccactggggcgtaggtctgggactccccctgtccgccctggcgcgacctcaggactctccgtgtcccctccgtgacccccgcggcccgggccgctctttgcatcttgtcttgcccacagctggcctcggccaggtccgagggcctggatgcgaccttggggcagcccctactcttccgggcagcccacttccgcggccaccggtgcagggcatgccccggggccgtggaggtgagggaaagaggcgcgagtcgcgttttaactccgcccccgtcccccaaggccgcgcctcgcagcctgggctgcaaactttagcgtcctttaagttacagacgtgcgtggggctccgtgaggaggtgggcgaagagaaaggctctgagtaaatagctgccttgaggtgcagtgttggggatccagagccatgtcggacctgctactactgggcctgattgggggcctgactctcttactgctgctgacgctgctggcctttgccgggtactcagggctactggctggggtggaagtgagtgctgggtcaccccccatccgcaacgtcactgtggcctacaagttccacatggggctctatggtgagactgggcggcttttcactgagagctgcagcatctctcccaagctccgctccatcgctgtctactatgacaacccccacatggtgccccctgataagtgccgatgtgccgtgggcagcatcctgagtgaaggtgaggaatcgccctcccctgagctcatcgacctctaccagaaatttggcttcaaggtgttctccttcccggcacccagccatgtggtgacagccaccttcccctacaccaccattctgtccatctggctggctacccgccgtgtccatcctgccttggacacctacatcaaggagcggaagctgtgtgcctatcctcggctggagatctaccaggaagaccagatccatttcatgtgcccactggcacggcagggagacttctatgtgcctgagatgaaggagacagagtggaaatggcgggggcttgtggaggccattgacacccaggtggatggcacaggagctgacacaatgagtgacacgagttctgtaagcttggaagtgagccctggcagccgggagacttcagctgccacactgtcacctggggcgagcagccgtggctgggatgacggtgacacccgcagcgagcacagctacagcgagtcaggtgccagcggctcctcttttgaggagctggacttggagggcgaggggcccttaggggagtcacggctggaccctgggactgagcccctggggactaccaagtggctctgggagcccactgcccctgagaagggcaaggagtaacccatggcctgcaccctcctgcagtgcagttgctgaggaactgagcagactctccagcagactctccagccctcttcctccttcctctgggggaggaggggttcctgagggacctgacttcccctgctccaggcctcttgctaagccttctcctcactgccctttaggctcccagggccagaggagccagggactattttctgcaccagcccccagggctgccgcccctgttgtgtctttttttcagactcacagtggagcttccaggacccagaataaagccaatgatttacttgtttcacctgga

SEQ ID NO: 112431 - DNA, 1248 bp, Homo sapiens
  misc_feature (153)..(153): n is a, c, g, or t
gtggtgaaggtactgccgctggtgttcctgtctgcagtccagctgctgggtgctagtgcactaagccctgttgccattgagacgtgggcggggcagtgcctccttccctccggtgtcccgctgctgcactgcgcccacggccacggatgtccngccgcgagagggggcggagcgagcgtgcgcggcgggcgcgcgcaggctccgtaaccgaaccctgagccgcctgcgcggatcggcgtccgcagcgggcggctgctgagccccctgataagtgccgatgtgccgtgggcagcatcctgagtgaaggtgaggaatcgccctcccctgagctcatcgacctctaccagaaatttggcttcaaggtgttctccttcccggcacccagccatgtggtgacagccaccttcccctacaccaccattctgtccatctggctggctacccgccgtgtccatcctgccttggacacctacatcaaggagcggaagctgtgtgcctatcctcggctggagatctaccaggaagaccagatccatttcatgtgcccactggcacggcagggagacttctatgtgcctgagatgaaggagacagagtggaaatggcgggggcttgtggaggccattgacacccaggtggatggcacaggagctgacacaatgagtgacacgagttctgtaagcttggaagtgagccctggcagccgggagacttcagctgccacactgtcacctggggcgagcagccgtggctgggatgacggtgacacccgcagcgagcacagctacagcgagtcaggtgccagcggctcctcttttgaggagctggacttggagggcgaggggcccttaggggagtcacggctggaccctgggactgagcccctggggactaccaagtggctctgggagcccactgcccctgagaagggcaaggagtaacccatggcctgcaccctcctgcagtgcagttgctgaggaactgagcagactctccagcagactctccagccctcttcctccttcctctgggggaggaggggttcctgagggacctgacttcccctgctccaggcctcttgctaagccttctcctcactgccctttaggctcccagggccagaggagccagggactattttctgcaccagcccccagggctgccgcccctgttgtgtctttttttcagactcacagtggagcttccaggacccagaataaagccaatgatttacttgtttcacctgga

SEQ ID NO: 112432 - DNA, 1771 bp, Homo sapiens
  misc_feature (153)..(153): n is a, c, g, or t
gtggtgaaggtactgccgctggtgttcctgtctgcagtccagctgctgggtgctagtgcactaagccctgttgccattgagacgtgggcggggcagtgcctccttccctccggtgtcccgctgctgcactgcgcccacggccacggatgtccngccgcgagagggggcggagcgagcgtgcgcggcgggcgcgcgcaggctccgtaaccgaaccctgagccgcctgcgcggatcggcgtccgcagcgggcggctgctgagctgccttgaggtgcagtgttggggatccagagccatgtcggacctgctactactgggcctgattgggggcctgactctcttactgctgctgacgctgctggcctttgccgggtactcagggctactggctggggtggaagtgagtgctgggtcaccccccatccgcaacgtcactgtggcctacaagttccacatggggctctatggtgagactgggcggcttttcactgagagctgcagcatctctcccaagctccgctccatcgctgtctactatgacaacccccacatggttctactctacatcctacagctctggagatgaagtcagacctggctctgccctcagtgaagctctgtgtggctgacatgtcagccccacataagtgattctccaacaaggacacgtgtgcttgagtgtccacatgaactttgagctgtaggttcatggtaggctgccatagagtctgctgcgggaggctcgagagaaggggtagatttcatgctggtgccttctcatgtgccccctgataagtgccgatgtgccgtgggcagcatcctgagtgaaggtgaggaatcgccctcccctgagctcatcgacctctaccagaaatttggcttcaaggtgttctccttcccggcacccagccatgtggtgacagccaccttcccctacaccaccattctgtccatctggctggctacccgccgtgtccatcctgccttggacacctacatcaaggagcggaagctgtgtgcctatcctcggctggagatctaccaggaagaccagatccatttcatgtgcccactggcacggcagggagacttctatgtgcctgagatgaaggagacagagtggaaatggcgggggcttgtggaggccattgacacccaggtggatggcacaggagctgacacaatgagtgacacgagttctgtaagcttggaagtgagccctggcagccgggagacttcagctgccacactgtcacctggggcgagcagccgtggctgggatgacggtgacacccgcagcgagcacagctacagcgagtcaggtgccagcggctcctcttttgaggagctggacttggagggcgaggggcccttaggggagtcacggctggaccctgggactgagcccctggggactaccaagtggctctgggagcccactgcccctgagaagggcaaggagtaacccatggcctgcaccctcctgcagtgcagttgctgaggaactgagcagactctccagcagactctccagccctcttcctccttcctctgggggaggaggggttcctgagggacctgacttcccctgctccaggcctcttgctaagccttctcctcactgccctttaggctcccagggccagaggagccagggactattttctgcaccagcccccagggctgccgcccctgttgtgtctttttttcagactcacagtggagcttccaggacccagaataaagccaatgatttacttgtttcacctgga

SEQ ID NO: 112433 - DNA, 4672 bp, Homo sapiens
gcagctataggcgccaccaatggcaagaacctagcctccgggaccccaaaaagaagagagctcagaagccctcccacatgagaagaaacatacgaaagctactccgggaggatcaattggagcctgttaccaaagcagcacagcaagaagagttggaaagaaggaagcgcctggagcagcagaggaaagattatgcagcccctattcctactgttccgctggagttcctccctgaggaaattgctttaagggcaagtgacggtccccaactgcctcctcgggtcttggcccaggaagtcatttgtttggacagtagcagtggcagtgaggatgaaaaaagcagtcgagatgaggtgattgaactgagctctggagaggaggacactctgcacattgtggacagcagtgaatctgtcagtgaagatgatgaggaagaagagaagggtggcacccatgtcaatgatgtcttaaaccagcgtgacgcccttgggcgggtccttgtcaacctaaaccaccctccagaggaggaaaatgtcttccttgccccacagttggcacgggctgtgaaacctcatcagattggcgggatccggttcctttacgataacctagtggagtctctggagaggtttaagaccagcagtggctttggctgtattctggcccacagcatgggtctggggaaaactttgcaagtgatctctttcatcgacgtcctcttccgccacacgccagccaaaacagtccttgccattgtgccggttaatactcttcagaattggctggcagagttcaacatgtggcttccacctcctgaagccctcccggctgacaacaagcctgaagaagtccagcctcggttctttaaagttcacatcttgaatgatgagcacaagacgatggcatctcgtgctaaagtgatggctgattgggtgtcagagggtggcgtgctgctgatggggtacgagatgtacagactcctcactctgaagaaatcatttgccacaggtagaccgaagaaaaccaagaagcgttctcacccagtcatcattgatctagatgaggaagatcggcagcaggagtttcggagagagtttgagaaggctttatgccgccctggccctgatgtagtaatctgtgatgagggacaccgcatcaaaaactgccaggccagcacctcacaggctctgaagaatatccgctctcgccgccgggtggtgctgactgggtaccctctgcaaaacaacctcattgagtactggtgcatggtggactttgtgcgcccagacttccttggcacccggcaggagttcagcaacatgtttgaacgccctatcctgaatgggcaatgtattgacagcacacctcaggacgtccgcctcatgcggtaccggagccatgtcctgcacagtcttctggagggctttgtgcagaggagaggccacactgtgctgaagattcatctccctgccaaggaagaaaatgtgatccttgtgcggctctccaagatccagcgagatttgtatacacagttcatggatcgcttccgggactgtggtagcagcggttggctggggctgaacccccttaaggcattctgtgtgtgttgcaagatctggaatcaccctgatgtgctgtatgaagcccttcagaaggagagcttggccaatgagcaggacctagacgtggaagaacttggctctgcagggaccagtgcccgctgtccaccacagggaacaaaaggcaagggagaggatagcaccttggcttcctcgatgggagaggcaaccaatagcaagttcctacagggcgttggcttcaaccctttccaggagcgaggcaacaacattgtcacatatgaatgggccaaggaccttctgactaattaccagactggagtcctagaaaactctcccaagatggtactgcttttccacctgattgaggaaagtgtgaagcttggggacaagatccttgtgtttagccagagtctttccaccttggctctcatcgaggaattccttggaaaacgagaagtaccctgtccacctggtaccgaggggcaaggagcacagaagtgggttcgaaacatcagctacttccggctagatggtagcacccctgcctttgagagggagcggcttattaatcagttcaatgatcccagcaacctcaccacctggctgttccttctctctacaagggccggatgcttgggtgtgaatctgattggtgccaaccgagtggtggtgtttgatgcttcctggaacccttgccatgatgcccaggcagtatgtcgggtataccgttatggccagaaaaagccctgttacatctatcgccttgtggctgattacactctagaaaagaagatctatgaccgtcagatttccaagcagggcatgtcagatcgggtggtggatgatctaaatccaatgctgaacttcacacggaaagaggtggaaaacctactgcactttgttgagaaggagccagctccccaagtttccttgaacgtaaaggggatcaaggagtcagtcctgcaactggcctgtctgaagtaccctcacctcatcaccaaggagcctttcgagcatgagtcattgctcttgaaccgaaaggatcacaagctaaccaaggctgagaaaaaagcagcaaagaaaagctatgaggaagacaaacgcacatcagtcccctatacccgcccatcgtatgcgcagtattaccctgccagcgatcagagcctgaccagcatccccgccttcagccagagaaactggcagccaactttgaagggtgatgaaaagcctgtggccagtgttcgtcctgtgcagtccacccccatccccatgatgccccggcatgtcccattgggaggaagtgtaagctctgcctccagcacaaatccatccatgaactttcccatcaactacttgcagcgtgcaggagtccttgtgcagaaggtggtcaccacgacagatattgttattcctggactcaacagctccacagatgtacaggcaagaattaatgctggtgagagcatccacatcatccgtgggacaaaagggacgtacatccgtaccagtgatggacggatctttgctgtccgggcaactggcaaaccaaaggttcctgaagatggtcggatggctgcctcaggttcccagggaccttcttgcgagtccacaagcaacggcagacacagtgcctcatcacccaaagcccccgaccctgaggggctggccaggcccgtctctcctgacagcccagagatcatcagtgagcttcagcagtatgcagatgtggctgctgcccgggaatcccgtcagagctccccaagcaccaatgccgccctgcctggccccccggcccaacttatggacagcagtgctgttcccgggacagctctcggaactgagcctcgactagggggtcattgcctcaatagttccctcttggtgactggccagccctgtggtgacaggcacccagtgctggacttaaggggccacaagcgaaagttggccacaccacctgctgcccaggagtcatcccgccggcggtccaggaagggtcatctgccagcccccgtgcagccgtatgaacacggctgccttgaggtgcagtgttggggatccagagccatgtcggacctgctactactgggcctgattgggggcctgactctcttactgctgctgacgctgctggcctttgccgggtactcagggctactggctggggtggaagtgagtgctgggtcaccccccatccgcaacgtcactgtggcctacaagttccacatggggctctatggtgagactgggcggcttttcactgagagctgcagcatctctcccaagctccgctccatcgctgtctactatgacaacccccacatggtgccccctgataagtgccgatgtgccgtgggcagcatcctgagtgaaggtgaggaatcgccctcccctgagctcatcgacctctaccagaaatttggcttcaaggtgttctccttcccggcacccagccatgtggtgacagccaccttcccctacaccaccattctgtccatctggctggctacccgccgtgtccatcctgccttggacacctacatcaaggagcggaagctgtgtgcctatcctcggctggagatctaccaggaagaccagatccatttcatgtgcccactggcacggcagggagacttctatgtgcctgagatgaaggagacagagtggaaatggcgggggcttgtggaggccattgacacccaggtggatggcacaggagctgacacaatgagtgacacgagttctgtaagcttggaagtgagccctggcagccgggagacttcagctgccacactgtcacctggggcgagcagccgtggctgggatgacggtgacacccgcagcgagcacagctacagcgagtcaggtgccagcggctcctcttttgaggagctggacttggagggcgaggggcccttaggggagtcacggctggaccctgggactgagcccctggggactaccaaaggagccagggactattttctgcaccagcccccagggctgccgcccctgttgtgtctttttttcagactcacagtggagcttccaggacccagaataaagccaatgatttacttgtttcacctgga

SEQ ID NO: 112434 - DNA, 3329 bp, Homo sapiens
gcagctataggcgccaccaatggcaagaacctagcctccgggaccccaaaaagaagagagctcagaagccctcccacatgagaagaaacatacgaaagctactccgggaggatcaattggagcctgttaccaaagcagcacagcaagaagagttggaaagaaggaagcgcctggagcagcagaggaaagattatgcagcccctattcctactgttccgctggagttcctccctgaggaaattgctttaagggcaagtgacggtccccaactgcctcctcgggtcttggcccaggaagtcatttgtttggacagtagcagtggcagtgaggatgaaaaaagcagtcgagatgaggtgattgaactgagctctggagaggaggacactctgcacattgtggacagcagtgaatctgtcagtgaagatgatgaggaagaagagaagggtggcacccatgtcaatgatgtcttaaaccagcgtgacgcccttgggcgggtccttgtcaacctaaaccaccctccagaggaggaaaatgtcttccttgccccacagttggcacgggctgtgaaacctcatcagattggcgggatccggttcctttacgataacctagtggagtctctggagaggtttaagaccagcagtggctttggctgtattctggcccacagcatgggtctggggaaaactttgcaagtgatctctttcatcgacgtcctcttccgccacacgccagccaaaacagtccttgccattgtgccggttaatactcttcagaattggctggcagagttcaacatgtggcttccacctcctgaagccctcccggctgacaacaagcctgaagaagtccagcctcggttctttaaagttcacatcttgaatgatgagcacaagacgatggcatctcgtgctaaagtgatggctgattgggtgtcagagggtggcgtgctgctgatggggtacgagatgtacagactcctcactctgaagaaatcatttgccacaggtagaccgaagaaaaccaagaagcgttctcacccagtcatcattgatctagatgaggaagatcggcagcaggagtttcggagagagtttgagaaggctttatgccgccctggccctgatgtagtaatctgtgatgagggacaccgcatcaaaaactgccaggccagcacctcacaggctctgaagaatatccgctctcgccgccgggtggtgctgactgggtaccctctgcaaaacaacctcattgagtactggtgcatggtggactttgtgcgcccagacttccttggcacccggcaggagttcagcaacatgtttgaacgccctatcctgaatgggcaatgtattgacagcacacctcaggacgtccgcctcatgcggtaccggagccatgtcctgcacagtcttctggagggctttgtgcagaggagaggccacactgtgctgaagattcatctccctgccaaggaagaaaatgtgatccttgtgcggctctccaagatccagcgagatttgtatacacagttcatggatcgcttccgggactgtggtagcagcggttggctggggctgaacccccttaaggcattctgtgtgtgttgcaagatctggaatcaccctgatgtgctgtatgaagcccttcagaaggagagcttggccaatgagcaggacctagacgtggaagaacttggctctgcagggaccagtgcccgctgtccaccacagggaacaaaaggcaagggagaggatagcaccttggcttcctcgatgggagaggcaaccaatagcaagttcctacagggcgttggcttcaaccctttccaggagcgaggcaacaacattgtcacatatgaatgggccaaggaccttctgactaattaccagactggagtcctagaaaactctcccaagatggtactgcttttccacctgattgaggaaagtgtgaagcttggggacaagatccttgtgtttagccagagtctttccaccttggctctcatcgaggaattccttggaaaacgagaagtaccctgtccacctggtaccgaggggcaaggagcacagaagtgggttcgaaacatcagctacttccggctagatggtagcacccctgcctttgagagggagcggcttattaatcagttcaatgatcccagcaacctcaccacctggctgttccttctctctacaagggccggatgcttgggtgtgaatctgattggtgccaaccgagtggtggtgtttgatgcttcctggaacccttgccatgatgcccaggcagtatgtcgggtataccgttatggccagaaaaagccctgttacatctatcgccttgtggctgattacactctagaaaagaagatctatgaccgtcagatttccaagcagggcatgtcagatcgggtggtggatgatctaaatccaatgctgaacttcacacggaaagaggtggaaaacctactgcactttgttgagaaggagccagctccccaagtttccttgaacgtaaaggggatcaaggagtcagtcctgcaactggcctgtctgaagtaccctcacctcatcaccaaggagcctttcgagcatgagtcattgctcttgaaccgaaaggatcacaagctaaccaaggctgagaaaaaagcagcaaagaaaagctatgaggaagacaaacgcacatcagtcccctatacccgcccatcgtatgcgcagtattaccctgccagcgatcagagcctgaccagcatccccgccttcagccagagaaactggcagccaactttgaagggtgatgaaaagcctgtggccagtgttcgtcctgtgcagtccacccccatccccatgatgccccggcatgtcccattgggaggaagtgtaagctctgcctccagcacaaatccatccatgaactttcccatcaactacttgcagcgtgcaggagtccttgtgcagaaggtggtcaccacgacagatattgttattcctggactcaacagctccacagatgtacaggcaagaattaatgctggtgagagcatccacatcatccgtgggacaaaagggacgtacatccgtaccagtgatggacggatctttgctgtccgggcaactggcaaaccaaaggttcctgaagatggtcggatggctgcctcaggttcccagggaccttcttgcgagtccacaagcaacggcagacacagtgcctcatcacccaaagcccccgaccctgaggggctggccaggcccgtctctcctgacagcccagagatcatcagtgagcttcagcagtatgcagaaacatggcaaaaccctatttctact

SEQ ID NO: 112435 - DNA, 3033 bp, Homo sapiens
gcagctataggcgccaccaatggcaagaacctagcctccgggaccccaaaaagaagagagctcagaagccctcccacatgagaagaaacatacgaaagctactccgggaggatcaattggagcctgttaccaaagcagcacagcaagaagagttggaaagaaggaagcgcctggagcagcagaggaaagattatgcagcccctattcctactgttccgctggagttcctccctgaggaaattgctttaagggcaagtgacggtccccaactgcctcctcgggtcttggcccaggaagtcatttgtttggacagtagcagtggcagtgaggatgaaaaaagcagtcgagatgaggtgattgaactgagctctggagaggaggacactctgcacattgtggacagcagtgaatctgtcagtgaagatgatgaggaagaagagaagggtggcacccatgtcaatgatgtcttaaaccagcgtgacgcccttgggcgggtccttgtcaacctaaaccaccctccagaggaggaaaatgtcttccttgccccacagttggcacgggctgtgaaacctcatcagattggcgggatccggttcctttacgataacctagtggagtctctggagaggtttaagaccagcagtggctttggctgtattctggcccacagcatgggtctggggaaaactttgcaagtgatctctttcatcgacgtcctcttccgccacacgccagccaaaacagtccttgccattgtgccggttaatactcttcagaattggctggcagagttcaacatgtggcttccacctcctgaagccctcccggctgacaacaagcctgaagaagtccagcctcggttctttaaagttcacatcttgaatgatgagcacaagacgatggcatctcgtgctaaagtgatggctgattgggtgtcagagggtggcgtgctgctgatggggtacgagatgtacagactcctcactctgaagaaatcatttgccacaggtagaccgaagaaaaccaagaagcgttctcacccagtcatcattgatctagatgaggaagatcggcagcaggagtttcggagagagtttgagaaggctttatgccgccctggccctgatgtagtaatctgtgatgagggacaccgcatcaaaaactgccaggccagcacctcacaggctctgaagaatatccgctctcgccgccgggtggtgctgactgggtaccctctgcaaaacaacctcattgagtactggtgcatggtggactttgtgcgcccagacttccttggcacccggcaggagttcagcaacatgtttgaacgccctatcctgaatgggcaatgtattgacagcacacctcaggacgtccgcctcatgcggtaccggagccatgtcctgcacagtcttctggagggctttgtgcagaggagaggccacactgtgctgaagattcatctccctgccaaggaagaaaatgtgatccttgtgcggctctccaagatccagcgagatttgtatacacagttcatggatcgcttccgggactgtggtagcagcggttggctggggctgaacccccttaaggcattctgtgtgtgttgcaagatctggaatcaccctgatgtgctgtatgaagcccttcagaaggagagcttggccaatgagcaggacctagacgtggaagaacttggctctgcagggaccagtgcccgctgtccaccacagggaacaaaaggcaagggagaggatagcaccttggcttcctcgatgggagaggcaaccaatagcaagttcctacagggcgttggcttcaaccctttccaggagcgaggcaacaacattgtcacatatgaatgggccaaggaccttctgactaattaccagactggagtcctagaaaactctcccaagatggtactgcttttccacctgattgaggaaagtgtgaagcttggggacaagatccttgtgtttagccagagtctttccaccttggctctcatcgaggaattccttggaaaacgagaagtaccctgtccacctggtaccgaggggcaaggagcacagaagtgggttcgaaacatcagctacttccggctagatggtagcacccctgcctttgagagggagcggcttattaatcagttcaatgatcccagcaacctcaccacctggctgttccttctctctacaagggccggatgcttgggtgtgaatctgattggtgccaaccgagtggtggtgtttgatgcttcctggaacccttgccatgatgcccaggcagtatgtcgggtataccgttatggccagaaaaagccctgttacatctatcgccttgtggctgattacactctagaaaagaagatctatgaccgtcagatttccaagcagggcatgtcagatcgggtggtggatgatctaaatccaatgctgaacttcacacggaaagaggtggaaaacctactgcactttgttgagaaggagccagctccccaagtttccttgaacgtaaaggggatcaaggagtcagtcctgcaactggcctgtctgaagtaccctcacctcatcaccaaggagcctttcgagcatgagtcattgctcttgaaccgaaaggatcacaagctaaccaaggctgagaaaaaagcagcaaagaaaagctatgaggaagacaaacgcacatcagtcccctatacccgcccatcgtatgcgcagtattaccctgccagcgatcagagcctgaccagcatccccgccttcagccagagaaactggcagccaactttgaagggtgatgaaaagcctgtggccagtgttcgtcctgtgcagtccacccccatccccatgatgccccggcatgtcccattgggaggaagtgtaagctctgcctccagcacaaatccatccatgaactttcccatcaactacttgcagcgtgcaggagtccttgtgcagaaggtggtcaccacgacagatattgttattcctggactcaacagctccttgtcgtggcgattgaatcctctag

SEQ ID NO: 112436 - DNA, 4207 bp, Homo sapiens
cggaagagaaagctggaacccggccggagtagctctgagcgccggctgtgaggaaggaggttctgggcaagctatagccatggctgtggctgtagccatggcgggagccttaatcgggtcggagccaggccccgcggaagaacttgccaaactcgagtacctgtctttggtgtcaaaggtttgcactgagctggacaatcacttggggatcaacgacaaggaccttgctgaatttgtgatcagtcttgctgagaaaaataccacctttgatacttttaaggcttctctcgtcaaaaatggtgcagaatttacggattctcttattagtaacttgctgcgtctcatacaaaccatgcggcctccagcgaagccttccactagcaaagatccagttgttaaacctaaaacagaaaaagaaaagctgaaggaactcttcccagtcctttgccaaccggacaacccttctgttcggaccatgttggatgaagatgatgtgaaagttgctgtggatgtcctgaaagaactggaagctttaatgcccagcgcagcaggccaggagaagcaaagagatgctgaacaccgggacaggacaaagaagaagaagcggagtcgaagccgagatcgaaaccgagatcgagacagagatagggaacgaaaccgagatagagaccacaagcggagacaccgatcccgctctcgatcacgttccaggacccgggagaggaataaagtgaagtctagatatcggtccaggagcaggagtcagagtccccccaaagaccggaaggaccgggacaaatatggagagcggaatctggatagatggcgggataagcatgtggaccgccctcctccagaagagcccaccattggtgacatttataatggcaaagttaccagcatcatgcagtttggttgctttgtgcagctggaaggactaaggaagcggtgggaaggcctggtgcacatctctgagctccggcgggagggtcgtgtggccaatgtagctgatgtcgtgagcaaaggccagagggtcaaagtcaaagtgctgtccttcactgggaccaagaccagcctgagcatgaaggatgtggatcaagagactggagaagatctaaacccaaatagacggcgaaatcttgtcggggagaccaatgaggagacctcaatgcggaatcctgatagacccactcacttgtcccttgtcagtgctcctgaagtagaggacgactcactggaacgcaagcgcctcacccgaatctctgacccagagaagtgggagatcaaacagatgattgctgccaatgtcctttccaaagaagaatttccagactttgatgaagagactggcattctccctaaggtggatgatgaagaagatgaggaccttgagattgaattggttgaggaagagcctccattcctgagagggcacactaagcaaagcatggacatgagccccattaaaattgtcaagaacccagacggctccctctcccaagcagcaatgatgcagagtgccttggccaaagaaaggcgggaactcaaacaggcccagcgggaagctgagatggattctattcccatgggactcaacaaacactgggttgaccctctgcctgatgcggaaggcagacagattgctgccaacatgaggggtattgggatgatgcccaatgatattcctgagtggaagaagcatgcctttgggggcaacaaagcctcttacggaaaaaagacccagatgtcaatccttgagcagagggagagcctgcccatctacaaactgaaggagcaattggtccaggccgtccatgacaatcagatcctgattgtcattggtgagacaggatctggaaagacaacacagatcacccagtacctggcggaggcaggctacacttccaggggcaagattgggtgtacccagcccagaagagtggcagctatgtcggtggccaaaagagtgtcagaggagtttggttgttgcttaggccaagaggtgggctacaccattcgatttgaggactgcactagccctgaaacagtcatcaagtacatgacagatgggatgttgcttagagagtgcttgattgaccctgacctcactcagtacgcgatcatcatgttggacgaggcacatgagaggacaattcacactgatgtgctctttggattgttgaaaaagacagttcagaaacggcaggacatgaagctgattgtcacctcagccaccttggatgcagtgaagttttctcaatacttctatgaagctcccattttcaccatcccaggtcgaacatatccagtggaaatactgtacacaaaggaacctgagacagattatctggatgccagcctgattactgttatgcagattcatttaacagaaccaccaggtgatatcctggtcttcctgactggtcaggaagaaattgatactgcttgtgagatcctgtatgaaagaatgaaatccctgggacctgatgttccagagttaattatcctcccagtgtactctgctcttcccagtgagatgcagacccgaatctttgacccagctccaccaggcagcagaaaggttgtgattgccaccaatatcgcagagacatcgctgactattgatggtatctactatgtggtggacccaggattcgtgaaacagaaagtttacaattccaagacagggattgaccagctcgtggtgacgcctatttctcaggctcaggcaaagcaacgagctggcagagctgggagaacaggcccagggaagtgttacaggttgtacacagaacgtgcctaccgagatgaaatgctgaccaccaacgtgccggaaatccagagaaccaacttagcaagcacagtgctgtcactcaaggccatgggtatcaatgatctgctgtcctttgatttcatggatgccccacctatggaaactttgatcacagccatggagcagctgtacacactgggggccctggatgacgagggcctgctcactcgcttgggccgccggatggcagagttccctctggagccaatgctatgcaaaatgctcatcatgtctgtgcatctgggctgcagtgaggaaatgctgaccattgtatccatgctgtctgtgcagaacgtcttctataggcccaaggataaacaagcccttgcagatcagaagaaggccaaattccaccagactgaaggggaccacctcaccctgctagctgtgtacaactcctggaagaacaacaagttctccaacccatggtgctatgagaactttatccaggctcgttccctgcgccgggcccaggacattcgcaagcagatgttaggcataatggacagacacaagctggatgttgtttcctgtggcaagtccacagtccgagtgcagaaggccatctgcagtgggttcttccgtaatgctgccaagaaagacccgcaggagggttaccggacactgatcgaccagcaggtggtctatatccatccttccagtgccctcttcaacagacagccagaatgggtggtgtaccatgagctggtgctcaccaccaaggaatacatgcgtgaagttaccaccatcgaccctcggtggcttgtggagtttgccccagccttcttcaaggtctcagacccaactaagctaagcaaacagaagaagcaacagcgtcttgaacccttgtacaaccgctatgaggaacccaatgcctggagaatatctcgagctttccgacggcgctgaaaggcaagattgttcctttgcctctccagcagcagtagccagggcttggacttatcgatgacaggctggtcctgaggatacagctgtcccgtgactgactgtcttaactgagcattttctcaactcgactctcatttcttccctgctggtaaaatagaaacagggatttaaacctggctttggcaagagcctgcagcctccatcaccccaagtccttgggcccagttgggagctcatatctaacacagagacacattgcatcaacttcaagaaagggacaatttgtgcagctccaggatgggaaggtggagtgggtgagcatcttgtgcagggacatggtgagtgccctgatgccccagctagcaggagctactgtgctcatctaaagtgtttgccccacttcccaccccgtctccagcccctgtactttggcttgacctcgtggaaatatttattttcttaagg

SEQ ID NO: 112437 - DNA, 4226 bp, Homo sapiens
cggaagagaaagctggaacccggccggagtagctctgagcgccggctgtgaggaaggaggttctgggcaagctatagccatggctgtggctgtagccatggcgggagccttaatcgggtcggagccaggccccgcggaagaacttgccaaactcgagtacctgtctttggtgtcaaaggtttgcactgagctggacaatcacttggggatcaacgacaaggaccttgctgaatttgtgatcagtcttgctgagaaaaataccacctttgatacttttaaggcttctctcgtcaaaaatggtgcagaatttacggattctcttattagtaacttgctgcgtctcatacaaaccatgcggcctccagcgaagccttccactagcaaagatccagttgttaaacctaaaacagaaaaagaaaagctgaaggaactcttcccagtcctttgccaaccggacaacccttctgttcggaccatgttggatgaagatgatgtgaaagttgctgtggatgtcctgaaagaactggaagctttaatgcccagcgcagcaggccaggagaagcaaagagatgctgaacaccggtgcttattgatttgttagggacaggacaaagaagaagaagcggagtcgaagccgagatcgaaaccgagatcgagacagagatagggaacgaaaccgagatagagaccacaagcggagacaccgatcccgctctcgatcacgttccaggacccgggagaggaataaagtgaagtctagatatcggtccaggagcaggagtcagagtccccccaaagaccggaaggaccgggacaaatatggagagcggaatctggatagatggcgggataagcatgtggaccgccctcctccagaagagcccaccattggtgacatttataatggcaaagttaccagcatcatgcagtttggttgctttgtgcagctggaaggactaaggaagcggtgggaaggcctggtgcacatctctgagctccggcgggagggtcgtgtggccaatgtagctgatgtcgtgagcaaaggccagagggtcaaagtcaaagtgctgtccttcactgggaccaagaccagcctgagcatgaaggatgtggatcaagagactggagaagatctaaacccaaatagacggcgaaatcttgtcggggagaccaatgaggagacctcaatgcggaatcctgatagacccactcacttgtcccttgtcagtgctcctgaagtagaggacgactcactggaacgcaagcgcctcacccgaatctctgacccagagaagtgggagatcaaacagatgattgctgccaatgtcctttccaaagaagaatttccagactttgatgaagagactggcattctccctaaggtggatgatgaagaagatgaggaccttgagattgaattggttgaggaagagcctccattcctgagagggcacactaagcaaagcatggacatgagccccattaaaattgtcaagaacccagacggctccctctcccaagcagcaatgatgcagagtgccttggccaaagaaaggcgggaactcaaacaggcccagcgggaagctgagatggattctattcccatgggactcaacaaacactgggttgaccctctgcctgatgcggaaggcagacagattgctgccaacatgaggggtattgggatgatgcccaatgatattcctgagtggaagaagcatgcctttgggggcaacaaagcctcttacggaaaaaagacccagatgtcaatccttgagcagagggagagcctgcccatctacaaactgaaggagcaattggtccaggccgtccatgacaatcagatcctgattgtcattggtgagacaggatctggaaagacaacacagatcacccagtacctggcggaggcaggctacacttccaggggcaagattgggtgtacccagcccagaagagtggcagctatgtcggtggccaaaagagtgtcagaggagtttggttgttgcttaggccaagaggtgggctacaccattcgatttgaggactgcactagccctgaaacagtcatcaagtacatgacagatgggatgttgcttagagagtgcttgattgaccctgacctcactcagtacgcgatcatcatgttggacgaggcacatgagaggacaattcacactgatgtgctctttggattgttgaaaaagacagttcagaaacggcaggacatgaagctgattgtcacctcagccaccttggatgcagtgaagttttctcaatacttctatgaagctcccattttcaccatcccaggtcgaacatatccagtggaaatactgtacacaaaggaacctgagacagattatctggatgccagcctgattactgttatgcagattcatttaacagaaccaccaggtgatatcctggtcttcctgactggtcaggaagaaattgatactgcttgtgagatcctgtatgaaagaatgaaatccctgggacctgatgttccagagttaattatcctcccagtgtactctgctcttcccagtgagatgcagacccgaatctttgacccagctccaccaggcagcagaaaggttgtgattgccaccaatatcgcagagacatcgctgactattgatggtatctactatgtggtggacccaggattcgtgaaacagaaagtttacaattccaagacagggattgaccagctcgtggtgacgcctatttctcaggctcaggcaaagcaacgagctggcagagctgggagaacaggcccagggaagtgttacaggttgtacacagaacgtgcctaccgagatgaaatgctgaccaccaacgtgccggaaatccagagaaccaacttagcaagcacagtgctgtcactcaaggccatgggtatcaatgatctgctgtcctttgatttcatggatgccccacctatggaaactttgatcacagccatggagcagctgtacacactgggggccctggatgacgagggcctgctcactcgcttgggccgccggatggcagagttccctctggagccaatgctatgcaaaatgctcatcatgtctgtgcatctgggctgcagtgaggaaatgctgaccattgtatccatgctgtctgtgcagaacgtcttctataggcccaaggataaacaagcccttgcagatcagaagaaggccaaattccaccagactgaaggggaccacctcaccctgctagctgtgtacaactcctggaagaacaacaagttctccaacccatggtgctatgagaactttatccaggctcgttccctgcgccgggcccaggacattcgcaagcagatgttaggcataatggacagacacaagctggatgttgtttcctgtggcaagtccacagtccgagtgcagaaggccatctgcagtgggttcttccgtaatgctgccaagaaagacccgcaggagggttaccggacactgatcgaccagcaggtggtctatatccatccttccagtgccctcttcaacagacagccagaatgggtggtgtaccatgagctggtgctcaccaccaaggaatacatgcgtgaagttaccaccatcgaccctcggtggcttgtggagtttgccccagccttcttcaaggtctcagacccaactaagctaagcaaacagaagaagcaacagcgtcttgaacccttgtacaaccgctatgaggaacccaatgcctggagaatatctcgagctttccgacggcgctgaaaggcaagattgttcctttgcctctccagcagcagtagccagggcttggacttatcgatgacaggctggtcctgaggatacagctgtcccgtgactgactgtcttaactgagcattttctcaactcgactctcatttcttccctgctggtaaaatagaaacagggatttaaacctggctttggcaagagcctgcagcctccatcaccccaagtccttgggcccagttgggagctcatatctaacacagagacacattgcatcaacttcaagaaagggacaatttgtgcagctccaggatgggaaggtggagtgggtgagcatcttgtgcagggacatggtgagtgccctgatgccccagctagcaggagctactgtgctcatctaaagtgtttgccccacttcccaccccgtctccagcccctgtactttggcttgacctcgtggaaatatttattttcttaagg

SEQ ID NO: 112438 - DNA, 2335 bp, Homo sapiens
tgctaggtagaggcgggtgttgaatcggccgaggcagggcaagattgggtgtacccagcccagaagagtggcagctatgtcggtggccaaaagagtgtcagaggagtttggttgttgcttaggccaagaggtgggctacaccattcgatttgaggactgcactagccctgaaacagtcatcaagtacatgacagatgggatgttgcttagagagtgcttgattgaccctgacctcactcagtacgcgatcatcatgttggacgaggcacatgagaggacaattcacactgatgtgctctttggattgttgaaaaagacagttcagaaacggcaggacatgaagctgattgtcacctcagccaccttggatgcagtgaagttttctcaatacttctatgaagctcccattttcaccatcccaggtcgaacatatccagtggaaatactgtacacaaaggaacctgagacagattatctggatgccagcctgattactgttatgcagattcatttaacagaaccaccaggtgatatcctggtcttcctgactggtcaggaagaaattgatactgcttgtgagatcctgtatgaaagaatgaaatccctgggacctgatgttccagagttaattatcctcccagtgtactctgctcttcccagtgagatgcagacccgaatctttgacccagctccaccaggcagcagaaaggttgtgattgccaccaatatcgcagagacatcgctgactattgatggtatctactatgtggtggacccaggattcgtgaaacagaaagtttacaattccaagacagggattgaccagctcgtggtgacgcctatttctcaggctcaggcaaagcaacgagctggcagagctgggagaacaggcccagggaagtgttacaggttgtacacagaacgtgcctaccgagatgaaatgctgaccaccaacgtgccggaaatccagagaaccaacttagcaagcacagtgctgtcactcaaggccatgggtatcaatgatctgctgtcctttgatttcatggatgccccacctatggaaactttgatcacagccatggagcagctgtacacactgggggccctggatgacgagggcctgctcactcgcttgggccgccggatggcagagttccctctggagccaatgctatgcaaaatgctcatcatgtctgtgcatctgggctgcagtgaggaaatgctgaccattgtatccatgctgtctgtgcagaacgtcttctataggcccaaggataaacaagcccttgcagatcagaagaaggccaaattccaccagactgaaggggaccacctcaccctgctagctgtgtacaactcctggaagaacaacaagttctccaacccatggtgctatgagaactttatccaggctcgttccctgcgccgggcccaggacattcgcaagcagatgttaggcataatggacagacacaagctggatgttgtttcctgtggcaagtccacagtccgagtgcagaaggccatctgcagtgggttcttccgtaatgctgccaagaaagacccgcaggagggttaccggacactgatcgaccagcaggtggtctatatccatccttccagtgccctcttcaacagacagccagaatgggtggtgtaccatgagctggtgctcaccaccaaggaatacatgcgtgaagttaccaccatcgaccctcggtggcttgtggagtttgccccagccttcttcaaggtctcagacccaactaagctaagcaaacagaagaagcaacagcgtcttgaacccttgtacaaccgctatgaggaacccaatgcctggagaatatctcgagctttccgacggcgctgaaaggcaagattgttcctttgcctctccagcagcagtagccagggcttggacttatcgatgacaggctggtcctgaggatacagctgtcccgtgactgactgtcttaactgagcattttctcaactcgactctcatttcttccctgctggtaaaatagaaacagggatttaaacctggctttggcaagagcctgcagcctccatcaccccaagtccttgggcccagttgggagctcatatctaacacagagacacattgcatcaacttcaagaaagggacaatttgtgcagctccaggatgggaaggtggagtgggtgagcatcttgtgcagggacatggtgagtgccctgatgccccagctagcaggagctactgtgctcatctaaagtgtttgccccacttcccaccccgtctccagcccctgtactttggcttgacctcgtggaaatatttattttcttaagg

SEQ ID NO: 112439 - DNA, 321 bp, Homo sapiens
gttcttggcaggaaatggatgactcatcctgaacatgtgctttcgttgctgggacaatggggcgcaatgaaaatgttcaacttactgaatagtgtggacatttttgtcatctgtttgtaggagactgatgaaatacaactacagattaataagaaccccgaagtaacctatgcttttgtgtgagaaaactaatgataaatattaagaaaaagacatggactgtttcaaaataatcagtaggttttctatgcactaaaagagactgtgtacggcagatcccaggaaagtagaggtggagaaattccagaatttaggaaggaa

SEQ ID NO: 112440 - DNA, 798 bp, Homo sapiens
gcaaaagaacaacttatttataaaaaaatgaaaaagcacaaataaagtttgtctctaagaagaaactgcttggagcttgcattagtttgctcaggctgccgtaacaaaatgccatagactgagtggcttaaacaacagaaatttgttttctcacagttctggaggatggaagtctgatatcagcatgccagcatggttgggttctggtgagggctctatgcctggcttgcagatggccgccttcttgctgtgccctcacatggtggagggagggcaagctctctgatgtctcttcttataaggacttaactaaccccatcatgagggccctacctcatctaaccctaattacctccaaaagatcccatctttaaggatgcagtcacactggggattaaggctttaacatatgaatttgaggaggagacacacttcagtccatatcagagcttaatccatttggtgcaagtgttacttcagttatgtagttttctaaatttgtaattaaatgttactattagaaggaaatcacatattaatacgaagagttgttttttttttaattaaggaaaagatttaaagagcacaaagcagtattttatgaaacataaaaaatatatcaaagatcattgtgccaaggaaatgagaaagctaggtgtttaatacctctacgtttatgatacagtgatacttcgcttatccaaaattctgctctgtggtagcatgagctatacagaaaagacctaaaaacaagcagcataaatattatgtaccaaagctcttctgttttattcatag

SEQ ID NO: 112441 - DNA, 516 bp, Homo sapiens
tttttagaaaaagatatttacccagatatgtggatttaactttattatattaggtcaatgaaaccagaatttatgtattagtggaagctgaacttccagtatcgcctagactgaaggtccccctccatatgggaagctgccctcttcaccaaatacacaatgagtaaaggagaaaccacaagcagaaatggaagaagcagatactcactagccaggctggtcaacctaattaaccctagtaggcagtgggacagcagttgtgttaaccagacaaagaactcttctggaagactggaatagaccctagataaacactaacttttttctagattaacttcgaataaattttatttgcattagtaaaattatcccaccatcatagttattttattcaactatattttccacattctttaatctttcaaagtgtatataaagatgtcttaggagatataaaggccacaaagttaagatgaaattcagataaaatttagtaacctagtcaataaaagtcag

SEQ ID NO: 112442 - DNA, 237 bp, Homo sapiens
cactagcagaagctccttcttggtttcagtattaaaacttggagtcttccagaaactttgccactatattgaagtactttagttgtaattacctttctataagttgaattccaattattgtttttttttaactctttagaatacaaaactcacaatatgttttaattttaatgcattctctaatgttattccattactgcaggccattttggtctgcatatttcaatattttgttcc

SEQ ID NO: 112443 - DNA, 2774 bp, Homo sapiens
tttgtttctggcgaccgtccccacccgggctcgcgtctccgtttctccgagaggcccaaggtgtcttcgccgcagcctctgtcgcgccgtgacctgtacaggtcgcgggagtcgtagggaggacgccgggacacctggaagccgagaaatggattcagtggcctttgaggatgtggctgtgaacttcaccctggaggagtgggctttgctggatccttcccagaagaatctctacagggatgtgatgcgggaaaccttcaggaacctggcttctgtaggaaaacaatgggaagaccagaacattgaagacccattcaaaattcccaggagaaatataagtcatattccagagagactctgtgaaagtaaagaaggtggtcaaggtgaagaaaccttcagccagattccagatggtattctgaacaagaaaactcctggagtaaaaccgtgtgaaagcagtgtgtgtggagaagttggcatgggtccttcatcacttaataggcacatcagagatcacactggacgtgaaccaaatgaatatcaggaatatggaacgaagtcatatacacgtaaccagtgtggacgagccttgagttatcatcgctcttttccagtacgtgaaaggactcatcctggaggaaagccctatgattgtaaggaatgtggagaaacctttatttctcttgtaagcattcgaagacacatgttaacgcataggggaggtgtaccttacaaatgtaaggtgtgtgggaaagcctttgattatcccagtttatttcgtatacatgaaagaagtcacactggagagaaaccttatgaatgcaagcaatgtgggaaagccttcagttgttccagttacattagaatacatgaaaggactcacactggagataaaccctatgaatgcaagcagtgtgggaaagctttcagttgttccaagtacattcgaatccatgaacgaactcacacaggagagaaaccctacgaatgtaaacagtgcggtaaagcctttaggtgcgccagttctgttcgaagtcacgagaggactcacaccggagagaaactttttgaatgtaaggaatgcgggaaggctttgacttgtcttgcaagtgttagaagacacatgataaagcacactggcaatggaccttataaatgtaaggtgtgtgggaaagcctttgatttccccagttcatttcgaatccatgaaaggacccacactggagagaaaccctatgattgtaagcaatgtgggaaagccttcagttgttccagttcgtttcgaaaacatgaaagaattcacactggagagaaaccctataaatgtacaaaatgtgggaaagccttcagtcgttccagttacttccgaatccatgaaagaactcacactggagagaaaccctatgaatgtaagcaatgtgggaaagccttcagtcgatccacttactttcgagtacatgaaaaaattcatactggagagaaaccctatgagaaccctaaccctaacgcttcagttgtcccagttctttcatgagcataaaaggagtcacatagagaaaccccatgaaagtaagaaatttgggaaagccttcagtcctttctgtttctttcaactacgtgaaaggattcacagtggagaaagaccctgtaagataattggctttaaattacgagagacttgtgataggacagtaaaacctagagttggagttggatctctggattgtgttatgtcagtgttggtaggttaggaactagatttcccagaatccattccatttgtgattccatgatacaattcaccagtaacctatcttacatgagattcggaagtaagttaagaaggcattagtcatggtttggaagcaccatacagggagacagctgtgtgaatacaggctgtatggacacttgcttccatcccattttcctgcttctttgggttgccaatcaagagtatcctcaaaacgacttgactttaattttctcggaggtgataggcttccacacaggtctccagaagccctgcattgaatatccatccacactttggttttccttcagacattattatgtctgtactaggcaactaattcagactgtcctggttgggaatattctgtgatgctctgactcccctagtctgtagacggaattggcatacggtctaatttgtgtagtaagcacctttgttcatactagtagtgactgtattcttgattcagcctgatagctaccatgctgctgtcaaaaccaaccagaggggagcttgttcttctgctgtagtgtgcagtgactggcctcacccaggactttgatgtgagaatgagcactttcctctatcaggaaatttcaagtgtttcctgttattcgtagctcaatgtaatgcctcagttcattttcagttgtttgattatatgtgactaatatgtattttttattcaaacaagacttctgtacatgtttcttcaaaacagtttattaactgtcttcagtcttggattacatcaagtttataattttggcaaattgttaagacactgtgaagtcagcgttaaccatgtgcatacaacttaaggaattttttcctcctcatgtaaattttacttttcatgcttatatagtttcaacttttatcttcatagtaatttctcatctactcataataccaaaagttaagtcatgctgttttgtgtgctctcttgctaaagaccgcagagaccatacctgttgtcaaagagggtgtaataaactgtaataataatcatgaccac

SEQ ID NO: 112444 - DNA, 1094 bp, Homo sapiens
gtctttttagtagagacggggtttctccatgttggtcagggtggtctctcttggctttttatctttatttttgtaccagtggaccttcctgctccctgagactgttttgattgacatcttttgtgtttctatattttccgaggcagtattttctttgtatgttaatcatagttatagtaaagtcagactcattaacttttcttcctagtaattttgacttggattattttctagcctgggggatggggttcatatgtgttgttgtaactttagattactaaacaaaacaaactgtttttttgtttgaaggtatcctttacatacctgtctgtaggtaagcaagtgttagtaaaaacaattttgtcaaacagtactcctgacagcttggtaaagtctaggtagagtttctgatttgtattatgtcctaagacttgaaagtgcatttgtctagttgccaaaagttctaaaaatgagatggtgggctttctcagcatctttttgcttcctagaattgagttgctcttgaagtctgtactcctgtgtcagaaagatggcagactgcaaatgggcagtacaggctttgccccatgctttcaaagtaggattctggattgcagtttcaaaaaaatatgatagattattgttatagaatcaaagtgtcctgaagggagaagaatagctatagttgctgggcaaagagtgtaagaaagaaactttagagcatttatcaatacttgagtgctttattatgttccaggctagaaatgtgatcattgcatggcctaagtgtagtcattcatatatatatgaatatctatatctatatctatacatatatatgtatcgccattatcgagtgttttctagccctggataaagttaatttttttgaagtttgattgccaagcaatccagtgaatctaaagtaatttttctcactttaaagaccagtgatgaggagtctggtccttcctgtactgatactgtagaactccagtcaaacttcagtgcactgctttcttacaggaagacaactcagaacacacagccataatctgctttggtgtcagtcacatcacagtggttatacattt

SEQ ID NO: 112445 - DNA, 417 bp, Homo sapiens
ccaatccctggtagtcagaaaatgagcctggaaatgggaatatgtgtataacgtggggcggggaaaggagagagagggaaagaggtgctacttgtgtatctgtaggagcaggtgtgtctatttctgtgtgtttgtgttaaggaacatgagaatgagcaggtgtgtgcactcttgcagctttctcagcatgcatgccgtagccagtgtttttgctctgtgcctcaaattcactttgccattagccacactactagccacccgcagcttttgaaagaactctctgctaggttctaatatctgggtctccttccagccaagtgacccctccttttttctcttttattgctagttcttcttactacccctcaaatctgggtgttctccagctcctcctgctttccactttctttattgaca

SEQ ID NO: 112446 - DNA, 476 bp, Homo sapiens
tctgcatctcctgcttgggaatcaagcaccttaaactgctatgcagggcaagtacatgtcttggatcttcagtgtgaacggaggctaagagtgtctcattttaatgctctgctgcacgtgagtgtaagaaagtaactgagaagtcacagatggcagagtgagtggagataagattttcattctgtagaagcaggaccctagaagagaaagaactctctccttcagaactcttttccccagatttatagtattggattcctgaagaaggaatcagaaaagaactacatgaggttacagcttacctgctggtattagaaaatgtagaatgcaattttgtggttggtcactaaaagattcactaagatctgagctgtgtcttactcagagtaagaactacgatgaaagccttgagctgtgagagggtgaagacaaagaccccgctggccactatgaggagaagaggaaaatctgagact

SEQ ID NO: 112447 - DNA, 265 bp, Homo sapiens
ccaggctaaagatttctgaactgcacgcaatgtctgaagaagcgcttgaaaggcactttatttctcccaggtccccaaccatgggtttaggtttttatgccagaaaggggaccttcatgaacaaagacccccaagacctagagagaagaggaagtctgaaagagggaggtttgaattcagccttcaggaatgaagagggcagacagagcaggaggctcaggcaggggagtcaggaaccacagaccagaaacatggacttggaaag

SEQ ID NO: 112448 - DNA, 267 bp, Homo sapiens
aacatgaacagagaagtaatttgagaaaattaattgttctttagtggatagtatcaactttagtgggaagaaaatggagtcaggaagtgtgcttagaaaattattgcaacacaacccacatagagtgagagaaatggcaggaaggcccgcaacaaaggacaccaggcaacggaggagcagagcaaagacgatgccaaggcctcgagccaggtgctcaaaaggggcatgagttacacaggcaccaggaaaatctggagaaggaattag

SEQ ID NO: 112449 - DNA, 252 bp, Homo sapiens
tcataaaactcacatttttattgtgtacccaaattcagcctataccaaaaatagttattgaacttacttcctgtgctggacattctaaatttcattcagcagaaatgttgaaatggatgtatttatttatttattcttcttgggtttttttttttttaacatggttcctacattttattgccaatatcatgttctggacttcagaagtcatgtgcttttcagtgttagatcatcttactaaagttattagtg

SEQ ID NO: 112450 - DNA, 688 bp, Homo sapiens
cagacagtttggcaaattgtattggtccataacctgtagtattagtagtgtctctctttccctctctctgtcgggatttttatgattgtgttgcagtcaaaatcgattagttctggtctgtttccatggaaacaagattgtgtcagaaggctgtaaatttttcatctttatggatggaaagttgctgtatgtcatacaacttgagatagcattaaaaaaatctgtaatgtattttcacgtctttgagaaggagagtgtgagttgctgtgaaggactgggtccattactgaggagggatgctgtattttcttggtatctacaagagactattatagtaagggtataaggtaaaagacaagattgaccgatgaattacctgttgaagaaaattagttatttttcccagtgaaattttcactgagagctaatgattgtctgttatttaccatatattctcaggcagcatatgcacccaacagcataagatttatcaaaggcatacatagagcactcagcacattataatgataaccactggacacattccaaggcagaattaaatactattttctataatttcaatagttttgaaataacaccttaatcagggggctgtgaagattgaataacaataaacaaaattctattgaatgattactatatctcagacactgtcatgccatatatg

SEQ ID NO: 112451 - DNA, 393 bp, Homo sapiens
gcccaggccggtcttgaactcctgggctcaagtgatcctcccacctcagcctcctgagtaccagggactacagatgcgtaccactgtgccctcactgtgcactttttatagacaagttttctaatataaaaggtggaagataattaatatttatcaagcaactgttttatgccagttattatagcaaaactaatgatctcacaacaaacctctagcataggagtttccatcaccattttagacatgaataactgaggatcaaaaatgttaagcttttggctaccaaagatcatacataacctaggaattagtaagcctagagctgcaattccaaagtccacattattttgaaacactgctagtcctgccttccagaaataattaacacttttt

SEQ ID NO: 112452 - DNA, 287 bp, Homo sapiens
caagggactctgaataacagaagtaatcttgaagaagagcaaatttggaggtctcatacttcctgatttcaaaacatattataaagtaatcaaaacagcatgatactggcataaagacaaatagatctacggaatagggtagggagtccagaaataaacccttgaccaaatatttagcatgcatgccaggtgcagatctcagctaattttttgtattttagtagagacagggttttactatgttggccaggatggtcttgaactcctgagctcaggcgatctgtccg

SEQ ID NO: 112453 - DNA, 329 bp, Homo sapiens
actcctacaaataatgtaaaatttatattttcatataaacattttgtatgtacatgtttaaaagtcaaatatatattctacaaggctctacctactctttagaggtaccactttatttatttacttatttattttgaggtggagttttgctctagtcgcccaggctggagtgcaatggcatgatctcggctcactgcaacctctgcctcctgggttcaagtgattcttctgcttcgacctccagagtagctgggattacaggcatgtgccaccatgctcagctaatttttgtatttttagtagagacagggtttcaccacattggccag

SEQ ID NO: 112454 - DNA, 477 bp, Homo sapiens
gaaaagcatggcactgactcagctcatgcttaacaagaaataatgcacagaccacagcaaaaaagccctttatgttgtgtgaaagtctatgccggagcagctgctgccacctcatgtactgtgatagagtgtgcatgtgtgtgtgtgtgcatgagtgtgagtacgcacacaaatgtgtgctgggagggggaggagctcacaccttccacagtcgccacctcagccttagctagcagcatggagaaatgccaaaagtcaagaggaagctgcaccaaagcaactgtgatcaccacatcagcaggtgctttctggttagtaaagctactgggactgaaaaacacacacgatctcgtccttcttttattttaatcagagcaaaatatttttataataattgtgttatatgaataaataattcataatgctgtaacccattatcacattcaatcctcccaacaaccctagaagatatgtaga

SEQ ID NO: 112455 - DNA, 467 bp, Homo sapiens
cacccgcctcagcctcccaaagtgctgggattacaggcgtgagccaccatgcccagcagacctgaattattattattattaaaatgttacatcaacatgtacaaatataaaactacatctaaactctaagtacaaacttcttatgcttaaaactcttacacagtgttaaccccaagacagatttgcaattaagtagttaaaataaaacaacaaagtcaataaaaatcaaataaacaatatacatttaatgtggtagactttgctgttttgctgaagctaagcaaggaaccagtttttaaatcagcaatccgttattttaatggactgagcaatttaatagtgcacctcaaaggtcaatgctaaaaactaaaaaaaaaattcctactgaaaaaactgtcatcgtttcacatttctggctacgttagtgcaaaagggaataaataaaggtgagatgtgtgtgacagtgt

SEQ ID NO: 112456 - DNA, 415 bp, Homo sapiens
actaaaccacagatccaggaagctaagaaaaggccaagcagaataactaccaaaaaattgacacctagatgtatatctaaactgtagaaaaccaaaaacataaaatcttgaaagaagccagaagaaaaaaacacatatagagaaacatgaataacattggatttcttgtcagaaatcatgcaagcaagagccagaatggaaatatttatgatgttaaaagaaaaacttcacaaacataggattttatccagcaaaattatccttcaaatgtgaaggagaaaagcaaagagaaaatcaaattgaaaaaaagaaatagtgaaggagaaatgaagactaaaactaaggaaatttaaggctgggcatagtggctcagacctataatcccaacatttggggaggccaaggcaggtgtatt

SEQ ID NO: 112457 - DNA, 378 bp, Homo sapiens
aaaattgtaggcaaagtttgtgtatgctgtggcctatcgacagcggggactctgccgctgatttctcctaagaagcctcctgggggtttgagcgaatcgtggtggtctccttccctctggagtgattagttttggctttggctcaacatggtgcagacccatgggatccaaagggaagttggccgggcatttctgggaaggatgtctcttcttctgatttctgagtgagggtaggaagccctcttcttcatcagacgccatggctcttacacgaatgatgcctagagcagacacagcccttccaggaccagaggccaaggctgacaatgggacaagagggcggaggaagaagtggggagcacctaagccttcctctga

SEQ ID NO: 112458 - DNA, 481 bp, Homo sapiens
cttcacgggaaagagaaccaaaagtattctgcaaatggcaggagattggaactgggctctctgtataaaagtagggaactgggaccgtgttttaggcagtgcaactatacctgaaatactatacccgaaataattccacctgacactgttggtattttcctgtgacccaatgaggcagttatgcaaaaataggaatgtaaccctataatatatgtagatgtggcacctgaattagagctctacttatgagggaccaaagttccagtcttctttatgttagacctactctggagctgtgtaactccagaggtgtgagtaaccatgcaaccacacagcaggcaggagttcgcagaggataaaacttccacataagatgaacctgcaaacaaatatcttaggaaacatgttgccataagagatatcggacatattaagtagcctcatttacatctgaggaaatgagagtaagaaccacaattcc

SEQ ID NO: 112459 - DNA, 608 bp, Homo sapiens
acctccttgacaatgtatagtatcagacaataaaagtatgattggaagatgcaagaagagcaagggctcctcagagtgtttcacagaactgtcaactgtcctcaccactatccccagcccttacaggataaactgaggccaagatggaggaagcaatgcctccctgaagtcttagatgtcacagaagggacaccgaggcttggggaaagcaggtgccaggtggacgtggggctctgccagctaggaggagttctgcttgtgtggcccaacagccagcttccagggagcaagcagagagaaaaactgtgctggtgggggctggcacctggggaaccctgctccaagaggagccagatagcaaaggccaaaccgcctgcctcctgcggtgggaagcaagcaatcccagagccttgaaatatgcttgctgtttctgcctcaaatggcgttttccttgctgggaagaggcttcagtatgaaaatgctgatatgttataaagaacaatgtaaatttcactagaatcactgcctaaaaataagaaggtctggctgggtgcagtggctcacgcctgtaatcccagcactttgggaggccaaggaggacagatcac

SEQ ID NO: 112460 - DNA, 358 bp, Homo sapiens
ctcctctgcatggaaccaggtggggagagagcgaacctcaaagtcatgcaaagggcttcttagcctggcttgaccactttggaacaggctgtctgtgggcaaaggattcaacctcactgaacctcaattttctcaaatgcaaaaagggttttaagtgctggctgttgttcaatggaagaggaaatcatttgaacaagaatcgcatcaagttgtgttgtgataaattttctttattaggatgaataacatgcacagatgagcttcaaaagtgaatgagcaaacttactggttacactctgcatccatttactctgtttagtatggagtaatgttaggcaataaatgatgctggcaaatg

SEQ ID NO: 112461 - DNA, 373 bp, Homo sapiens
gaataagtcaagagagaacaagcaacaataaaaacatcgtttatatagcaccgagagagagagaaagtagagatgaatgtattgccattagtgtcgcaggccaacttcagaaaagcttttggtgactggaaaatgatacggaggttaggaaatgaacacagaaggaacataactactggaattcaaaccaacatcaaaggctctaaagaagacagttgagcctgtcttgctggttcttagtctctccctagaaaacaaaacagttacataactggagaaggttcttccaactaacatttcctctctgtcccacttatgtttttctcccccactacttcaccctgtcacccacctcaatgtgaacgatcataca

SEQ ID NO: 112462 - DNA, 303 bp, Homo sapiens
gggattacaggcgtgagccaccgcacctggcaattattttattttttttatagagatgggatcttgcaatgttttctaggctagtctcgaactagcttcaagccatcctcttgccctggcctcccaaaacgctgggatttcaggtgtgtatcttctgaaagtacagtttgttacttctgatgaaatatttttttcttccagagcttctcagtttctgaagtaaattagaattaatctctgattctttgtctctttcagggcttttcataatttgacttactctgcacacccaactataccatc

SEQ ID NO: 112463 - DNA, 143 bp, Homo sapiens
gttgtttttggctttcttacctggggtgcaagtggagcaccctgtgggcatcatgagggtgtcaggaaagccttctggtaactgaaacgcagtccattctgtgtcccccagattctgagttttcagcacctgacagtggcggg

SEQ ID NO: 112464 - DNA, 655 bp, Homo sapiens
caaataagaaaatggacaaggcatcacatattggcctcttgcctgttttaaaagggtgaaaatggaagtagataagctgcaaagtgtcctgtgtgtgatgaatgttgacacatgaaacaaatgtctaaagtgcttcacaaatggaactgttgttccaaagcatcgttcaaagttgttccactattaatttaggatgaatagtctaaatggtggctaagatttttaatttttaattgaattaatagtttcactttattcaaaaggggctattatcacgtattctctgttaatcatgtgtacttctaatggctttctgtgatagtaaataagactttcctgtgggctgccattgcatttttgctaaataatttagcatctagttaagaatcaggaataaaagagtactaagactgtgtcacaagcaaatcacagttgttgagggcatatttcaccatctcttaagtgattccttctcattgatcaatcccccttcttcagggtgttatatggaactcaatattggatcatttttataattgattatcaataccacgtgttactgttacccacatctaatggctccttcctcttggtagtagaattattagtaggtactcttcagacacagtgtaaaagctcagaaacaactctctga

SEQ ID NO: 112465 - DNA, 671 bp, Homo sapiens
ctcttaacctttatcataatcatgcaaatcatcaaataattagtaactgcctacagtttgtgtggctcatcataataagacctttcccttaagttatttatcatcttagggtaggcagcataagtagaagatttcagtactattaacagcaaacaacttctaaaactccattgacaatgatacataatttagaaaggaaataatgttaaaggtcttatttatcatttctaatcttgttctttcacaatatcaggactttttaaaaaataattataatgtatttggttctgagtagctcatagtgtgtttcacctgcataatttcatttgatcttcacagttctgtgtgcatggaatagggtacactaccctacattctacatatgaggaaacaaactcagtgtttggtggatgctcatgtttgaagtgacaaaaccttggttttctgactcctaattcaggatttgttctacaacataggtcctgttcttcttgttttccatttagtaatgttctagagtcagaggtagtcttttgagatcatagtcatgagccacactggctatttttttgttatttattttactactgatttttgagtaggtaacatatatatatatatatatatatatacacatatatatggtgcacaattcagaggcacaaaagaat

SEQ ID NO: 112466 - DNA, 753 bp, Homo sapiens
atcctcagagttgtttctgagcatctcaggcttaaggcgaaagtgcccattatacacataatgctaattgtataacaagtaaaaggaagctaggcagcaagctgtggccagaatctcctactttatacactagaatgcacttagttcttaatcctaaaaactacattcttgaaataagcttattagcatgtggcctaaactgatcttagagcagttatattctgtttaatgtttacctttgcctataagtaaaatattttaatgttagatttgtagtttacccaacatccatgtatcaaaaacattttttaaaaggttataagcacatgtgacttactctataggaaataacatcattgttggaatcttacccagattctaaatggcctagaattatatgtaaaataggattgcagttctagtaagtttcactatttaatacatcattatcagcagttttgtagtatactcaggaaattgagggaagggctattgaaaacattaacacttattcaagtaaaataattcaacaaaattgccaggacttgtattaggcatggagacacaaaaataagtagagacatggtgttttgcccttaagaaattagtaagaataagaagtgacaacatttttgaagtaggagacagaagaactataaaatttaggaataaagactgtaacagcttagtgatctatgcttttagtgcagggttgtttaaaagtagatgaaggtgcttctcctttctactata

SEQ ID NO: 112467 - DNA, 382 bp, Homo sapiens
gcatgtcaatggtggagttgggataagaattaatgttgactacgttcttgtctaattattgccctagcccagacaaaacagaaaatctaattttctggaaattactagttatgtctatgtattttgcacaaatttttttttctacctaattattgctgtctgggaagcttgaaaggattgctaagcaaacaccatggaactacctctaaccaatagggcctgtgctaaggaggtgcacatgagaattattttggctccattccactaaccttatgagtcaaaattgctggtcatcctccttctacaaaagcaccatggaagcactgtacctagtgcttctcaccatctctgtcccctcctgctccccgaaccttatgggcat

SEQ ID NO: 112468 - DNA, 287 bp, Homo sapiens
tatgaggcccaatcttagtgttatatagtctaaattttcaaaaagccatgtttcacttttcacatacatttgttaaagacaacagaatagtaccttccttataaaataccctatagtgactcttatatataattacataatttaaggttagaaaaaaaaactagctaaaattcatctggtctccaaatactacaataatagggagataaggagcttttgagattagacttacaaatgtcaggagtaaaggttacagatacatcctcatagatgctagaacacacttg

SEQ ID NO: 112469 - DNA, 514 bp, Homo sapiens
atacttgaagaggttgttgactttcaggaataaggggaagctgaggttacacacacccaaaggatgagagggaggtggggaagatgacccccatatattgttcagaaataaaaaatgaaagcatgtggttagtagggacagctctttgcattcaaagacacaagagcttaattgttgtcattgtccttatcattaaaatcttgctttcctcttccttcatcttttcccgtcttctttgtcccttatttattgagcatttatcaagtcttcctctaggtaaggttgggcatagaaagctcagttattgtcaagttaatattaaggtgcacttgagtaagggagtgaataattatacatgtaactattagtggcagaactctgaatatcttggtcacaagttacagaggatcaaccaacacctttaaggaggtggctgtttggctggcctctgaaagaggtaccaattggatgttattttgagaggtatctgtatgtgtataggttgtagcatagg

SEQ ID NO: 112470 - DNA, 586 bp, Homo sapiens
gacagcttttacataaacaattggatacaccaggaaccccagtcatcccttgtgctgtggatgcatcctggttccctgaaagaggcagcatcatggtacccatgttccagagcagtgtgtcgcaaactctagtgtgcatccaagtcttgttaaaaatgcaatttctgtataggattcagtaggtctaggagggggcctgggattctgcatttctaaactcccacatgatgccaatgctgctggtctgtgaaccacttgttgaatagcaaagttctagaagaaggtcttattaggcttttcatatgggaaatctgggcttgcctagtatggatatatatttttttattcatattccacccacctaactttgaagaagaaagatgcctatttcttttccccacaattcctttcttccactccctgccctatcccttcctccccttcttgaacagaggctgcttagcttagcagtggcaggagtccctctgaggatttgatttttaaaaaccattgaagaggtgtaaaggaccctgcttgctgaaaggaaaaggaagagtgactgggcctcccccaggtcatccctgtc

SEQ ID NO: 112471 - DNA, 289 bp, Homo sapiens
ctgaatcttatctttacttcattctcctcttggagtgttctaggctgtggccctctctgctacctccatccttcaacatgcttccatccatcttgtgagctccagaaatagattgaaatttcttatctattgatgattttccttcctatcctgtatgctgttgtaggtttatccccttttgttttctttgctgtcattttaatggcatgctgagacaaaagggcataaagcagatgcttagattcattatctacctggaagctacccaactgttttaaaatagaaaacc

SEQ ID NO: 112472 - DNA, 296 bp, Homo sapiens
aggctggtctcgaactcctgacctcaggtgatccacctgcctcggccttccaaagttctgggattacaggcttcagccaccgtgcccagccgatagctcatttctttctagtgctgaataatattttatttatggatatatcacaatttgttcatccatttacctgttgcgggacatcttggtttgggtagctgaagtttagacaattatgaataaaggtgctgtaaacattcatgtgcaggtttttatgtggtcatattttcagtccatttgagtaaataccaggtagtacaatt

SEQ ID NO: 112473 - DNA, 693 bp, Homo sapiens
ggggaagcttaattaaaaaaattttaaaaatagaaatatctagccagactgatcgaaaattaggaggagatatacagattaccaatattaggactgagagaggtgatatcaatgtgaattctacagatattaaaaggataataagagacttatggtcaaccttatgcaggtaaatttgacaacttatataaaatggataaatttaatgaacagcacaaaccacctaatctcactcaggaagaaatagaaacctgagcagtcctgtatctgttatagaaattgaatttgtagttgaaaaccttcccacaaaggaaactgcagacacagatggctttgctatggaattctaccagacatttagggaagacatagtattaattatattctaactcttctaggaaattaaagaggagagaatacttcccttctgattctatagtataggcaccataaccaggcaagcatattacaagtaaaagtacagaccaatatttctcataaacatggctctaaaaatacctgacaaaattttagcgaatgatccagcaattcataagaagaaaaacacatcataaccaagtaggtttatggaatgcaagcttaacattcaaaactcaggaaaacagtttattatattaacaggctaaaaaagaaaaccatatgatcatttgattgctgtaaatgaaaaaaaaa

SEQ ID NO: 112474 - DNA, 456 bp, Homo sapiens
cttgcattgttaaaagataaaatttcaatactgtaataatatttgattctatttgatgttacatgtttggtgtgtgtagtatacagaattactcttatcatgggcttggcttaagccatagtgtacatataaggctgtttcattacattattgaaagtaggtctttaaagtagtgacattatggatatttcatgaaataaaattatttttcattgaagatactaagaaaacttaaaactctataatggtagcccctttttaaaaatcatctggctaggcatggtggttcacacctgtaatcccagcactttgggcggccaaggtggggaggatcccttgagcccaggagttcaagaccagccttggcaatgtaaggagacccccatcactacaaaaaataaaaataaaattagccagatgtgttggctcatgctaatggtcacagctactcagaag

SEQ ID NO: 112475 - DNA, 272 bp, Homo sapiens
ccactgtattacagagtatgcgttagagactcctttatgcatttgttgattgtttttattgagtggctgctccgtgcctggcactgtgctagagactctcaagtactggctcatggtggaatggatgagaaagaaaactcaaaagacccatgtggccgggtgctatggctcacgcctgtaatcccagcactttgggaggccgaggcaggtggatcacctgaggtcaggagtttgagaccaatctcagcaacatggagaaaccctgtctctac

SEQ ID NO: 112476 - DNA, 250 bp, Homo sapiens
ctgcctggtgagcaagagagattccaaagactttactttgaaaagcatctcccagcttctacttttttttaaggaaaagtagattttctttgtctttgtttttgttttaagcaagaacagaatctaatgacttttttcatgccatcgctttgaaatagcgtcgtcttcctttctttctctccctcttcctggcaaagtatatactggatttttattgccttcttgggtttttttccctacgtgtatcggc

SEQ ID NO: 112477 - DNA, 121 bp, Homo sapiens
agggaggcctcgtccttgctgaggtatttcataacctcaggatagagaaatccccccaactttaatgcaaagccaagcaagctgaaaaatggccttgaataggctgagatgaaaaaacaaa

SEQ ID NO: 112478 - DNA, 163 bp, Homo sapiens
gctgactggtagtggagttcagtctagctccagtgctgtccattccatcatgctgtatccgagagcactagtcagggatataaagagattatccctacccttgaataatttgaagcccaattacactgacaatcacaataatgacttagatctgaaaagcaga

SEQ ID NO: 112479 - DNA, 567 bp, Homo sapiens
taatagctcaccatgttggggtaaaatgttggtatgttgcacacaggtgcaagaactttgttttttagagagaccaacttcttaaatgtgtaacagtcacattgtgaagggactgcatttgtctggatttcacctgcagctgggcccacagcctgcctgaggtcagaaaatttttcatgacccattttttaccctgaattgacaagtttagaaaacagggtaatggactacttcatcctcctggaccttgaaaagctggctgaccaatattagactactactgctcaattagtgtgctagggaaacctttttgctgcacatgcagatttttctgtgacattttgactaaaatttgagggcttctggggactatgcctgtttcctttgtacaccatcttcatccttctcatttgaagcagagttgaagtggctaatgcagggaatgcatttatggaagcttgcacgctatctgcctttgtgcagcaaatgcaggtggctcctagcatttatctatgttatagatatgtgaggtcagggaagggtactaaataacactctggaaaaaaa

SEQ ID NO: 112480 - DNA, 824 bp, Homo sapiens
gcggccgccctcatgctagcccccgccccctcgcaggctcccggccttcgccaacctgcaggaggcgctgctggagaacatgatccagaacatcctggtggaggcgagccgcggggaggtggtactcacctcgcggccacgcgtcatcgccctgccgccgttctgcgtgcccaggagtctgaccccggacacgctgctgccgacgcagcaagcagaggtactccacccggtggtgccacttcctaccgaccttccgtaaatgcccgcgcccagcctctccgacatgccgctaggggtcacgcctggccccctctccaccgccagtaaaagcatctagtcttttttctgtatctaccttgactttatttccccgacgagggggaacgcgcgcgcgagctctgagagggaaggatggcagggagcagcccgggcggactgcagaggcgcggcgggaacttagggcccgggaggatgcacctctccgcccacactgcagctggactgagacctggccgctagctgccggccgctggaccgggtctggccagtggagggcgctccggacggggcctggctggcctttgccccagcgcaccttggtgcacagtaactgagtgccaggcctggccagcgaagcaggtgtccactgggcagggcggccacccctcacctttccgcgccgcgcctgctcggaggcttagcacccccagggccagccccttagtgtagtggatgaggggagtcgaatgggaatctccgtagagctcgcggcacactgtaccgcacggacaggcgagcgaggaggcgcgcgggcactgcggccg

SEQ ID NO: 112481 - DNA, 421 bp, Homo sapiens
tataaataattttggtctatatttttaaatagacaacaggcaatataacctaaataagaaaaaattgcctatataatatgtttttccaaatgttacaagtacctttgaacagcaatgcaaagaataggagaatatgctgtttcaaaaaggtcttcaaacaaaagattttccagtagttgtggtcagaaatgtgatttaatttcttgtttgtaaaatagcaacaaaaaaaatcttatagaaaaatctcatatttttctgtatagcctgttcacaggaagaattctgttcagctgaactccagagaaatagtttctctctttggaaagtgcaaattctaaagcattacagaatagaaatgtaaaaggaaatagagaacagagaaatggttgtggtaggtaaagatgttacctgggaaaaaaaa

SEQ ID NO: 112482 - DNA, 425 bp, Homo sapiens
atccatgctaaaggtaaacaaactgcaacttatatctgcaatttattttggtatagacaagaggtatgccagtagcacactggtggcttcagaagaaattctcaacacctagctcgccagagagtctatgtatgggattgaacaatctgtaaactaaaggtatgaaaaaatttgtaaaattgggaaggtgagggaaaggtgtgacatttatttttgggtgcagaaacatctaatgcccatgtataaactagggatctggggtgaaaggtgcttctaggggatgagatgttggaaggagcaatgagatgttggaaggagcactgagactgttggaaggacgcgactgagatgttcggaaggaggcatcgagatcgttggacacggagctatgagactgctggacggagccactcgagatgcatgga

SEQ ID NO: 112483 - DNA, 915 bp, Homo sapiens
atccatgctaaaggtaaacaaactgcaacttatatctgcaatttattttggtatagacaagaggtatgccagtagcacactggtggcttcagaagaaattctcaacacctagctcgccagagagtctatgtatgggattgaacaatctgtaaactaaaggatcctaatcatgaaaataagtatgataaattataagtcactattggcactgttgtttatattagcctcctggatcatttttacagttttccagaactccacaaaggtttggtctgctctaaacttatccatctccctccattactggaacaactccacaaagtccttattccctaaaacaccactgatatcattaaagccactaacagagactgaactcagaataaaggaaatcatagagaaactagatcagcagatcccacccagacctttcacccacgtgaacaccaccaccagcgccacacatagcacagccaccatcctcaaccctcgagatacgtactgcaggggagaccagctgcacatcctgctggaggtgagggaccacttgggacgcaggaagcaatatggcggggatttcctgagggccaggatgtcttccccagcgctgatggcaggtgcttcaggaaaggtgactgacttcaacaacggcacctacctggtcagcttcactctgttctgggagggccaggtctctctggctctgctgctcatccaccccagtgaaggggggtgcagctctctggagtgcaaggaaccaaggctatgacagggggatcttcactggccaggttggtcaatggcacttcccaggtccactctgaatggggggcggaccctaaacacaaggctggattgggcagtacctggacaacagagaccaagaaggcttctactgtgtgaggcctcaacaca

SEQ ID NO: 112484 - DNA, 301 bp, Homo sapiens
atccacaatccccagtgggcatgtctggagaaacacatggaatcctgtctcctgtagtttggctacagtcaaaatgaaggaatgcctgagaggaaaactcatatacctaatgggagattccacgatccgccagtggatggaatacttcaaagccagtatcaacagtatgcctcagtctaagctataattcttacccctttcagaaacttcttttccatttcaaaggggagaagggaatatgggaaattcctctttttttcatattcttcaatcacaacacaccaaaatttttcacaaggca

SEQ ID NO: 112485 - DNA, 1690 bp, Homo sapiens
atccatgctaaaggtaaacaaactgcaacttatatctgcaatttattttggtatagacaagaggtatgccagtagcacactggtggcttcagaagaaattctcaacacctagctcgccagagagtctatgtatgggattgaacaatctgtaaactaaaggatcctaatcatgaaaataagtatgataaattataagtcactattggcactgttgtttatattagcctcctggatcatttttacagttttccagaactccacaaaggtttggtctgctctaaacttatccatctccctccattactggaacaactccacaaagtccttattccctaaaacaccactgatatcattaaagccactaacagagactgaactcagaataaaggaaatcatagagaaactagatcagcagatcccacccagacctttcacccacgtgaacaccaccaccagcgccacacatagcacagccaccatcctcaaccctcgagatacgtactgcaggggagaccagctgcacatcctgctggaggtcaaatgtgggtgtagagattatggaaaaattcaatacaattagtgcctccaaatgcaacaaagaaacagttgcaatgaaagagaaatgcaagtttggaatgacatccacaatccccagtgggcatgtctggagaaacacatggaatcctgtctcctgtagtttggctacagtcaaaatgaaggaatgcctgagaggaaaactcatatacctaatgggagattccacgatccgccagtggatggaatacttcaaagccagtatcaacacactgaagtcagtggatctgcatgaatctggaaaattgcaacaccagcttgctgtggatttggataggaacatcaacatccagtggcaaaaatattgttatcccttgataggatcaatgacctattcagtcaaagagatggagtacctcacccgggccattgacagaactggaggagaaaaaaaatactgtcattgttatttccctgggccagcatttcagaccctttcccattgatgtttttatccgaagggccctcaatgtccacaaagccattcagcatcttcttctgagaagcccagacactatggttatcatcaaaacagaaaacatcagggagatgtacaatgatgcagaaagatttagtgactttcatggttacattcaatatctcatcataaaggacattttccaggatctcagtgtgagtatcattgatgcctgggatataacaattgcatatggcacaaataatgtacacccacctcaacatgtagtcggaaatcagattaatatattattaaactatatttgttaaataacacaaaagtctgaaattcattcacttaagtaaaaaaatttattgactgtctactagcaggccagatgctgtgtttggctctgaattcccaactagcaagagcagagaatctacattatggctgatccataagccaccaattcagctaaatgagatgtttctaatctgggcttccacttaaaaataaaactaaaaatactcatgaaaagagcctacccttcttgatcagagccatacccctcttcaccaatgggaagtcaagacacctatgggtaaaagttctctctgatgcatgaaaactcagagtgataaagtaattttaaaataaaaatttggagaaagcagt

SEQ ID NO: 112486 - DNA, 404 bp, Homo sapiens
gggcctgtcggagggctgggggcaagaggagggagagcagtaggacaaatatctaatccatgtggggcttaaaacctagatgatgggttgataggtgcagcaaaccaccatggcacatgtatacctatgtaagaaacctgcatgttctgcaaatgtatcccagaacttaaaagaaaatttaaaaaaagccagggaatcaatagatttgtgacagtggaggtagagagagacaaataagtaaaatgtcaggtgataataaatgctgtgaagtaagcagtgggtaagaggctaaaaaatgacaaggtgcactgctgttttaggtaaggaggtggtcaagatgatattcgagcagagacttaaataaaaaataaaacaaacacactaaccgccctctccagaagaga

SEQ ID NO: 112487 - DNA, 884 bp, Homo sapiens
tgcggtggctcatgcctgtaatcccagcactttggaaggccgaggcaggcggatcatgtgagggtcaggagttcaaaaccagcctggctaacatggtgaaaccctgtctctactaaaaatacaaaaattagccaggtgtggtggcaggcacctgtaatcccagctactcgggaggctgaggcatgagaattgcttgaacccaggaggcagaggttgcagtgagccaagacctcgccactgcactccagcctgtgctatagagcgagactcagtctcaaataaataataataattaaaaaacaaaaatcaaacaaacaaaaaaacaaaaaccttacctacaaagaagcaaggataagaattacctgggagtactttgcagaagccgtgcaaacaggaagagaataaaatgaatctaatttttaaagtgttaaaagaaaaaacccaccaacctagaattctggattcagcaagattaaccttcaaaagagaaagaaaaatattttcttagacaaacaagaattgatggaatttattgctagcatatatgccttgcaagaaatgtttaaaaaagttcttcagaaaggagaaaaggtgataaagtcagaaactgccatctacataaagaaaaaaagagtattaaagaaggaataagtggatataagataaaatattttcttattaatttgacagatgacactttgtgttcaacatcataattgcaatagtgtttgtagtaattttagtttatgaataactgaagttaatggcagaaatgttataaaggatgagagagggcttgggaattctgttataagcaatttatactattcaagaagtggcataggtttacttgaaagtaaacttaagttagttataaatattta

SEQ ID NO: 112488 - DNA, 827 bp, Homo sapiens
tattaatctgcaacacaatcaatttagcaggctcttatatttaaaaataacaagagaaattataattcctttctttttataacaaccattcaatgaaacctgtagtttattaaacaatatcacctcttctgtcttttttctttttcggttaaaattttaccattcattaagtgagctgaatgaatgtttacgtgaacttcatatgtagtaaatgcataacataagcacacatataagttctggaaatagaatatttgctaaaggaaatagattttgttgttacattggtaaaataattttgtgcacagcattccctatatttattctttataaggcagaacaaaaattaaaagacatgctgattatagaactgcaatgttgaaagttgcaatcttaaagcttactgtgtactatctatttgtgtgcaaactattagtatgactgagccactcatatctggttaaaatatttttggtttcttaatgcagtggaatgaatttggtaactcagcattctttattcatttacttaataattaccaagtacttattatgtggtagcactatcccaagaggttgtagtaaaatagtaaataaagcaaacaaattcaacctcaataaataagtctacctgggggatagacggaacaatgtgaaaactgataaattacaaatcctcaatcaacagatttctattttctctcagacaattttaaaactgaaaattattatgaaatattatagctgtacttatttcacagagtctcatttgtaaaatgggtgtaattctacctgccttgcttacagagtatgaggaccaaaggagaa

SEQ ID NO: 112489 - DNA, 203 bp, Homo sapiens
ctgggaggactccagcttagaccagagacggtggtggcctggcctgaggggaggcccagcccagtcacaggccggctctcttctgggctttctgcctcctgtcatcgtgtccgggagttgattagtctggacgtgcagagtggagccctgctggtctggggccggaggagtctgcgagagttgcttcaaagagtgctgtcctg

SEQ ID NO: 112490 - DNA, 321 bp, Homo sapiens
gtttctttctgattcaatcttggaaagttgtacatttccaggcatttgtccatttttctaggttttccaggttgtgttcatagaggtgtttgtagtagtcctgagggtttttggtatttctgtggcatcagtagtaaagtcccctttgccatttctgattgtgttaatttggatcagcctgtgatctatcaatcttatttattctttctaagaatcagctcctgggttcattgattttttttgtatagttcagttctgattttggttattttttgtcttctgctagcttcggggttggtttgctcttgtttttctagttcc

SEQ ID NO: 112491 - DNA, 592 bp, Homo sapiens
atcactcagaatgcttttttgcctccgtcttttggttatacttcctgaagtatactaactatagtaaggagagaggtgtaatgcctctcctttacaaacgaggagaagagtgtttgagcagagggaatgtggaaaaggagaatggtaatgaaatatttgccacaggaaccctttcaggtagatcagtttagtaaagaatacatttatctagaagatgaagagctggaaattgagtcacttaaaatgatctatacctgcatatctctttaaaggagtttatgtaccctagagcccacaaattccttagtttgaggaattatggcatttgtttttatctttgtagatattggcttactttctttggattttcattcatgcaataaatacttattcattgtctatttactagaatactgtgttttatatctgatttccagttgcttagtaaatacatgaattgaattgaatatttgttgaatgtgcctattaaatagatttccaagctagttccttccataatttttgtagttaaatggactttatatgtcttgccatgagacctatttgaaatattattttgataagaaaatgc

SEQ ID NO: 112492 - DNA, 483 bp, Homo sapiens
ttgaaagtgttcctcatggtgcgccggcttcatgatacgttgaaggcagctttcactctgcaaatcttcattgcggctgggagttccattctctcttgttgctctccacttcccactggaccaagcccctctctattacatgttactagatggctgctgcctctcagggtattttttgaggctgtttgtttagcctgggtaggaggattcctttggacaggctggcagcccactccaactttggcgatttccagaaacagcttcaactaaacagaagaaccagttcatgctcaaattatcctttgcatgaggctatatccactttggaagaaagatgaatttagagtatttcagtgggttttctaatagcaaatagctctaacgatacacacaaaagaagcctgtggctgagtcgaagtggggcaggcctcctgctcttgagtttggagtccacccctctcagtggcagaggaggggctccca

SEQ ID NO: 112493 - DNA, 296 bp, Homo sapiens
agacgggatctagaggatcccagagactggagaaggagtaaaatatctacaaattacttatgttatttataaagttgtgcatctacggaaatgtttactgcctgaatgctgctatatatatcactgaagctgaatctcatgtgactctccagggataggctaaaagagagaactgggagaaagaagtggcaagaaaaaagcaaacccagggattcactccatgacacaattatgtacaattacaatcatgttgacataaatgttatgttctctctccttctccctttctacttgaa

SEQ ID NO: 112494 - DNA, 701 bp, Homo sapiens
tttctgtagtgtggtttatacacaaggagaatcacgaacccagacactagtcaatctctctattccctgacttgtactgagattggggaatttgggaggtcagacttacctcaaacgtagaagaaggcagatagagttcttaacctttttcaacttagccacctcaattatttgttcacattttaaggaagtaggaaagagtagtttgaagtcacaaaatttgttctcaggtgttcttaaagctccctgttctcactgcgacagaagactcaggcctactcattttgtgctgtcccacaaaagtgagaggagtacttctctttttttaaatcatcagtaaatttcaattttaaggggcctatgcaaaatgcctcctttctgatgtgattttcttgggttgctggccctagttgaatttatgggccctgaagcctctagtggaaatcttgtcttccctatagaacgagaacagctatgtaatttgcttcaccttctgttaggacttgcaccctctttgccatacagaatgctataaaaaggacagtctgccagtgaccgaagctttctcatttttttttcttccagaacaatagcacacatcttggttaaagctatagtctccttattattcagaaatattctttttcctgctgcaccattaggcaaacatacattatgcttagaatgatacttggaaactc

SEQ ID NO: 112495 - DNA, 368 bp, Homo sapiens
cagttttggcatcgaaagaccaagcattctcttttggatgtgtccagattgagatgtctgtgattcatccaattagagaagtctggcagacaattagataacatgagtctggaagtctggggagaggtctgagctgtaggtataaatttaggaatcacgagcatgtcatagctattttaagccatgggatgggataatgtcaattagggcagaaggtatggatagagaataactgagggcccaggaatgaggtgaaggccacaccgacatttaccaatggggtaggggaaaggaggaggtggctttttacagatgatcaagtatgagctaccagggaagtgagcagaaaaccaacacatgtaagctga

SEQ ID NO: 112496 - DNA, 1128 bp, Homo sapiens
gcggccgcacctgcaccgcctggggcgcctgccactctactgcctcctggctgcgttatgccagggactccccgctgggtgctcgacagacctcaaagcctgtgggatggccccctgcctcctgtgagggcgcaggaattggggcctggaagatgtcaagcgacttgccgaaggtcatgcagaccacacccgatggctgcttagtaaattggaaactggctgaacccccagattcaagtgtttcaagttggcttcaccatgcagtatcctcagtccagtcctctaccgaacaatcgctgggatcacccttaagtgggttcaggtcccagctcagaagtccagctgccaggtgggagcaaggccctgtggatttgtgaaggatccctgaacacctgctgccctgaggaactctcactgggatgggcagtaccccccaccatacatcctggggcggagcctcagtggttaggtgcctgggcactggacaggcagtgcctgagttcaaatcccactgatgggcggtgtgatcctgggcaggtgttatggaccccactccccttcatatgttgaagccctcagccccagagtatctgtatttgcagatggggctgtgaggaggtgatcaagattaattgaggtcataagggttaggtgcccttataaggagaggaagacacaccagggccctctccaccatgaggacacatccagaaggcagccatccacaaggcggagtgccaccaccaggaaccaataggctggcattctgatcttggacttcctaggctctaaaaccgtgagaaataaatggctgttgtttaagcacccccatctacggtattttgtcatggcagcctgagatgactaatacagcaggttatctaacttctctgtgttctcatttcttcatctagaaaatgtggctaataatagattctatcacagacatagctgtattccgtggacacagacgagtgtggaggggccagtctctgcacatcccactaaagaatgctgatcaggaagatgagtgctagtgacatcatcaaggggtggcttcaaattctctccattggctgggatttattttttttaagtcagtcatttggaaactctgacgctttattg

SEQ ID NO: 112497 - DNA, 315 bp, Homo sapiens
gatttatttatttatttttccctaggaacaaagttcaacaaaagtaggtaatttaaggaatttatgaggaacaatttttaaaagtgcataattttttagttctgtacagctgtagtttgaggcagtaccttcatgaatttctttaggtgacgtacacctgtattttctcttcttattttcaaatggttgcttctgctagaaatccacttggtaaccatgtatgagtgaaaatgtgttcctaaactgaggcattttgactgtgggaagagctataaataatgatggaaaattcaggataaaaattcaggcaaaaac

SEQ ID NO: 112498 - DNA, 140 bp, Homo sapiens
acactgaaaggagcaattctaaagatatccagacaaggcatggaaatttcttccatgtgcaacgggaaaagtcagtactcaaacactaactctgctatttcagtatcatatttctgtccactgacactttctctttctcc

SEQ ID NO: 112499 - DNA, 473 bp, Homo sapiens
tgaaagtgctgggaatacaggtgtgagccactgcgcctggcctccacttcccacatttcttaagtccgtggcccagaccttcctgcttgaccgccccggccaccgcccggattcctccttggcaaagatgcctcatcacagtttggtgaaccctcactcctcaccctgccacccccactggggacactaagttccccgccttgtcccacccatccctacggccccctccacccagggaggagacttttcagagtgtgtttggggagggagtcgtctgtatgctgggcagtcctggcctacagcggtgctggccacggaaacacccaggactcaggaatgaagcacaagtgtttccagtccccacacgctaaaaaggcgacaagaaccggtgaaagtaattttaatattctatttaatccagtgtagctaacatattacttcaacgctgattaacataaaattcttcgcgagat

SEQ ID NO: 112500 - DNA, 640 bp, Homo sapiens
tgaaagtgctgggaatacaggtgtgagccactgcgcctggcctccacttcccacatttcttaagtccgtggcccagaccttcctgcttgaccgccccggccaccgcccggattcctccttggcaaagatgcctcatcacagtttggtgaaccctcactcctcaccctgccacccccactggggacactaagttccccgccttgtcccacccatccctacggccccctccacccagggaggagacttttcagagtgtgtttggggagggagtcgtctgtatgctgggcagtcctggcctacagcggtgctggccacggaaacacccaggactcaggaatgaagcacaagtgtttccagtccccacacgctaaaaaggcgacaagaaccggtgaaagtaattttaatattctatttaatccagtgtagctaacatattacttcaacgctgattaacataaaattcttcgcgagatagtgaagtttctttttcttctcacactgaaatgagtggtgtatttttgatgtgccgaggtctctcatcagagccctgtttcagatgctcagtagcgcccttggccagtgccccccaatatgggacagcgcaggtccagtggcctccccagtggggaacaaggcggac

SEQ ID NO: 112501 - DNA, 733 bp, Homo sapiens
atgaggattaaaataaagcaataaagcctttaacctgccacatagtgagtctttgataagtattatagctcctattatggttataataattactatttatatttttcttaatataataacgaatatataaatagaaataaaatataaaataaataactttatgataattaagctgattataaaaacttgaattgtactttgcaattttatgaagccctttctcgtgtcattttcttcatgcattcaataaatctttgttgaataccatctgctttttagtaacagtgttaagtgagtctgctatgaagtgaataacacattgctccttttgtcttgattgagccaccacctcggaagggataatgcaaaggcatgggaataaagtgtgataagtgtactgtgggctttagttctcagcttctttttggagagctacacatggtgtaaaaagttgatatgtatgtgcacatgtgtaatatatttccttgttctgatatagatatcatgtcagctgccacggaatggagctgaattgttgttactccatacattctggtttcctagaaggccagtatttgcccagttattgggaaacctggttgaggtgtgcacctaagattatgttctaatcctagttctattacttgctagttgtgagtttttggaaaagttatttaacttcttcatgattcacacttgcttatctatgtgggggtgagcgaatatcttataa

SEQ ID NO: 112502 - DNA, 377 bp, Homo sapiens
ttttttttttcatttcttcataaaatatttctatgataatattaatcgtgaagatttgtcacaagggttgcctcctccaacaaacacctctccttgcccttgttcacccactaggtctagtttgggttttgttcctctttgcctcacctcataccatcccagttacccaattctgctattatcttcccacgttataaatgcaaataattaatacgttccatagttaaccccatataaattttaattcccaatatactaatgcaatatcctgcaaattcatataccatggtcataaaataaattggcatgaggtgcagtatttcagatgaatgaacacactttctcagagcttccacttccactatctaattgaagtt

SEQ ID NO: 112503 - DNA, 387 bp, Homo sapiens
gttggcaggccatcacaaggctggcctgtcttcttctgtcctgtggctccctcctcgttctcctttttcatctcctaagagttaggatccccagggcttaacaatttgatactcttctcactcaggctgccaggaacagcctccgcatcatggcttcagcaaccacctttatgcagaaaaggcctgactttcaaaattatatttctctacccacatattaaaatgtaacagattcttcttaaagagcccatatgaagaaataattcttttttgtgtgctttttaaaatgataaataatcgtacactttttttttttttttgagacggagtttcgctcttgttgcccgggctgaagtgcaatggcaccatcttggctcactacaacct

SEQ ID NO: 112504 - DNA, 783 bp, Homo sapiens
aagtgaaaagaaggaagtaatctgacattaggggtagagaaaacctagcctgagccctaggactattgccgtttatgactagtggatttttgaagtgcttaggtgaagatgtgggctacaggctttgcaactacttatgtttagtaacctcagaaagtctttaggcttttggttttcaaagtaatatactattgggggtataaatcacatcccctttgttactcctgtacctgagcaaggaatttttcacaagcctcttcacttcctgtcagactttgccattcatgacataccatggataggaacagcgtagaaggtgtttgaccactgcggacattgaatgtgtctttggtgagtcagtataaaaactgaagccatggcagttattatttctacatatgacagtgaccctctgccatctgaactttacttgccaggtagaatctgtgtctggagccttaatttgtaagatctgtactcaagtcctgactctaccactggacactgaatatctttcacttttagtctattcatttgtaaaagggatataataaaaatacctgttctgctttctaaaaatatttgtttaaagcataaaatgtagtgacacatgcaaaagccattaaatgtaagtgatgaagtacaatgctaatgtaaggcaataatacatttaaaataaacatagtgaacattatactagaaacttcaagttaatgtagcaagacttattatttattccaaataattttgaacaaaaaagtaccattatttttaaatgagaaa

SEQ ID NO: 112505 - DNA, 599 bp, Homo sapiens
caagctatgtgtctttgtttgatctctttgtacttcaaatatttcatatttataatggagataatggtatccaactcataggttttattggttacagtctttacggcacttataatagcatttgcatatggtaaaatataagttgctaagttgctattgtcatccctacatgtctaatgtttttattttaatgtttattaagtaattgccccaatccccttcagaagtaggtagaggtacatgccttccatgaggtactgagaggaactaaagtttctcaaatgaataattctctttattaatcacagcccagttctctaaattgtaatgatgagactccactgtgatagtttcacctacaataccttcaagtcggaacgggtaggtatcactatagttcagcaattctgagatgcacatcttttcactgttaggttgtgttttacaattactgtatatcctagcttaattgggagcaatttttctttcttagtggtacattagataatggcaaattttacaatccatggcaccttagatttgatgaaatatgggtttagtctcatgtagacggggagactgagatactatgtgctctg

SEQ ID NO: 112506 - DNA, 533 bp, Homo sapiens
ccattaatgctgaactctttagatagagtcacttatttgttcttcatagcagtcctatgaggtaggaattgttactgttacaactttatagtggaggaaaccaagagacagattaaatagcatgccccaaatcacttagctgctgtgggtagagacaggattgaatctcatgagattggctatagaagttgtggtcttagccacctgtcaaatggactaaaccagaggttttcatactttcttagttctagtaacccctaggccaaaagaaatacagtaagtcctcacttaatgtcatatataataagttactggaaattgtgactttaaacgaaatgatgtgtaacaaaaccagttttttccctcatcaacgttgtaatgaaccgatgaaagaatgatgttatttctttcaacctgctgtaagtcctttcacttaaagttgcagtttctaagaactgctccatgatgttaagtaaggacttgctgaccgttaagtatttgtcttctaacaaatttagtgaccattaaaaaaa

SEQ ID NO: 112507 - DNA, 172 bp, Homo sapiens
tcaccccagcctcccaaagtgctgggattacaagcataagccaccatgccccatggctcttccactctttccccaagccctgtacacaagaaccatcagaccctattagcttcagcatcaccatagagcctgacctaccacttctcataccctcactccactgaggcatcca

SEQ ID NO: 112508 - DNA, 384 bp, Homo sapiens
ctttccttcctgaaatgccagcaggaaggggttggagctcccgtgattagccagggagtcaggcttcctgaagtttacacaatacaaagcatattaagtgagaatgtagcagaaaaaagaacttatcccaatgattatagcaatttaaattctcttgaacccaagctctcaaggcctacctgttttatagcctcaagggactctactcctatcccagactataatgaattgtgtctcctggagttgtgcagtacgcaacctgtgaagctgtacacgacagccctataaattctctagcagacagccctcctagattctagttcccacttcacagctgaactgcatttaatctctgtaggactgttttcctgtctgtaaacctgg

SEQ ID NO: 112509 - DNA, 422 bp, Homo sapiens
acatttgggggcaggaggctgtagggtccatgaagaaactccactgtaggttgtggggtcggaggaagccgagggctaaaggatgagtatcacctggagagaggaagaggtttccattgacctggagagaggaagaggtttccattggcaagtggtactggattcctgtttgctgtgggagctgcctgggtgttgtaggatattgagtttaggcaaagccctggaggcagcagatagcaggtgtgtctgtaactatgtgaccccagggaggttggcgcccagtgggcagcctggggagcataagaggaggctgtaggagcaaacaagcaggcaggatcctggagggcccataggtactgaggagtgtgggctacgtgtttggagcaggaaagccacatactccgagcagccttttacaatgg

SEQ ID NO: 112510 - DNA, 721 bp, Homo sapiens
ggaactggaagaaagggcttttcttcctggttctggcatgttctttgtgtttgtttctgtagcacatgggacacccagcagtgcacatcccaatgagttccaaaggccccatccctatgggtagcttcccagcaagttctgtaccaggtcagctccccatggggagcttctagcaccccagagtgtggctcctcagtgagttctgccagctcagcactgcagtggcatctccatccagtgggctgtggctgtgccctctccaacaaggcctggatctaagacctggcaggaaaggggaagttgtggcaccctcctgcaaatttgttcttacctttgatgttctgcctcagccctagagacactctatatctgttattgctgtattcttttgagtttcactttttgttataacacttagtagttaataattcttaacattaaactttccctgttcaaatgattatgtggtttctattactgaaaatgtattcatctccatcttagggactgtcttgccaatgaagccaaaattaaataacagaatactgagctttgaatattatggatatttagccaggcatggtggtgtacaactgtagtcctagctactctggaggctgaggcaggaggatcactttaacccaggggttcaaggctgctgcagtgagctgtggttgcaccactgcactccaacctgggtgatagagtgagaccccatcta

SEQ ID NO: 112511 - DNA, 761 bp, Homo sapiens
gacctttccatctcctgaggtacatttgatgaggctaaaaacctgatgaaattattgttctctcttgaatgattccctgtattgtattagatcatacaatttctgagcataatgtcttaaaaatcaactaattgtttttctcgaaatatctgaaaaaatgcattgtttgtgtcaatcttggttcaggctagggtaaaccaaaatacgttttcaaaaaatatttttattctaacatttcttctgtggttatcaaaattggatgcagactctatgttcctgcttagccacatgaacatctttggtgaatatttttaaatggttgttgagcttgtcataagcacagttgtaatgatcctattttaaaagaattatatataattgggtcatagcaagagctaagtatatggcataagaaacttactcaatggcagaaggactttcaagctaaagccaaaccttttattaggtctctttgttaataaaatatggtcattgtgaattttgttgaggcagcttaaaacttttgaacggatagcttgaatgtaagttatctatccattttcctatgtatgtatgtatctatcaatcaatgtaacatctttctagttagattttcttatcatctattccagaagtgaagtatagttattaacaatggatcatatttaacacgtcttatgaagatacctaccatctgtgatttattttaagttttccagtttatcgaggttgtttgacaaatcaaaattgtctatactgaa

SEQ ID NO: 112512 - DNA, 392 bp, Homo sapiens
ttcaatgtcatgccactgtctacaggataaactgaagctgtaaagcacagtatgcaaagtcccaccataatcaaacctttctctccatccctactcatccccaagctaccatttcatactacatttttactgatttgtgattctttaaaaaataaaaattaatgttaaaacccattctttttcacacctctatatatactcatgtagctccccttagctcaaatgcctttccctcactcatttgacacccagccagcagccactcatactcccgcttcacccagtttgagacccagctgatctgctcctcgaagcttttcctgggctcctaaactgggttaggtgccagactctttgatatttccttagtatggtaggtgaaataaggaccc

SEQ ID NO: 112513 - DNA, 755 bp, Homo sapiens
aacaggcttggaaagcaggcatcaccatgcctatttaacagttggggtcccttggccaccaggtgctggagtaggaatctgagcccggacatgcctgatctgtaaattttgtgttttccccactgtgctgggcagatcacagctatcagcgccaaattcatagaaggggcgccccctgtggtcaattgagggatttgtgtttgaggtagatctcaagaaggaatgggtggggaacttagcctaggacagagcagaaaggagccctcactccccaagcaccaacggcctcagtccttcctgctgactccagcctctagctctcacccagactatctgcatccttctctccaccacgctcctttggaacctgcgtaaaacacagattaaaggaattccgccttacttccctttccgcattatgaccaaatggttttacactatcattgaacagtttagtacaaaacatgccaccttttaatctattcattcatttaacaaatactttggagtgtttaccatgtgccaagtgctgttctaatagacataagctgtgaggttatgcttatctgattctcacagcaacagctttcgagatatgaattggtatactcatttgacagatgaggaaattgaattcatgtagtgagaaaggaagagctgcaattcagggttactggtttctcctgcactaagcactgagccacactagaagagaaggcatgaggaagacaaaagtgagaaggtacgagagaaga

SEQ ID NO: 112514 - DNA, 269 bp, Homo sapiens
gctgatttgcaacatcttacctttccataaccctcctgactgagccacaaattgaagtctgcaaattcccctcccaaccactctgattactgtcctcagagaggtcaggtcagctctcctttctagtggaaaaccccttcttttggaggaataaacctaagtctttcctgggttccttggcccttaagaccatcggaaatttgtctgccctttgcttgcttctgcacagctactgttcccgaaagactcttgctgctaaccatgctcat

SEQ ID NO: 112515 - DNA, 180 bp, Homo sapiens
tcttgaactcctgagctcaagaaatcctcccacctcagcctcccaaagcgttgagattacatgtgcaagccactgtgccctgccatgtttcttaatatatgcacatatgtatatgtaacacataaataattacatacataatacaggaagacacagaaataattacatacatgatacagg

SEQ ID NO: 112516 - DNA, 262 bp, Homo sapiens
gttaagatagcaatactcccaaagttgatctatagtgtcaataaaatacctatcaaaattccaacagccttttttgcagaaataaacaagctgatcctaaaattcatatggatttgcaaggcaacacgaatagccgtaacaatctaaaaagaagtctaaagttggaggactcactcttttcaatttgaaaacttactataaaactacagtaatcaagactgtctgagccaggcacagtggtgttcacctgtaatcctagctc

SEQ ID NO: 112517 - DNA, 491 bp, Homo sapiens
tcctgactacagccccaaagccctacatgatcctgccccatttacagctccaggctcattacctacctcgtgctcccagcccacggatcatcgcctaccacatgctcccagcccccggatctccagcacatcagcctcttggctcttcttagaactccctgaattcactcctgtctcaaggactttcctgtgcttttccttagacaggagacacccctcccagttcacatggctcactcgcttcatccaggtctcttctccagtgtcccctccttgtgacccctggatctaaaggagttgaaccaccccactcctacccttatattctcatagctcctcacgctgcctcacttttagcaagatttcattaaaattttattgctgtctaaaattctattatatatttaaccatttacttgtttagtatctgtgtcttccattagcaagtaagttctggccaggcgtggtggctcacacctgtaatcccagca

SEQ ID NO: 112518 - DNA, 583 bp, Homo sapiens
atcactgctacttgcacaccctcctcccccagcaggaccttgtctgaggctgacttgatgtggactccactgtatccggcacagtccctcaggttctccttctttaacactctccttacctggttctgtgacgaggctcttctagcatcctctctgtcactcctcaggggtcctctcccacctcttccagactgctccttctccactcaggtctgaaatgctggtgccctccgggttctgcccttggctgttcttctcccgcacaccctgcatcatggggacccatccttgaactcccacctcttcactgatgaagcccaagtgtacatctcccacatacatctgtccccaaagcccagccccaggccccttgaattgactgtggtaggggatgctcttctgcctggacgtcttccacgcacaccccaaatgcaatagaaacatatcgagatgccacatctttccccaccgactctccctactgcccccgtccttccttcctctgcctccatcagtgaccccacctacctactcactcctctttgtccccatcctgtggaatttctgttctaaatatttttaa

SEQ ID NO: 112519 - DNA, 174 bp, Homo sapiens
ggagattaaggtcgcagtgagctatgatggcgccgctgcattccagtctgggcgacaaagcaatacctcatttcaagaaacgaaatggaattttttccttataagaatcttaaagaaggtgtacattatcttggctaactttctataggattaagtagaagttattgagacttg

SEQ ID NO: 112520 - DNA, 430 bp, Homo sapiens
ctcaaatataaaattttctttttaattctcagcaaggcaaagtacttctacagaaaggtgtgcccttacagatggagcaatgatggagtctcactttgtcagtcagactggagtgcagtagcacgatctcagctcacggcaacctctgcctctcgggttcaagagattctctcaagtagctggtattacagaggccctggacaatgtcaacatcaggagcctcatatgcgctggagaggccagtggacctgctccagcacctggtgctgcaccagtgggaggtcctgctccctccaccactgcagcccaagctgaagagagggaagtggaatcaaagaaagaagaatccgaggagtctgatgatgcatgggctttggtcttttttgacaaaatctcttttgtaacatgttcaataaaaaaccaaactctt

SEQ ID NO: 112521 - DNA, 248 bp, Homo sapiens
atcttgacagctgccatgtcttgagaacactcaagcagctctgtggagaagcccatgtgggaggaactgaggccttctgccaacagccagcatcaacttgtcagcagcattgtgagaccccaagccagaaccacccagctaagctgctcctgcattcctaacccacaaaaactagctgagcaattaatgttcacattgtgttaagctgtcaaatgttgggataatgcgttacacgacaatggataata

SEQ ID NO: 112522 - DNA, 442 bp, Homo sapiens
ttagcgtggtcacgcaatcacctcgacatcgagcagatattccaacccagatcctacacatcaaaatacatcatggcatttttcatccaaaatagccagaatgtgcacttccaaagcaaaggccctaatataaacaaatgctcatgtagacattgggtatgtatctgacagccaaatattggagctatgcagagcagctagaagagtggaccgcaggcagcatggcaagtccagaagacagctcacttaaaacatcatttttaaaatgtacattcttaaagccttaaagacaagactcaaatctgatccaggaataactgtagctgccatctctaatttaaaaagcaggtgataatctcattttccagccctcctgtcatgtgaaggttgtttatctttccatagagacataacctaccagtatccaggtttctgcaggggc

SEQ ID NO: 112523 - DNA, 349 bp, Homo sapiens
gagattgtgccactgcactccagcctgcgtgacagagtgagattctgtctttaaaaaaaaaaaaagaaaagaaaactatgacccagccaaatttgtccagctgcctgtttttaagaggctcatgagctcagaatggcttttatatttttaatgactggagggaaaaagtcaaaagaagaatgtttcatgacacatgaaaattacatgaaattcaaatgtcactgcccttaaataaagttttattgcaacacagcaatacctatttgcattatccctgccttctcattgaaatggcaacgttgagtaactgacagggactgtatggactacacagtgtaagatatttacc

SEQ ID NO: 112524 - DNA, 414 bp, Homo sapiens
gcccttgctgtggcccccagcttcacacaggtataacctgacagcaccctgccttggctgtaccatgtctttctagcattctgccttggggcgtctttgagacacctgcagaaacacgtacaaacctgaaagtacagggactcagtaccctggggcaacacttggccaagggagaggggaataatggatacatgcctacctcatctgtccttcagccacttcccaagcacattctatgtggctcctcagaggatccctgtgggattaagcccccactgcccacagcagtgaccagcttgataatgcaggcttgtgttggctcttcctccttccttgtttctctctttgtagccccttctcctgttgcctgggatcagtgcccaaaataagccacccgcacaccagcccttgcct

SEQ ID NO: 112525 - DNA, 214 bp, Homo sapiens
tttattcaattaacaaatatttattgagcacctactatattttaggcactgtgctaaaatcaattccaatggtcaacaaatatgtgaacaaatggtaatcattattgaaggaatgcaaatgtacaaaaagtgacttttccatttttcacctattcaatggtctatattcaaaataaatgattctccaggattggatgagcgtggctttgggatc

SEQ ID NO: 112526 - DNA, 348 bp, Homo sapiens
gtggtgggtgcccccctctctcaatggggggtgctgtttacagttaacaattgatcagaacaggtaaagggtaattaaaatgtattcgcccaacaaatgggcattccttttataataatgaaaaaaacctctctgttcgtaaagagttgtctgcatcataaataagaaaggtattcataattatatcccaaaactgaaaagacaacaagtgtctcccaaggtggattgtgaaatcaactcggtgcttcaacgtacttggaaagtcagcctggtttttgttttgttttgtttttgtttttgttttgagacggagtttagctcttgttgcccaggctgtagtgcagtctc

SEQ ID NO: 112527 - DNA, 355 bp, Homo sapiens
  misc_feature (271)..(271): n is a, c, g, or t
ctgtcatcataggcttgatcaactgtaatagacatgaaccaacatgacaccctggaggatgcatgtgatgttgaaatcatacccatgctctgttctcactcataagtgggagctgaacaatgagaacacatggacacggggaggggaacgtcacacaccggggcctgtcgggggttgggggcaaggggagggggagcattaggacaaatacctaatgtatgtggggcttaaaacctggatgacgggttgatgggtgcaacaaaccaccatngcacatgtatacctatgtaacaaacctgcacattctgcacattatcccagagcttaaggcataataaaaaaataataaaaaatc

SEQ ID NO: 112528 - DNA, 301 bp, Homo sapiens
tggaattacatagtggtgatggttgcacaacactgtgaatatactaaaaaaaatcaccgaattatgcactttaaagtgtgtattttaaaagataaattttgggccgggcactgtggttcatgcctgtaatcccagcactttgagaggccaaggtgggcagatcacttgaggtcgggagttggagaccagcctgaccaacatggagaaaccgcatctctacttaaaatacaaaattagctgggtatggtggcgcatgcctgtaatcccagctactcgggaagctgaggcaggagaatcgctt

SEQ ID NO: 112529 - DNA, 397 bp, Homo sapiens
taatatatctagtgtgtagaagtttcaatagcacctagttttagaagtttcaatagcagcatcatcagtattaaatacatagatatacatttgaaaaaagagggttaaaacctacacattgaaaattacaaaggtattatgtgatgctgaggtttggggtatgattgaccccatcacccaggtaatgatgatagtacccaataataggtaagttttcagcccttgcccccctccctctctaccccctcaaggagtcctcagtgtctgttgttcccatctttatgtccgtggcattacacaggatacctttgtaacaaacctgcacatgtatctccctgtttctacaataaaagttgaaaagaaaaaaagaaaattacaaaatatgccaaaagaaact

SEQ ID NO: 112530 - DNA, 392 bp, Homo sapiens
atctatgactgtctcaataaaaacttaaattaaaaacaccatttacaatagcagcatcatcagtattaaatacatagatatacatttgaaaaaagagggttaaaacctacacattgaaaattacaaaggtattatgtgatgctgaggtttggggtatgattgaccccatcacccaggtaatgatgatagtacccaataataggtaagttttcagcccttgcccccctccctctctaccccctcaaggagtcctcagtgtctgttgttcccatctttatgtccgtggcattacacaggatacctttgtaacaaacctgcacatgtatctccctgtttctacaataaaagttgaaaagaaaaaaagaaaattacaaaatatgccaaaagaaact

SEQ ID NO: 112531 - DNA, 1018 bp, Homo sapiens
cttgcagtgagccgagatggcgccactgcactccagcctgggcgacagagcgagactccgtctcagaaaaaactacaaccttgactatagtcccatattttagtccaaatactgtgattggcttctcttcctgttagacacaacctatgcaaaaccaaatgaatttgggttcggtatttctatcgtcattggctttggaaatcatttcacacttaatagaaaaattgtgagagttttacagaaaactcctctatagctttttcctagattgacaaacacacatacagatttatttacatatataagtttttttctgaaccatttgagtgtaggctatatatgttatgcttcttgatctcttaatacttcagtgtatatttcccatcaaaaaaggatattcttatgtaaccacttagaaatttaacattggcaaaatactgaaatctacagtgcatgtttcagttttattacttgtcccaataatgtactttatgttcctcctgtttagaatcttgaattgcatttaatttcatgtctctttgatctttaatctggagctttttcagcctttgtcttaattgacattaacagttctgaagaatacaaactagttactttatagaatattcctcaatttgggtttttcttatcattcggaagcctaacattagattcagttatatattcttaacttaaatacaccgtgaagtctccttttcaggaatcacagctagaggcacatgatatctgactgctcctctttgttaaggttagttttgactatgtagtcaagatgttgtccagcttctctgctgtgtagttactctctacccttgcaactaataagcaatctgtagggagatctttctagccagtacaaatagcctgctgatcattgaatcccacacccctggatgtagcatccactgatgattcttgcctgaatcgaacttgactaaaatgattacaaaatcatagcacctctacaggttgcagtatcctccctcaactctaccac

SEQ ID NO: 112532 - DNA, 931 bp, Homo sapiens
actagcatgtgtaagtagtgatttatgttaaggctgattgttatttctcaatcattagacatgtttcctttgttgactgtcctggccacgatattttgatggctactatgctgaacggtgcagcagtgatggatgcagctcttctgttgataggtaaatacctcacaattggtttggacaaatcaatgtggaacaaatccaagatgaaatatttaaaggggaactaaggcctttaaggatcatatctattacctaagggtgacatgaatgggaactaacatgtcatccaggatgactttcctacctatcagctatcacaaaatactcaaaaagatagacttggggctgatagcttgcgagaattcttgtggtagcatttgagaaaaagaaaaaaagtcaatagttcatttttctcatttaaatcacatgaggtgatttatttagttttaaatgtatgtgtaaaactatttgtgttatggttgtgtgtgtgtatgtctgaactgtctactgtggaagtatttaagatacaaatattcataatacgtgctgaagtgtaggaataagtggagtttgaagggtagcgtatgcttgtttcttatgttagctgttgagagatttcattactagggggtaaaattttttaaaagctgctggtgcggtggctcacgcctgtaatcctagcactttgggaggctgaggtcggcggatcacctgaggtcaggagtttgagaccagcctgaccaacatggagaaacccctctctactaaaaatacaaaattagccgggtgtggtggcgcatgcttgtaatcccatctactcaggagaatctcttgaaccgggaggcagaggtggcagtgagccaagattgcgccattgcactccagtctgggtaacaagagtaaaactacatctcaaaaaaaaaaaaaaaaa

SEQ ID NO: 112533 - DNA, 558 bp, Homo sapiens
taaagaggcaaagaaagcagcaaaggttcaaaagctgtctaagaatgaagtgctcatggtgaacataggatccctgtcaacaggagggagagttagtgctgtcaaggccgatttgggtaaaattgttttgaccaatccagtgtgcacagaggtaggagaaaaaattgcccttagccgaagagttgaaaaacactggcggtaagtttgttagtctttgccactgtctaattaaaaaaagacacagtcttgtacagaaaaaaaagcacacaatcttccttgaggacaacagttactgtggctttcagtctcaactatttatttggatgactttgaaaactatacttcggccgggtgcggtggctcacgcctgtaatcccagcactttgggaggcctaggcgggtggatcatgaggtcaggagatcaagaccatcctggctaacatggtgaaaccccgtctctactaaaaaatacaaaaaattagccgggcgtggtggcgggcgcctgtagtcccagctactcgggaggctgaggcaggagaatggcgtgaacctgggagt

SEQ ID NO: 112534 - DNA, 428 bp, Homo sapiens
tactactactactaaattcgggccgcgtcgactgattttaattgttctgatttaattggcttggagtagaattcaggcattgatatctttaaaaactccccagtgttgagaaacaaatttagagagttgagaagtaggtatattaaattacagaatcttactgagttttggtagactgataatacaatttgctttgcttttcttaaatttgcattgagatgggatttgaagcatattgtgctcttgtgaatgttgaagttgcattgtagaagtttagaagctctggctatgggttgcctaaattgatgttttgaggaagcatattaatgttataaacttcgctgactttgaaggttgtgttgtagcatgaggaacacaaataaaacaattctaaatcaaacaaaaaaaaagtcgacgcggccgcgaat

SEQ ID NO: 112535 - DNA, 312 bp, Homo sapiens
cttgcagtgagccgagatggcgccactgcactccagcctgggcgacagagcgagactccgtctcagaaaaaactacaaccttgactatagtcccatattttagtccaaatactgtgattggcttctcttcctgttagacacaacctatgcaaaaccaaatgaatttgggttcggtatttctatcgtcattggctttggaaatcatttcacacttaatagaaaaattgtgagagttttacagaaaactcctctatagctttttcctagattgacaaacacacatacagccccatgccgcaaagcctgtagatc

SEQ ID NO: 112536 - DNA, 343 bp, Homo sapiens
ttggctgcggctgatctagaggatcccgtgtgtcgagataagcagggaatcacagctagaggcacatgatatctgactgctcctctttgttaaggttagttttgactatgtagtcaagatgttgtccagcttctctgctgtgtagttactctctacccttgcaactaataagcaatctgtagggagatctttctagccagtacaaatagcctgctgatcattgaatcccacacccctggatgtagcatccactgatgattcttgcctgaatcgaacttgactaaaatgattacaaaatcatagcacctctacaggttgcagtatcctccctcaactctaccac

SEQ ID NO: 112537 - DNA, 3689 bp, Homo sapiens
agtattgcctgcacaaatatctaccaggtctgcgacgaatagctccagcaacttcgcaccgtgttttccactcagcctaccgacaggcactgtgcagattcaagcggagagatgtccaagcagtgaggccgctgctgcaccggccatcctgagcccctactcggccttcccgtctccgcttccccgccccgcactaggacccctgcagatgatcaggcggcagccggggtgatttccttcctcttttggcaacatggcgggcggagaagctggagtgactctagggcagccgcatctttcgcgtcaggatctcaccaccttggatgttaccaagttgacgccactttcacacgaagttatcagcagacaagccacaattaacataggtacaattggtcatgtagctcatgggaaatccacagtcgtcaaagctatttctggagttcatactgtcaggttcaaaaatgaactagaaagaaatattacaatcaagcttggatatgctaatgctaagatttataagcttgatgacccaagttgccctcggccagaatgttatagatcttgtgggagcagtacacctgacgagtttcctacggacattccagggaccaaagggaacttcaaattagtcagacatgtttcctttgttgactgtcctggccacgatattttgatggctactatgctgaacggtgcagcagtgatggatgcagctcttctgttgatagctggtaatgaatcttgccctcagcctcagacatcggaacacctggctgctatagagatcatgaaactgaagcatattttgattctacaaaataaaattgatttggtaaaagaaagtcaggctaaagaacaatacgagcagatccttgcatttgtccaaggtacagtagcagagggagctcccattattccaatttcagctcagctgaaatacaatattgaagttgtttgtgagtacatagtaaagaaaattccagtacccccaagagactttacttcagagccccggcttattgttattagatcttttgatgtcaacaaacctggctgtgaagttgatgaccttaagggaggtgtagctggtggtagtatcctaaaaggagtattaaaggtgggccaggagatagaagtaagacctggtattgtttccaaagatagtgaaggaaaactcatgtgtaaaccaatcttttccaaaattgtatcactttttgcggagcataatgatctgcaatatgctgctccaggcggtcttattggagttggaacaaaaattgaccccactttgtgccgggctgacagaatggtggggcaagtacttggtgcagtcggagctttacctgagatattcacagaattggaaatttcctatttcctgcttagacggcttctaggtgtacgcactgaaggagacaagaaagcagcaaaggttcaaaagctgtctaagaatgaagtgctcatggtgaacataggatccctgtcaacaggagggagagttagtgctgtcaaggccgatttgggtaaaattgttttgaccaatccagtgtgcacagaggtaggagaaaaaattgcccttagccgaagagttgaaaaacactggcgtttaattggttggggtcagataagaagaggagtgacaatcaagccaacagtagatgatgactgaagaataccagttaaataatacattcggatggatttggaagttggaattcctcttaacaaccaaggggtttattttcaaagcaatattggggaattgatttcacagttcgttaccttagtaggtaacggtaaggttattcttttttttttttttttttggttatgaaaacttagggactaaaattaatataaaaattggcataatgttggattgaatctacattttggcagaagttaaacattcccacataatgtcaaaattatacatcatgcagttctgtttttttgtttgttttattttgttttgtttttgagtctggctctgtcacccaggctggagtgcagtggcgtgatctgcaacctctgccccccgggttcaagcgattctcctgcctcagcctcccgagtagctgagattacaggtgcgcgccaccacacttggctaatttttgtattattagtagagacggggtttcagcatgttggctaggccggtctctcctgacctcagggtgatcagcccacctcggcctcacaaagtgctgggattacaggcgtgagccaccttgcccagcccacatcatacagtttgaaatgaaactttgccacaaccagcctttgctgtagcacacacatatatcactgaacctgtttgaaataaagttttttttctttttcatgattcgtctttgagtacctccaggctgaaagactgttgtaccagtaaaaacttaaaggcacaaattctccttgaagaccttctcccttttatgtggccccatattttatgttgctttatctttgaaattttgcatgaaaaggaaatgaatggattcgaatgaaattgtcctttagagcatgattacttgttcccatggacaaatatttttctccccttgctcttcctggcctgaaacacgggaaaccagagtcaaaagttatctccctctccctgtgatgccttgagatttttttctgcgttgtttaatgcctgaaatccaagtcttcctccatgggaaaatactgttataccaaataattctagatgagtaacaaagatctttttaggccttcattttatgttttttcttaactgttatattatgattgtgacatagattatactactactaatttttggatgtttcaaaaggtcaagaagtaaaagatgttagaaagcaatgagtgagtccttttgatttttaacttattccccatgtccctatacttcgtgtgcttttcctttttttttttgagacggaggctcactccgtcacctaggctagagtacagtggcacgatcttggctcgctgcaacctctgcctccctgattcaagtgattctcgtgcttcagcctcccatgtagctgatattacaggcacttgccaccatacccggctaattttggtatttttagtagagatggggtttcaccatgttgcccaggctggtcttgaactcctaacctcaggtgatccgcccgcctctgccttccaaagtgctgggattacaggcgtgagccactctgcccggcttatttttctttatgtttttgcttcgtaagaggttctgttgagcagtgatttgcaactcttgctgacgttgctggggaagctttaaaaaaaaaaaagatgccccacagagattctgattttaattgttctgatttaattggcttggagtagaattcaggcattgatatctttaaaaactccccagtgttgagaaacaaatttagagagttgagaagtaggtatattaaattacagaatcttactgagttttggtagactgataatacaatttgctttgcttttcttaaatttgcattgagatgggatttgaagcatattgtgctcttgtgaatgttgaagttgcattgtagaagtttagaagctctggctatgggttgcctaaattgatgttttgaggaagcatattaatgttataaacttcgctgactttgaaggttgtgttgtagcatgaggaacacaaataaaacaattctaaatcaaac

SEQ ID NO: 112538 - DNA, 2853 bp, Homo sapiens
agtattgcctgcacaaatatctaccaggtctgcgacgaatagctccagcaacttcgcaccgtgttttccactcagcctaccgacaggcactgtgcagattcaagcggagagatgtccaagcagtgaggccgctgctgcaccggccatcctgagcccctactcggccttcccgtctccgcttccccgccccgcactaggacccctgcagatgatcaggcggcagccggggtgatttccttcctcttttggcaacatggcgggcggagaagctggagtgactctagggcagccgcatctttcgcgtcaggatctcaccaccttggatgttaccaagttgacgccactttcacacgaagttatcagcagacaagccacaattaacataggtacaattggtcatgtagctcatgggaaatccacagtcgtcaaagctatttctggagttcatactgtcaggttcaaaaatgaactagaaagaaatattacaatcaagcttggatatgctaatgctaagatttataagcttgatgacccaagttgccctcggccagaatgttatagatcttgtgggagcagtacacctgacgagtttcctacggacattccagggaccaaagggaacttcaaattagtcagacatgtttcctttgttgactgtcctggccacgatattttgatggctactatgctgaacggtgcagcagtgatggatgcagctcttctgttgatagctggtaatgaatcttgccctcagcctcagacatcggaacacctggctgctatagagatcatgaaactgaagcatattttgattctacaaaataaaattgatttggtaaaagaaagtcaggctaaagaacaatacgagcagatccttgcatttgtccaaggtacagtagcagagggagctcccattattccaatttcagctcagctgaaatacaatattgaagttgtttgtgagtacatagtaaagaaaattccagtacccccaagagactttacttcagagccccggcttattgttattagatcttttgatgtcaacaaacctggctgtgaagttgatgaccttaagggaggtgtagctggtggtagtatcctaaaaggagtattaaaggtgggccaggagatagaagtaagacctggtattgtttccaaagatagtgaaggaaaactcatgtgtaaaccaatcttttccaaaattgtatcactttttgcggagcataatgatctgcaatatgctgctccaggcggtcttattggagttggaacaaaaattgaccccactttgtgccgggctgacagaatggtggggcaagtacttggtgcagtcggagctttacctgagatattcacagaattggaaatttcctatttcctgcttagacggcttctaggtgtacgcactgaaggagacaagaaagcagcaaaggttcaaaagctgtctaagaatgaagtgctcatggtgaacataggatccctgtcaacaggagggagagttagtgctgtcaaggccgatttgggtaaaattgttttgaccaatccagtgtgcacagaggtaggagaaaaaattgcccttagccgaagagttgaaaaacactggcgtttaattggttggggtcagataagaagaggagtgacaatcaagccaacagtagatgatgactgaagaataccagttaaataatacattcggatggatttggaagttggaattcctcttaacaaccaaggggtttattttcaaagcaatattggggaattgatttcacagttcgttaccttagtaggtaacggtaaggttattcttttttttttttttttttggttatgaaaacttagggactaaaattaatataaaaattggcataatgttggattgaatctacattttggcagaagttaaacattcccacataatgtcaaaattatacatcatgcagttctgtttttttgtttgttttattttgttttgtttttgagtctggctctgtcacccaggctggagtgcagtggcgtgatctgcaacctctgccccccgggttcaagcgattctcctgcctcagcctcccgagtagctgagattacaggtgcgcgccaccacacttggctaatttttgtattattagtagagacggggtttcagcatgttggctaggccggtctctcctgacctcagggtgatcagcccacctcggcctcacaaagtgctgggattacaggcgtgagccaccttgcccagcccacatcatacagtttgaaatgaaactttgccacaaccagcctttgctgtagcacacacatatatcactgaacctgtttgaaataaagttttttttctttttcatgattcgtctttgagtacctccaggctgaaagactgttgtaccagtaaaaacttaaaggcacaaattctccttgaagaccttctcccttttatgtggccccatattttatgttgctttatctttgaaattttgcatgaaaaggaaatgaatggattcgaatgaaattgtcctttagagcatgattacttgttcccatggacaaatatttttctccccttgctcttcctggcctgaaacacgggaaaccagagtcaaaagttatctccctctccctgtgatgccttgagatttttttctgcgttgtttaatgcctgaaatccaagtcttcctccatgggaaaatactgttataccaaataattctagatgagtaacaaagatctttttaggccttcattttatgttttttcttaactgttatattatgattgtgacatagattatactactactaatttttggatgtttcaaaaggtcaagaagtaaaagatgttagaaagcaa

SEQ ID NO: 112539 - DNA, 3878 bp, Homo sapiens
agtattgcctgcacaaatatctaccaggtctgcgacgaatagctccagcaacttcgcaccgtgttttccactcagcctaccgacaggcactgtgcagattcaagcggagagatgtccaagcagtgaggccgctgctgcaccggccatcctgagcccctactcggccttcccgtctccgcttccccgccccgcactaggacccctgcagatgatcaggcggcagccggggtgatttccttcctcttttggcaacatggcgggcggagaagctggagtgactctagggcagccgcatctttcgcgtcaggatctcaccaccttggatgttaccaagttgacgccactttcacacgaagttatcagcagacaagccacaattaacataggtacaattggtcatgtagctcatgggaaatccacagtcgtcaaagctatttctggagttcatactgtcaggttcaaaaatgaactagaaagaaatattacaatcaagcttggatatgctaatgctaagatttataagcttgatgacccaagttgccctcggccagaatgttatagatcttgtgggagcagtacacctgacgagtttcctacggacattccagggaccaaagggaacttcaaattagtcagacatgtttcctttgttgactgtcctggccacgatattttgatggctactatgctgaacggtgcagcagtgatggatgcagctcttctgttgatagctggtaatgaatcttgccctcagcctcagacatcggaacacctggctgctatagagatcatgaaactgaagcatattttgattctacaaaataaaattgatttggtaaaagaaagtcaggctaaagaacaatacgagcagatccttgcatttgtccaaggtacagtagcagagggagctcccattattccaatttcagctcagctgaaatacaatattgaagttgtttgtgagtacatagtaaagaaaattccagtacccccaagagactttacttcagagccccggcttattgttattagatcttttgatgtcaacaaacctggctgtgaagttgatgaccttaagggaggtgtagctggtggtagtatcctaaaaggagtattaaaggtgggccaggagatagaagtaagacctggtattgtttccaaagatagtgaaggaaaactcatgtgtaaaccaatcttttccaaaattgtatcactttttgcggagcataatgatctgcaatatgctgctccaggcggtcttattggagttggaacaaaaattgaccccactttgtgccgggctgacagaatggtggggcaagtacttggtgcagtcggagctttacctgagatattcacagaattggaaatttcctatttcctgcttagacggcttctaggtgtacgcactgaaggagacaagaaagcagcaaaggttcaaaagctgtctaagaatgaagtgctcatggtgaacataggatccctgtcaacaggagggagagttagtgctgtcaaggccgatttgggtaaaattgttttgaccaatccagtgtgcacagaggtaggagaaaaaattgcccttagccgaagagttgaaaaacactggcgtttaattggttggggtcagataagaagaggagtgacaatcaagccaacagtagatgatgactgaagaataccagttaaataatacattcggatggatttggaagttggaattcctcttaacaaccaaggggtttattttcaaagcaatattggggaattgatttcacagttcgttaccttagtaggtaacggtaaggttattcttttttttttttttttttggttatgaaaacttagggactaaaattaatataaaaattggcataatgttggattgaatctacattttggcagaagttaaacattcccacataatgtcaaaattatacatcatgcagttctgtttttttgtttgttttattttgttttgtttttgagtctggctctgtcacccaggctggagtgcagtggcgtgatctgcaacctctgccccccgggttcaagcgattctcctgcctcagcctcccgagtagctgagattacaggtgcgcgccaccacacttggctaatttttgtattattagtagagacggggtttcagcatgttggctaggccggtctctcctgacctcagggtgatcagcccacctcggcctcacaaagtgctgggattacaggcgtgagccaccttgcccagcccacatcatacagtttgaaatgaaactttgccacaaccagcctttgctgtagcacacacatatatcactgaacctgtttgaaataaagttttttttctttttcatgattcgtctttgagtacctccaggctgaaagactgttgtaccagtaaaaacttaaaggcacaaattctccttgaagaccttctcccttttatgtggccccatattttatgttgctttatctttgaaattttgcatgaaaaggaaatgaatggattcgaatgaaattgtcctttagagcatgattacttgttcccatggacaaatatttttctccccttgctcttcctggcctgaaacacgggaaaccagagtcaaaagttatctccctctccctgtgatgccttgagatttttttctgcgttgtttaatgcctgaaatccaagtcttcctccatgggaaaatactgttataccaaataattctagatgagtaacaaagatctttttaggccttcattttatgttttttcttaactgttatattatgattgtgacatagattatactactactaatttttggatgtttcaaaaggtcaagaagtaaaagatgttagaaagcaatgagtgagtccttttgatttttaacttattccccatgtccctatacttcgtgtgcttttcctttttttttttgagacggaggctcactccgtcacctaggctagagtacagtggcacgatcttggctcgctgcaacctctgcctccctgattcaagtgattctcgtgcttcagcctcccatgtagctgatattacaggcacttgccaccatacccggctaattttggtatttttagtagagatggggtttcaccatgttgcccaggctggtcttgaactcctaacctcaggtgatccgcccgcctctgccttccaaagtgctgggattacaggcgtgagccactctgcccggcttatttttctttatgtttttgcttcgtaagaggttctgttgagcagtgatttgcaactcttgctgacgttgctggggaagctttaaaaaaaaaaaagatgccccacagagattctgattttaattgttctgatttaattggcttggagtagaattcaggcattgatatctttaaaaactccccagtgttgagaaacaaatttagagagttgagaagtaggtatattaaattacagaatcttactgagttttggtagactgataatacaatttgctttgcttttcttaaatttgcattgagatgggatttgaagcatattgtgctcttgtgaatgttgaagttgcattgtagaagtttagaagctctggctatgggttgcctaaattgatgttttgaggaagcatattaatgttataaacttcgctgactttgaaggttgtgttgtagcatgaggaacacaaataaaacaattctaaatcaaactaattttatatctaacatgtccccatgtgttttgtaggtaccttctaccagaaattttggaataagacttaaaatatagacattgtaattaatctcatgtaagatttgaaaccagaattctattataattaatttcagacatccacatgaattagcaaatttgtaaagcactgtactgagtgtaatggg

SEQ ID NO: 112540 - DNA, 3944 bp, Homo sapiens
  misc_feature (3744)..(3744): n is a, c, g, or t
  misc_feature (3750)..(3750): n is a, c, g, or t
  misc_feature (3753)..(3753): n is a, c, g, or t
agtattgcctgcacaaatatctaccaggtctgcgacgaatagctccagcaacttcgcaccgtgttttccactcagcctaccgacaggcactgtgcagattcaagcggagagatgtccaagcagtgaggccgctgctgcaccggccatcctgagcccctactcggccttcccgtctccgcttccccgccccgcactaggacccctgcagatgatcaggcggcagccggggtgatttccttcctcttttggcaacatggcgggcggagaagctggagtgactctagggcagccgcatctttcgcgtcaggatctcaccaccttggatgttaccaagttgacgccactttcacacgaagttatcagcagacaagccacaattaacataggtacaattggtcatgtagctcatgggaaatccacagtcgtcaaagctatttctggagttcatactgtcaggttcaaaaatgaactagaaagaaatattacaatcaagcttggatatgctaatgctaagatttataagcttgatgacccaagttgccctcggccagaatgttatagatcttgtgggagcagtacacctgacgagtttcctacggacattccagggaccaaagggaacttcaaattagtcagacatgtttcctttgttgactgtcctggccacgatattttgatggctactatgctgaacggtgcagcagtgatggatgcagctcttctgttgatagctggtaatgaatcttgccctcagcctcagacatcggaacacctggctgctatagagatcatgaaactgaagcatattttgattctacaaaataaaattgatttggtaaaagaaagtcaggctaaagaacaatacgagcagatccttgcatttgtccaaggtacagtagcagagggagctcccattattccaatttcagctcagctgaaatacaatattgaagttgtttgtgagtacatagtaaagaaaattccagtacccccaagagactttacttcagagccccggcttattgttattagatcttttgatgtcaacaaacctggctgtgaagttgatgaccttaagggaggtgtagctggtggtagtatcctaaaaggagtattaaaggtgggccaggagatagaagtaagacctggtattgtttccaaagatagtgaaggaaaactcatgtgtaaaccaatcttttccaaaattgtatcactttttgcggagcataatgatctgcaatatgctgctccaggcggtcttattggagttggaacaaaaattgaccccactttgtgccgggctgacagaatggtggggcaagtacttggtgcagtcggagctttacctgagatattcacagaattggaaatttcctatttcctgcttagacggcttctaggtgtacgcactgaaggagacaagaaagcagcaaaggttcaaaagctgtctaagaatgaagtgctcatggtgaacataggatccctgtcaacaggagggagagttagtgctgtcaaggccgatttgggtaaaattgttttgaccaatccagtgtgcacagaggtaggagaaaaaattgcccttagccgaagagttgaaaaacactggcgtttaattggttggggtcagataagaagaggagtgacaatcaagccaacagtagatgatgactgaagaataccagttaaataatacattcggatggatttggaagttggaattcctcttaacaaccaaggggtttattttcaaagcaatattggggaattgatttcacagttcgttaccttagtaggtaacggtaaggttattcttttttttttttttttttggttatgaaaacttagggactaaaattaatataaaaattggcataatgttggattgaatctacattttggcagaagttaaacattcccacataatgtcaaaattatacatcatgcagttctgtttttttgtttgttttattttgttttgtttttgagtctggctctgtcacccaggctggagtgcagtggcgtgatctgcaacctctgccccccgggttcaagcgattctcctgcctcagcctcccgagtagctgagattacaggtgcgcgccaccacacttggctaatttttgtattattagtagagacggggtttcagcatgttggctaggccggtctctcctgacctcagggtgatcagcccacctcggcctcacaaagtgctgggattacaggcgtgagccaccttgcccagcccacatcatacagtttgaaatgaaactttgccacaaccagcctttgctgtagcacacacatatatcactgaacctgtttgaaataaagttttttttctttttcatgattcgtctttgagtacctccaggctgaaagactgttgtaccagtaaaaacttaaaggcacaaattctccttgaagaccttctcccttttatgtggccccatattttatgttgctttatctttgaaattttgcatgaaaaggaaatgaatggattcgaatgaaattgtcctttagagcatgattacttgttcccatggacaaatatttttctccccttgctcttcctggcctgaaacacgggaaaccagagtcaaaagttatctccctctccctgtgatgccttgagatttttttctgcgttgtttaatgcctgaaatccaagtcttcctccatgggaaaatactgttataccaaataattctagatgagtaacaaagatctttttaggccttcattttatgttttttcttaactgttatattatgattgtgacatagattatactactactaatttttggatgtttcaaaaggtcaagaagtaaaagatgttagaaagcaatgagtgagtccttttgatttttaacttattccccatgtccctatacttcgtgtgcttttcctttttttttttgagacggaggctcactccgtcacctaggctagagtacagtggcacgatcttggctcgctgcaacctctgcctccctgattcaagtgattctcgtgcttcagcctcccatgtagctgatattacaggcacttgccaccatacccggctaattttggtatttttagtagagatggggtttcaccatgttgcccaggctggtcttgaactcctaacctcaggtgatccgcccgcctctgccttccaaagtgctgggattacaggcgtgagccactctgcccggcttatttttctttatgtttttgcttcgtaagaggttctgttgagcagtgatttgcaactcttgctgacgttgctggggaagctttaaaaaaaaaaaagatgccccacagagattctgattttaattgttctgatttaattggcttggagtagaattcaggcattgatatctttaaaaactccccagtgttgagaaacaaatttagagagttgagaagtaggtatattaaattacagaatcttactgagttttggtagactgataatacaatttgctttgcttttcttaaatttgcattgagatgggatttgaagcatattgtgctcttgtgaatgttgaagttgcattgtagaagtttagaagctctggctatgggttgcctaaattgatgttttgaggaagcatattaatgttataaacttcgctgactttgaaggttgtgttgtagcatgaggaacacaaataaaacaattctaaatcaaacaaaaaaaaaaaaaaaaaaaaaaaaaaaaaaaaaaaaaaaaaaggggaggagaganaaaaanatnaccagaaggggcccaaagagaaagcaaccacagttagtgaaaaacagggggccacttaagacgagggcacaaataagaacaaagagagaaggacaggagaaaaaaaaagtgaacgcgcgaaaaacggaaaccagtaagaactgggaaagagcacacaacaaggggggagacacataagggcacaaatacag

SEQ ID NO: 112541 - DNA, 3980 bp, Homo sapiens
  misc_feature (3780)..(3780): n is a, c, g, or t
  misc_feature (3786)..(3786): n is a, c, g, or t
  misc_feature (3789)..(3789): n is a, c, g, or t
agtattgcctgcacaaatatctaccaggtctgcgacgaatagctccagcaacttcgcaccgtgttttccactcagcctaccgacaggcactgtgcagattcaagcggagagatgtccaagcagtgaggccgctgctgcaccggccatcctgagcccctactcggccttcccgtctccgcttccccgccccgcactaggacccctgcagatgatcaggcggcagccggggtgatttccttcctcttttggcaacatggcgggcggagaagctggagtgactctagggcagccgcatctttcgcgtcaggatctcaccaccttggatgttaccaagttgacgccactttcacacgaagttatcagcagacaagccacaattaacataggtacaattggtcatgtagctcatgggaaatccacagtcgtcaaagctatttctggagttcatactgtcaggttcaaaaatgaactagaaagaaatattacaatcaagcttggatatgctaatgctaagatttataagcttgatgacccaagttgccctcggccagaatgttatagatcttgtgggagcagtacacctgacgagtttcctacggacattccagggaccaaagggaacttcaaattagtcagacatgtttcctttgttgactgtcctggccacgatattttgatggctactatgctgaacggtgcagcagtgatggatgcagctcttctgttgatagctggtaatgaatcttgccctcagcctcagacatcggaacacctggctgctatagagatcatgaaactgaagcatattttgattctacaaaataaaattgatttggtaaaagaaagtcaggctaaagaacaatacgagcagatccttgcatttgtccaaggtacagtagcagagggagctcccattattccaatttcagctcagctgaaatacaatattgaagttgtttgtgagtacatagtaaagaaaattccagtacccccaagagactttacttcagagccccggcttattgttattagatcttttgatgtcaacaaacctggctgtgaagttgatgaccttaagggaggtgtagctggtggtagtatcctaaaaggagtattaaaggtgggccaggagatagaagtaagacctggtattgtttccaaagatagtgaaggaaaactcatgtgtaaaccaatcttttccaaaattgtatcactttttgcggagcataatgatctgcaatatgctgctccaggcggtcttattggagttggaacaaaaattgaccccactttgtgccgggctgacagaatggtggggcaagtacttggtgcagtcggagctttacctgagatattcacagaattggaaatttcctatttcctgcttagacggcttctaggtgtacgcactgaaggagacaagaaagcagcaaaggttcaaaagctgtctaagaatgaagtgctcatggtgaacataggatccctgtcaacaggagggagagttagtgctgtcaaggccgatttgggtaaaattgttttgaccaatccagtgtgcacagaggtaggagaaaaaattgcccttagccgaagagttgaaaaacactggcgtttaattggttggggtcagataagaagaggagtgacaatcaagccaacagtagatgatgactgaagaataccagttaaataatacattcggatggatttggaagttggaattcctcttaacaaccaaggggtttattttcaaagcaatattggggaattgatttcacagttcgttaccttagtaggtaacggtaaggttattcttttttttttttttttttggttatgaaaacttagggactaaaattaatataaaaattggcataatgttggattgaatctacattttggcagaagttaaacattcccacataatgtcaaaattatacatcatgcagttctgtttttttgtttgttttattttgttttgtttttgagtctggctctgtcacccaggctggagtgcagtggcgtgatctgcaacctctgccccccgggttcaagcgattctcctgcctcagcctcccgagtagctgagattacaggtgcgcgccaccacacttggctaatttttgtattattagtagagacggggtttcagcatgttggctaggccggtctctcctgacctcagggtgatcagcccacctcggcctcacaaagtgctgggattacaggcgtgagccaccttgcccagcccacatcatacagtttgaaatgaaactttgccacaaccagcctttgctgtagcacacacatatatcactgaacctgtttgaaataaagttttttttctttttcatgattcgtctttgagtacctccaggctgaaagactgttgtaccagtaaaaacttaaaggcacaaattctccttgaagaccttctcccttttatgtggccccatattttatgttgctttatctttgaaattttgcatgaaaaggaaatgaatggattcgaatgaaattgtcctttagagcatgattacttgttcccatggacaaatatttttctccccttgctcttcctggcctgaaacacgggaaaccagagtcaaaagttatctccctctccctgtgatgccttgagatttttttctgcgttgtttaatgcctgaaatccaagtcttcctccatgggaaaatactgttataccaaataattctagatgagtaacaaagatctttttaggccttcattttatgttttttcttaactgttatattatgattgtgacatagattatactactactaatttttggatgtttcaaaaggtcaagaagtaaaagatgttagaaagcaatgagtgagtccttttgatttttaacttattccccatgtccctatacttcgtgtgcttttcctttttttttttgagacggaggctcactccgtcacctaggctagagtacagtggcacgatcttggctcgctgcaacctctgcctccctgattcaagtgattctcgtgcttcagcctcccatgtagctgatattacaggcacttgccaccatacccggctaattttggtatttttagtagagatggggtttcaccatgttgcccaggctggtcttgaactcctaacctcaggtgatccgcccgcctctgccttccaaagtgctgggattacaggcgtgagccactctgcccggcttatttttctttatgtttttgcttcgtaagaggttctgttgagcagtgatttgcaactcttgctgacgttgctggggaagctttaaaaaaaaaaaagatgccccacagagattctgattttaattgttctgatttaattggcttggagtagaattcaggcattgatatctttaaaaactccccagtgttgagaaacaaatttagagagttgagaagtaggtatattaaattacagaatcttactgagttttggtagactgataatacaatttgctttgcttttcttaaatttgcattgagatgggatttgaagcatattgtgctcttgtgaatgttgaagttgcattgtagaagtttagaagctctggctatgggttgcctaaattgatgttttgaggaagcatattaatgttataaacttcgctgactttgaaggttgtgttgtagcatgaggaacacaaataaaacaattctaaatcaaacaaaaaaaaaaaaaaaaaaaaaaaaaaaaaaaaaaaaaaaaaaaaaaaaaaaaaaaaaaaaaaaaaaaaaaaaaaaaaaggggaggagaganaaaaanatnaccagaaggggcccaaagagaaagcaaccacagttagtgaaaaacagggggccacttaagacgagggcacaaataagaacaaagagagaaggacaggagaaaaaaaaagtgaacgcgcgaaaaacggaaaccagtaagaactgggaaagagcacacaacaaggggggagacacataagggcacaaatacag

SEQ ID NO: 112542 - DNA, 3375 bp, Homo sapiens
agtattgcctgcacaaatatctaccaggtctgcgacgaatagctccagcaacttcgcaccgtgttttccactcagcctaccgacaggcactgtgcagattcaagcggagagatgtccaagcagtgaggccgctgctgcaccggccatcctgagcccctactcggccttcccgtctccgcttccccgccccgcactaggacccctgcagatgatcaggcggcagccggggtgatttccttcctcttttggcaacatggcgggcggagaagctggagtgactctagggcagccgcatctttcgcgtcaggatctcaccaccttggatgttaccaagttgacgccactttcacacgaagttatcagcagacaagccacaattaacataggtacaattggtcatgtagctcatgggaaatccacagtcgtcaaagctatttctggagttcatactgtcaggttcaaaaatgaactagaaagaaatattacaatcaagcttggatatgctaatgctaagatttataagcttgatgacccaagttgccctcggccagaatgttatagatcttgtgggagcagtacacctgacgagtttcctacggacattccagggaccaaagggaacttcaaattagtcagacatgtttcctttgttgactgtcctggccacgatattttgatggctactatgctgaacggtgcagcagtgatggatgcagctcttctgttgatagctggtaatgaatcttgccctcagcctcagacatcggaacacctggctgctatagagatcatgaaactgaagcatattttgattctacaaaataaaattgatttggtaaaagaaagtcaggctaaagaacaatacgagcagatccttgcatttgtccaaggtacagtagcagagggagctcccattattccaatttcagctcagctgaaatacaatattgaagttgtttgtgagtacatagtaaagaaaattccagtacccccaagagactttacttcagagccccggcttattgttattagatcttttgatgtcaacaaacctggctgtgaagttgatgaccttaagggaggtgtagctggtggtagtatcctaaaaggagtattaaaggtgggccaggagatagaagtaagacctggtattgtttccaaagatagtgaaggaaaactcatgtgtaaaccaatcttttccaaaattgtatcactttttgcggagcataatgatctgcaatatgctgctccaggcggtcttattggagttggaacaaaaattgaccccactttgtgccgggctgacagaatggtggggcaagtacttggtgcagtcggagctttacctgagatattcacagaattggaaatttcctatttcctgcttagacggcttctaggtgtacgcactgaaggagacaagaaagcagcaaaggttcaaaagctgtctaagaatgaagtgctcatggtgaacataggatccctgtcaacaggagggagagttagtgctgtcaaggccgatttgggtaaaattgttttgaccaatccagtgtgcacagaggtaggagaaaaaattgcccttagccgaagagttgaaaaacactggcgtttaattggttggggtcagataagaagaggagtgacaatcaagccaacagtagatgatgactgaagaataccagttaaataatacattcggatggatttggaagttggaattcctcttaacaaccaaggggtttattttcaaagcaatattggggaattgatttcacagttcgttaccttagtaggtaacggtaaggttattcttttttttttttttttttggttatgaaaacttagggactaaaattaatataaaaattggcataatgttggattgaatctacattttggcagaagttaaacattcccacataatgtcaaaattatacatcatgcagttctgtttttttgtttgttttattttgttttgtttttgagtctggctctgtcacccaggctggagtgcagtggcgtgatctgcaacctctgccccccgggttcaagcgattctcctgcctcagcctcccgagtagctgagattacaggtgcgcgccaccacacttggctaatttttgtattattagtagagacggggtttcagcatgttggctaggccggtctctcctgacctcagggtgatcagcccacctcggcctcacaaagtgctgggattacaggcgtgagccaccttgcccagcccacatcatacagtttgaaatgaaactttgccacaaccagcctttgctgtagcacacacatatatcactgaacctgtttgaaataaagttttttttctttttcatgattcgtctttgagtacctccaggctgaaagactgttgtaccagtaaaaacttaaaggcacaaattctccttgaagaccttctcccttttatgtggccccatattttatgttgctttatctttgaaattttgcatgaaaaggaaatgaatggattcgaatgaaattgtcctttagagcatgattacttgttcccatggacaaatatttttctccccttgctcttcctggcctgaaacacgggaaaccagagtcaaaagttatctccctctccctgtgatgccttgagatttttttctgcgttgtttaatgcctgaaatccaagtcttcctccatgggaaaatactgttataccaaataattctagatgagtaacaaagatctttttaggccttcattttatgttttttcttaactgttatattatgattgtgacatagattatactactactaatttttggatgtttcaaaaggtcaagaagtaaaagatgttagaaagcaatgagtgagtccttttgatttttaacttattccccatgtccctatacttcgtgtgcttttcctttttttttttgagacggaggctcactccgtcacctaggctagagtacagtggcacgatcttggctcgctgcaacctctgcctccctgattctgattttaattgttctgatttaattggcttggagtagaattcaggcattgatatctttaaaaactccccagtgttgagaaacaaatttagagagttgagaagtaggtatattaaattacagaatcttactgagttttggtagactgataatacaatttgctttgcttttcttaaatttgcattgagatgggatttgaagcatattgtgctcttgtgaatgttgaagttgcattgtagaagtttagaagctctggctatgggttgcctaaattgatgttttgaggaagcatattaatgttataaacttcgctgactttgaaggttgtgttgtagcatgaggaacacaaataaaacaattctaaatcaaac

SEQ ID NO: 112543 - DNA, 3275 bp, Homo sapiens
agtattgcctgcacaaatatctaccaggtctgcgacgaatagctccagcaacttcgcaccgtgttttccactcagcctaccgacaggcactgtgcagattcaagcggagagatgtccaagcagtgaggccgctgctgcaccggccatcctgagcccctactcggccttcccgtctccgcttccccgccccgcactaggacccctgcagatgatcaggcggcagccggggtgatttccttcctcttttggcaacatggcgggcggagaagctggagtgactctagggcagccgcatctttcgcgtcaggatctcaccaccttggatgttaccaagttgacgccactttcacacgaagttatcagcagacaagccacaattaacataggtacaattggtcatgtagctcatgggaaatccacagtcgtcaaagctatttctggagttcatactgtcaggttcaaaaatgaactagaaagaaatattacaatcaagcttggatatgctaatgctaagatttataagcttgatgacccaagttgccctcggccagaatgttatagatcttgtgggagcagtacacctgacgagtttcctacggacattccagggaccaaagggaacttcaaattagtcagacatgtttcctttgttgactgtcctggccacgatattttgatggctactatgctgaacggtgcagcagtgatggatgcagctcttctgttgatagctggtaatgaatcttgccctcagcctcagacatcggaacacctggctgctatagagatcatgaaactgaagcatattttgattctacaaaataaaattgatttggtaaaagaaagtcaggctaaagaacaatacgagcagatccttgcatttgtccaaggtacagtagcagagggagctcccattattccaatttcagctcagctgaaatacaatattgaagttgtttgtgagtacatagtaaagaaaattccagtacccccaagagactttacttcagagccccggcttattgttattagatcttttgatgtcaacaaacctggctgtgaagttgatgaccttaagggaggtgtagctggtggtagtatcctaaaaggagtattaaaggtgggccaggagatagaagtaagacctggtattgtttccaaagatagtgaaggaaaactcatgtgtaaaccaatcttttccaaaattgtatcactttttgcggagcataatgatctgcaatatgctgctccaggcggtcttattggagttggaacaaaaattgaccccactttgtgccgggctgacagaatggtggggcaagtacttggtgcagtcggagctttacctgagatattcacagaattggaaatttcctatttcctgcttagacggcttctaggtgtacgcactgaaggagacaagaaagcagcaaaggttcaaaagctgtctaagaatgaagtgctcatggtgaacataggatccctgtcaacaggagggagagttagtgctgtcaaggccgatttgggtaaaattgttttgaccaatccagtgtgcacagaggtaggagaaaaaattgcccttagccgaagagttgaaaaacactggcgtttaattggttggggtcagataagaagaggagtgacaatcaagccaacagtagatgatgactgaagaataccagttaaataatacattcggatggatttggaagttggaattcctcttaacaaccaaggggtttattttcaaagcaatattggggaattgatttcacagttcgttaccttagtaggtaacggtaaggttattcttttttttttttttttttggttatgaaaacttagggactaaaattaatataaaaattggcataatgttggattgaatctacattttggcagaagttaaacattcccacataatgtcaaaattatacatcatgcagttctgtttttttgtttgttttattttgttttgtttttgagtctggctctgtcacccaggctggagtgcagtggcgtgatctgcaacctctgccccccgggttcaagcgattctcctgcctcagcctcccgagtagctgagattacaggtgcgcgccaccacacttggctaatttttgtattattagtagagacggggtttcagcatgttggctaggccggtctctcctgacctcagggtgatcagcccacctcggcctcacaaagtgctgggattacaggcgtgagccaccttgcccagcccacatcatacagtttgaaatgaaactttgccacaaccagcctttgctgtagcacacacatatatcactgaacctgtttgaaataaagttttttttctttttcatgattcgtctttgagtacctccaggctgaaagactgttgtaccagtaaaaacttaaaggcacaaattctccttgaagaccttctcccttttatgtggccccatattttatgttgctttatctttgaaattttgcatgaaaaggaaatgaatggattcgaatgaaattgtcctttagagcatgattacttgttcccatggacaaatatttttctccccttgctcttcctggcctgaaacacgggaaaccagagtcaaaagttatctccctctccctgtgatgccttgagatttttttctgcgttgtttaatgcctgaaatccaagtcttcctccatgggaaaatactgttataccaaataattctagatgagtaacaaagatctttttaggccttcattttatgttttttcttaactgttatattatgattgtgacatagattatactactactaatttttggatgtttcaaaaggtcaagaagtaaaagatgttagaaagcaatgagtgagtccttttgatttttaacttattccccatgtccctatacttcgtgtgcttttcctttttttttttgagacggaggctcactccgtcacctaggctagagtacagtggcacgatcttggctcgctgcaacctctgcctccctgattcaagtgattctcgtgcttcagcctcccatgtagctgatattacaggcacttgccaccatacccggctggccaacatggcgaaaccctgtctctactaaaaatacaaaagttagccgggtgtggtggcaggtgcctgtaatcccagctactctggaggctgaggcaggggaatcgcttgaacccaggaggtggaggttgcagtgagctgaggtcacaccattgcactccagcctgggtgacaagaacaagactccatctcaaaaaaaaaaa

SEQ ID NO: 112544 - DNA, 2733 bp, Homo sapiens
agtattgcctgcacaaatatctaccaggtctgcgacgaatagctccagcaacttcgcaccgtgttttccactcagcctaccgacaggcactgtgcagattcaagcggagagatgtccaagcagtgaggccgctgctgcaccggccatcctgagcccctactcggccttcccgtctccgcttccccgccccgcactaggacccctgcagatgatcaggcggcagccggggtgatttccttcctcttttggcaacatggcgggcggagaagctggagtgactctagggcagccgcatctttcgcgtcaggatctcaccaccttggatgttaccaagttgacgccactttcacacgaagttatcagcagacaagccacaattaacataggtacaattggtcatgtagctcatgggaaatccacagtcgtcaaagctatttctggagttcatactgtcaggttcaaaaatgaactagaaagaaatattacaatcaagcttggatatgctaatgctaagatttataagcttgatgacccaagttgccctcggccagaatgttatagatcttgtgggagcagtacacctgacgagtttcctacggacattccagggaccaaagggaacttcaaattagtcagacatgtttcctttgttgactgtcctggccacgatattttgatggctactatgctgaacggtgcagcagtgatggatgcagctcttctgttgatagctggtaatgaatcttgccctcagcctcagacatcggaacacctggctgctatagagatcatgaaactgaagcatattttgattctacaaaataaaattgatttggtaaaagaaagtcaggctaaagaacaatacgagcagatccttgcatttgtccaaggtacagtagcagagggagctcccattattccaatttcagctcagctgaaatacaatattgaagttgtttgtgagtacatagtaaagaaaattccagtacccccaagagactttacttcagagccccggcttattgttattagatcttttgatgtcaacaaacctggctgtgaagttgatgaccttaagggaggtgtagctggtggtagtatcctaaaaggagtattaaaggtgggccaggagatagaagtaagacctggtattgtttccaaagatagtgaaggaaaactcatgtgtaaaccaatcttttccaaaattgtatcactttttgcggagcataatgatctgcaatatgctgctccaggcggtcttattggagttggaacaaaaattgaccccactttgtgccgggctgacagaatggtggggcaagtacttggtgcagtcggagctttacctgagatattcacagaattggaaatttcctatttcctgcttagacggcttctaggtgtacgcactgaaggagacaagaaagcagcaaaggttcaaaagctgtctaagaatgaagtgctcatggtgaacataggatccctgtcaacaggagggagagttagtgctgtcaaggccgatttgggtaaaattgttttgaccaatccagtgtgcacagaggtaggagaaaaaattgcccttagccgaagagttgaaaaacactggcgtttaattggttggggtcagataagaagaggagtgacaatcaagccaacagtagatgatgactgaagaataccagttaaataatacattcggatggatttggaagttggaattcctcttaacaaccaaggggtttattttcaaagcaatattggggaattgatttcacagttcgttaccttagtaggtaacggtaaggttattcttttttttttttttttttggttatgaaaacttagggactaaaattaatataaaaattggcataatgttggattgaatctacattttggcagaagttaaacattcccacataatgtcaaaattatacatcatgcagttctgtttttttgtttgttttattttgttttgtttttgagtctggctctgtcacccaggctggagtgcagtggcgtgatctgcaacctctgccccccgggttcaagcgattctcctgcctcagcctcccgagtagctgagattacaggtgcgcgccaccacacttggctaatttttgtattattagtagagacggggtttcagcatgttggctaggccggtctctcctgacctcagggtgatcagcccacctcggcctcacaaagtgctgggattacaggcgtgagccaccttgcccagcccacatcatacagtttgaaatgaaactttgccacaaccagcctttgctgtagcacacacatatatcactgaacctgtttgaaataaagttttttttctttttcatgattcgtctttgagtacctccaggctgaaagactgttgtaccagtaaaaacttaaaggcacaaattctccttgaagaccttctcccttttatgtggccccatattttatgttgctttatctttgaaattttgcatgaaaaggaaatgaatggattcgaatgaaattgtcctttagagcatgattacttgttcccatggacaaatcttcctccatgggaaaatactgttataccaaataattctagatgagtaacaaagatctttttaggccttcattttatgttttttcttaactgttatattatgattgtgacatagattatactactactaatttttggatgtttcaaaaggtcaagaagtaaaagatgttagaaagcaa

SEQ ID NO: 112545 - DNA, 2588 bp, Homo sapiens
agtattgcctgcacaaatatctaccaggtctgcgacgaatagctccagcaacttcgcaccgtgttttccactcagcctaccgacaggcactgtgcagattcaagcggagagatgtccaagcagtgaggccgctgctgcaccggccatcctgagcccctactcggccttcccgtctccgcttccccgccccgcactaggacccctgcagatgatcaggcggcagccggggtgatttccttcctcttttggcaacatggcgggcggagaagctggagtgactctagggcagccgcatctttcgcgtcaggatctcaccaccttggatgttaccaagttgacgccactttcacacgaagttatcagcagacaagccacaattaacataggtacaattggtcatgtagctcatgggaaatccacagtcgtcaaagctatttctggagttcatactgtcaggttcaaaaatgaactagaaagaaatattacaatcaagcttggatatgctaatgctaagatttataagcttgatgacccaagttgccctcggccagaatgttatagatcttgtgggagcagtacacctgacgagtttcctacggacattccagggaccaaagggaacttcaaattagtcagacatgtttcctttgttgactgtcctggccacgatattttgatggctactatgctgaacggtgcagcagtgatggatgcagctcttctgttgatagctggtaatgaatcttgccctcagcctcagacatcggaacacctggctgctatagagatcatgaaactgaagcatattttgattctacaaaataaaattgatttggtaaaagaaagtcaggctaaagaacaatacgagcagatccttgcatttgtccaaggtacagtagcagagggagctcccattattccaatttcagctcagctgaaatacaatattgaagttgtttgtgagtacatagtaaagaaaattccagtacccccaagagactttacttcagagccccggcttattgttattagatcttttgatgtcaacaaacctggctgtgaagttgatgaccttaagggaggtgtagctggtggtagtatcctaaaaggagtattaaaggtgggccaggagatagaagtaagacctggtattgtttccaaagatagtgaaggaaaactcatgtgtaaaccaatcttttccaaaattgtatcactttttgcggagcataatgatctgcaatatgctgctccaggcggtcttattggagttggaacaaaaattgaccccactttgtgccgggctgacagaatggtggggcaagtacttggtgcagtcggagctttacctgagatattcacagaattggaaatttcctatttcctgcttagacggcttctaggtgtacgcactgaaggagacaagaaagcagcaaaggttcaaaagctgtctaagaatgaagtgctcatggtgaacataggatccctgtcaacaggagggagagttagtgctgtcaaggccgatttgggtaaaattgttttgaccaatccagtgtgcacagaggtaggagaaaaaattgcccttagccgaagagttgaaaaacactggcgtttaattggttggggtcagataagaagaggagtgacaatcaagccaacagtagatgatgactgaagaataccagttaaataatacattcggatggatttggaagttggaattcctcttaacaaccaaggggtttattttcaaagcaatattggggaattgatttcacagttcgttaccttagtaggtaacggtaaggttattcttttttttttttttttttggttatgaaaacttagggactaaaattaatataaaaattggcataatgttggattgaatctacattttggcagaagttaaacattcccacataatgtcaaaattatacatcatgcagttctgtttttttgtttgttttattttgttttgtttttgagtctggctctgtcacccaggctggagtgcagtggcgtgatctgcaacctctgccccccgggttcaagcgattctcctgcctcagcctcccgagtagctgagattacaggtgcgcgccaccacacttggctaatttttgtattattagtagagacggggtttcagcatgttggctaggccggtctctcctgacctcagggtgatcagcccacctcggcctcacaaagtgctgggattacaggcgtgagccaccttgcccagcccacatcatacagtttgaaatgaaactttgccacaaccagcctttgctgtagcacacacatatatcactgaacctgtttgaaataaagttttttttctttttcatgattcgtctttgagtacctccaggctgaaagactgttgtaccagtaaaaacttaaaggcacaaattctccttgaagaccttctcccttttatgtggccccatattttatgttgctttatctttgaaattttgcatgaaaaggaaatgaatggattcgaatgaatagtccctgggcagttatcgatcccaggacaacatgtgcccccgacttccggccgaacaggaaacggtcagttt

SEQ ID NO: 112546 - DNA, 2456 bp, Homo sapiens
agtattgcctgcacaaatatctaccaggtctgcgacgaatagctccagcaacttcgcaccgtgttttccactcagcctaccgacaggcactgtgcagattcaagcggagagatgtccaagcagtgaggccgctgctgcaccggccatcctgagcccctactcggccttcccgtctccgcttccccgccccgcactaggacccctgcagatgatcaggcggcagccggggtgatttccttcctcttttggcaacatggcgggcggagaagctggagtgactctagggcagccgcatctttcgcgtcaggatctcaccaccttggatgttaccaagttgacgccactttcacacgaagttatcagcagacaagccacaattaacataggtacaattggtcatgtagctcatgggaaatccacagtcgtcaaagctatttctggagttcatactgtcaggttcaaaaatgaactagaaagaaatattacaatcaagcttggatatgctaatgctaagatttataagcttgatgacccaagttgccctcggccagaatgttatagatcttgtgggagcagtacacctgacgagtttcctacggacattccagggaccaaagggaacttcaaattagtcagacatgtttcctttgttgactgtcctggccacgatattttgatggctactatgctgaacggtgcagcagtgatggatgcagctcttctgttgatagctggtaatgaatcttgccctcagcctcagacatcggaacacctggctgctatagagatcatgaaactgaagcatattttgattctacaaaataaaattgatttggtaaaagaaagtcaggctaaagaacaatacgagcagatccttgcatttgtccaaggtacagtagcagagggagctcccattattccaatttcagctcagctgaaatacaatattgaagttgtttgtgagtacatagtaaagaaaattccagtacccccaagagactttacttcagagccccggcttattgttattagatcttttgatgtcaacaaacctggctgtgaagttgatgaccttaagggaggtgtagctggtggtagtatcctaaaaggagtattaaaggtgggccaggagatagaagtaagacctggtattgtttccaaagatagtgaaggaaaactcatgtgtaaaccaatcttttccaaaattgtatcactttttgcggagcataatgatctgcaatatgctgctccaggcggtcttattggagttggaacaaaaattgaccccactttgtgccgggctgacagaatggtggggcaagtacttggtgcagtcggagctttacctgagatattcacagaattggaaatttcctatttcctgcttagacggcttctaggtgtacgcactgaaggagacaagaaagcagcaaaggttcaaaagctgtctaagaatgaagtgctcatggtgaacataggatccctgtcaacaggagggagagttagtgctgtcaaggccgatttgggtaaaattgttttgaccaatccagtgtgcacagaggtaggagaaaaaattgcccttagccgaagagttgaaaaacactggcgtttaattggttggggtcagataagaagaggagtgacaatcaagccaacagtagatgatgactgaagaataccagttaaataatacattcggatggatttggaagttggaattcctcttaacaaccaaggggtttattttcaaagcaatattggggaattgatttcacagttcgttaccttagtaggtaacggtaaggttattcttttttttttttttttttggttatgaaaacttagggactaaaattaatataaaaattggcataatgttggattgaatctacattttggcagaagttaaacattcccacataatgtcaaaattatacatcatgcagttctgttataacggtggtcaaataggttggtggagtctggactctggaactccagcctgggggtgaccagagtaagactgtctcaaaaaaataggaaaaagaaagaaaaagaccgtatcaggtctccatccctggagactctcatttaaatagttggtgggatggattcccgtgctaggtgaccctaatgtgccatttgggggtgggaacccacggtcaattaccattataagggccctatatcccaccgtagggttactaggggatttttcccagaaatattaaccgcctttttagagaagaaagccgtgctgcggctggcattgggcactgcttatattaagacgtgcgcataatcttagcagacttttgggtgtgtgcctactggaacacgataatcacacgcccaagaaagcgcgttgttatagagacgcagtacttggcaaaaagcgaattagtgggatattactgtgacagaaatggtaggacaaaagcgagcttttgtgtaaa

SEQ ID NO: 112547 - DNA, 3015 bp, Homo sapiens
agtattgcctgcacaaatatctaccaggtctgcgacgaatagctccagcaacttcgcaccgtgttttccactcagcctaccgacaggcactgtgcagattcaagcggagagatgtccaagcagtgaggccgctgctgcaccggccatcctgagcccctactcggccttcccgtctccgcttccccgccccgcactaggacccctgcagatgatcaggcggcagccggggtgatttccttcctcttttggcaacatggcgggcggagaagctggagtgactctagggcagccgcatctttcgcgtcaggatctcaccaccttggatgttaccaagttgacgccactttcacacgaagttatcagcagacaagccacaattaacataggtacaattggtcatgtagctcatgggaaatccacagtcgtcaaagctatttctggagttcatactgtcaggttcaaaaatgaactagaaagaaatattacaatcaagcttggatatgctaatgctaagatttataagcttgatgacccaagttgccctcggccagaatgttatagatcttgtgggagcagtacacctgacgagtttcctacggacattccagggaccaaagggaacttcaaattagtcagacatgtttcctttgttgactgtcctggccacgatattttgatggctactatgctgaacggtgcagcagtgatggatgcagctcttctgttgatagctggtaatgaatcttgccctcagcctcagacatcggaacacctggctgctatagagatcatgaaactgaagcatattttgattctacaaaataaaattgatttggtaaaagaaagtcaggctaaagaacaatacgagcagatccttgcatttgtccaaggtacagtagcagagggagctcccattattccaatttcagctcagctgaaatacaatattgaagttgtttgtgagtacatagtaaagaaaattccagtacccccaagagactttacttcagagccccggcttattgttattagatcttttgatgtcaacaaacctggctgtgaagttgatgaccttaagggaggtgtagctggtggtagtatcctaaaaggagtattaaaggtgggccaggagatagaagtaagacctggtattgtttccaaagatagtgaaggaaaactcatgtgtaaaccaatcttttccaaaattgtatcactttttgcggagcataatgatctgcaatatgctgctccaggcggtcttattggagttggaacaaaaattgaccccactttgtgccgggctgacagaatggtggggcaagtacttggtgcagtcggagctttacctgagatattcacagaattggaaatttcctatttcctgcttagacggcttctaggtgtacgcactgaaggagacaagaaagcagcaaaggttcaaaagctgtctaagaatgaagtgctcatggtgaacataggatccctgtcaacaggagggagagttagtgctgtcaaggccgatttgggtaaaattgttttgaccaatccagtgtgcacagaggtaggagaaaaaattgcccttagccgaagagttgaaaaacactggcgtttaattggttggggtcagataagaagaggagtgacaatcaagccaacagtagatgatgactgaagaataccagttaaataatacattcggatggatttggaagttggaattcctcttaacaaccaaggggtttattttcaaagcaatattggggaattgatttcacagttcgttaccttagtaggtaacggtaaggttattcttttttttttttttttttggttatgaaaacacttgagggcattaaaatattcaattataaaatatgggcctataagtgttgtggctatgtgaaactcttcactatcttgtggcccagacacgttctcacacactaatcttcccacacatataaatagtgtttcaaacacactgtattatcgacatactccgtagtggcagactatctccgtgggtatttctttactgtcgggttgtagtgagtttttcaactacttatagtcgtagtcgtttgtagaggtgttatactatttgtggagaggtattctggtggggggacacttccgattggtgttacaacaacccaccgccaggaaggtgggtgcctggttggtggagcaagcttgtgtggtgtcgagcaaggtcagttgggcgggagctggttgcattgaagcaaactttcgttgtttgggagatcagaacaacccgccttccttgcttgttggcagcacccgccccgctcctgcaggagggtctgattgattcctccacgtagaggtaacgcagcagtggaacaaattgctatctaccatgccgcctgtgttgggagccactcttgctctttcaggacagggtgcccaatccagtttacacgcgcgacggactgaaggtatgtacttcgaaggccgagtccggttaggagtgcaaggaactctatcgtttatttcacaacaccggaagggaaggtaagtttggcaggccgagctgcgcccgtgctgccacactacaagcccaacctacatgaccaacacttctgcttcggttggctggtgacgttcatatatcgaagcaattcttcgtacatcgacgtaggttaggagtagattcatatcctttttacattctacttccgtttaactattacgtaccggcgtctagttaacagaggcaaaagcagacaacctccgctcgggtaggagagaggcgggtactagttgaatagcactacacctaaaggcagcgacactacaacgagctaagggtcgactttcgttggaggcgtcccctctactttacttgggacggtgcccccgcgtagtagaggagtagttaccttagcttcctacgctcccctcgcctgtttagagtagaagctcctactttcactagatggcagggaggttggactagcaataacatgcagtaagagaggccgtccaacacag

SEQ ID NO: 112548 - DNA, 1968 bp, Homo sapiens
agtattgcctgcacaaatatctaccaggtctgcgacgaatagctccagcaacttcgcaccgtgttttccactcagcctaccgacaggcactgtgcagattcaagcggagagatgtccaagcagtgaggccgctgctgcaccggccatcctgagcccctactcggccttcccgtctccgcttccccgccccgcactaggacccctgcagatgatcaggcggcagccggggtgatttccttcctcttttggcaacatggcgggcggagaagctggagtgactctagggcagccgcatctttcgcgtcaggatctcaccaccttggatgttaccaagttgacgccactttcacacgaagttatcagcagacaagccacaattaacataggtacaattggtcatgtagctcatgggaaatccacagtcgtcaaagctatttctggagttcatactgtcaggttcaaaaatgaactagaaagaaatattacaatcaagcttggatatgctaatgctaagatttataagcttgatgacccaagttgccctcggccagaatgttatagatcttgtgggagcagtacacctgacgagtttcctacggacattccagggaccaaagggaacttcaaattagtcagacatgtttcctttgttgactgtcctggccacgatattttgatggctactatgctgaacggtgcagcagtgatggatgcagctcttctgttgatagctggtaatgaatcttgccctcagcctcagacatcggaacacctggctgctatagagatcatgaaactgaagcatattttgattctacaaaataaaattgatttggtaaaagaaagtcaggctaaagaacaatacgagcagatccttgcatttgtccaaggtacagtagcagagggagctcccattattccaatttcagctcagctgaaatacaatattgaagttgtttgtgagtacatagtaaagaaaattccagtacccccaagagactttacttcagagccccggcttattgttattagatcttttgatgtcaacaaacctggctgtgaagttgatgaccttaagggaggtgtagctggtggtagtatcctaaaaggagtattaaaggtgggccaggagatagaagtaagacctggtattgtttccaaagatagtgaaggaaaactcatgtgtaaaccaatcttttccaaaattgtatcactttttgcggagcataatgatctgcaatatgctgctccaggcggtcttattggagttggaacaaaaattgaccccactttgtgccgggctgacagaatggtggggcaagtacttggtgcagtcggagctttacctgagatattcacagaattggaaatttcctatttcctgcttagacggcttctaggtgtacgcactgaaggagacaagaaagcagcaaaggttcaaaagctgtctaagaatgaagtgctcatggtgaacataggatccctgtcaacaggagggagagttagtgctgtcaaggccgatttgggtaaaattgttttgaccaatccagtgtgcacagaggtaggagaaaaaattgcccttagccgaagagttgaaaaacactggcggtaagtttgttagtctttgccactgtctaattaaaaaaagacacagtcttgtacagaaaaaaaagcacacaatcttccttgaggacaacagttactgtggctttcagtctcaactatttatttggatgactttgaaaactatacttcggccgggtgcggtggctcacgcctgtaatcccagcactttgggaggcctaggcgggtggatcatgaggtcaggagatcaagaccatcctggctaacatggtgaaaccccgtctctactaaaaaatacaaaaaattagccgggcgtggtggcgggcgcctgtagtcccagctactcgggaggctgaggcaggagaatggcgtgaacctgggagt

SEQ ID NO: 112549 - DNA, 2509 bp, Homo sapiens
attactaattatatgtttacaggtgggccaggagatagaagtaagacctggtattgtttccaaagatagtgaaggaaaactcatgtgtaaaccaatcttttccaaaattgtatcactttttgcggagcataatgatctgcaatatgctgctccaggcggtcttattggagttggaacaaaaattgaccccactttgtgccgggctgacagaatggtggggcaagtacttggtgcagtcggagctttacctgagatattcacagaattggaaatttcctatttcctgcttagacggcttctaggtgtacgcactgaaggagacaagaaagcagcaaaggttcaaaagctgtctaagaatgaagtgctcatggtgaacataggatccctgtcaacaggagggagagttagtgctgtcaaggccgatttggtttaattggttggggtcagataagaagaggagtgacaatcaagccaacagtagatgatgactgaagaataccagttaaataatacattcggatggatttggaagttggaattcctcttaacaaccaaggggtttattttcaaagcaatattggggaattgatttcacagttcgttaccttagtaggtaacggtaaggttattcttttttttttttttttttggttatgaaaacttagggactaaaattaatataaaaattggcataatgttggattgaatctacattttggcagaagttaaacattcccacataatgtcaaaattatacatcatgcagttctgtttttttgtttgttttattttgttttgtttttgagtctggctctgtcacccaggctggagtgcagtggcgtgatctgcaacctctgccccccgggttcaagcgattctcctgcctcagcctcccgagtagctgagattacaggtgcgcgccaccacacttggctaatttttgtattattagtagagacggggtttcagcatgttggctaggccggtctctcctgacctcagggtgatcagcccacctcggcctcacaaagtgctgggattacaggcgtgagccaccttgcccagcccacatcatacagtttgaaatgaaactttgccacaaccagcctttgctgtagcacacacatatatcactgaacctgtttgaaataaagttttttttctttttcatgattcgtctttgagtacctccaggctgaaagactgttgtaccagtaaaaacttaaaggcacaaattctccttgaagaccttctcccttttatgtggccccatattttatgttgctttatctttgaaattttgcatgaaaaggaaatgaatggattcgaatgaaattgtcctttagagcatgattacttgttcccatggacaaatatttttctccccttgctcttcctggcctgaaacacgggaaaccagagtcaaaagttatctccctctccctgtgatgccttgagatttttttctgcgttgtttaatgcctgaaatccaagtcttcctccatgggaaaatactgttataccaaataattctagatgagtaacaaagatctttttaggccttcattttatgttttttcttaactgttatattatgattgtgacatagattatactactactaatttttggatgtttcaaaaggtcaagaagtaaaagatgttagaaagcaatgagtgagtccttttgatttttaacttattccccatgtccctatacttcgtgtgcttttcctttttttttttgagacggaggctcactccgtcacctaggctagagtacagtggcacgatcttggctcgctgcaacctctgcctccctgattcaagtgattctcgtgcttcagcctcccatgtagctgatattacaggcacttgccaccatacccggctaattttggtatttttagtagagatggggtttcaccatgttgcccaggctggtcttgaactcctaacctcaggtgatccgcccgcctctgccttccaaagtgctgggattacaggcgtgagccactctgcccggcttatttttctttatgtttttgcttcgtaagaggttctgttgagcagtgatttgcaactcttgctgacgttgctggggaagctttaaaaaaaaaaaagatgccccacagagattctgattttaattgttctgatttaattggcttggagtagaattcaggcattgatatctttaaaaactccccagtgttgagaaacaaatttagagagttgagaagtaggtatattaaattacagaatcttactgagttttggtagactgataatacaatttgctttgcttttcttaaatttgcattgagatgggatttgaagcatattgtgctcttgtgaatgttgaagttgcattgtagaagtttagaagctctggctatgggttgcctaaattgatgttttgaggaagcatattaatgttataaacttcgctgactttgaaggttgtgttgtagcatgaggaacacaaataaaacaattctaaatcaaac

SEQ ID NO: 112550 - DNA, 1575 bp, Homo sapiens
ggacgcgtgggtcgacccacgcgtcggggtttcagcatgttggctaggccggtctctcctgacctcagggtgatcagcccacctcggcctcacaaagtgctgggattacaggcgtgagccaccttgcccagcccacatcatacagtttgaaatgaaactttgccacaaccagcctttgctgtagcacacacatatatcactgaacctgtttgaaataaagttttttttctttttcatgattcgtctttgagtacctccaggctgaaagactgttgtaccagtaaaaacttaaaggcacaaattctccttgaagaccttctcccttttatgtggccccatattttatgttgctttatctttgaaattttgcatgaaaaggaaatgaatggattcgaatgaaattgtcctttagagcatgattacttgttcccatggacaaatatttttctccccttgctcttcctggcctgaaacacgggaaaccagagtcaaaagttatctccctctccctgtgatgccttgagatttttttctgcgttgtttaatgcctgaaatccaagtcttcctccatgggaaaatactgttataccaaataattctagatgagtaacaaagatctttttaggccttcattttatgttttttcttaactgttatattatgattgtgacatagattatactactactaatttttggatgtttcaaaaggtcaagaagtaaaagatgttagaaagcaatgagtgagtccttttgatttttaacttattccccatgtccctatacttcgtgtgcttttcctttttttttttgagacggaggctcactccgtcacctaggctagagtacagtggcacgatcttggctcgctgcaacctctgcctccctgattcaagtgattctcgtgcttcagcctcccatgtagctgatattacaggcacttgccaccatacccggctaattttggtatttttagtagagatggggtttcaccatgttgcccaggctggtcttgaactcctaacctcaggtgatccgcccgcctctgccttccaaagtgctgggattacaggcgtgagccactctgcccggcttatttttctttatgtttttgcttcgtaagaggttctgttgagcagtgatttgcaactcttgctgacgttgctggggaagctttaaaaaaaaaaaagatgccccacagagattctgattttaattgttctgatttaattggcttggagtagaattcaggcattgatatctttaaaaactccccagtgttgagaaacaaatttagagagttgagaagtaggtatattaaattacagaatcttactgagttttggtagactgataatacaatttgctttgcttttcttaaatttgcattgagatgggatttgaagcatattgtgctcttgtgaatgttgaagttgcattgtagaagtttagaagctctggctatgggttgcctaaattgatgttttgaggaagcatattaatgttataaacttcgctgactttgaaggttgtgttgtagcatgaggaacacaaataaaacaattctaaatcaaac

SEQ ID NO: 112551 - DNA, 1041 bp, Homo sapiens
  misc_feature (1018)..(1018): n is a, c, g, or t
agtattgcctgcacaaatatctaccaggtctgcgacgaatagctccagcaacttcgcaccgtgttttccactcagcctaccgacaggcactgtgcagattcaagcggagagatgtccaagcagtgaggccgctgctgcaccggccatcctgagcccctactcggccttcccgtctccgcttccccgccccgcactaggacccctgcagatgatcaggcggcagccggggtgatttccttcctcttttggcaacatggcgggcggagaagctggagtgactctagggcagccgcatctttcgcgtcaggatctcaccaccttggatgttaccaagttgacgccactttcacacgaagttatcagcagacaagccacaattaacataggtacaattggtcatgtagctcatgggaaatccacagtcgtcaaagctatttctggagttcatactgtcaggttcaaaaatgaactagaaagaaatattacaatcaagcttggatatgctaatgctaagatttataagcttgatgacccaagttgccctcggccagaatgttatagatcttgtgggagcagtacacctgacgagtttcctacggacattccagggaccaaagggaacttcaaattagtcagacatgtttcctttgttgactgtcctggccacgatattttgatggctactatgctgaacggtgcagcagtgatggatgcagctcttctgttgatagctggtaatgaatcttgccctcagcctcagacatcggaacacctggctgctatagagatcatgaaactgaagcatattttgattctacaaaataaaattgatttggtaaaagaaagtcaggctaaagaacaatacgagcagatccttgcatttgtccaaggtacagtagcagagggagctcccattattccaatttcagctcagctgaaatacaatattgaagttgtttgtgagtacatagtaaagaaaattccagtacccccaagaatttatttaaacccggtttgngttgattttgtgtcacaacgggt

SEQ ID NO: 112552 - DNA, 2760 bp, Homo sapiens
tctccataaagaaagcccacactatattcttagattctttttattcttgcttttgtgtgttttttctgagacagtctcactctgtcacccaggttggagtgcagtggtgcgatctcggctcactacaacctctgcctcctgggttcaagtgattctcctgcctcagcctcccaagtagctgggactacaggcatgagccaccacgcctgacctctttcttcttttttttggaacatttccttattttctggcacaaaatcttccagactcatcttgtaccttctctgttccagttttagaactggccatttctcttataaatgaaaagctgagtgttcaggtgtgctcatggctcttagggtgctgttgcttctaggtcttttgagagcatagagccaggaagcatacacacatttttggctcctgactttttgctctttcccaggttattgagtttgccccttgctttccattcctcgtcacctcatcacagtccataccaccatcactttacacttcacagttagtgcgaaagactcctagtttgcctcttaacttggtcaaaattagtcttcttaaaacattttcatcatgctgtgtttaataatttctagagtcttctcactactttttgatatttgggacttttctagaaacctgcttcaacccatttaagctttccttctgcattgtcttatataaaccctctaaattagactgttttgtgccctaactgtccccataattattcacatcacccctacccactatctacttccttaattatttattttatattttttagaggcagggtctctctgttgaccaggctggagtttagtggcatgatcatagctcactgcagcctcagtgtctaagtagctaggactattggctcacaccaccgtgatcagctaatttttttgttttttgtagacacttggtctcactgtgttgcccagcatgatctcaaactcctggcctcaagccatcctcccacctcagcctctcaaagtgttgggattacagacatgagccaccccgcccagccctgtttcctttattaaggcttccatgctactgtgcccacgatggtctcatcacttgtccaggagatttatctgaattattgccctgtaatttagaaagttaaatttttgttgtctcttaagtaaataattatttgtggtgacttatgcccttttgattttactgtcttttgtgattatatttttttgctattacagacacacgacttccagtgtattttgaaatagatttaagcaataaactttcagtccagccaccttgcccagcccacatcatacagtttgaaatgaaactttgccacaaccagcctttgctgtagcacacacatatatcactgaacctgtttgaaataaagttttttttctttttcatgattcgtctttgagtacctccaggctgaaagactgttgtaccagtaaaaacttaaaggcacaaattctccttgaagaccttctcccttttatgtggccccatattttatgttgctttatctttgaaattttgcatgaaaaggaaatgaatggattcgaatgaaattgtcctttagagcatgattacttgttcccatggacaaatatttttctccccttgctcttcctggcctgaaacacgggaaaccagagtcaaaagttatctccctctccctgtgatgccttgagatttttttctgcgttgtttaatgcctgaaatccaagtcttcctccatgggaaaatactgttataccaaataattctagatgagtaacaaagatctttttaggccttcattttatgttttttcttaactgttatattatgattgtgacatagattatactactactaatttttggatgtttcaaaaggtcaagaagtaaaagatgttagaaagcaatgagtgagtccttttgatttttaacttattccccatgtccctatacttcgtgtgcttttcctttttttttttgagacggaggctcactccgtcacctaggctagagtacagtggcacgatcttggctcgctgcaacctctgcctccctgattcaagtgattctcgtgcttcagcctcccatgtagctgatattacaggcacttgccaccatacccggctaattttggtatttttagtagagatggggtttcaccatgttgcccaggctggtcttgaactcctaacctcaggtgatccgcccgcctctgccttccaaagtgctgggattacaggcgtgagccactctgcccggcttatttttctttatgtttttgcttcgtaagaggttctgttgagcagtgatttgcaactcttgctgacgttgctggggaagctttaaaaaaaaaaaagatgccccacagagattctgattttaattgttctgatttaattggcttggagtagaattcaggcattgatatctttaaaaactccccagtgttgagaaacaaatttagagagttgagaagtaggtatattaaattacagaatcttactgagttttggtagactgataatacaatttgctttgcttttcttaaatttgcattgagatgggatttgaagcatattgtgctcttgtgaatgttgaagttgcattgtagaagtttagaagctctggctatgggttgcctaaattgatgttttgaggaagcatattaatgttataaacttcgctgactttgaaggttgtgttgtagcatgaggaacacaaataaaacaattctaaatcaaac

SEQ ID NO: 112553 - DNA, 2803 bp, Homo sapiens
ggtagaatgcagtggcatgatctcagctcactgcaacctctgcctcccaggttcaagcaattctcctgcctcagcctcccgagtagctgggactacaggcacacgccaccacacccggctaatttttgtattttcagtagagacggggtttcaccacgttggccagcctggtctttaacccccgacctcaggtgatccgccctccttggcctcccaaagtgctgggattacaggcatgagccaccacgcctgacctctttcttcttttttttggaacatttccttattttctggcacaaaatcttccagactcatcttgtaccttctctgttccagttttagaactggccatttctcttataaatgaaaagctgagtgttcaggtgtgctcatggctcttagggtgctgttgcttctaggtcttttgagagcatagagccaggaagcatacacacatttttggctcctgactttttgctctttcccaggttattgagtttgccccttgctttccattcctcgtcacctcatcacagtccataccaccatcactttacacttcacagttagtgcgaaagactcctagtttgcctcttaacttggtcaaaattagtcttcttaaaacattttcatcatgctgtgtttaataatttctagagtcttctcactactttttgatatttgggacttttctagaaacctgcttcaacccatttaagctttccttctgcattgtcttatataaaccctctaaattagactgttttgtgccctaactgtccccataattattcacatcacccctacccactatctacttccttaattatttattttatattttttagaggcagggtctctctgttgaccaggctggagtttagtggcatgatcatagctcactgcagcctcagtgtctaagtagctaggactattggctcacaccaccgtgatcagctaatttttttgttttttgtagacacttggtctcactgtgttgcccagcatgatctcaaactcctggcctcaagccatcctcccacctcagcctctcaaagtgttgggattacagacatgagccaccccgcccagccctgtttcctttattaaggcttccatgctactgtgcccacgatggtctcatcacttgtccaggagatttatctgaattattgccctgtaatttagaaagttaaatttttgttgtctcttaagtaaataattatttgtggtgacttatgcccttttgattttactgtcttttgtgattatatttttttgctattacagacacacgacttccagtgtattttgaaatagatttaagcaataaactttcagtccagccaccttgcccagcccacatcatacagtttgaaatgaaactttgccacaaccagcctttgctgtagcacacacatatatcactgaacctgtttgaaataaagttttttttctttttcatgattcgtctttgagtacctccaggctgaaagactgttgtaccagtaaaaacttaaaggcacaaattctccttgaagaccttctcccttttatgtggccccatattttatgttgctttatctttgaaattttgcatgaaaaggaaatgaatggattcgaatgaaattgtcctttagagcatgattacttgttcccatggacaaatatttttctccccttgctcttcctggcctgaaacacgggaaaccagagtcaaaagttatctccctctccctgtgatgccttgagatttttttctgcgttgtttaatgcctgaaatccaagtcttcctccatgggaaaatactgttataccaaataattctagatgagtaacaaagatctttttaggccttcattttatgttttttcttaactgttatattatgattgtgacatagattatactactactaatttttggatgtttcaaaaggtcaagaagtaaaagatgttagaaagcaatgagtgagtccttttgatttttaacttattccccatgtccctatacttcgtgtgcttttcctttttttttttgagacggaggctcactccgtcacctaggctagagtacagtggcacgatcttggctcgctgcaacctctgcctccctgattcaagtgattctcgtgcttcagcctcccatgtagctgatattacaggcacttgccaccatacccggctaattttggtatttttagtagagatggggtttcaccatgttgcccaggctggtcttgaactcctaacctcaggtgatccgcccgcctctgccttccaaagtgctgggattacaggcgtgagccactctgcccggcttatttttctttatgtttttgcttcgtaagaggttctgttgagcagtgatttgcaactcttgctgacgttgctggggaagctttaaaaaaaaaaaagatgccccacagagattctgattttaattgttctgatttaattggcttggagtagaattcaggcattgatatctttaaaaactccccagtgttgagaaacaaatttagagagttgagaagtaggtatattaaattacagaatcttactgagttttggtagactgataatacaatttgctttgcttttcttaaatttgcattgagatgggatttgaagcatattgtgctcttgtgaatgttgaagttgcattgtagaagtttagaagctctggctatgggttgcctaaattgatgttttgaggaagcatattaatgttataaacttcgctgactttgaaggttgtgttgtagcatgaggaacacaaataaaacaattctaaatcaaac

SEQ ID NO: 112554 - DNA, 2397 bp, Homo sapiens
gggggtgtctgaggtccgaaaacgacatagagccaggaagcatacacacatttttggctcctgactttttgctctttcccaggttattgagtttgccccttgctttccattcctcgtcacctcatcacagtccataccaccatcactttacacttcacagttagtgcgaaagactcctagtttgcctcttaacttggtcaaaattagtcttcttaaaacattttcatcatgctgtgtttaataatttctagagtcttctcactactttttgatatttgggacttttctagaaacctgcttcaacccatttaagctttccttctgcattgtcttatataaaccctctaaattagactgttttgtgccctaactgtccccataattattcacatcacccctacccactatctacttccttaattatttattttatattttttagaggcagggtctctctgttgaccaggctggagtttagtggcatgatcatagctcactgcagcctcagtgtctaagtagctaggactattggctcacaccaccgtgatcagctaatttttttgttttttgtagacacttggtctcactgtgttgcccagcatgatctcaaactcctggcctcaagccatcctcccacctcagcctctcaaagtgttgggattacagacatgagccaccccgcccagccctgtttcctttattaaggcttccatgctactgtgcccacgatggtctcatcacttgtccaggagatttatctgaattattgccctgtaatttagaaagttaaatttttgttgtctcttaagtaaataattatttgtggtgacttatgcccttttgattttactgtcttttgtgattatatttttttgctattacagacacacgacttccagtgtattttgaaatagatttaagcaataaactttcagtccagccaccttgcccagcccacatcatacagtttgaaatgaaactttgccacaaccagcctttgctgtagcacacacatatatcactgaacctgtttgaaataaagttttttttctttttcatgattcgtctttgagtacctccaggctgaaagactgttgtaccagtaaaaacttaaaggcacaaattctccttgaagaccttctcccttttatgtggccccatattttatgttgctttatctttgaaattttgcatgaaaaggaaatgaatggattcgaatgaaattgtcctttagagcatgattacttgttcccatggacaaatatttttctccccttgctcttcctggcctgaaacacgggaaaccagagtcaaaagttatctccctctccctgtgatgccttgagatttttttctgcgttgtttaatgcctgaaatccaagtcttcctccatgggaaaatactgttataccaaataattctagatgagtaacaaagatctttttaggccttcattttatgttttttcttaactgttatattatgattgtgacatagattatactactactaatttttggatgtttcaaaaggtcaagaagtaaaagatgttagaaagcaatgagtgagtccttttgatttttaacttattccccatgtccctatacttcgtgtgcttttcctttttttttttgagacggaggctcactccgtcacctaggctagagtacagtggcacgatcttggctcgctgcaacctctgcctccctgattcaagtgattctcgtgcttcagcctcccatgtagctgatattacaggcacttgccaccatacccggctaattttggtatttttagtagagatggggtttcaccatgttgcccaggctggtcttgaactcctaacctcaggtgatccgcccgcctctgccttccaaagtgctgggattacaggcgtgagccactctgcccggcttatttttctttatgtttttgcttcgtaagaggttctgttgagcagtgatttgcaactcttgctgacgttgctggggaagctttaaaaaaaaaaaagatgccccacagagattctgattttaattgttctgatttaattggcttggagtagaattcaggcattgatatctttaaaaactccccagtgttgagaaacaaatttagagagttgagaagtaggtatattaaattacagaatcttactgagttttggtagactgataatacaatttgctttgcttttcttaaatttgcattgagatgggatttgaagcatattgtgctcttgtgaatgttgaagttgcattgtagaagtttagaagctctggctatgggttgcctaaattgatgttttgaggaagcatattaatgttataaacttcgctgactttgaaggttgtgttgtagcatgaggaacacaaataaaacaattctaaatcaaac

SEQ ID NO: 112555 - DNA, 2028 bp, Homo sapiens
tgctggcccttacgcgcgtctgctggccctacccactatctacttccttaattatttattttatattttttagaggcagggtctctctgttgaccaggctggagtttagtggcatgatcatagctcactgcagcctcagtgtctaagtagctaggactattggctcacaccaccgtgatcagctaatttttttgttttttgtagacacttggtctcactgtgttgcccagcatgatctcaaactcctggcctcaagccatcctcccacctcagcctctcaaagtgttgggattacagacatgagccaccccgcccagccctgtttcctttattaaggcttccatgctactgtgcccacgatggtctcatcacttgtccaggagatttatctgaattattgccctgtaatttagaaagttaaatttttgttgtctcttaagtaaataattatttgtggtgacttatgcccttttgattttactgtcttttgtgattatatttttttgctattacagacacacgacttccagtgtattttgaaatagatttaagcaataaactttcagtccagccaccttgcccagcccacatcatacagtttgaaatgaaactttgccacaaccagcctttgctgtagcacacacatatatcactgaacctgtttgaaataaagttttttttctttttcatgattcgtctttgagtacctccaggctgaaagactgttgtaccagtaaaaacttaaaggcacaaattctccttgaagaccttctcccttttatgtggccccatattttatgttgctttatctttgaaattttgcatgaaaaggaaatgaatggattcgaatgaaattgtcctttagagcatgattacttgttcccatggacaaatatttttctccccttgctcttcctggcctgaaacacgggaaaccagagtcaaaagttatctccctctccctgtgatgccttgagatttttttctgcgttgtttaatgcctgaaatccaagtcttcctccatgggaaaatactgttataccaaataattctagatgagtaacaaagatctttttaggccttcattttatgttttttcttaactgttatattatgattgtgacatagattatactactactaatttttggatgtttcaaaaggtcaagaagtaaaagatgttagaaagcaatgagtgagtccttttgatttttaacttattccccatgtccctatacttcgtgtgcttttcctttttttttttgagacggaggctcactccgtcacctaggctagagtacagtggcacgatcttggctcgctgcaacctctgcctccctgattcaagtgattctcgtgcttcagcctcccatgtagctgatattacaggcacttgccaccatacccggctaattttggtatttttagtagagatggggtttcaccatgttgcccaggctggtcttgaactcctaacctcaggtgatccgcccgcctctgccttccaaagtgctgggattacaggcgtgagccactctgcccggcttatttttctttatgtttttgcttcgtaagaggttctgttgagcagtgatttgcaactcttgctgacgttgctggggaagctttaaaaaaaaaaaagatgccccacagagattctgattttaattgttctgatttaattggcttggagtagaattcaggcattgatatctttaaaaactccccagtgttgagaaacaaatttagagagttgagaagtaggtatattaaattacagaatcttactgagttttggtagactgataatacaatttgctttgcttttcttaaatttgcattgagatgggatttgaagcatattgtgctcttgtgaatgttgaagttgcattgtagaagtttagaagctctggctatgggttgcctaaattgatgttttgaggaagcatattaatgttataaacttcgctgactttgaaggttgtgttgtagcatgaggaacacaaataaaacaattctaaatcaaac

SEQ ID NO: 112556 - DNA, 1910 bp, Homo sapiens
cttgcagtgagccgagatggcgccactgcactccagcctgggcgacagagcgagactccgtctcagaaaaaactacaaccttgactatagtcccatattttagtccaaatactgtgattggcttctcttcctgttagacacaacctatgcaaaaccaaatgaatttgggttcggtatttctatcgtcattggctttggaaatcatttcacacttaatagaaaaattgtgagagttttacagaaaactcctctatagctttttcctagattgacaaacacacatacagatttatttacatatataagtttttttctgaaccatttgagtgtaggctatatatgttatgcttcttgatctcttaatacttcagtgtatatttcccatcaaaaaaggatattcttatgtaaccacttagaaatttaacattggcaaaatactgaaatctacagtgcatgtttcagttttattacttgtcccaataatgtactttatgttcctcctgtttagaatcttgaattgcatttaatttcatgtctctttgatctttaatctggagttttttctttttcatgattcgtctttgagtacctccaggctgaaagactgttgtaccagtaaaaacttaaaggcacaaattctccttgaagaccttctcccttttatgtggccccatattttatgttgctttatctttgaaattttgcatgaaaaggaaatgaatggattcgaatgaaattgtcctttagagcatgattacttgttcccatggacaaatatttttctccccttgctcttcctggcctgaaacacgggaaaccagagtcaaaagttatctccctctccctgtgatgccttgagatttttttctgcgttgtttaatgcctgaaatccaagtcttcctccatgggaaaatactgttataccaaataattctagatgagtaacaaagatctttttaggccttcattttatgttttttcttaactgttatattatgattgtgacatagattatactactactaatttttggatgtttcaaaaggtcaagaagtaaaagatgttagaaagcaatgagtgagtccttttgatttttaacttattccccatgtccctatacttcgtgtgcttttcctttttttttttgagacggaggctcactccgtcacctaggctagagtacagtggcacgatcttggctcgctgcaacctctgcctccctgattcaagtgattctcgtgcttcagcctcccatgtagctgatattacaggcacttgccaccatacccggctaattttggtatttttagtagagatggggtttcaccatgttgcccaggctggtcttgaactcctaacctcaggtgatccgcccgcctctgccttccaaagtgctgggattacaggcgtgagccactctgcccggcttatttttctttatgtttttgcttcgtaagaggttctgttgagcagtgatttgcaactcttgctgacgttgctggggaagctttaaaaaaaaaaaagatgccccacagagattctgattttaattgttctgatttaattggcttggagtagaattcaggcattgatatctttaaaaactccccagtgttgagaaacaaatttagagagttgagaagtaggtatattaaattacagaatcttactgagttttggtagactgataatacaatttgctttgcttttcttaaatttgcattgagatgggatttgaagcatattgtgctcttgtgaatgttgaagttgcattgtagaagtttagaagctctggctatgggttgcctaaattgatgttttgaggaagcatattaatgttataaacttcgctgactttgaaggttgtgttgtagcatgaggaacacaaataaaacaattctaaatcaaac

SEQ ID NO: 112557 - DNA, 600 bp, Homo sapiens
cttaaacccaggagttcgagacctgcctgggcaatatagcaagaccccgttctccacacaaaggaaaaaaaaagtattgttgggccaggcacggtggctcacgcctgtaatcccggcttatttttctttatgtttttgcttcgtaagaggttctgttgagcagtgatttgcaactcttgctgacgttgctggggaagctttaaaaaaaaaaaagatgccccacagagattctgattttaattgttctgatttaattggcttggagtagaattcaggcattgatatctttaaaaactccccagtgttgagaaacaaatttagagagttgagaagtaggtatattaaattacagaatcttactgagttttggtagactgataatacaatttgctttgcttttcttaaatttgcattgagatgggatttgaagcatattgtgctcttgtgaatgttgaagttgcattgtagaagtttagaagctctggctatgggttgcctaaattgatgttttgaggaagcatattaatgttataaacttcgctgactttgaaggttgtgttgtagcatgaggaacacaaataaaacaattctaaatcaaac

SEQ ID NO: 112558 - DNA, 1509 bp, Homo sapiens
agtattgcctgcacaaatatctaccaggtctgcgacgaatagctccagcaacttcgcaccgtgttttccactcagcctaccgacaggcactgtgcagattcaagcggagagatgtccaagcagtgaggccgctgctgcaccggccatcctgagcccctactcggccttcccgtctccgcttccccgccccgcactaggacccctgcagatgatcaggcggcagccggggtgatttccttcctcttttggcaacatggcgggcggagaagctggagtgactctagggcagccgcatctttcgcgtcaggatctcaccaccttggatgttaccaagttgacgccactttcacacgaagttatcagcagacaagccacaattaacataggtacaattggtcatgtagctcatgggaaatccacagtcgtcaaagctatttctggagttcatactgtcaggttcaaaaatgaactagaaagaaatattacaatcaagcttggatatgctaatgctaagatttataagcttgatgacccaagttgccctcggccagaatgttatagatcttgtgggagcagtacacctgacgagtttcctacggacattccagggaccaaagggaacttcaaattagtcagacatgtttcctttgttgactgtcctggccacgatattttgatggctactatgctgaacggtgcagcagtgatggatgcagctcttctgttgataggtaaatacctcacaattggtttggacaaatcaatgtggaacaaatccaagatgaaatatttaaaggggaactaaggcctttaaggatcatatctattacctaagggtgacatgaatgggaactaacatgtcatccaggatgactttcctacctatcagctatcacaaaatactcaaaaagatagacttggggctgatagcttgcgagaattcttgtggtagcatttgagaaaaagaaaaaaagtcaatagttcatttttctcatttaaatcacatgaggtgatttatttagttttaaatgtatgtgtaaaactatttgtgttatggttgtgtgtgtgtatgtctgaactgtctactgtggaagtatttaagatacaaatattcataatacgtgctgaagtgtaggaataagtggagtttgaagggtagcgtatgcttgtttcttatgttagctgttgagagatttcattactagggggtaaaattttttaaaagctgctggtgcggtggctcacgcctgtaatcctagcactttgggaggctgaggtcggcggatcacctgaggtcaggagtttgagaccagcctgaccaacatggagaaacccctctctactaaaaatacaaaattagccgggtgtggtggcgcatgcttgtaatcccatctactcaggagaatctcttgaaccgggaggcagaggtggcagtgagccaagattgcgccattgcactccagtctgggtaacaagagtaaaactacatctcaaaaaaaaaaaaaaaaa

SEQ ID NO: 112559 - DNA, 1289 bp, Homo sapiens
tctccataaagaaagcccacactatattcttagattctttttattcttgcttttgtgtgttttttctgagacagtctcactctgtcacccaggttggagtgcagtggtgcgatctcggctcactacaacctctgcctcctgggttcaagtgattctcctgcctcagcctcccaagtagctgggactacaggcatgagccaccacgcctgacctctttcttcttttttttggaacatttccttattttctggcacaaaatcttccagactcatcttgtaccttctctgttccagttttagaactggccatttctcttataaatgaaaagctgagtgttcaggtgtgctcatggctcttagggtgctgttgcttctaggtcttttgagagcatagagccaggaagcatacacacatttttggctcctgactttttgctctttcccaggttattgagtttgccccttgctttccattcctcgtcacctcatcacagtccataccaccatcactttacacttcacagttagtgcgaaagactcctagtttgcctcttaacttggtcaaaattagtcttcttaaaacattttcatcatgctgtgtttaataatttctagagtcttctcactactttttgatatttgggacttttctagaaacctgcttcaacccatttaagctttccttctgcattgtcttatataaaccctctaaattagactgttttgtgccctaactgtccccataattattcacatcacccctacccactatctacttccttaattatttattttatattttttagaggcagggtctctctgttgaccaggctggagtttagtggcatgatcatagctcactgcagcctcagtgtctaagtagctaggactattggctcacaccaccgtgatcagctaatttttttgttttttgtagacacttggtctcactgtgttgcccagcatgatctcaaactcctggcctcaagccatcctcccacctcagcctctcaaagtgttgggattacagacatgagccaccccgcccagccctgtttcctttattaaggcttccatgctactgtgcccacgatggtctcatcacttgtccaggagatttatctgaattattgccctgtaatttagaaagttaaatttttgttgtctcttaagtaaataattatttgtggtgacttatgcccttttgattttactgtcttttgtgattatatttttttgctattacagacacacgacttccagtgagcccactgggggatcctctgacac

SEQ ID NO: 112560 - DNA, 734 bp, Homo sapiens
agtattgcctgcacaaatatctaccaggtctgcgacgaatagctccagcaacttcgcaccgtgttttccactcagcctaccgacaggcactgtgcagattcaagcggagagatgtccaagcagtgaggccgctgctgcaccggccatcctgagcccctactcggccttcccgtctccgcttccccgccccgcactaggacccctgcagatgatcaggcggcagccggggtgatttccttcctcttttggcaacatggcgggcggagaagctggagtgactctagggcagccgcatctttcgcgtcaggatctcaccaccttggatgttaccaagttgacgccactttcacacgaagttatcagcagacaagccacaattaacataggtacaattggtcatgtagctcatgggaaatccacagtcgtcaaagctatttctggagttcatactgtcaggttcaaaaatgaactagaaagaaatattacaatcaagcttggatatgctaatgctaaggtaagctgtgtactgtggaacgagaaactaactttaattgttgtgcagataacaaatcaaaatctttttttattgaaattttagatttataagcttgatgacccaagttgccctcagcctcccgagtagctgggattacaggcgtgagcccccatgcccagctagtttttatttttatttatttatttatttatttttgagacggagtctttctgtgtcg

SEQ ID NO: 112561 - DNA, 575 bp, Homo sapiens
  misc_feature (533)..(533): n is a, c, g, or t
  misc_feature (553)..(553): n is a, c, g, or t
agtattgcctgcacaaatatctaccaggtctgcgacgaatagctccagcaacttcgcaccgtgttttccactcagcctaccgacaggcactgtgcagattcaagcggagagatgtccaagcagtgaggccgctgctgcaccggccatcctgagcccctactcggccttcccgtctccgcttccccgccccgcactaggacccctgcagatgatcaggcggcagccggggtgatttccttcctcttttggcaacatggcgggcggagaagctggagtgactctagggcagccgcatctttcgcgtcaggatctcaccaccttggatgttaccaagttgacgccactttcacacgaagttatcagcagacaagccacaattaacataggtacaattggtcatgtagctcatgggaaatccacagtcgtcaaagctatttctggagttcatactgtcaggttcaaaaatgaactagaaagaaatattacaatcaagcttggatatgctaatgctaagtgtagatgaaagaattacncgaattgatggagatatgancgccagaagaacttttagcgcc

SEQ ID NO: 112562 - DNA, 428 bp, Homo sapiens
ccgagatcgtaccaccgcactccagactgggtgacagagtgagactgtctcagaaaaaacacacaaaagcaagaataaaaaagaatctaagaatatagtgtgggctttctttatggaggagcaggctttgggaacaaatttgaattcagaagataagcaggtaaaatttatcacaagattgtgtggtaatgagagtgaagtggatgtaagatttatgatttcttttattttcattttgcagtttaattggttggggtcagataagaagaggagtgacaatcaagccaacagtagatgatgactgaagaataccagttaaataatacattcggatggatttggaagttggaattcctcttaacaaccaaggggtttattttcaaagcaatattggggaattgatttcacagttcgttaccttagtaggt

SEQ ID NO: 112563 - DNA, 432 bp, Homo sapiens
aaaaacttaaaggcacaaattctccttgaagaccttctcccttttatgtggccccatattttatgttgctttatctttgaaattttgcatgaaaaggaaatgaatggattcgaatgaaattgtcctttagagcatgattacttgttcccatggacaaatatttttctccccttgctcttcctggcctgaaacacgggaaaccagagtcaaaagttatctccctctccctgtgatgccttgagatttttttctgcgttgtttaatgcctgaaatccaagtcttcctccatgggaaaatactgttataccaaataattctagatgagtaacaaagatctttttaggccttcattttatgttttttcttaactgttatattatgattgtgacatagattatactactactaatttttggatgtttcaaaaggtca

SEQ ID NO: 112564 - DNA, 3108 bp, Homo sapiens
  misc_feature (2908)..(2908): n is a, c, g, or t
  misc_feature (2914)..(2914): n is a, c, g, or t
  misc_feature (2917)..(2917): n is a, c, g, or t
agtattgcctgcacaaatatctaccaggtctgcgacgaatagctccagcaacttcgcaccgtgttttccactcagcctaccgacaggcactgtgcagattcaagcggagagatgtccaagcagtgaggccgctgctgcaccggccatcctgagcccctactcggccttcccgtctccgcttccccgccccgcactaggacccctgcagatgatcaggcggcagccggggtgatttccttcctcttttggcaacatggcgggcggagaagctggagtgactctagggcagccgcatctttcgcgtcaggatctcaccaccttggatgttaccaagttgacgccactttcacacgaagttatcagcagacaagccacaattaacataggtacaattggtcatgtagctcatgggaaatccacagtcgtcaaagctatttctggagttcatactgtcaggttcaaaaatgaactagaaagaaatattacaatcaagcttggatatgctaatgctaagatttataagcttgatgacccaagttgccctcggccagaatgttatagatcttgtgggagcagtacacctgacgagtttcctacggacattccagggaccaaagggaacttcaaattagtcagacatgtttcctttgttgactgtcctggccacgatattttgatggctactatgctgaacggtgcagcagtgatggatgcagctcttctgttgatagctggtaatgaatcttgccctcagcctcagacatcggaacacctggctgctatagagatcatgaaactgaagcatattttgattctacaaaataaaattgatttggtaaaagaaagtcaggctaaagaacaatacgagcagatccttgcatttgtccaaggtacagtagcagagggagctcccattattccaatttcagctcagctgaaatacaatattgaagttgtttgtgagtacatagtaaagaaaattccagtacccccaagagactttacttcagagccccggcttattgttattagatcttttgatgtcaacaaacctggctgtgaagttgatgaccttaagggaggtgtagctggtggtagtatcctaaaaggagtattaaaggtgggccaggagatagaagtaagacctggtattgtttccaaagatagtgaaggaaaactcatgtgtaaaccaatcttttccaaaattgtatcactttttgcggagcataatgatctgcaatatgctgctccaggcggtcttattggagttggaacaaaaattgaccccactttgtgccgggctgacagaatggtggggcaagtacttggtgcagtcggagctttacctgagatattcacagaattggaaatttcctatttcctgcttagacggcttctaggtgtacgcactgaaggagacaagaaagcagcaaaggttcaaaagctgtctaagaatgaagtgctcatggtgaacataggatccctgtcaacaggagggagagttagtgctgtcaaggccgatttgggtaaaattgttttgaccaatccagtgtgcacagaggtaggagaaaaaattgcccttagccgaagagttgaaaaacactggcgtttaattggttggggtcagataagaagaggagtgacaatcaagccaacagtagatgatgactgaagaataccagttaaataatacattcggatggatttggaagttggaattcctcttaacaaccaaggggtttattttcaaagcaatattggggaattgatttcacagttcgttaccttagtaggtaacggtaaggttattcttttttttttttttttttggttatgaaaacttagggactaaaattaatataaaaattggcataatgttggattgaatctacattttggcagaagttaaacattcccacataatgtcaaaattatacatcatgcagttctgtttttttgtttgttttattttgttttgtttttgagtctggctctgtcacccaggctggagtgcagtggcgtgatctgcaacctctgccccccgggttcaagcgattctcctgcctcagcctcccgagtagctgagattacaggtgcgcgccaccacacttggctaatttttgtattattagtagagacggggtttcagcatgttggctaggccggtctctcctgacctcagggtgatcagcccacctcggcctcacaaagtgctgggattacaggcgtgagccaccttgcccagcccacatcatacagtttgaaatgaaactttgccacaaccagcctttgctgtagcacacacatatatcactgaacctgtttgaaataaagttttttttctttttcatgattcgtctttgagtacctccaggctgaaagactgttgtaccagtaaaaacttaaaggcacaaattctccttgaagaccttctcccttttatgtggccccatattttatgttgctttatctttgaaattttgcatgaaaaggaaatgaatggattcgaatgaaattgtcctttagagcatgattacttgttcccatggacaaatatttttctccccttgctcttcctggcctgaaacacgggaaaccagagtcaaaagttatctccctctccctgtgatgccttgagatttttttctgcgttgtttaatgcctgaaatccaagtcttcctccatgggaaaatactgttataccaaataattctagatgagtaacaaagatctttttaggccttcattttatgttttttcttaactgttatattatgattgtgacatagattatactactactaatttttggatgtttcaaaaggtcaagaagtaaaagatgttagaaagcaaaaaaaaaaaaaaaaaaaaaaaaaaaaaaaaaaaaaaaaaaaaggggaggagaganaaaaanatnaccagaaggggcccaaagagaaagcaaccacagttagtgaaaaacagggggccacttaagacgagggcacaaataagaacaaagagagaaggacaggagaaaaaaaaagtgaacgcgcgaaaaacggaaaccagtaagaactgggaaagagcacacaacaaggggggagacacataagggcacaaatacag

SEQ ID NO: 112565 - DNA, 2988 bp, Homo sapiens
  misc_feature (2788)..(2788): n is a, c, g, or t
  misc_feature (2794)..(2794): n is a, c, g, or t
  misc_feature (2797)..(2797): n is a, c, g, or t
agtattgcctgcacaaatatctaccaggtctgcgacgaatagctccagcaacttcgcaccgtgttttccactcagcctaccgacaggcactgtgcagattcaagcggagagatgtccaagcagtgaggccgctgctgcaccggccatcctgagcccctactcggccttcccgtctccgcttccccgccccgcactaggacccctgcagatgatcaggcggcagccggggtgatttccttcctcttttggcaacatggcgggcggagaagctggagtgactctagggcagccgcatctttcgcgtcaggatctcaccaccttggatgttaccaagttgacgccactttcacacgaagttatcagcagacaagccacaattaacataggtacaattggtcatgtagctcatgggaaatccacagtcgtcaaagctatttctggagttcatactgtcaggttcaaaaatgaactagaaagaaatattacaatcaagcttggatatgctaatgctaagatttataagcttgatgacccaagttgccctcggccagaatgttatagatcttgtgggagcagtacacctgacgagtttcctacggacattccagggaccaaagggaacttcaaattagtcagacatgtttcctttgttgactgtcctggccacgatattttgatggctactatgctgaacggtgcagcagtgatggatgcagctcttctgttgatagctggtaatgaatcttgccctcagcctcagacatcggaacacctggctgctatagagatcatgaaactgaagcatattttgattctacaaaataaaattgatttggtaaaagaaagtcaggctaaagaacaatacgagcagatccttgcatttgtccaaggtacagtagcagagggagctcccattattccaatttcagctcagctgaaatacaatattgaagttgtttgtgagtacatagtaaagaaaattccagtacccccaagagactttacttcagagccccggcttattgttattagatcttttgatgtcaacaaacctggctgtgaagttgatgaccttaagggaggtgtagctggtggtagtatcctaaaaggagtattaaaggtgggccaggagatagaagtaagacctggtattgtttccaaagatagtgaaggaaaactcatgtgtaaaccaatcttttccaaaattgtatcactttttgcggagcataatgatctgcaatatgctgctccaggcggtcttattggagttggaacaaaaattgaccccactttgtgccgggctgacagaatggtggggcaagtacttggtgcagtcggagctttacctgagatattcacagaattggaaatttcctatttcctgcttagacggcttctaggtgtacgcactgaaggagacaagaaagcagcaaaggttcaaaagctgtctaagaatgaagtgctcatggtgaacataggatccctgtcaacaggagggagagttagtgctgtcaaggccgatttgggtaaaattgttttgaccaatccagtgtgcacagaggtaggagaaaaaattgcccttagccgaagagttgaaaaacactggcgtttaattggttggggtcagataagaagaggagtgacaatcaagccaacagtagatgatgactgaagaataccagttaaataatacattcggatggatttggaagttggaattcctcttaacaaccaaggggtttattttcaaagcaatattggggaattgatttcacagttcgttaccttagtaggtaacggtaaggttattcttttttttttttttttttggttatgaaaacttagggactaaaattaatataaaaattggcataatgttggattgaatctacattttggcagaagttaaacattcccacataatgtcaaaattatacatcatgcagttctgtttttttgtttgttttattttgttttgtttttgagtctggctctgtcacccaggctggagtgcagtggcgtgatctgcaacctctgccccccgggttcaagcgattctcctgcctcagcctcccgagtagctgagattacaggtgcgcgccaccacacttggctaatttttgtattattagtagagacggggtttcagcatgttggctaggccggtctctcctgacctcagggtgatcagcccacctcggcctcacaaagtgctgggattacaggcgtgagccaccttgcccagcccacatcatacagtttgaaatgaaactttgccacaaccagcctttgctgtagcacacacatatatcactgaacctgtttgaaataaagttttttttctttttcatgattcgtctttgagtacctccaggctgaaagactgttgtaccagtaaaaacttaaaggcacaaattctccttgaagaccttctcccttttatgtggccccatattttatgttgctttatctttgaaattttgcatgaaaaggaaatgaatggattcgaatgaaattgtcctttagagcatgattacttgttcccatggacaaatcttcctccatgggaaaatactgttataccaaataattctagatgagtaacaaagatctttttaggccttcattttatgttttttcttaactgttatattatgattgtgacatagattatactactactaatttttggatgtttcaaaaggtcaagaagtaaaagatgttagaaagcaaaaaaaaaaaaaaaaaaaaaaaaaaaaaaaaaaaaaaaaaaaaggggaggagaganaaaaanatnaccagaaggggcccaaagagaaagcaaccacagttagtgaaaaacagggggccacttaagacgagggcacaaataagaacaaagagagaaggacaggagaaaaaaaaagtgaacgcgcgaaaaacggaaaccagtaagaactgggaaagagcacacaacaaggggggagacacataagggcacaaatacag

SEQ ID NO: 112566 - DNA, 3516 bp, Homo sapiens
agtattgcctgcacaaatatctaccaggtctgcgacgaatagctccagcaacttcgcaccgtgttttccactcagcctaccgacaggcactgtgcagattcaagcggagagatgtccaagcagtgaggccgctgctgcaccggccatcctgagcccctactcggccttcccgtctccgcttccccgccccgcactaggacccctgcagatgatcaggcggcagccggggtgatttccttcctcttttggcaacatggcgggcggagaagctggagtgactctagggcagccgcatctttcgcgtcaggatctcaccaccttggatgttaccaagttgacgccactttcacacgaagttatcagcagacaagccacaattaacataggtacaattggtcatgtagctcatgggaaatccacagtcgtcaaagctatttctggagttcatactgtcaggttcaaaaatgaactagaaagaaatattacaatcaagcttggatatgctaatgctaagatttataagcttgatgacccaagttgccctcggccagaatgttatagatcttgtgggagcagtacacctgacgagtttcctacggacattccagggaccaaagggaacttcaaattagtcagacatgtttcctttgttgactgtcctggccacgatattttgatggctactatgctgaacggtgcagcagtgatggatgcagctcttctgttgatagctggtaatgaatcttgccctcagcctcagacatcggaacacctggctgctatagagatcatgaaactgaagcatattttgattctacaaaataaaattgatttggtaaaagaaagtcaggctaaagaacaatacgagcagatccttgcatttgtccaaggtacagtagcagagggagctcccattattccaatttcagctcagctgaaatacaatattgaagttgtttgtgagtacatagtaaagaaaattccagtacccccaagagactttacttcagagccccggcttattgttattagatcttttgatgtcaacaaacctggctgtgaagttgatgaccttaagggaggtgtagctggtggtagtatcctaaaaggagtattaaaggtgggccaggagatagaagtaagacctggtattgtttccaaagatagtgaaggaaaactcatgtgtaaaccaatcttttccaaaattgtatcactttttgcggagcataatgatctgcaatatgctgctccaggcggtcttattggagttggaacaaaaattgaccccactttgtgccgggctgacagaatggtggggcaagtacttggtgcagtcggagctttacctgagatattcacagaattggaaatttcctatttcctgcttagacggcttctaggtgtacgcactgaaggagacaagaaagcagcaaagtttaattggttggggtcagataagaagaggagtgacaatcaagccaacagtagatgatgactgaagaataccagttaaataatacattcggatggatttggaagttggaattcctcttaacaaccaaggggtttattttcaaagcaatattggggaattgatttcacagttcgttaccttagtaggtaacggtaaggttattcttttttttttttttttttggttatgaaaacttagggactaaaattaatataaaaattggcataatgttggattgaatctacattttggcagaagttaaacattcccacataatgtcaaaattatacatcatgcagttctgtttttttgtttgttttattttgttttgtttttgagtctggctctgtcacccaggctggagtgcagtggcgtgatctgcaacctctgccccccgggttcaagcgattctcctgcctcagcctcccgagtagctgagattacaggtgcgcgccaccacacttggctaatttttgtattattagtagagacggggtttcagcatgttggctaggccggtctctcctgacctcagggtgatcagcccacctcggcctcacaaagtgctgggattacaggcgtgagccaccttgcccagcccacatcatacagtttgaaatgaaactttgccacaaccagcctttgctgtagcacacacatatatcactgaacctgtttgaaataaagttttttttctttttcatgattcgtctttgagtacctccaggctgaaagactgttgtaccagtaaaaacttaaaggcacaaattctccttgaagaccttctcccttttatgtggccccatattttatgttgctttatctttgaaattttgcatgaaaaggaaatgaatggattcgaatgaaattgtcctttagagcatgattacttgttcccatggacaaatatttttctccccttgctcttcctggcctgaaacacgggaaaccagagtcaaaagttatctccctctccctgtgatgccttgagatttttttctgcgttgtttaatgcctgaaatccaagtcttcctccatgggaaaatactgttataccaaataattctagatgagtaacaaagatctttttaggccttcattttatgttttttcttaactgttatattatgattgtgacatagattatactactactaatttttggatgtttcaaaaggtcaagaagtaaaagatgttagaaagcaatgagtgagtccttttgatttttaacttattccccatgtccctatacttcgtgtgcttttcctttttttttttgagacggaggctcactccgtcacctaggctagagtacagtggcacgatcttggctcgctgcaacctctgcctccctgattcaagtgattctcgtgcttcagcctcccatgtagctgatattacaggcacttgccaccatacccggctaattttggtatttttagtagagatggggtttcaccatgttgcccaggctggtcttgaactcctaacctcaggtgatccgcccgcctctgccttccaaagtgctgggattacaggcgtgagccactctgcccggcttatttttctttatgtttttgcttcgtaagaggttctgttgagcagtgatttgcaactcttgctgacgttgctggggaagctttaaaaaaaaaaaagatgccccacagagattctgattttaattgttctgatttaattggcttggagtagaattcaggcattgatatctttaaaaactccccagtgttgagaaacaaatttagagagttgagaagtaggtatattaaattacagaatcttactgagttttggtagactgataatacaatttgctttgcttttcttaaatttgcattgagatgggatttgaagcatattgtgctcttgtgaatgttgaagttgcattgtagaagtttagaagctctggctatgggttgcctaaattgatgttttgaggaagcatattaatgttataaacttcgctgactttgaaggttgtgttgtagcatgaggaacacaaataaaacaattctaaatcaaac

SEQ ID NO: 112567 - DNA, 3218 bp, Homo sapiens
agtattgcctgcacaaatatctaccaggtctgcgacgaatagctccagcaacttcgcaccgtgttttccactcagcctaccgacaggcactgtgcagattcaagcggagagatgtccaagcagtgaggccgctgctgcaccggccatcctgagcccctactcggccttcccgtctccgcttccccgccccgcactaggacccctgcagatgatcaggcggcagccggggtgatttccttcctcttttggcaacatggcgggcggagaagctggagtgactctagggcagccgcatctttcgcgtcaggatctcaccaccttggatgttaccaagttgacgccactttcacacgaagttatcagcagacaagccacaattaacataggtacaattggtcatgtagctcatgggaaatccacagtcgtcaaagctatttctggagttcatactgtcaggttcaaaaatgaactagaaagaaatattacaatcaagcttggatatgctaatgctaagatttataagcttgatgacccaagttgccctcggccagaatgttatagatcttgtgggagcagtacacctgacgagtttcctacggacattccagggaccaaagggaacttcaaattagtcagacatgtttcctttgttgactgtcctggccacgatattttgatggctactatgctgaacggtgcagcagtgatggatgcagctcttctgttgatagctggtaatgaatcttgccctcagcctcagacatcggaacacctggctgctatagagatcatgaaactgaagcatattttgattctacaaaataaaattgatttggtaaaagaaagtcaggctaaagaacaatacgagcagatccttgcatttgtccaaggtacagtagcagagggagctcccattattccaatttcagctcagctgaaatacaatattgaagttgtttgtgagtacatagtaaagaaaattccagtacccccaagagactttacttcagagccccggcttattgttattagatcttttgatgtcaacaaacctggctgtgaagttgatgaccttaagggaggtgtagctggtggtagtatcctaaaaggagtattaaaggtgggccaggagatagaagtaagacctggtattgtttccaaagatagtgaaggaaaactcatgtgtaaaccaatcttttccaaaattgtatcactttttgcggagcataatgatctgcaatatgctgctccaggcggtcttattggagttggaacaaaaattgaccccactttgtgccgggctgacagaatggtggggcaagtacttggtgcagtcggagctttacctgagatattcacagaattggaaatttcctatttcctgcttagacggcttctaggtgtacgcactgaaggagacaagaaagcagcaaaggttcaaaagctgtctaagaatgaagtgctcatggtgaacataggatccctgtcaacaggagggagagttagtgctgtcaaggccgatttgggtaaaattgttttgaccaatccagtgtgcacagaggtaggagaaaaaattgcccttagccgaagagttgaaaaacactggcggtaagtttgttagtctttgccactgtctaattaaaaaaagacacagtcttgtacagaaaaaaaagcacacaatcttccttgaggacaacagttactgtggctttcagtctcaactatttatttggatgactttgaaaactatacttcggccggccaccttgcccagcccacatcatacagtttgaaatgaaactttgccacaaccagcctttgctgtagcacacacatatatcactgaacctgtttgaaataaagttttttttctttttcatgattcgtctttgagtacctccaggctgaaagactgttgtaccagtaaaaacttaaaggcacaaattctccttgaagaccttctcccttttatgtggccccatattttatgttgctttatctttgaaattttgcatgaaaaggaaatgaatggattcgaatgaaattgtcctttagagcatgattacttgttcccatggacaaatatttttctccccttgctcttcctggcctgaaacacgggaaaccagagtcaaaagttatctccctctccctgtgatgccttgagatttttttctgcgttgtttaatgcctgaaatccaagtcttcctccatgggaaaatactgttataccaaataattctagatgagtaacaaagatctttttaggccttcattttatgttttttcttaactgttatattatgattgtgacatagattatactactactaatttttggatgtttcaaaaggtcaagaagtaaaagatgttagaaagcaatgagtgagtccttttgatttttaacttattccccatgtccctatacttcgtgtgcttttcctttttttttttgagacggaggctcactccgtcacctaggctagagtacagtggcacgatcttggctcgctgcaacctctgcctccctgattcaagtgattctcgtgcttcagcctcccatgtagctgatattacaggcacttgccaccatacccggctaattttggtatttttagtagagatggggtttcaccatgttgcccaggctggtcttgaactcctaacctcaggtgatccgcccgcctctgccttccaaagtgctgggattacaggcgtgagccactctgcccggcttatttttctttatgtttttgcttcgtaagaggttctgttgagcagtgatttgcaactcttgctgacgttgctggggaagctttaaaaaaaaaaaagatgccccacagagattctgattttaattgttctgatttaattggcttggagtagaattcaggcattgatatctttaaaaactccccagtgttgagaaacaaatttagagagttgagaagtaggtatattaaattacagaatcttactgagttttggtagactgataatacaatttgctttgcttttcttaaatttgcattgagatgggatttgaagcatattgtgctcttgtgaatgttgaagttgcattgtagaagtttagaagctctggctatgggttgcctaaattgatgttttgaggaagcatattaatgttataaacttcgctgactttgaaggttgtgttgtagcatgaggaacacaaataaaacaattctaaatcaaac

SEQ ID NO: 112568 - DNA, 2944 bp, Homo sapiens
ggacgcgtgggtcgacccacgcgtcacctggctgctatagagatcatgaaactgaagcatattttgattctacaaaataaaattgatttggtaaaagaaagtcaggctaaagaacaatacgagcagatccttgcatttgtccaaggtacagtagcagagggagctcccattattccaatttcagctcagctgaaatacaatattgaagttgtttgtgagtacatagtaaagaaaattccagtacccccaagagactttacttcagagccccggcttattgttattagatcttttgatgtcaacaaacctggctgtgaagttgatgaccttaagggaggtgtagctggtggtagtatcctaaaaggagtattaaaggtgggccaggagatagaagtaagacctggtattgtttccaaagatagtgaaggaaaactcatgtgtaaaccaatcttttccaaaattgtatcactttttgcggagcataatgatctgcaatatgctgctccaggcggtcttattggagttggaacaaaaattgaccccactttgtgccgggctgacagaatggtggggcaagtacttggtgcagtcggagctttacctgagatattcacagaattggaaatttcctatttcctgcttagacggcttctaggtgtacgcactgaaggagacaagaaagcagcaaaggttcaaaagctgtctaagaatgaagtgctcatggtgaacataggatccctgtcaacaggagggagagttagtgctgtcaaggccgatttgggtaaaattgttttgaccaatccagtgtgcacagaggtaggagaaaaaattgcccttagccgaagagttgaaaaacactggcgtttaattggttggggtcagataagaagaggagtgacaatcaagccaacagtagatgatgactgaagaataccagttaaataatacattcggatggatttggaagttggaattcctcttaacaaccaaggggtttattttcaaagcaatattggggaattgatttcacagttcgttaccttagtaggtaacggtaaggttattcttttttttttttttttttggttatgaaaacttagggactaaaattaatataaaaattggcataatgttggattgaatctacattttggcagaagttaaacattcccacataatgtcaaaattatacatcatgcagttctgtttttttgtttgttttattttgttttgtttttgagtctggctctgtcacccaggctggagtgcagtggcgtgatctgcaacctctgccccccgggttcaagcgattctcctgcctcagcctcccgagtagctgagattacaggtgcgcgccaccacacttggctaatttttgtattattagtagagacggggtttcagcatgttggctaggccggtctctcctgacctcagggtgatcagcccacctcggcctcacaaagtgctgggattacaggcgtgagccaccttgcccagcccacatcatacagtttgaaatgaaactttgccacaaccagcctttgctgtagcacacacatatatcactgaacctgtttgaaataaagttttttttctttttcatgattcgtctttgagtacctccaggctgaaagactgttgtaccagtaaaaacttaaaggcacaaattctccttgaagaccttctcccttttatgtggccccatattttatgttgctttatctttgaaattttgcatgaaaaggaaatgaatggattcgaatgaaattgtcctttagagcatgattacttgttcccatggacaaatatttttctccccttgctcttcctggcctgaaacacgggaaaccagagtcaaaagttatctccctctccctgtgatgccttgagatttttttctgcgttgtttaatgcctgaaatccaagtcttcctccatgggaaaatactgttataccaaataattctagatgagtaacaaagatctttttaggccttcattttatgttttttcttaactgttatattatgattgtgacatagattatactactactaatttttggatgtttcaaaaggtcaagaagtaaaagatgttagaaagcaatgagtgagtccttttgatttttaacttattccccatgtccctatacttcgtgtgcttttcctttttttttttgagacggaggctcactccgtcacctaggctagagtacagtggcacgatcttggctcgctgcaacctctgcctccctgattcaagtgattctcgtgcttcagcctcccatgtagctgatattacaggcacttgccaccatacccggctaattttggtatttttagtagagatggggtttcaccatgttgcccaggctggtcttgaactcctaacctcaggtgatccgcccgcctctgccttccaaagtgctgggattacaggcgtgagccactctgcccggcttatttttctttatgtttttgcttcgtaagaggttctgttgagcagtgatttgcaactcttgctgacgttgctggggaagctttaaaaaaaaaaaagatgccccacagagattctgattttaattgttctgatttaattggcttggagtagaattcaggcattgatatctttaaaaactccccagtgttgagaaacaaatttagagagttgagaagtaggtatattaaattacagaatcttactgagttttggtagactgataatacaatttgctttgcttttcttaaatttgcattgagatgggatttgaagcatattgtgctcttgtgaatgttgaagttgcattgtagaagtttagaagctctggctatgggttgcctaaattgatgttttgaggaagcatattaatgttataaacttcgctgactttgaaggttgtgttgtagcatgaggaacacaaataaaacaattctaaatcaaac

SEQ ID NO: 112569 - DNA, 2771 bp, Homo sapiens
agtattgcctgcacaaatatctaccaggtctgcgacgaatagctccagcaacttcgcaccgtgttttccactcagcctaccgacaggcactgtgcagattcaagcggagagatgtccaagcagtgaggccgctgctgcaccggccatcctgagcccctactcggccttcccgtctccgcttccccgccccgcactaggacccctgcagatgatcaggcggcagccggggtgatttccttccaaagatagtgaaggaaaactcatgtgtaaaccaatcttttccaaaattgtatcactttttgcggagcataatgatctgcaatatgctgctccaggcggtcttattggagttggaacaaaaattgaccccactttgtgccgggctgacagaatggtggggcaagtacttggtgcagtcggagctttacctgagatattcacagaattggaaatttcctatttcctgcttagacggcttctaggtgtacgcactgaaggagacaagaaagcagcaaaggttcaaaagctgtctaagaatgaagtgctcatggtgaacataggatccctgtcaacaggagggagagttagtgctgtcaaggccgatttgggtaaaattgttttgaccaatccagtgtgcacagaggtaggagaaaaaattgcccttagccgaagagttgaaaaacactggcgtttaattggttggggtcagataagaagaggagtgacaatcaagccaacagtagatgatgactgaagaataccagttaaataatacattcggatggatttggaagttggaattcctcttaacaaccaaggggtttattttcaaagcaatattggggaattgatttcacagttcgttaccttagtaggtaacggtaaggttattcttttttttttttttttttggttatgaaaacttagggactaaaattaatataaaaattggcataatgttggattgaatctacattttggcagaagttaaacattcccacataatgtcaaaattatacatcatgcagttctgtttttttgtttgttttattttgttttgtttttgagtctggctctgtcacccaggctggagtgcagtggcgtgatctgcaacctctgccccccgggttcaagcgattctcctgcctcagcctcccgagtagctgagattacaggtgcgcgccaccacacttggctaatttttgtattattagtagagacggggtttcagcatgttggctaggccggtctctcctgacctcagggtgatcagcccacctcggcctcacaaagtgctgggattacaggcgtgagccaccttgcccagcccacatcatacagtttgaaatgaaactttgccacaaccagcctttgctgtagcacacacatatatcactgaacctgtttgaaataaagttttttttctttttcatgattcgtctttgagtacctccaggctgaaagactgttgtaccagtaaaaacttaaaggcacaaattctccttgaagaccttctcccttttatgtggccccatattttatgttgctttatctttgaaattttgcatgaaaaggaaatgaatggattcgaatgaaattgtcctttagagcatgattacttgttcccatggacaaatatttttctccccttgctcttcctggcctgaaacacgggaaaccagagtcaaaagttatctccctctccctgtgatgccttgagatttttttctgcgttgtttaatgcctgaaatccaagtcttcctccatgggaaaatactgttataccaaataattctagatgagtaacaaagatctttttaggccttcattttatgttttttcttaactgttatattatgattgtgacatagattatactactactaatttttggatgtttcaaaaggtcaagaagtaaaagatgttagaaagcaatgagtgagtccttttgatttttaacttattccccatgtccctatacttcgtgtgcttttcctttttttttttgagacggaggctcactccgtcacctaggctagagtacagtggcacgatcttggctcgctgcaacctctgcctccctgattcaagtgattctcgtgcttcagcctcccatgtagctgatattacaggcacttgccaccatacccggctaattttggtatttttagtagagatggggtttcaccatgttgcccaggctggtcttgaactcctaacctcaggtgatccgcccgcctctgccttccaaagtgctgggattacaggcgtgagccactctgcccggcttatttttctttatgtttttgcttcgtaagaggttctgttgagcagtgatttgcaactcttgctgacgttgctggggaagctttaaaaaaaaaaaagatgccccacagagattctgattttaattgttctgatttaattggcttggagtagaattcaggcattgatatctttaaaaactccccagtgttgagaaacaaatttagagagttgagaagtaggtatattaaattacagaatcttactgagttttggtagactgataatacaatttgctttgcttttcttaaatttgcattgagatgggatttgaagcatattgtgctcttgtgaatgttgaagttgcattgtagaagtttagaagctctggctatgggttgcctaaattgatgttttgaggaagcatattaatgttataaacttcgctgactttgaaggttgtgttgtagcatgaggaacacaaataaaacaattctaaatcaaac

SEQ ID NO: 112570 - DNA, 1370 bp, Homo sapiens
agtattgcctgcacaaatatctaccaggtctgcgacgaatagctccagcaacttcgcaccgtgttttccactcagcctaccgacaggcactgtgcagattcaagcggagagatgtccaagcagtgaggccgctgctgcaccggccatcctgagcccctactcggccttcccgtctccgcttccccgccccgcactaggacccctgcagatgatcaggcggcagccggggtgatttccttcctcttttggcaacatggcgggcggagaagctggagtgactctagggcagccgcatctttcgcgtcaggatctcaccaccttggatgttaccaagttgacgccactttcacacgaagttatcagcagacaagccacaattaacataggtacaattggtcatgtagctcatgggaaatccacagtcgtcaaagctatttctggagttcatactgtcaggttcaaaaatgaactagaaagaaatattacaatcaagcttggatatgctaatgctaagatttataagcttgatgacccaagttgccctcggccagaatgttatagatcttgtgggagcagtacacctgacgagtttcctacggacattccagggaccaaagggaacttcaaattagtcagacatgtttcctttgttgactgtcctggccacgatattttgatggctactatgctgaacggtgcagcagtgatggatgcagctcttctgttgatagctggtaatgaatcttgccctcagcctcagacatcggaacacctggctgctatagagatcatgaaactgaagcatattttgattctacaaaataaaattgatttggtaaaagaaagtcaggctaaagaacaatacgagcagatccttgcatttgtccaaggcagaggactccaaattcactttagtgttatgggaaaagattcccgtctgctggtggaatataataggtgtacagggaggcagttgtggaggaccatgtgagcagctgggggctgggaagtccagcacggaggaaacagggagtctcatttaactattgggatgttaaggagttaccagactgtgattttattacagagggagtctcattatccacatcactgcccggaaatcactaatggagtaatcccttatcacagagaagagtaatagaaactcagcatataatccgcgcgcgcacacacacacccctcagcataaatttcctaaagctaaaattatatctaacactgtaactgacaacagcaccataacctactgaaagagatgtaaataaaagcctcccatatctgaaacataaaaatgtttttctatataactattggattgtatatacatactactctgaaagtttgtaagg

SEQ ID NO: 112571 - DNA, 1578 bp, Homo sapiens
agtattgcctgcacaaatatctaccaggtctgcgacgaatagctccagcaacttcgcaccgtgttttccactcagcctaccgacaggcactgtgcagattcaagcggagagatgtccaagcagtgaggccgctgctgcaccggccatcctgagcccctactcggccttcccgtctccgcttccccgccccgcactaggacccctgcagatgatcaggcggcagccggggtgatttccttcctcttttggcaacatggcgggcggagaagctggagtgactctagggcagccgcatctttcgcgtcaggatctcaccaccttggatgttaccaagttgacgccactttcacacgaagttatcagcagacaagccacaattaacataggtacaattggtcatgtagctcatgggaaatccacagtcgtcaaagctatttctggagttcatactgtcaggttcaaacacatgacactcagcacacagcacaatcattcaccacatcaagccttgggatcatgctcaatgctcaagcatttatcacagcttgcatgcacccaaagattgcccctcgggcccagcacatgttcatcagcatcattggtggagcagccagatcaccaccatggcacagcagctttccctcacggcaccattcacaggggtcacctaaacaggggcacactctcaacacacattcatgatccagacacccatgttctctccctctctaggtatgacaccatggtcgcgtagggcccccacagccatcatatcattgagcatcgggctacactcaattagacattgcaaaccacgaggaagcctaagaccagcgtagcaatgtcgcatagcccagcactccatcacggtagtcagggcatccagcttaggggctcacaatagcacactccatttggcccacccacgcaggcgcatcacagtcaccaaattcaagaggcaaaacgacgcattgggggattagcagtttaatccaggcaggcaatcccagtggcaaaaagttggcaaaggacaatttattagataagggcattagacagttaaccagaaaaaaattcaaaacagttacgggaatcatgaagagcatccacaaaaagacacaaaatgttcataggggcgtgcacagaaaggcagaaagaaacacttaacccagaaaaggaccacaggtacactatccccattaggggcacacatacacgggcaaccacaaaagggcagtattacaccaaggaaacagagaccacaagcaacacaggagaagagcacataccccacgaaccacattgatcaaattatgccgccacaacaaatttatgtagccaagggcctatccaagacggacctggaccaagaagagtaaccagcacagcacactcatggcaacagaggcgacgaggaagaaagggacgacacagctcaacccaacttacagagtacagcacggccacagacaactgttgcccaacgatactcacaccccaaccaagcagaaaacaaaccatcgtcaacccacagcacgacaagaaccccacagaacagataaacaggggcagacacca

SEQ ID NO: 112572 - DNA, 329 bp, Homo sapiens
gagccaaaaatagggcagtgggcaagtgtcctgtgctaccaaggttgcgggctgtccaggatggtgggtgggttatggacagttcctggaagtgggcaggctcaccacccagaccccagactccaggaggttcagtctgcctcccctcatctgcaggagtgggcactaaaccaagaaaatgggagcaatgaatcacggggttcacagccaataagaatccccaaagccgtgcgcagtggctcatgcctgtaatcccaacattttgggaggccaaagtgagaggattacttgaagccaagagtttgaggctgcagtgagctatgactgtt

SEQ ID NO: 112573 - DNA, 216 bp, Homo sapiens
cactccattcaaggaagtatcacggatgacttagatgagcagttcgaacagtcgaaaggacctgaataggctgagagcagtgactcacacctgtaatgccagcactttgggaggccaaggcaggcagatcatctgaagccagtagttcaagaccagcctgaccaacatggtgaaaccccatctctactaaaaatacaaaaattagctgggcatgga

SEQ ID NO: 112574 - DNA, 4650 bp, Homo sapiens
  misc_feature (1)..(2): n is a, c, g, or t
  misc_feature (298)..(298): n is a, c, g, or t
  misc_feature (342)..(342): n is a, c, g, or t
  misc_feature (1016)..(1016): n is a, c, g, or t
  misc_feature (1124)..(1124): n is a, c, g, or t
  misc_feature (2816)..(2816): n is a, c, g, or t
  misc_feature (2952)..(2952): n is a, c, g, or t
  misc_feature (2987)..(2987): n is a, c, g, or t
  misc_feature (3083)..(3083): n is a, c, g, or t
  misc_feature (3089)..(3089): n is a, c, g, or t
nngtctccatagtttagttttttccagaatgtcatatagttggaatcatacagtatacagcctcttcagattggcttctagtcacctggcaatgtgcatttaaatttcctctatgtcttttcatgggttgatagctcatttctttttagcactgaataatattttggttgtaccacagttcacccattcatatactaaaggacatcttagttgcttccaggttttagcaattatgaatcaagctgctataaacattcatgtgtaggtttttgtgtagacataagtttgcacctccttngggtaaaatgcaaagagtgatattgctgtatcagatggtaagantatgtttaattttatcagaaactgccagactgtcttgcaaaatggttacacctgtttgtattcccttcagcaatacgttgaagttcttgttgcatcgcatcttggccagcatttgtttttgtcagtgtttcggattgtcaccattctagtaggttttgtagtgctgtctcattttaatttgcagttccgtcaatgtaatttgcaattctatcaatggcatacgatgtaaagtttcattttaacaatcatatatctgaagaatattttcccagatattcatgggtgaagatatttaggaatgcatgtattgaggggagaaaacttgggtatatatatataaagagattgtcttatattttttaaactacccctcactaactagcagcgaataacatatattggaaattgttgtttttaattgcctgaatttcaaatgttaagttttccaagcattcactattgattaggttggaaagtttacatgctattgagttgtatcaatagaaacgtatatttttttccttttcattttaaaacgtttaaaaatttttttggagtgaggtctcattctgtcacccaggctggagtgcagtgacgcaatcataggtcaccatacctctaattcctgacctcaagggatcctcctgcgttggtcccccaaaaccctgagattncaggcactggacaccatgcctgacccttatttacttttttttttttaaagtggagtctccctctgtcgcccacgctggagtgcagtggcacgatctcagctcactgcnaactctgtctcctgatcaagtgattctcctgtctcagccttctaagtagctgggatacaggggtgcaccaccatgcccggctaactttttttttttttttttttttttgagacagagtctttctctgttgcccaggctagagagcagtggtgttatcatggctcattgcagcctccaccttctggtttcaagcgattttcctgcctcagcctcccgagtagctgggactacaggtgcccaccaccacacctggctgattttttgtgtttttaatagagatgggtttcaccatgttgaccaggctggtctcaaactcctgacctcaggtgatctgcccgcttcggcctcccaaactgcttggattacaggcttgagccaccgtgcttggccttaatttcttttgtatttttagtatttatggggtttcaccatgttggccaggctggtccctaactcctgacctcaagtgatctgcctgcctcagcctcccatagtgctgggattacaagtgtgagccaccatgtccggcccagtttacttttattagaaaagattcatttgctgatgtatattgttcagtatcttaatacttttttcatgagttaatactttcttggcaaagaggcctaatatcttgaggtttttaaaaatacccatgaatatttcatgtaagtgatttttgcttcattctttgtgtctacaatttgttatctaatatttctggctcctaacgattttcttttttgttttttttgagatgcagtcttgctgtgtcgccaagcttttcatagagatggggtttcaccatcatggccaggctggtctcgatcccctgacctcaggtgatctgcctgcctcagccccccaaagtgctgaggttacaggagtgagccaccgcgcctggccaacagttcttatttaatctttctcatgaaagtttaattggttataaccttattgttctgttatgtaaccttctttagtgaaggaaaaggtaatagaatatagtttgctcacactaaaatattttcaattgctaaatatagttttttttagggaatttatttttaggaatatttagatattcctaattgattaaaaaggctgaatcctgttgtcagaacttactatatttttctctagaattatatattttttagtggatttaaatgttctacattattttagcattttcgttttttgagacatagaacctaaatagcatgtggtgattcctggacaattcttaaagctttttttgagataaacatgagaggtctttatcaataaagaattttgactgtgacctaaaaaagagtattgattgtgcccattaagattgcattcactcaaacaagagttatattgataaagtgttagatgaatacctctcgtcattgatcattaaatggtgttccagttgacacagttaaagcagtttttatttagttcagtgagtgtatccccaagtttaggtggtcatactacactttagctttacctgagtactgtgttaagtcattcctttaaattaggttattggtaatacacacacacatatacacccacaaaatatacgtgttgagtatcccttatctaaaatgtttgggactagaagtgtattggaatttggatttttttgaattttgaaacatttgtgtattatgtaatgagatatcttggggatggganccagatccaaatatgaaattcacttatgtttcatatatgtcttatatacatagcctgaaggtaacttcatagaatttaatttttttattttttattttttatttttttgagacggagtcttgctgtatcgcccagnctggagtgcagtggcgtgatcttggctcactgcangctccgcctcccgggttcatgccattctcctgcctcagcctcccgagtagctgggactacaggtgccctccaccatgcccagctaatttttttgtntttttngtagagacggggtttcaccgtgttagctgggatggtcttgatctcttgacctcgtgatccatccgcctcagcctcccaaagtgctgggattatgtgtctgtccaaaaaaaattttttttaagagacagtgtctcactgtgtgacacaggcttgtcttgaattcctgggctcgagcaattggcatctcagcctcccaaagtgctgggattataggcatgaaccactatgcctggctcagtagaatattttaagtaattttgtgcgtgaaagttttgcctacattttgacttagacccatcacatgaggtcaagtatggaatcttccactttgggcatcgtgttggtgtttaaaaagttttggattttggagcacttggggttttggatggttatgctaaccttgtttcatgatagcccaagtactaaatattaaaggaaaaatatccatgttctgcacaaaaagtgccatgtgccagtagtggcatgtttaccatgccactttggaaaatatttgttaggttaatttaccttacttagtgcaagcttcctgttctatattttcatgaaagaaaactgactgcgattttaaaaatattgcttctcaaaccttttggcttccatatttctttaattttccatatcactattaaaaattattgagggcgccaaagtcctgctaaaggattatatcaatatttaccatattataagccaaagcgaggttttaaagaaaacgttacagagttaagagtcgctttcttgtacatttttgcaaatgtcttttaatgttccctttagtgtagtgggaagaatggtgttgttttatgttttgtaaatttgttttgctctataaaaaatggttggcttcccacgtttgcttttgcagtccatctattgcagaaagctttttaattaaaacgcatcaaagaagacctgactttatacggagaagtgataagggaggagtatgttaataacctttaaagataattgtggatttttttgatactactgtaaaacttaaaagtactcttacatcgaaattaattgggttggctgggcatggtggctcacacctgtaatcacagcactttggggggttgaggcaggtggatcacttgagctcaggagttcaagaccatcccaagtaacatggtaaaaccccatttctacaaaaaacacaaaaattatctgggcgtgatggtatctgcctatagttccagctacccttgaggctgaggcaggaggattgcttgaatctgggagtcagaggctgcatgagttgagatcacgccattgcaccccagcctgggcaacagagtgagactgacaaaggaaaaaaaaaaaaaaaaagaaatccgctgggctgctttgaattttgaatggattttttacccatgcatgattttttagtgttatgtaccaatcagaagaaaaatactgatgcattggcctaagcagattatccaaaatgctaatgtatttattttacaaaattaaaaagaagttacatgtcttcatattgatctcatagaaaatatccgccaaatactcaagccaa

SEQ ID NO: 112575 - DNA, 403 bp, Homo sapiens
tttccatccatcagagatgagacttaaataaattaaaaggtacttcgtggggcggctgggcctaatgataagcaattataggaagccaaatgaaggcagtgctttgtgcggggcctgtgaaattggttaagcaaaaagaataatggcctgtttcagtgattcatccctttgctcatttcagagggagcattatctcagttaagtgatgcaattaatatgaaaatgagggaatcattgtttaaggagatgaggagaaagtgaggagggggctggaagccacagtggggaaaactaagggccaccgagatggaaatttgcataggtcagtagcaatgtgatgcctttagcacgcactcaaagcttagctagcattgtaatacgtcgccattaaattctcattacg

SEQ ID NO: 112576 - DNA, 234 bp, Homo sapiens
gaattaatgcaagggtcctgagctgtatacagtgtaaattacaagcttactatgtaaattacaggatattgctatatgccaattgtactaaagataaaaaacaaaattctttttttttgaagttgcaagatttaatagagtgaaaacagagctcccataaaatgggaggggacccaaagggggttgccgttgctggctcgaatgcctgggtatatcccgatcattgtccctccc

SEQ ID NO: 112577 - DNA, 773 bp, Homo sapiens
gactgaggtgggagaatcacttgagcctgggaggttgaggctgcagtgagctgtgtttataccactgcactccagcctgctgggtaacagagcaagactccatctcaaaaagaaaagaaaaaatgctttgctacataatgaggccaggcaaaaaaaaaaaagtcctgtggaaatcatatagacaaacatttgcaaagctgctactgccattgtaccagtgttaaactgtgttctaccttgcatcttttactgatttttatgacagattttatattgtaaccattcgagaactctgtaagtgctatggcttccttaaactacgatttatcatatgctcccggtgtttactttgagactgaatggcaaccagagaatgtaaacaaccaaggtgcatctggttatgttttaaaataaagattaataaaagttttggtttttctctttctaaccttctttttaaactagaaatataatacctatagaaaagtaaatgttggccgggtgcggtggctcatgcctataatcccagcactttgggaggccgaggcaggcagatcacctgaggtcaagagttcgagaccagtctggccaacatggtgaaaccctgtctctactaaaaatacaaaaattagccgggcatagtggcagacacctgtaatcccagctactgggaaggctgagccagaatggcttgaacctgggaggcagaggttgcagtgagccgagatcgccccattgcactccagcttgagcaacaagagcgaaactgtctc

SEQ ID NO: 112578 - DNA, 812 bp, Homo sapiens
aggccaggttagtgaggaaggctgtgttctccagattgtggtttcctctttaagacagggtcttgctctgttgcccaggctgcagtgagctgtgtttataccactgcactccagcctgctgggtaacagagcaagactccatctcaaaaagaaaagaaaaaatgctttgctacataatgaggccaggcaaaaaaaaaaaagtcctgtggaaatcatatagacaaacatttgcaaagctgctactgccattgtaccagtgttaaactgtgttctaccttgcatcttttactgatttttatgacagattttatattgtaaccattcgagaactctgtaagtgctatggcttccttaaactacgatttatcatatgctcccggtgtttactttgagactgaatggcaaccagagaatgtaaacaaccaaggtgcatctggttatgttttaaaataaagattaataaaagttttggtttttctctttctaaccttctttttaaactagaaatataatacctatagaaaagtaaatgttggccgggtgcggtggctcatgcctataatcccagcactttgggaggccgaggcaggcagatcacctgaggtcaagagttcgagaccagtctggccaacatggtgaaaccctgtctctactaaaaatacaaaaattagccgggcatagtggcagacacctgtaatcccagctactgggaaggctgagccagaatggcttgaacctgggaggcagaggttgcagtgagccgagatcgccccattgcactccagcttgagcaacaagagcgaaactgtctc

SEQ ID NO: 112579 - DNA, 797 bp, Homo sapiens
aagaattcggcacgaggagcctcctaagtagctgggattacaggtgcgtgccaccacacccggttaattattttattttattttttttgagatggtgtccctgctgggtaacagagcaagactccatctcaaaaagaaaagaaaaaatgctttgctacataatgaggccaggcaaaaaaaaaaaagtcctgtggaaatcatatagacaaacatttgcaaagctgctactgccattgtaccagtgttaaactgtgttctaccttgcatcttttactgatttttatgacagattttatattgtaaccattcgagaactctgtaagtgctatggcttccttaaactacgatttatcatatgctcccggtgtttactttgagactgaatggcaaccagagaatgtaaacaaccaaggtgcatctggttatgttttaaaataaagattaataaaagttttggtttttctctttctaaccttctttttaaactagaaatataatacctatagaaaagtaaatgttggccgggtgcggtggctcatgcctataatcccagcactttgggaggccgaggcaggcagatcacctgaggtcaagagttcgagaccagtctggccaacatggtgaaaccctgtctctactaaaaatacaaaaattagccgggcatagtggcagacacctgtaatcccagctactgggaaggctgagccagaatggcttgaacctgggaggcagaggttgcagtgagccgagatcgccccattgcactccagcttgagcaacaagagcgaaactgtctc

SEQ ID NO: 112580 - DNA, 1398 bp, Homo sapiens
aggccaggttagtgaggaaggctgtgttctccagattgtggtttcctctttaagacagggtcttgctctgttgcccaggctgcagtgagctgtgtttataccactgcactccagcctgctgggtaacagagcaagactccatctcaaaaagaaaagaaaaaatgctttgctacataatgaggccaggcaaaaaaaaaaaagtcctgtggaaatcatatagacaaacatttgcaaagctgctactgccattgtaccagtgttaaactgtgttctaccttgcatcttttactgatttttatgacagattttatattgtaaccattcgagaactctgtaagtgctatggcttccttaaactacgatttatcatatgctcccggtgtttactttgagactgaatggcaaccagagaatgtaaacaaccaaggtgcatctggttatgttttaaaataaagattaataaaagcaatacaaaaacaaaaaaaaaaacgaaaaaaacctgtgttgggggggcatatggcaccttggaaaaaaggtttttctaagaaccaatatggttgtgggggggagggggcccccaggagggttaaccggccaaccgtgtggacccacatacgacgcgcgtccccccaagggaaaaacaccggggaacaagaaccaacagatggcgcaggagaactctccacacacagcaatgacaaaaaacagcgccacgcggcgaagcaaacaccacgcaaggcgtttctcccagacagcaacaagtcacaacacattaggaccaactacacaaggaaggagtcacaccaacaaccggcagcgaactcccttaaacaacaagacaaaaggagcagtgctccacaaaaggcggagaaacgcagcaagcaagataacgaaaagaaatggacacaacgcagccccacgagcaaaccgggggagcacagacagagagagagagaagagagaacacgacaaaacaaaagacaaacaacagacaaaacacacgagaacagaaaacacagcaaaaccacgagaaaaccaacaagaaacacaaaccaacagtagaacaagaaagagccgcaggtagaaaggaggacagaggggcagaaagaaagcaagcgagagagacgagagacacacgagagaaagaagaaggaagcgcaagccacggaaaagagaacgaaacagagagaaaagacaggaaaggcagagaaagaaacgagaaagagagaagaaagcgagagaggacgaaggaagcgagacacgaagagaacagacaacagaaggagaagagagaggcaagcgaagaacgaagctacgaacgacgcaagaagcacgaggcaagaacgaagaacgacagagaagcaagaagggagagcaaaggagagcgacaatgcaccc

SEQ ID NO: 112581 - DNA, 744 bp, Homo sapiens
gagtcccaggctcaagtgattctcccacctcagtctcctgagtagccctgctgggtaacagagcaagactccatctcaaaaagaaaagaaaaaatgctttgctacataatgaggccaggcaaaaaaaaaaaagtcctgtggaaatcatatagacaaacatttgcaaagctgctactgccattgtaccagtgttaaactgtgttctaccttgcatcttttactgatttttatgacagattttatattgtaaccattcgagaactctgtaagtgctatggcttccttaaactacgatttatcatatgctcccggtgtttactttgagactgaatggcaaccagagaatgtaaacaaccaaggtgcatctggttatgttttaaaataaagattaataaaagttttggtttttctctttctaaccttctttttaaactagaaatataatacctatagaaaagtaaatgttggccgggtgcggtggctcatgcctataatcccagcactttgggaggccgaggcaggcagatcacctgaggtcaagagttcgagaccagtctggccaacatggtgaaaccctgtctctactaaaaatacaaaaattagccgggcatagtggcagacacctgtaatcccagctactgggaaggctgagccagaatggcttgaacctgggaggcagaggttgcagtgagccgagatcgccccattgcactccagcttgagcaacaagagcgaaactgtctc

SEQ ID NO: 112582 - DNA, 872 bp, Homo sapiens
aggtaagtcctcttcccccaagacatcagtgtggagtatcctgttgagctctgttcttgtccccttagaccttgagatgacaagagaatcattgccaaatacaagaggacacctggttacatttccatttcagatcaaaaaatggatttttttaggataagtatatctcaagtactgaataggatatacttatactaaacatttattgtttatttaactgagcatcttgtatttttacttgctaaatcttgcaaccctagacaggtagagctggtcctctcttaacaggaacagaagcagagccaagagccccacatgaaagtgctgaccaaacccaaaccctcatgaagaacccaccaagcctggctattgctgtcctaaaagatttgccctatagaggttcatccacatataatttttccagaactgacctggttagctttatctactgcccccaaattagttcatatccaaacaattccatacctgtctctcagtctgtatataaacagtttgcattcaatgtatttgtacctgctgatacctttgtacatgctgtctctttctctaacagatccagattcaatacttactaaatgccaacaatgagacagagaatagtatgaggtgctgtccttatcttcacaacaaccctgtgagggaagcctcacttattattattgctgttcctgttctccagatgagaaaactgagcttcaaagattccctgtagctgggctcagtgtgtgagtctgtaattccagcttctttggaagttgaggcaggaggatcccttgagcccagaagttggagggtgcagtgagctatgattgcaccacttaactccagcctgggtgacagagcaagatatc

SEQ ID NO: 112583 - DNA, 340 bp, Homo sapiens
ccatcctcacttgattaagtaaaaagcttacaacatgcaatccagtttacgtgttagatgaggtcttctcagctagcatcacataattcaaaagcagacaacaatgcaactggaataactcaaaggcctaacaccaacatcagaaatgtgttgagggccaggcgcagtggctcacgcctgtaatcccagcactttgagaagccgaggagggcagatcacctgaggtcaggagttccagaccagcctcgccaacatggtgaaaccccgtacctactaaaaatacaaaaattagctgggcatggtggcacatgcctgtaatctcacctacttgggaggctga

SEQ ID NO: 112584 - DNA, 386 bp, Homo sapiens
gggattacaggcgtgagccactgcgcccagcctcaatattaaaaaaaaaattttttaaggccatttctactccagagttttttaaggatcaaatgatatactgtatgttaatcattcagcacaagctggtgctaaaagcaaacgctagttgttttctgttcccagactttgttcattaagttgttctccacatgtatggaaagctttctctacaccaggtcagaggatgtgaataagaacatggtagagaacagcaagtaaaacagctgtggagtagatgccagcacagtaccgtagaaatcagcacagggtgctgtgggggccttgaggaggggtttctaaccccgtcttgggggaatggtgatgtcaaggaaagtgtcccagag

SEQ ID NO: 112585 - DNA, 784 bp, Homo sapiens
ggaagatattctataaatatttgttgaataaaatggatagaagatgaatagatagatgaatgaatataatttatttgagtgtatgaaatgagtgactcatctaacttaattttcttctaatagttaatcagttgccatggcatcattggaaaaacaaatctatgttttgttcactgactgaaataccaccttcatattatctttaattcttacatatactttatttctgtatttgctcttctattttactcctgtttatttctttgaactacactgcttaaaatattttctctatataaattaactttatattggatataaaaattctactatatttatattagatatatttagagaggttaagcttccatctctgccctctctcctgtgttctgatgttttccctataggtacaaatttttattggttttccatttatcctttttttatttttttttaaatgtaagcaaacagtataggtatttgtaccccttttttttctttataaaaaagtagcaaactgtgcgtgcttatttatatcttgctttttccttttaaacttaatatatcctggtggtcaccttatagcaatatgtaaagatctttgtcattttttaaggagatggatagtactccattgtttgtatccactatatgttcaatcatttctgtatagtaggatatgtgaaatgttatcagtcttttgctacctgaattagtgcttcaacaaatagccttgtgcatatatcatttcgtatatttgtcattatgcctttgggagatc

SEQ ID NO: 112586 - DNA, 409 bp, Homo sapiens
ggtaaccagattgaccgtgataacctcttggcagtctctgacccagatggacttgtttatcttggggttcagatgtcaataatcagcccatttcctgtggaggttgggacagcttggctgctcctggagacctggattcaagactgcagatacctttgttcagccttttctcactttccccccaaatggaaatagagatgttctcagctttgcttgaactccacaaatatatctgtacctaacatgggattatacaaaccttttcatagttctttgcagacaacaaagaaaaacatggcttctgagattatgatgtgtgagacaccaatttttctgtataagtagtatttttaattataaaaggaagacataattatggcaaaaagaaattcaaagagtagagaagggc

SEQ ID NO: 112587 - DNA, 492 bp, Homo sapiens
gatttggaaggtgtttttttttttctccccctcaccccgcaagactgggatggtgttttgaagggttccttgatacctgagcttagtaaacacttgtccaccttggggatctttttacctgaggcaaaggagaagcgggttattattttgaaattagcagtctatttctgaaagtaaggaaatactagctaccctgaaaaaccagttgtttggtaattgaaactggtttaaaagcactgtgtttgggcatcgaaactagtttaaagggattgtgtttcctgcatactttgcaaagaactatgtgtttatgtggatacagccccttgcccccaaccataattggtaaatgcagcgttattttttgagattgaggaaggcattgagtttttgaacttctgatcaatttatggtggtagttgaggattacaaatccttttaaagacacactgaatttgaagaaaatttagactagggtattgttaattgaaaagc

SEQ ID NO: 112588 - DNA, 167 bp, Homo sapiens
gtttcctcacttgtaaaaggggcaggagcattaggtggcactgtggacaggacagggctgtgtaaactgtggagtgctgtctggagggagcaggcattattgctgctgcataatggatttgacaaggttttcctcctctctctattaggactcccatggcgtccctc

SEQ ID NO: 112589 - DNA, 451 bp, Homo sapiens
ggctcagaggagagatacagatagaaatttggaaatcatcaagcagaggagaacagaaagaaggccagtgcagttgaagggttttgtgaccctttatcttgggtcacaaaagagtgacccaagataaagttgaaaaggtgggagggtcaggcatggtggtgcatgcctgtggtcccagctactaggaaggctgaggaaggaggatcacttgagcccaagagttctggactgtagagcactaagctaatcagatgtccacattaagttcagcatcactatggtgacctctcgggagcgggggaccaccaggttgccaaaggaggggtgaaccggcccaggttggaaacagcagatcaaaactcctgtgctgatcagtagtgggattccacctgtgaatagcctgtgttgcccactccagcttgggcaacatagtgacaccacatctctgtta

SEQ ID NO: 112590 - DNA, 273 bp, Homo sapiens
tgggctgagggtcaacagccgccctgctggggacaaggctttgtcctcattgaggagagtaaggccattcattcattcattcattcatccacctatccgccctggtctgggcacctgtgctgtgcctggcctcctgtgcctggcctcctgggcactgaccccgctgtgtggacccggctgtggccctgggagccctgtgcacagcccccggggacgcagcttctaagcattgaggtctgaagggaaagtcagccccatcctccagccaggcgg

SEQ ID NO: 112591 - DNA, 615 bp, Homo sapiens
aatgtatgttagaagcagtgttgacagtgtttggcagctttatgggtgtgtgaagagtggataaggaggaggagatgaaaataacgtagaggttttaaaacggtgtttggggatggcactcttgacgattggaaaaataaaatggaaagccattctggaggtgggtggataagtttcgttttggttgggtcatacagtatttgaacctaagaatcccaagaaaacttttattaaaagctatatttattgaatgttaccattttcaggtactgtgcaatgtgaatcatttaagtttttggtgacccatgtagaaaggaactgatctagtctaaacatggaactatctcttaaatcaagataacagctgtaatcatatagatgcttttcctgagttagttgttttacgtcttcctttgtgtgacttaaagtttttagtttgactctgctacttttgttctatttgtgcgtggcttgatggatttttcctgtccccatctatacactcgtcacaatgaggggctactaaataaggcagtgttctctgtttgtgtagtccccacagctgtttcctatagtaaagactctggaaaacaatgacctcatagtttccacaaa

SEQ ID NO: 112592 - DNA, 442 bp, Homo sapiens
ggccaggctgccagttccatggtccagagtgagaacttatagtgctttttccaggcctgcctatggaccaatcagcgcacacttcccctcctctgaagcccataaaaaccccagactcagccagactcaggcagacaatgggataacctgcctgtggagaggagctacccaccatgggtctcctctctgctgagagctgagcagatgatgggacgacctgcctgcagagaggagctagcttcatactgctggtctcctctatgctgagagatgagtagacaatgggaggacctgactgcagagaggagctacccactgagattctcctctgagctgttctgtcacccaataaagcacctctttgccttgctcaccctctatttgtatgcatacctcattcttcctggacacaggacaacaactcagaatccactgaatggca

SEQ ID NO: 112593 - DNA, 279 bp, Homo sapiens
ccacacccgcagtgggggagacgtggaggcttattcatcactgaagtcatggaggatcagttctccatcttaattttgggtgcattagggctgggcatggtggctcaaagcctgtaatcccagtactttgggaggccaaggtgagtggatcatttgaggtcaggagttcaagaccagcctggccaacatggtaaaaccccgtctctactaaaaatacaaaaattagccaggcatggtggcgaacacctgtagtcccagctactcaggagcctgaggcaa

SEQ ID NO: 112594 - DNA, 369 bp, Homo sapiens
catatcaaaaaaaaaaaaaaaaaatccaaaaccccaagggttttatttttcatttagagccacaggatagaaacagtttcacttttaattcctaattaagataattctatagcaaatgaatgtgtacatttctaaaagtatagttttctaaggatactgagtaggattaagtagaatttcaaagtttctgataactcttctaatagatttgttcatgttaagaggtactagtgaaactcaggatttctcctattatcacagagtgtgattatgacataaatatgaatattgaggaaacattttaataagctctttaaaatgttagacttgagaaaaaatatatttctgagaagtaaagctctgggaaaa

SEQ ID NO: 112595 - DNA, 561 bp, Homo sapiens
tttttagtagagatggggtttcaccatgttggccaggttggtctcaaactcctgaccttaagtgatccaccagcctctgactcccaaagtgctgggattaccggtatgagccactgtgcctggccaataattcattttaataccttcaagggatagtgagtttgggaataagcaaagggagtagcaaattattgctgtaaaatatatgaactatatatgaactattttgccatagagaatgtattagtctggtttttgtgttgctgtaaaggaatgcctgagactgagtaatttataaagaaaagaggtttaattggcacagggttctgtaggatgtagaagcatggtaccagcatctgcttctggtgagggcctcaggaagcttactgtcatagtgaaaggcaaagggagagaggttgttgtcacatggtgagagtggcagcaagagaaaaaggagggaagtgccacactcttttaaacaaccagatttcttgtgaactcagagcgagcactcactcatttgtgggggtggcaccaagccattcatgagggatctgcctg

SEQ ID NO: 112596 - DNA, 358 bp, Homo sapiens
gagagaactagaagtacctgggggcacaggtgccacagacagaccattagccaacaatggtacaagaatatgaaagtccagctccttgcctccagtgggggacacgtgaaggcgtagtttgcatcccagagctccctgggaatcaggctgatgctgggactttgcctgtcctgcacccttgactggcttctcccttttccctgtcctgcttccctcactcccttacctgtttctcctggcaggatgttctcaataagtcaggatctgcttcctggaaatacaacttaggacatcactcatgtacacaattactcaaatgtctatctgaggccctttcaggtttagagacaatactgaa

SEQ ID NO: 112597 - DNA, 215 bp, Homo sapiens
gacaaataaatatatattaaatactttctatctgctagccactatgacagacacttgttttaaaagcacaggctgacctcaaggaattcacagtctgataggagagataagacagtgacctccttggagttagggactgccttggtttactgttatctccatagcacaatgcctggcacatggaaggcattctataatagtttgttaaatgaacg

SEQ ID NO: 112598 - DNA, 402 bp, Homo sapiens
gaactttttctgtgcgtactggtttttcatttgttttgattttgttttccaggaatgtggagttaaaaggcaataagagaatagtgtccagttgcagagtctaggtagggggtccacagtgtccgtgtttgcgtccctgaggggtctgaggagggcagttcacgctggagcctcctctgtggcagcctctgctcagccgcaggaacctgaaggtcacgcacagcccacatcctgtgcgtctcaaagaagtcaagcctcaaaatgaaaaatgaggctgggcacggtggctcactttgggaggcctaggtgggtggatcacctgaggtcaggagttcaagaccagcctggtcaacatggtagaaccccatctctactaaaaatacaaaaattagctgggcgtgg

SEQ ID NO: 112599 - DNA, 384 bp, Homo sapiens
tcccgggttcaagcgattctgctgccccagccttccaagaagctgagattacaggcgcccaccaggcccggctaatttttatatttttagtaggggagcagtcgggctctggactacatttcccggaggattctgcgggccaataccatgtctcgcgagattttggcttcctcttagccaggtggcagaatctttcgctgtgcccaattagctgctgccacgccttggagtccggagtaacttggccaggccggccccgagcggaactagagaaagctgaggatgaggaatccggctctggtccttttgtgtgtggagggctgaggagaggagtttgcgtgtgtgattgcgatggttgccgtgggtcttcgtggtctgtgactg

SEQ ID NO: 112600 - DNA, 686 bp, Homo sapiens
ggcctgcagcaacccctcccagcaggtcagatcccggccctggtcccggcaccactccaaagcctcctgggctgagttctccattctgagggaacttctggctcaagacgtgctctgtgatgtcagcaaaccctaccgtctggccacgcctgtttatgcctccctcacacctcggtcaaggcccaggccccccaaagacagtcaggcctcccctggtcgcccgtcctcggtggaggaggtaaggatcgcagcttcacccaagagcaccgggcccagaccaagcctgcgcccactgcggctggaggtgaaaagggaggtccgccggcctgccagactgcagcagcaggaggaggaagacgaggaagaagaggaggaggaagaggaagaagaaaaagaggaggaggaggagtggggcaggaaaaggccaggccgaggcctgccatggacgaagctggggaggaagctggagagctctgtgtgccccgtgcggcgttctcggagactgaaccctgagctgggcccctggctgacatttgcagatgagccgctggtcccctcggagccccaaggtgctctgccctcactgtgcctggctcccaaggcctacgacgtagagcgggagctgggcagccccacggacgaggacagtggccaagaccagcagctcctacggggaccccagatcc

SEQ ID NO: 112601 - DNA, 513 bp, Homo sapiens
aatatattgaaatttatatttgcaaaactaggatcataaaataagttgttttccctcagcaatatatagtaattacctttgtatgttattaaatattttctctatcaccatttttaattattaaatttaattaaattatagcacaactattcacagacttcattatgggaatagttgtgctataatttacctgaatactcttctgtggttgaacattaaaaggtatttttcagctgggtgcagggctcatgcccgtaatcccaacactttgggaggccaaggtgggtggagcacttgagcccaggagttcaagaccagcctgggcaacatggccaaaccctgtctctacaaaaaatacaaaaattagtgaagcttggtggtatgcacctgtggtcccagctactcaggaggctgaggtgggaggatcgattgactccagaaggtgaaggctgcagtgagctgtgatcacattgctatactccagcctgggcaacagagttagaccctgtctca

SEQ ID NO: 112602 - DNA, 410 bp, Homo sapiens
acaaaagtttttctatttgtagtagttacggatttctgttaacagtcttggatgtgcaagtgacaagttctacttaattatttgtctgtaaccaaactcaagttctattttgagtcccattcattatctcagtaaaaacttaatctgaaccaatttagaatcctcctaagataggtcccactatatacaagatccagtgggtatataaaaggtgagagtacagggtagtaattaattacctgtctggtaattaaattgtgtctataagataaatactgaaaaatccatcttgtccttgatcttagtccacacattttagtaagccatccgttttcctgtttctatgggttagttagtttaggaggccataaagggggcacagaaatgtttctgttgctgtgatgtcattc

SEQ ID NO: 112603 - DNA, 638 bp, Homo sapiens
caccccatctctcaaggtgactgcttggatgggctggcgtgactgggaaggcctttgccactttgctgtctcctggattccatatctactggatgggtgccatcttgcctctagccagggaagcaagcaggcacaccaactctttcctttccagtattcctgggcccagtggggtcttctcactcagttacaatatttgatctaagaacattcactttccaactgatcagaaagtaaaggtgactggcatggtgttgctgtgagaggtgcagcgtaacctcagaggtgaacatcagtgctgggaccatttggagcagcatgtggtaaccaccaaatgggaaccacggccttctggctcgacctagagcatgaatgtagcaaagcgaagccctgtacactttataaaaaccagtagaaagacactccagtctgagtgagcagctggaacaaaggtaccacctgaatagagggtgtgtggcaagggcaggcacgagacaggaaatcagactggaagagtaggttgggcctggtcatgcgtgccaaggcaggcagcattctctaaggagcagtggtaagccatcaaggcatttgttactaggggtgtgacaatatgagattgtattttcagaagatgactg

SEQ ID NO: 112604 - DNA, 353 bp, Homo sapiens
agcagaagggaaatgacaccagatgtaaagctggatctggaggcagaattcaaagctccactgatagtcccccctgcaaggacaccaagttaacaacaatctataccgaaaaacaaacaaaaacaccttcataagaacaaaagtcaggtgagcactcatagtacttggttttaactttatatccctgaaagaggcactgaagacatagaaaaaaaaagtcctgaattgctgacaacactcctcccccgccagctcacccccagcccagcagcagcttcagggtgtggagagcatctctgagtactgggggagggagaacagagcaattgggaggaattgaactcagtgctgcc

SEQ ID NO: 112605 - DNA, 664 bp, Homo sapiens
cagttcctatgcttgtagttatgaagttggaattttctaattcgcttcctattttctggtctcctgattggccagtgcaagaggagtgaaagtgatttatgccatatggggatctgacgctaaattttctcacagaaaccctcatgtcactttttacccacccatgcagctggaaggaaaggacctcgaggccttaccgtatggagtagtcacatgacaaaatacacagactactgagtctcaatgtagactagatagcaaagaaacctggattcctgagacaccacataaagcacagcagctctggagagatgccagactaggaacattcgtattacactgtagatctgtaaaaataagcttctttaaaaagacactgagattttttgaattttgatgacagtctgttttatataatactaatattattgctaaaacgatttctcattccacttgccaaatattgttaggagtggtctgatttagtaatctacttaagcgatatattttggtggtattttttgtttctgaatttatacaggttctctattgttaccttcccaatattggtgagattcaccatttgtttggtttcttaacaaaaactccctaatttggggtctcagtcttcttttctggaatgctgccacaagatcctaagtga

SEQ ID NO: 112606 - DNA, 704 bp, Homo sapiens
gatgctgttttaggtcaatttctcatgtaggtgatatgttgtgctaggaattagttgttgagggtgcatgctgtaaagttgctctggctaggtatggtagcttggtggtacaacacttactgcctgacttgactaaatcatgttaaatgttggtaagactgatagtcccaggttcatgtaacttatgaggattgaatgaggtgatgtatttatattgcttagcattgtccttggcaagcagtgtttgataaaagcttagttgccatcatcattttcatttttaagtttgcttatcatcacctaagtctaatttatctcaccatagtatacttgtcaagaatacagaccatgataatcattaataattgtgactatctgctctgccatcaagtgtgaatgaattataaagttgcttagcaagctactatatttgaatttgctgtataaatagagctattttccatttccatggaacctctgttgttattgcaccctaccttaaaagatggaaggttagtggttttgagctctgaacatatttatacatatagtatttatatgtaatttgcctgtgctgtcactttgctgttatattgagatagaactttagtcttgcagttttaaaaaatacttttgacccatcttgtctcctgttcttctgatacatcaaaacaaggtagcattgaggttttagagtaaaagat

SEQ ID NO: 112607 - DNA, 1302 bp, Homo sapiens
ggatgggagtaaaaataaacagtaagaattcaaaggcttttaataccctcagcttctcgcctcttctctcccagctgcccgtcagtccccagctggctcagaggaatgataagggacagagaggcgggaggggaccttgcttccacagtctgagtgctgccccgaatcactgggaacacttctcagcagggtgccgctgacatttcagactgggtgcgtttctgctggagggctgtctgcacattgcagaagctgagaggcattcctggcctccacccactagatgccagtagcagcccccctccagttgtgacaatcgaatcgaatatatcttctgacgttgccatgtgtcccgtaggggacaaaattgccaggtcgagagcactgctttaaagaagcagctgacacgtactctggcttactctgtgccttgcaccattggcaactctcaggtaagtgaatcattcagtcttcgccacacacgtccctacagggctttacaaatgggcatgccatggtgcacagaggtgacataactcacctgtcatggcccagctagtccacatcggagcaggatggaacccagattgttcaaggtctcaaccgctctgccctgttgctctccagtatacaagtacctgggtaaaaagtcactctgagccagcgagggggacggggggcagaggcctgccgcagctcctgctagagtcccacacaaggtagcacctcaggtcctctagcgacatcaaaaaagggagtgccagagggaatttccacacgctccactctcagtaattaaactgcaacaacctcccagactctcaggcctcaggagcaaccgccttaattaatatattccacgttgcagcctcctccatccacagccacgctcggtattcccgaaccgcactccaccagcagagctaggacaaaacaggcctcctagtgaggcatggcatttgcaggccacagccccattcttaggggataagcctgggatggggaatgtgtcttgaggtcaccaaccccaattcaaacctgatgcaaagctccttcctgctccctgaagccaggtgatgctaccgaagaataattactgttgtcaccacagcattttctaagtccaggcacagagtggcagagtcagtcagccctcacaagcctgcaaggtaggaattattcccattttatggatgacaaaactgaggctcagagaaggtaagtaacctgcctgaggccatggagtaataagtggtaagcctggatccaaggccatgctttccctctctcctaacagcccct

SEQ ID NO: 112608 - DNA, 504 bp, Homo sapiens
gaaaaatggggattaaaaattgtacctagcttcaagggtggctgtgagggccaagtgagatcatggatgtaaaactcttggcatgttgcctgcccactgataagccctcaataaaggctggcaataattaccaaagttcttattcaaagaactatagtccgatacggtataagtgtgtcaaaagaagtatgatcaaagggccatggggcacagcagagggaacatcagttctatactgggtgggtagtcagggagaagaatcctttttatgtgggattgtaatctggagcctagatccagatgtggtctacaaaatatgtttgggggctactgttgtgttttaaagattttgaaattcaactcctttagacaggcagtcacccctaccacaacttaatggaccaaactggtttgttagggacattaatgttgcttgagttctgtgccccacgatggaaggtgacctttgacctggaacttaaaggttggctttgaattagccag

SEQ ID NO: 112609 - DNA, 444 bp, Homo sapiens
tggataattttgagtaaaggtggagaggaaggtcaaggaggataagggctgcacctcacagggaccctgctggtcagcatgacaacactggggcagaggagccctgggtggaccctgcatagcaattcctaagcatgcttctcattctcaacctcatgcctccaattcagaaaactatgtgaaaaatgtctgcatggccaggcgtggtggctgacacctgcaatcccactactttgggaggctgaggtgggcagatcacgaggtcaggagttcaagaccagcctggccaacatagtgaaaacctgtctctactaaaaatacaaaaactagccgggagtggtggcacccacctatagtcccagctacttgggaggctgaggtgggagaatcgcttgaaccgggaggcaaaggttgcagtgagccaagaccatgccattgtactcc

SEQ ID NO: 112610 - DNA, 265 bp, Homo sapiens
aggattggacagtaaattgcagtcaattttggtcagtttcagctcctagaactgtagcagctaaccaatccctagcctcatggcgggcaactatgcacatgctccaggatcagcttacacaaagcctgtgggatgaggatcccgtcctccaaaaatctggggatctgtgctttgatcaatggttgctgttctgatcttggagatacaaacacataggcaggcagccattgttgcaaccctcttagcacagttacaaacccctccc

SEQ ID NO: 112611 - DNA, 1408 bp, Homo sapiens
  misc_feature (399)..(399): n is a, c, g, or t
  misc_feature (644)..(644): n is a, c, g, or t
cagtgaactgcctgctagatgccaggcaagtttaaaggaaaggtcaatgagaaataaagtgctcaagggcagattcaaggaaaacatggggagcattgcagagcaaccaggtcttaaaagagaagttaaggagaacagcaagaagcaagcacacaggagcaggcagaggcacactggttgagaaagtaggatgcccagcagcctggtctgattaaatcagaaattccctctgtaggagggacaagcaaagcatattatcataggctgggcagaattccaaaggtcatttcatccaacactcctcagacgctgaaactcaaggtttcgaaggcaaaagtggaagtgtagacaattgctacagaattgaagcccaacattctgtcctttgcctttcataanttgagacaaaattaaaaccatctgaaatatctcccttggctgcttttttcaaactttaatttccctgcaagtatatgataattgagtttctttagagcacaaggctggatatattggaccttaatgtgcacaagttcatcctagaaattgtctttagagtaccaagtctttcctccccaagagttccaaaactaattcaatatttagaatgctcccctggacctcccagttccagtggctgaatntcagggctcaggcattagaggattctttttgttctttggccctcttggggactaaatgccatgtatgtcaccatgtcagtgactacagccttggtttcatcccctgatgacccacaaccatcatctcccttatgctgaacatctctctgaatcttggaattttcagatgactctaactttgccaaattagaatcatgcctgattctttttttgtttgattgtttgctttatgtttgtttactttgctcagtgccaagcacaggatttagcataagaaaagttccactagaggttgtttattcaagtaagtaattattatagccatccgtatatgaatgctttacaaaattttggctgatggtcctcgcaggtctgttttattagtcaatttataaactcaagtttatgtcttcaacttgaccatctcctttgacttccagattcgcctcttcccacaaaactgactctccacttggacatctaacaggcatcttaaatttaatgcatccactttggggggctgaggtgggcagatcacgagatcaggagatcaagaccatcctggctggcacggtgaaaccccgtctctgctgaaaatacaaaaaattggccaggcgtggtggcaggcgcctgtggtcccggctactcgggaggctgaggcaggaaaatggcatgaacccaggaggcgtagcttgcagtgagctgagatcgtgccactgcactccagcctgggcgacagagcaagactccttctcaaaaagaaa

SEQ ID NO: 112612 - DNA, 270 bp, Homo sapiens
aagatggagggcgcttgactttgcgacacgcacattctgccgtcttgggaagggggaaagaggggcatctagctgggcgctgcgtgtagcctgcccggcggggccggggtgtggcaggaccgaagcctgctcctcgtgtggggcccggcgcgaaaacagcttgtgcagccgctgagtgactgaggaccgtgtcccagtgtagtgtcatttcctcgtacatgtggagtttaaagaattataggtaccttgagctactggcaggtaaaagac

SEQ ID NO: 112613 - DNA, 372 bp, Homo sapiens
gcatggagagacagggcaggaggtagagactgagagagagaaggatggaggggacagggattgtgagacataaacaaatggggagtggccgggcacggtggctcacacctgtaatcctagcactttgggaggccgagacgggtggatcacttgaggtcagcagttcgagaccagtctggccaacatggcaaaaccccgtctctactaaaaatacaaaacttagccgggcgtggtggtgcacctctgtaatcccagctcctcaggaggctgaggcaggagaatcatttgaacctgggaggcagaggttgcagcgagccgagatcacactactgcactccagcctgggcgacagagcgagacaccgtttcagaa

SEQ ID NO: 112614 - DNA, 100 bp, Homo sapiens
gagcaagtcactgtctcaaaaaaataataataatttgaaagttggaggcttgcccagagtctagtggggagatggatatacaagcagatgtggtgaatac

SEQ ID NO: 112615 - DNA, 263 bp, Homo sapiens
  misc_feature (31)..(31): n is a, c, g, or t
agtgcaattaaaaattcaaaatgtcattttncagtgcaattcggcctgaaatcaacctgttttatggtaattatgggctctggcaccagaacatagcagagctttagaaacattgaatgagtgattgagtccaacctccataaatgtgaaacatatgaaatgatttgggtaaagtaaaaaccagagagcgttgtcaccctccctaccttgagctatgcataaagctgcgttaatgtagtggagtagtcatatcagaatgaggg

SEQ ID NO: 112616 - DNA, 407 bp, Homo sapiens
ctggcaatccacgcatggatggcaatcatggctggggttcatgggtagaagaagtcaggtgtctgaatttggataggaaaaaaagttttatcttttctctgtctggtagctgaaatatagcatttcctttcatcatgaatgtgaagcaggaaaatagggtctggaggcagggaacataaggctgattcacactaaagctatgacaggaaatatcctctccacagggcgtaggccaagtaaatgacttgtaacttcacgtcatcctttccatttacacagggtataccccaagtaaccaatggaatcctctaggggatatttaaactcccaaaaattctctaacagggtgttttgagctcctatgctgtggagtgtagtttcgttttcaataaatccctttgtccctt

SEQ ID NO: 112617 - DNA, 836 bp, Homo sapiens
acaaaaataaaaaaaatagacaaatgggatcatgtcaaactaaaaacttgtgcacaacgaagaaaacattaaatagagtgaaaacacaacttactcaatgggaggaaatatatgcaaactgtatatctaataaggtgttgatatcaaaaacacatgagaaacgtgaacaactcaatggaaagaaaacaaataacctgattaaataatgggccaaaaacctgaatgaacatttcttaaaagaagacatacaaatagccaatatgtgtgtgataaaaatgctcaacatcacttatcatcagggaactgcaatgagatgttacctcatacctgttagaatggcaattatcaaaaacaaaagataacacatgctattgtggatgtggagaaagggaaattcttatacattgttgggaaagtaaagtagtacattcattatggaaaaacagtatagagtttcctcaaaaattaaaaacagaactaccatataatccagcaatccaactactgggtatatatacaaagaaaatgaaatcagtgtgttgaaaaggtatctgcactgccatgtttattgaagcattattcacaataataaagacataaaatcaaacttattgtccatcaatggataaatggatgaagaaaatgtgatatattcaatgaaatactattcagccataaaaagaaagaaatcctgtcattggcaagaacataattgaagctggaggacattatgttaaatgaaataagccgtaggcacagaaagactagcacatcatgagcttgctcacatgtagaatctaaaaatgtttatcccataaaagtagagagtagaatgg

SEQ ID NO: 112618 - DNA, 302 bp, Homo sapiens
attttttccacgttttaaatacttcctgatttttgactagatatcaagctttgttaatttcacaactttgggtgccaaaaatttttacattcctatcaatattcttgagctttgttccagtacgttgttattttacatggaaaccatttcatactttcaaagcttgcatttatttgttaggtgggaccagaacaagggctaatgttgtcccactatggaagcaatactttctgagtagtctccctgatacttcatgaattatgaagttttctagtcggattttggggaactgaaaccatttt

SEQ ID NO: 112619 - DNA, 471 bp, Homo sapiens
aatggaatcagcaaggtctagagaagggcagctaaaatcatcaaaagacagaaaagtcgtcttcctaacgataaattaaataaattaggagtctgcaagacaaataaaaatgttaggaggagacaatgtcaatgttttcaaagccttgaagagaaaaaatggatttgtaaaccatattccagataacagactgaggtatcatcccttgaatcttaaaacagacaaatttagggcagttagaaattactaataacaacaaaactggtgatatcaagagccagtaaggactaaaaacgtaaatttaaggaggatgtagataaagtcatgaaaaaaatctacgtaagaaccttaagaggaaactgaacatctctaacctctggagacaggctcaactcccgaatcgcgtggcatgttgactaccaacagctaagctctactcactgcaggactttgagagttgcttgtttcctt

SEQ ID NO: 112620 - DNA, 1355 bp, Homo sapiens
agcagtttgaaccagtggaaatcaaggtagtgaagaaatcagaagagcgacctatgaccgcagaagaacttagggagcgagaattccttgaacgaaagcataggagaaaaaaacttgagacagatggaaaactacctccaactgtgtccaaaaaggcaccctctcagaaagaaagtgtgggcacaaaacttagcaaaggttctggagacaggcatccttcttccaaaggaatgccccttcctcatgctgagaagaaatcaagacccagcatggccaatgagaaacacctcgctttgtcttcatccaaatccatgccaggagagaggatcaaggcaggatctggcaatagctcccaaccctcacttcgtgagggccacgacaaacctgtttttaatggagctggaaagcctcattccagcacctcttcaccaagtgtcccaaagacttctgctagcaggactcagaaatctgctgttgagcacaaagccaaaaaatctctgtcccatcctagccattccaggcctgggcccatggtcaccccacacaataaggctaagagtccaggtgtcaggcagccaggcagcagctctagctcagcccctgggcagcccagcacaggggttgctcgacccacagttagttctggccctgtgcctaggcgccagaatggcagctccagctcaggacctgagcgatcaatcagtgggtccaagaagccaaccaatgactcaaatccctctaggcggacagtcagtggtacatgtggccctggacaacctgcaagcagctcaggtggccctgggcgacccatcagtggttcagttagttctgcaagacccttgggcagctctcgtggccctggcgggcctgtgagcagtccacatgaacttcgacgaccagtgagtggcttgggccccccggggcggtctgtcagtggccctgggagatccataagtggctcaattccagctggacggactgtcagtaattcagtcccaggaagaccagtgagcagcttgggacctgggcaaacagttagtagctcaggtcccactataaagcctaagtgcactgttgtctccgaaacaatttcttccaagaatatcattagccggtccagcaatggacagatgaatggaatgaagcctcccctatctggctacagagctgcccaaggtcctcaaaggcttcccttccctactggttacaaaaggcagcgagaatatgaagaggaagatgacgatgatgatgaatacgactctgaaatggaagattttattgaagatgaaggagagcctcaggaagaaatatccaagcacattagagaaatctttggttatgaccgaaaaaagtaa

SEQ ID NO: 112621 - DNA, 676 bp, Homo sapiens
cgagaccagcctggccaacatggtgaaaacttgtctccacaaaaaatacaaaaattagccaggcatggtggcacatgcctgtaatcccagctactcaggctgaggcacaagaattgcttgaacttgggaggcggaagctgcagtgagctgagatcgcaccactgcactccagcctgggtgacagagtgaaaccctgtctcaaaaataaaaataaaaaaaataaaattatagttataataagctgaagatgaacagacatgtcaagatctctgaacttttcaaaatcactttccagaacctctttgctgcatggaggcagtgtgagtcgaagtcgaaatagcacgtctctttgctgttctagattctctgcctaaatcactcccttgacagctggagcatcagtgtctattgaccctgtaacctgtactcagatgggaactctttggtaactgctctcctaagagaggtaagggaaaacaatatggttagtttccaaaatatctggggctgtcgtccaccttgttcaagaaatcgtaactctgacatttggatttggggaattcatcagttctgactgggagcaaagtgacacacctattccagacactgagatgggaggtctctctgaatcttccctcagtctccctcccaggccgttgccaccttcccgaagggt

SEQ ID NO: 112622 - DNA, 418 bp, Homo sapiens
catagtggtatttctgcagggatgaaagataagttcatttctacctaaatataaatacaattgtctgattaatcataagaccactgaaaaccttattctaggaattaatattttttatcttaagaatttcatgtcattaccaattgtgataggaattctaggcagtatttctcaaactttaggccagagttatttcagaaaatccaaaaatctccatgtgcactaagcattatttgtgggtgctgttgtgatttagtaaaatatgaaatcattggaccagcttcatggtaactttttgttacacagttttataaccaatagctatttgaacagatcatcgaacgttttagaccatactcaccaatagaaatgtaatatgagctacatataaatttaaatgttcttgataccacattat

SEQ ID NO: 112623 - DNA, 151 bp, Homo sapiens
ttctttctcaacactctccaaagtgattatgcctaattgagttactttaataaccatctatatgtgattattgctagatttttagactgctcttctctcttaagtcatgtcctatttttcctactgcctgctggtcaattccatgtgggca

SEQ ID NO: 112624 - DNA, 891 bp, Homo sapiens
gtactgggaagatcttataaccacctaccactaggacagaagtggcattggagtgaatgtcaggagcaaattgtgcagagatgaagcggggtgaggtcagcgatagaggtatcggacagcaagatttaaagctgccggtttagaggaggagggggatgacctggaagcaatgttgagaagcaagaaggaaacctatctcacctccaggcactaagaagctgaaggttgaaaacacagttgccggaagtagttctgtcctgtggggttcggcatcatgcaagttccccctgggctgttctctgatacagggcacttgctccacactctgggaacccagattaaccagtctgccctgtcacatagttgaaggagttgcatttatctttctggctcccaattcctttaaaattacatttgttgcagaacctccacaaggctaaataaaataaaattacatttgtgaccatcagagaactgaagaactattaactggctgttctggttttgctgagatcgggctgttgacagttcctggttgtcccacagctacccatgtcagttatctccactaacatttccaagaatctttgtaggacaatttctccacctgcaaggtctttcaagtaagaactcttctttcctttaaggcaattagcccattgccaaaaggttttactgtcttaaagctggaactatctgagatctaattccaaggacttttctacagctaagtgagatgcctcacaccagtattaggtgattcttcgtgaggacagaacagagcattttcatcttgtgtttaaagcaatttgttggcttcggctcctcaccactttctataccagtctcccattcacgtccctagtaatgcctatgccaaaaaaaaagaaa

SEQ ID NO: 112625 - DNA, 794 bp, Homo sapiens
taacaacctatctataacaaccacacagccaacataatactggattggagaaaagttgaaaatattccctctgaaaactggaactagaaaaggatgcccactctcaccacttctgatcaacatagtactggaagtcctagccagagcaatcagacaagagaaagaaagagcatccaaattggtaaagaggatgtcaaattgttgctgtttgctgatgatatgattgtatacctagaaaaccctaaagactcctccaaaaagctcctagaactgataaaagaattcagcaaagtttcaggatacaaaattaatgtacacaaatcagtagctctcctgtacaccagcagcgaccaagctgagaattaaatcaagaactcaactccttctacaatagccagaaaaaaaaaaaaggtacttaggaatatacctaaccaaggacgtgaaagctctctacaaggaaaactacaaaacactcctgaaagaaatcgtagatgacacaaataaatggaaacacatcccatgctcatgggtgggtagaatcaatattgtgaaaatggccatactgccaaaagcaatctacaaattcagtgcaattcctatcaaaataccaccatcattcttcacagaactagagaaaaacagtcctaaaattcatatggaatgaaaaaagagcctgcatagccaaagcaagactaagccaaaagaacaaatcaggaggcatcacattacctgatttcaagttgtactatcaggccatagtcaccaaaacagcatggtactggtatgaaaatagg

SEQ ID NO: 112626 - DNA, 596 bp, Homo sapiens
tggaccttgtctaagagtcaacatttaccaacatttatcccaaaatttgactctttgtgatgtttaaaatatcccatgaaccatttaaaagcttgattttttttgtttatgaagctttttttaaaaaattaatttatttactttaagttctgggatacatgtgctggtttgtgacataggtatacatttgccatggtggtttgctgcacctgtcagtccatcatctaggttttaagccccacgtgcattaggtatttgtcctaatgctctccctcccctttcctcccactcctcgacaggctctggtatgtgatgttcccctccctgtgtccatgtgttctcattgttcagctcccacttatgagtgagaacccgtggtgtttggttttctgttcctgtgttagttttttatatgtgtataccaagcatataatgatataacaaaattcaggagctagtctacgttattttgttgtgtagaatattgtaaatgaaacacttctatagcttaggaatttttttgttactgaaacactatttgtatgtttattttgttgttagtttgtttttatctttttggtttttaaatagattaa

SEQ ID NO: 112627 - DNA, 336 bp, Homo sapiens
tctaggagtgacctgaaacctcctaggttcggttctgcgccttcgcctctggaaggaggctgggcttgggccctgctgggaagaaaaaccccttagatagaatgtttaggcggatcacgaggtcgggagatcgagaccatcccggctaaaacggtgaaaccccgtctctactaaaaatacaaaaaattagccgggcgtagtggcgggcgcctgtagtcccagctacttgggaagctgaggcaggagaatggtgtgaacccgggaggcggagcttgcagtgagccgagatcccgccactgcactccagcctgggcgacagagcgagactccatctca

SEQ ID NO: 112628 - DNA, 350 bp, Homo sapiens
cctgcagctcttaacccaggctggaggggagtgttcagggaagacttcctggagggagtggctcttctaaactgagacctgaagaaccagatggtgctaggcaggtaaatgagaggagaagaaaagcattccagacagaaagaaagcactgcaaagaaagctgggaggacagaggcaagcttggggctttcgggaagctaaatagttcagcacagttagagcatggggtggaggtgagggctgttcttccttgcactagtgccacaagctacttacagtgagatgccctaatgtaaatcagagcctggctgggttagattacacatgtcagtcctaagtatttcagatgt

SEQ ID NO: 112629 - DNA, 393 bp, Homo sapiens
tccaggcccctccacctggaagcctctcctggcagtcattctaaggaaattctcagccaggtgccctaaataagtactatttggggtagtaaaagatggaaaccatctatacattcaaaaccaggggattaattagaaccgtaatgctggtgcttcctgttaaaatgataacggagaaataactttcatatgacatgaacaaggcagcccgtaaagcagtatgtgttgaacaagatcccattttcgtaaaggatctgtaaggacaggaagtgttcaacggttgattctaggtggagggagaagaggtgttgtttatgccattcagtatattctgagatttttactaaagaacactgcttttccacaaactctaagggcagattttattcccag

SEQ ID NO: 112630 - DNA, 946 bp, Homo sapiens
  misc_feature (23)..(23): n is a, c, g, or t
  misc_feature (599)..(599): n is a, c, g, or t
  misc_feature (661)..(661): n is a, c, g, or t
  misc_feature (860)..(860): n is a, c, g, or t
  misc_feature (863)..(863): n is a, c, g, or t
tctgttcctgtggcccaccctgngcctccaccggccagcagcccgaccccggctctggggagcgcgacgggggagcaaacaaatgatgcagtggcacaaagagcgagcatgtgctcccgagcccaccagtcagaccccaccagcatccccactttccaaactgagcaggccctacttggtagagctgctgtctcgccgagcggggaggccggacccagagccaagtgagccgtccaaggaggaccaggagagcagtgaccgccggccaccctcgcccccaggccccgaggaaaggaagggacagaagagggacgaggaggaagaggcgacagagaggaaacctgcttccccacctctgcctgccactcagcaagagaaaccttctcaaacacccgaggccgggaggaagacctcatcagcccaacatcaaagacaccatcggaacagcagcgcccgcagcacccaccccgcaccggcgactccatcttcatggccaccccctgcggtggacggttgaccaccagccaccacatcatcccagagctgagctcctccagcgggatgacgccgtccccaccacctccctcttcttctttttnatccttctgtctctttgtttctgagctttcctgtctttccttttttctgagagattcaaagnctccacgactctgtttcccccgtcccttctgaatttaatttgcactaagtcatttgcactggttggagttgtggagacggccttgagtctcagtacgagtgtgcgtgagtgtgagccaccttggcaagtgcctgtgcagggcccggccgtcctccatctgggccgggtgactgggcgccggctgtgtgccccgagcctnaancttgccttggctaatctggaagctccgaccgacatcaccgagcagccttcagcattccattacgccccatcttggctctgggc

SEQ ID NO: 112631 - DNA, 493 bp, Homo sapiens
  misc_feature (23)..(23): n is a, c, g, or t
tctgttcctgtggcccaccctgngcctccaccggccagcagcccgaccccggctctggggagcgcgacgggggagcaaacaaatgatgcagtggcacaaagagcgagcatgtgctcccgagcccaccagtcagaccccaccagcatccccactttccaaactgagcaggccctacttggtagagctgctgtctcgccgagcggggaggccggacccagagccaagtgagccgtccaaggaggaccaggagagcagtgaccgccggccaccctcgcccccaggccccgaggaaaggaagggacagaagagggacgaggaggaagaggcgacagagaggaaacctgcttccccacctctgcctgccactcagcaagagaaaccttctcaaacacccgaggccgggaggaaagaagccgatgcttcagagcagacactccttaggtggctccaaacttacagagaaagtggaaactgctcacgcgctgctggaaat

SEQ ID NO: 112632 - DNA, 777 bp, Homo sapiens
gtctgccctctaggagcctccagtcttgtcagactagaggagatattcaggtaaacactggcagtggtatatgctgattcgagtaattaggagttcgtgggaacagagggtaagaaaaacccctttatagttagagatgtagatggatcaagagaaacttacctaaagagtcctaattcttgaagcacaattaggaattaaacagattggctaggcacaggtagcattcaatgtggaggataaaccatgtttaaaagaaaagagctataagggaacatgtatccttagagaccttacttacagtcagaaaaatgtacctatatctgtagaaaaccacatagtgtgtggaactagaatcacctaggagctttcaaaaaatactgccacttaccagagattctgacgagtgaggagtggccagggcattcacggtttaaaagtcctccggatgattttaatggacacctggttcattgtgtgaaaaccactttatcacaaccacttggaatcagacatacctgtggtcacatcctaggcctttgattcactcatttgtgtctatagacacataatctttgtgatcctttttccttatctgcaaaaatggggctaatacccacttcagaaggctgcaattcactcattcattcattcactcaagtactaattcaacaggtatttattgagcgcctactgtgtgccaggcattgttccaggctctggagatttagtagggaactaaacagatctcttctgatctgtacccctcaaaaaaca

SEQ ID NO: 112633 - DNA, 233 bp, Homo sapiens
aaattcggtaaatcatgaaacttgtcaagatgattctgaagttaatatggaagccttaataatgaatggtttaaaccatagtatattcatgctatggaatacaatggattagttaaggataatgaggtaaatttgtacatatgagaatggctacacctccaagatacgtttttgtgtggtgaaaagagaaaattgctaaacagtacatataatatgatatcatttttttaaaa

SEQ ID NO: 112634 - DNA, 141 bp, Homo sapiens
tccgagaccaacctgggcaaaacagtgagacctcctctgtatttttaaaaacagaagaagaagaagaaaacaacaacaataacaaggcccagatctaataaatcagagcctgccttttaccaagatcccggatgtttcctg

SEQ ID NO: 112635 - DNA, 280 bp, Homo sapiens
cagaaatgaagagttctgaggattaacgattaggctgccttgagaaactcagagcagaaacctatgttgggtattaccctcaggaacagagttagggataaacaattcatggttctctgactggggtcaggccatttattcacacaattttgtacaagggttgctgttactgtagaccatggctcaaagatcatttccaaaagaatgtttattgggtgtttactaggtagcagtgctggggttacaaaaataaatatgatccagccaggcgcagtggctc

SEQ ID NO: 112636 - DNA, 212 bp, Homo sapiens
tgacaaagagcaggctttagatggaaggcatttctaagagacagaattgctatggtacacacagccttctgatggtctatctagggatcaatttaggagttggaaacacatgatactgtgtttaagatattcttcaaatatcttaaacattacgtatctcttcctcaaattcaaggtgtaggccaggcatggtggctcacgcctgtaatccc

SEQ ID NO: 112637 - DNA, 381 bp, Homo sapiens
tccgggggtgctggagctttgtgaccatgggccttgcctcctcggctgcctctgctatgaagcctcatgcggttggaggaggatgtggatgagatgaccaagcggggtgcccgctagcaccaggtggtgggtaggcgtcggcagactaggagagcctcagagcctttgtttaacttgtgctgagaaggagtgtgactccaggagagttgggtggagagcctcaccttggcacacactatgctgtgtccagactggaccccatggtgtctgagcattattctctctagggtcaccttcccctgcactgtgaccttgcggagcttcaaacagtggtttcctaaggtaacagagcaggtggtggtgtggtgcgtgtgcgtgtgt

SEQ ID NO: 112638 - DNA, 282 bp, Homo sapiens
cagtagcacagcatagcacctgcttgggtctggggaaatggtaaataataacccagtgtgaatccacagtccagtgcactgccctcaggggtctccaaattgcggtccatgctattttcaggatttgggaggacagaggagctttcccactgtaaggatcttggcagttcacagcaagaatgaggactatcaaaatacttcaacttaccctttccctgaacactgagttcctctggactcctaaccaatgtcagctgcattggcctctagctttcttttctt

SEQ ID NO: 112639 - DNA, 318 bp, Homo sapiens
acaccacgtctggccctcattcttaaataagaacaggttgcctaagctccctccccattcacttattcaacaaagagttacctccccattcacttattcaacaaagagttacctccccattcacttattcaacaaagaggcaggcactttcccttctctctagatactcagtgacaaaacacagaacaatccccaccctcaaggagcttaccttccagaaaggggaaactacaaacaagggagaggcagtggagagtatgacagacagagactggtgctgtggaaactgaaggagagaaggcaatgaagaatagaggg

SEQ ID NO: 112640 - DNA, 605 bp, Homo sapiens
gaataactgagttggattttgaagaaagaataggatttctccaacagtatagtcagaaaggactttgtaagcctggtaaagagcaaggcatggaggagatgtgagacagtatggcatgtgtgaggatgagcaagtcttcaggcgttgctgctgtggaacatttggagctgtcggggaaagtcttgaagagagaaactggagatgaagacatgaggcagatcagggagaaccctggcctataattagggaatctggctagtcctcttgggcagtggaaatgcagtgaatagttttatgcaaggggattaggtgacttgatttgttttactacataattttggaagtcatagaatagactaggagaggaaggaacagcagtttaaaaggttttggggtaatgcaatgagcctaaattaagatgatgacagaggggatggagaggaagagaagacatatttaagaaatattttaagatctagaattgacaggagtttgtgattctttggctttttagggtgaagaggaagggtctaaaccaggggtatccaatcgtttggtttccctgggtcacgttggaagaagaaaaattgtcttgggccacacat

SEQ ID NO: 112641 - DNA, 258 bp, Homo sapiens
tggcctggagctgtgtgggagccagcccctgcacatgaggcatgcgctcagcagctcctcaccctgcccactccatactcagcccactccatagctacccgacctttggatgcacctgaatttgtgacccttgacaaaggctatggtactttcttagacctctgagtccgaaaacccagctccacattctggttcctcctcttactggctgagggactttggacaggtgcttttacttctaaagccccagtttattaa

SEQ ID NO: 112642 - DNA, 263 bp, Homo sapiens
atctgcccacctcggcctcccaaagttctgagattacaggtgtgagccaccacacctggcctacttttcaattttgaagagcttctgtgataccgtggatgaggcacatgactgggttgcatgtcacagtggaaggcaatgttcgtcacagagggctactggaacctttaagagggagatcctaaagtgacgaggtttaagatgccgccttaagcaatagggctatatgtgaggtcaggattcagaaatcaatttcacatcca

SEQ ID NO: 112643 - DNA, 434 bp, Homo sapiens
gggtgattcatcgaacaatttcccatttccctattgactgctttacaacgggatacaatgaaacataggtgaagtttctctatatacgtgtgggtccctttaggggctccctgttctcttcctttagtctgtctatccctaaaccattactatggcatctcaattactatagctaagaaatttacattaagtagggtgagttttaattttgatgaagtccaatacaccaattgtttttcttttacggtaaatgaactttgcgttatatctaagcaatctttgcctaacaggcattcacgaaggcattctattttctctcctaaagcatcacagttttagctttcatatgaatgtgtataattgaataaaaaaagtaatttttgtgtatgacaaaagttagggttgaggttcattttttttcaccatgtgaatat

SEQ ID NO: 112644 - DNA, 198 bp, Homo sapiens
agcctcccaaagtgctgggattacaggcgtgagccagcacccctggccagaacataagttttttgtgaaggcggaagttgtgtcatattcacacacactgcttggcacatagatgcttggtaactgtcacagaattgaaaggaacctctagcacttaagtctctgcctctgcatcccccttatcttctctgcctgtct

SEQ ID NO: 112645 - DNA, 406 bp, Homo sapiens
tggctttcttctgtttgggttcctaaagtcaaaataaatctgctctattccatttcatttattactatctaatatattacttatctacttaggttagtttacttaatgtttaccccactaaaatataagctttctgagagtaagaatttttgtttactgctatatgtactaagcctagaacagaacagaacagaacacatgataggtgatcagtaaatacttattgactgacagactgagtgaataaatgttgctcaaccagcagagactcaacatttaattccctgactaggtagaatctagatggaaaattttcacccataaatggctacaaaattgtggcagggaagataactaggatgctattttcttttctatttaatcaaatatacgttttttaaaggac

SEQ ID NO: 112646 - DNA, 528 bp, Homo sapiens
gggacgttgcccagtccccccagtcggaagggccagtgggtggagttgggctcactggcctctggagggtccctagcaggccaccccacctcagttaagtcgggactggggagccccatcctgggtactctgtgcaggaaagggggtcccacccacaacccacactcaccctggaaggcagagcctcttctcccataaagcctggcccagcctggagctgaagcccggggccgccacctgagagggcttggttctgtctgtagagcaggggtctgaatagcctggtgccctggaccaggtgacccggctctgtgcactgcacctgctcctatcactgaactctcccacaaggcggggacagacgaagaaactgaggcttgatgagtgaccccactgcagagccccaccgtgggtagggtgccccgacctgcactctggctgctgggctccacggcccagctgtgtgccctgagtggtatcctggggacgatgccacacaaagcctgcggagccgtaccgtgcctgaca

SEQ ID NO: 112647 - DNA, 426 bp, Homo sapiens
agtgggagagtaaatatggatttgagcaaagtgtgatccttggaccagcagcaccagtatcatctgagaatgtgttagaaatgcacattcttgggatccatcccagacagacatactgaatcagaaactctgggggtgagggcggacagtctgtattttaacaagctattctgatgtacagaaaagtttgagagtcactggattagggagatgagtataatgcactaaggatccatccgagcttagtggtcttaaatttgatgtgaaagcagtcagtagattgtgttgaagcaaaaaagggttgagagaagtgaatgtgtacaaaggattattttaaatgatataccataaaatctaagctacataaagaagtgaggagagggcatcaaaatttgtgggatatagctaaagtagtactttggggaa

SEQ ID NO: 112648 - DNA, 674 bp, Homo sapiens
tgctctgggttttcttgaacttctattgttgtatctctttgtcaattacatattgatacattttcttaatttcagttttatgatttcagctttttaattggactttaagataactatctaatagaattggaagggtgaggtatatttaagggaatacaaatgtttttgtttgacgtttttaccattttgcatgtttctgtagtggcatctcaactattgcaatggaaaatatgtccttggcaagactcttagaaacacagcctcaaaggtcattggattgtgcaagcttcttgactatttacaaggtcacctacctgaatgaatagaaatgctccctgcccttaaggaatttgcaattttatgaagagagatgagtgagaactactttgtggattattcttggagaatgttgaatcccagatgagcttttagtcccctgatgttcattgtttttatctatgccatcagatcactgtgcccaaataatttgaattcatgttaataatagcttacgaaaaatgcagtaagagagcttgctggaaaagtgacagcatgcattttaaattacttctagttgacctggctttcattacccaaatatccacaggcccttccatgaatatggataattgagttgatatttagcaaataccattgaagaggttagatgtgtc

SEQ ID NO: 112649 - DNA, 530 bp, Homo sapiens
ttttttttttaaatcccattttacagaggtgacactgaagcttgaaagggatgagtcttgcatatggtcacatagccagcatgtggctgagcagggggcccaaagcaaagtcagcctgactttttggcatctgcttctggacaagtgtaggctgagacttctgagaaaggagccctaagaagccttttatgcactccagggagcaccctctgactgcggcagggttgttgggggtgccagtgttattttgcaccgagggtcatgcagagctgagactgttctggagagactcagagattgggggtttgcagcatcttcctcttagctggaggagagcatgggggcaggcctgcgtgggggcagcaggatggctgagttggcctgcctgagctttggacactccaggtttcttggccacgcacttttgttcctgagctcagaggccctggccacaggcttctggctatgggtctttggcgactcctgggggagaggggccccacctgtgtgactgaagaagacaaggaccc

SEQ ID NO: 112650 - DNA, 401 bp, Homo sapiens
ttgtgattcagatcaagcggtgagatgactacaggtaacagacccttgctatcatttgggtgttctcacaaggaacaggagccaggtagtgaaccatgtgcctaccctttgggcagggaatgggtggctctaagagatgacagatgctgtcatccggaatcagttctcatcttggtcaattggatgagtcagagagattttggaaacatcttcaggctaacccaatttacattatagttatattttaattgccttttaaagtctaaatgcagttgattgtgaaaactgtgtcacatcatttaagggaactagagctttctttttatggaaacgcaaaaggacctagcaggaaaataccacattgcctaagcagtaaagaaatatgtccggccgggcgcggt

SEQ ID NO: 112651 - DNA, 222 bp, Homo sapiens
ccacctctcccctctgtttgtaactgtcctgtctttgatatttaaaagctagttggccacttctggccatgccttatctggtacctgttagccaaccatgacagtgatgccatacccaggactgtctgcttcttgttctcaggcaggtaggtgctctcagcactgatgtctcttgctttccaagtcagcttttacatctggcctgctaggaactggagagca

SEQ ID NO: 112652 - DNA, 650 bp, Homo sapiens
tacaaaaagaattaaaaaaaaaattagccaggcacagtggctcctgcctgtagtcctagtgctttggaaggctgaagtaggaggattacttgagttgtgaacctttcagaatttaagcagagttttgaggaccacgtaaaggacgttgtgagactccgaaagtgtcatacaatggtgtccttaaggacctgaaaaacttaacagttcaccctatgtacaaatagcttataattacagagctatggcttcttagcagtcaatccctaaagaacaaatgctttttgggacagagtgtgatagtttacacctctttatgttcaagatgcctatttcttttctgatgttaaatgaagaatgaaaaacactgaattgtaactgttgatttttcttttttcttttttttgaggcagggtctcaacaaaaaacagacaccaacacacaaacacaaaaaaactttgttggggccgcccttgggcgctcttgaaaaaagtttttcttgacaaccccattctcgtttgggggcgcgccggggccccccgtttgtgttttatgtgtctgacaccctgtggcgccaatagagctgggttcccaaaagggagaaaacccggggccccgtcgacacactagtggccggggatttccctccccaa

SEQ ID NO: 112653 - DNA, 228 bp, Homo sapiens
tcctacgagcgcaggggagttacaaaaatatgtgaataaactgaatgcagaggctgaggcaggtggataatgagggtaatgatgtctaggggcccagactttaatgtgtaccggagcactcttagattgaaaagtagaggatttcctgagagattctagagacaaagttaacatggtaacatggaggaggttataaaagaaagtgtatgtatattaagagttaagagt

SEQ ID NO: 112654 - DNA, 192 bp, Homo sapiens
ctaggaaatttgggatactttatttaaataatatatcctttgccattttccaagacaaagctctcattttggcaaaaagagaaactatcttggattctggaggctactcaatgtttcatccttatagttactcaggtatccattgctgagtgagtaattctactcagcctttcatccacctgtaatttttca

SEQ ID NO: 112655 - DNA, 565 bp, Homo sapiens
ctggggattctcacagcatggtgaccgggttctatgtgcaagcagtccaagagagaggattccaacgggcacaggcagaagacacaaggcttttcatgacctagcctctgaagtcccagaaagttacagtctattggttaagcaagtcactaaagccagcccagattcaaggggacaagggaaatagactccaccactgaatagcaagaagggaagaaattggtggcggccactttggatacaagctaccacagaccaccctctggccccaacaaggccctcccacatgcaaaatacactcaccctcttctaagaccttcaaaagtctcatttcattatggcatcagcttgatgtccagaatctcgatatctaaatcaggtccagatgtggttgaggctcctcagatgcagttcctcaggtacagctactgcagtatagttcctcctgatctgaattaaagaaacaaattatctgctcccacacacccaacatacaaacatacaatagtgagactgacttaagataagcacaatagacactctcattcaaaatgtgaggaaaaag

SEQ ID NO: 112656 - DNA, 339 bp, Homo sapiens
gaggttgcagtgaggtgagatcatgccactgtacctcagcctgggtgacagagtaggactttatattgtactgccataacattttaattcaaatagaatataactgaattgtaagggtaatccctaatatttagctttgaattgttgtagaaatataaaatggtagagctgaaaaggttttgtagtctaataacctcctgtttctattgaagcagaaattgggccaggcgcagtggcttgtacctgtaatcccagcactttgggaggccaaggcaggtggatcatttgaggtcaggagttcgagaccagcctggccaacacagtgaaaccctgtctcta

SEQ ID NO: 112657 - DNA, 284 bp, Homo sapiens
ttctcattatttttccctttattctttagaattaaatacagaatagcaagattttagttggttgcctgatgattatctgactccactgaaagttgtcagttttgtgggcattgttggaaacatgcagctattccctgcttcattatttcgtttgagagattatattgtcattgaatgtatcaattagagtagggttctgcagcaaataacagaaacccctttgcagtggcttaagcaagtcagggattcctcatggaacagcaagtccagctgcacacagtcct

SEQ ID NO: 112658 - DNA, 810 bp, Homo sapiens
atcctgaattgtttcactgagttctttgtattggttttcagatttctcttgcacctcactgaccatatttaaaaatcagtattttgagttccttatctgagactttaagaatttcattctggttatgatctattagtggagaactgttgtgttcattctggggtgtcatacttccttgtttttcatgtttcctgtgagactctgaatttctatcaagtttccagttgatgccaataatgctgattccacacagcctttctcaaccagcattcattatctgaaccatggaacacagagaatgttttgagaagctcttttctcaattctcccaaggatggtacctaaccagaaccattctagatacaaatcaggacactgattccttacatgcaattagtgcctttggtttagggcttaatttttttgaggaaacttggttgagaaagctgtctttgtaaagctgctaaagagaaaggctcagactctgaaaaagctagctttatagagaaaactacaccattaccacctttaattctaaccggtcttttgtatcaataatatcatatcgatgataatgaaataattggactaatagtgttttggtctacgaaatatcatctattaattcagtaattatttgtggagtacctgctattgcttagcactgtgatgctgaaaacatttgaagaataaatgatgaaataattattcataacttttaagcaccttcttcctgttgttcatcattaaacttaagtgaaatatctgtacatgactcagatactttagaaaaatattctcagcaaaaaa

SEQ ID NO: 112659 - DNA, 486 bp, Homo sapiens
ctgtaggtgcccactttactgatgagaaaactgaggctcagggagatgaaatgaccttttaaagagctaggattctgatccttgcctgtccaatttgcaagtccattctcttaacttctactgtatactacttctccaggtttaagacctggggagctaggaaggagcaagaaagagttagatcattgtaaaaagagaggcagagaagaagcctgtcctctctcctttgcattgtaacttgtttgctccctccttgtcactttctccctcagattccatttcctagaactttggagtcatcttagaatccccaggggtaatcagagaggctaattaagctatagaggccccattagccataagactattagtattcattaggtctgttggcagcagaagttggactatggtcattgaaaagtgccagatgggtagagtcctttctctaggatgtcagtatcccagaaccctcttctgagtgttccc

SEQ ID NO: 112660 - DNA, 317 bp, Homo sapiens
tgtatttttagtagagacagggtttcaccataatggccaggctggtctcaaactcctgacctcagatgatcgcccgcctcggcctccgaaagtgctgggattacaagcgtgagccaccgcgcccagcctttaattcatctttaaatgaattgtccccattttctaggagttattatcttttctaaaaataacataacttttttggattaaatttagatatcctatttatatcttcagcattgaatcaatattttattaaatatacattaagggagcttcagtgatactaaaagagtgtgatgctgttgtaaatttgc

SEQ ID NO: 112661 - DNA, 405 bp, Homo sapiens
gcggccgcctactactactaaattttcggccggtcgatttttttttttttttttgagatggagtcttgctctgttgcccaggctggagtgcagtggcacaatcttggctcaccacaacctctgcctcccgggttccagcaattctcctgcctcagcctcctgagtagctgggactacagacgtgtgccaccacacccggctaatttttgtatttttagtagagacggagtttcactatgttggccaggctggtctcgaactcctgacagcaggtgatctgcccgcctcagcctctcaaagtgatgggattacaggtgtgagcctccacgcccagcctgaacccgcttttaatatccactccttaagaagactactagggttctaatgaaaaggttaaaagccact

SEQ ID NO: 112662 - DNA, 834 bp, Homo sapiens
gcccatctctgggattcccagcccagatgaatcaccaaaaagggccctcgccttcctttggggtccagccttgtggtccccatgactctgcccggggtgggatgatcccacatcctcagtcccggggacccttcccaacttgccagctgaagtctgagctggacatgctggttggcaagtgccgggaggaacccttggaaggtgatatgtccagccccaactccacaggcatacaggatcccctgttggggatgctggatgggcgggaggacctcgagagagaggagaagcgtgagcctgaatctgtgtatgaaactgactgccgttgggatggctgcagccaggaatttgactcccaagagcagctggtgcaccacatcaacagcgagcacatccacggggagcggaaggagttcgtgtgccactgggggggctgctccagggagctgaggcccttcaaagcccagtacatgctggtggttcacatgcgcagacacactggcgagaagccacacaagtgcacgtattgaagggtgccggaagtcatactcacgcctcgaacacctgaagacgcacctgaggtcaacacacagggtgagaagcccatacatgtgtgagcacgagggctgacagtaaagccttcagcacatgcccagtgaactgagccaagacaccaagaatcggaacccattcccacatgaggaaggccgtatgtatgtaagctccctgggttgccccacacgctatacagatcctagctcgattcgacaacatgtcacgaacgtgatggtactgacgcccatgtgaccaaaaggaacgggggaatgcccctga

SEQ ID NO: 112663 - DNA, 805 bp, Homo sapiens
cgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccaaattcactcttaactataaaaaataactagaaatcgggtgtattctttactgacaatttctcccaatgtaatacctcataaaattatagtaaatagttcattacattttacttgttataatagtaattaaaaataacaaattattcataaatgttccctttttcctggaatcaggattcataatttgaaaagcctaactcttaggggttcttatcaagatgctatgttacttcatcctgtgatttatctgtgtgtcacccaggatactcatttgcaagtcaaacaggaaattggttggaaagacattggggcatctcatttatctgtgagagggcccacattgcttgtgggattaagaaacagccagaatcacaaactctaaggcctctaagaggttttttatctttgcctctcatttgcttatcggcctcattctgttagctggcttcttccacatggtgagtcataagcattgtactaaaactcacagaaattgtttctagataggattgtctagtttttcattttaagacaagatgaagaagaaagaaaaagaaaaaaagaaaggtaggagaggctctgattggcccagctaaggtcacttaaagacgcttgaccaattacccaaggttaaagggacagaatatgt

SEQ ID NO: 112664 - DNA, 696 bp, Homo sapiens
gaagaaattattgtaactcaagtatagtactagtactgtctgactgaaatgaaataaaacccatgactgattgaattcctggccacttcaaagcaggtatgaaagtgattcatacccaaacatcacaggttcatttgagagttaagagattgaatagatcatgagtaactgcagttaatttaaaccatgtatgcagaatatttggaggtgatgatcaaagcgagcattgataataatattcataatgttaattcataatgttaatgctttgaggaaataagacagcagtaaccctgtcttctttagaggacctctggatttatatccatttagaacattcatattgttaaattaataaaacttctttaggagattgattattttacccaagtatgctttccatattaatgtaaacattaatatcaataactttatatgttcctcagagtgagggaaaagtcaaccttaacatagagtcaaaaataaacacaagaacctgaagactttaaccaaaagtttttactaacctgttccctaaaacttgagaaatataaagatagtgaaagtggtttcctcccaatacatttattgagcattttaagtttatggaactgtgtggtggattttccagcatatcagggaagcaaaagcgatgtctcttgtcttcacaagcttaaaatgtcattggggagacaa

SEQ ID NO: 112665 - DNA, 188 bp, Homo sapiens
aggaacaagatatagtaggtaccttctgcagatgttcccaaccataaagaaagtaaaggagcactcatctacccattaattcaacaaatattgagtgaatacctactatgggccaagtaaaaatcctaggtacttggttactttagtaaacaaacaaacacaacaattcctttcttggtggagcttaa

SEQ ID NO: 112666 - DNA, 618 bp, Homo sapiens
cgaggactctgcttacttaacccagtgtgatgttttaatctatgtatataccatagaaagataaaatcaacctaagtaacatatccatcatctcagctacttatttttttgtggtgagaaatacattcttttttagcaattttgaagtacgtattgtttttctgacacgttacaacatgggtgaaccttgaggacattagctatgtaaaagacggacacagaaagacaaatgttgcatgatttcacttatatgaggtacctagaatgggcaaattcttagagacagaaaggagaacagaggttatcaggggctggagaaaaggaagttcagtttgggtgatgacaaagttctggaaataatagtggtgatggttacgtaactctgtgagtgttgtgatggtactgaatgctactgaatgctgtccctaaaatttactattttaaccatttttacgttatgtatataggaaaagaaaggggaaggaaaggagaaaagaaaaccaataacaaaatgatcattcctgattctttaacaactgaaattctaccaaattctactagaatcactctaacactgagtgatttgggacaatcggcccctttccattttttaatcgc

SEQ ID NO: 112667 - DNA, 576 bp, Homo sapiens
gaataaaaagtttgagactgataactatatatagcattgcattctaacacaatttattttcccatatacctaatgatggacattctggttgcttccaatagttgactattatgattagtgctgctatgaacattcctgtacatttcttttggtggaaataattactcttttctgttaggtatgcacatcagagtgaaattgctgcatcataggatataaatttcttcagctgtagttgacattatgcaacaattttctaatttaggccaggtgtggtggttcacgcttgtaatctcagcactttgggaggctgagataggcatatcacttgaggtcagtagtttgagacctgcctggccaacatggttaaaccctgtctctactaaaaatacaaaaattagctgggtgtggtggtgggtgcctgtaatcccagctacttgggaggctgaggcgggcggatcacctgacatcaggagtttgagaccagcctggccaacgtggtgaaaccccgtctctattaaaaacacaaaacaaaattaaccaggtatggtggcaggtgcctgtaatcccagctac

SEQ ID NO: 112668 - DNA, 263 bp, Homo sapiens
attgcactccagtccgggcaacaagagcataactccgtctcaaaaaaaaagaaagaaaatagggaatgaaaaaatgatgaagtaatagaaaataatagggaaacaatatcagttgtctggagagatgcattgaaacagagaactgaaggatgggaaggaaccagccatatagggattggtttcagtcagaggttgggaaggaggcatgatgctctaagaaaataacaggtgtggcatgtttgaggaactgaaaagatgttagt

SEQ ID NO: 112669 - DNA, 993 bp, Homo sapiens
tgacgtcagcatggccgcggcccctgactacccagctcccttctatccctcgagcggcaggaatccgtccccacgcccttttcctttaaagggcaacgggccgaaggtggggcgggcggcgcggctcccgcgatccattcaggtcaaaagggagagtgatcaaacaggagagccgaggggacctatattcagagacttaaccggacacctggacagaccattacaacttgggacttttcaggagaatgagggaaatgtagttattgcacctgagcctcactccagctctgaggtcctcttcacttctctttggaagaaaattggatatcttttcctagttgaaagagtagagatctgatttctccaaggatcatcgctttttgacacgggattattagaagcattcattcatctatcaaggagttttgggatacttgccataagccaagccctctgataggtgctggaaacatcaagctctgtgcccaggaagttcatccttggactgcacgcatgaacgagtttgctgtcttcccattggattcagccagtccgcggtcctggaagcaagaaatactttcccagacaaataaaagctgaggccatatccatcaacatcagaaccctgtctgtacaacccaatgcttacagggaggtccttcatcccaaaagaaccagatgtcacggagcacacactcactccttcctgcaggtgccacaactgtcctggtacatggcaagttacaaggaaaaaaccaggaaatatttcattaaccatgggaagctgacattgcgtgtagagtgtggctaacgtaccgcccataatggttcagcataacaatgacgtaagatattaatgtaattgacactgacgtaattgtcacgagaagtgttacaagaagcttagacgtggcgcacaaggaaatagacacagggagtagcaccgagcacggtgtcacaaaaggcagcgttagaacaggtaacggggtatag

SEQ ID NO: 112670 - DNA, 297 bp, Homo sapiens
aatgctgcggactcggcaggcaggggcaggtgtttgcctgtgcttccaggcctccttagcaccaggctctgccgtgccgcccccctcatgccctctactggcccgtatctccaggtgggtggggcacctgtgggtctgctgccccgctcctgccccatccccccaacacacgccgcttcccagccaccgatcagctcctgtgggcggcactatttctgaatcccagtgagttaggacgggacagccagagcaggtctgtctggaggtggtgtgggtgggtgccgagtccgctgcatt

SEQ ID NO: 112671 - DNA, 566 bp, Homo sapiens
atgaaatgagttgatgagatgatgagatgaaatgatgagatgaaaagagatgaaatgagatgaaattagatgaaatgaaattagatgaaatgtaatgagatgaaatgaaatgacataatgaaatgaaataatgaaatgaggtgaaattaaatgagatgatgaaattaaatgatgaaatgaaataatgaaatggaaatggaaatgatgagatgagatgaaatgatgagatgaatgatgagatgcaatgatgagatgaaatgatgagatgagatgagatgtaatgatgagatgtaatgaaatgagatgaaatgaatgagatgaaatgaaataatgaaggaaattgaaatgagatgaaatgagataaaatgagatgaaataagaaatgatgagatgaaatgatgaaatgctgaggtgagatgaggtgaaaggagatgaaatgaaaggatgagatgaaatgatgagatgagatgaaatgagatgaggtgagatgagatgaaatgagatgaaatgatgaaatgctgaggtgagatgaggtgaaaggagatgaaatgaaaggatgagatgaa

SEQ ID NO: 112672 - DNA, 439 bp, Homo sapiens
tatatttcatggagcctgtgttccctttttcagtgtatttctgtcatgttctgatccccagacacaaagtagaagccatcaaagcctccactaatacaggcaggaggacagaggttgatgctaacactgtgtgaatgtatggataactttatcatatttacatgtgagtgattatgtatcccttttgcttttcagtgtcttctcggaaaaaaccagccttgaagtgtcttctccgaaacaaccagcattgaaggctatctgtgacaaggaagattctgttccgaatatggccacggaaaaaaaggatgaacaaatatctgggacaggtaattttgcaaacacatttaatatgatgttcggtcagggtagaagagaacttctcttcaccaaataaaacagcaggatgatgaattcgcgcaacaggatgaaaaattcgcgc

SEQ ID NO: 112673 - DNA, 352 bp, Homo sapiens
gttgcagacattatatccctttacccctaaatacttcaatgcatatttcctaaaaacaaggctattctgtttaataactacagtataattatcagacctagaaaattaacactgatgccttgttagcactattaccttatctgcaggctgtattcgatgccccactaatgtcctttatagcaaatgaagaattttttagtccagaatctgatccaagatcacatactatatttaggtggatctatttcctcagaaaacattctttttttttttttttttttgagatggagtatcactctgtcacccaggttggagtgcagtggcacaatcttggctcactgcaacctctgcc

SEQ ID NO: 112674 - DNA, 647 bp, Homo sapiens
ttttgttgttgttgttgttgaattgttagtagagacaatgtttctccattttggtcaggctggtcttgaactcctgacctcaggtgatccggccgcttccgcctcccaaagtactgggattacacgcatgagggaccgcgcccagccaccacttagcatttacattttgcaattgttgaagttatagatttatacacacatcaattgctgctttgttatacacttgcatatacataagatgggaaatagaaaagaataaaatgggcacggtatccctgaagtttcacattctgagactttaaaaatatttgctctttagaaatttgtttcaataaagaaactgtggtatacacacccaatgaagtattattcagcctaaagaggaagaaaatcctctctgctgcagacaaaatggatgtgattgcaggtctgtatattaaatgaaataagccaggcacagaatgtcaaatatttcatgtcctcacttctacgtaggaagaaaaaaggaaaccttgaccaggcgtggtggctcagacctgtaatcccagcactctgggaggccgagtcgcacggatcaattgagtccaggggttcgagacccgcttggccaacatggtgaaaccccgtctctacggaaaaaacaaaca

SEQ ID NO: 112675 - DNA, 767 bp, Homo sapiens
gtagctgggaatacaggtgtgtgccaccacacccggctaatttttgtattttttagtagagacagggtttcaccatgttagtcaggctggcctcatactgctgaccttgtgatccgcccgccttgacctcccaaagtgctgggatttcaggcatgagccaccgtgcccagcctgtaggatgtctttaaatattcttgatattaatactttgtcagttgtgtgaatttcagatacctgctgccagtttgcaaattgcttgattattaatcccttgtcagatgggtggttggcaaattattttctcccattctccaggttgtcccttcactttgttggttgtatcctttgatgtacagtagctttttaatttgatgtgatcccatttgtccatttttgcttagcttgcctgtgcttttgaagtcttactccagaaatttttgcccagaccaacgtcctggtatgtttccccaatgttttcttgtagtagtttcatagtttgcggtcttagatttaagtctttaattcacttagattgtattttttgtatatggcaagaggtaggggtctcattcttctgcatatggatatccagttttgcttgggctgatttctaaaaattgaaactggtaacatttgagtagtgagattatgggaaatgggggaggagagactttgttttctaccattctttatggtttaaatacatatgtatttctgtatgtgtctatagcaggtgtggagattttaattatatgtgtcattgtata

SEQ ID NO: 112676 - DNA, 142 bp, Homo sapiens
agcatcacctgagaacttcagtcccagacccactggaaaagaatctgtattttaataagatccccagatggtttgcttacacattaagtgtgagccatgctgcttcagagttattgcctgaggagtggctgtccgaccaagt

SEQ ID NO: 112677 - DNA, 320 bp, Homo sapiens
actattgtttggtaatttgattcagtttgtgaatatggggagaggaattgggcaacaggagttattgaaatgtgaggattggtaaggtggaaatcacagaggaacagaaaggagggagaattcgtgggttgtaagtgcattagtgacctgattaattttgtgagtcttggcagagggaagaggaagggtgtggttcagagttgagaagagcacattagtaaactactggagatcacgatagaattgatagatcacaaagaaaggaagacatggaaaagcaagacgttgcttcctcaaccagagcaagacgttgcttccct

SEQ ID NO: 112678 - DNA, 90 bp, Homo sapiens
  misc_feature (85)..(85): n is a, c, g, or t
  misc_feature (87)..(89): n is a, c, g, or t
tggattggtccaggattggggttttgctagtccatagcaattcgaagggcagtgggctagtgttatgagaatattggcaaaaaanannna

SEQ ID NO: 112679 - DNA, 725 bp, Homo sapiens
ataaacaaagtgaataatagaacataatctaactgtatgctgcctacaagaaactcacttcaaattctatgattagttaagttgaaagtaaaagggtggaaaaacatatatcatacaaatattaatttttaaaaaaacaggagtgcttatactagtatctgataaaagtggactttggaacaaagaaaatatctggaaacaagaaggaacattatataatgataaaagaatggatccacctggaagacaaaatgatcttatgtacataccaaataacagagcctcaaaatacacaaagcaaaaactgatagaactgaaagagaaacaaataaatcatcaattatatttcaggacttcaatgtcctctctcaacaacaaatagaactactatacagaaaatcatcaagaatatagaagattgcgccatcacaatcagcaaatagaatctaattgaaatatatagaatactccatccaacaacagcagaatatactttttatctcaagcaaccgaagaacattcaccaaaatagatcatatcataggccataaaaaatgcttagcaaatttttacagaatgtgttatccataacaaaaaaatagcagaaaaatctctaaaacatgaaaatttataacacacttctaagttatcaacaggtcaaagagtaagtctttaaaggcctcacatcaataacctaagttcctattttgagaaacgagaaaaat

SEQ ID NO: 112680 - DNA, 566 bp, Homo sapiens
agagctatagatgtatgtaggctaaaatattttattctgaatttaaccatattctgtaatacattaagaaaaccctagtgatttcttggttagaaattggtcaaaccaggaatcttagtctagaaacttttaaacttatacactgtatgtacattacttaagtactttaaaatctttaaaacatgaagtattctatttctttgacattcagtgggacacataatgaggccatcatagatttgatggtgacctaaatagccactacctctggccttgggttacttggcttcctggcccggcaacaacagattctgttacagacacctaactatctgtaatgctaccgatactaggtgagaacatgtagactttttgagggagggagaggccattcttaggatactgaggtaggaacagctagctaccatttgtattgtggttacaatgataaataaactacttcatcaaagcaattgggatttttttgttagaggatttttcagcctctttttatcctacttcattatatttattgttggggtatagttaggtaagcaaaaaagaaa

SEQ ID NO: 112681 - DNA, 554 bp, Homo sapiens
aacactgggatgggaacctgaggctatttgactccagagtatacgtttttaatgactattttcatacctataagttaggtaaatgaataaaaagaaggaaaaaggaacaaagagaagaaataaagattatcaggaagaatttttcatgagagctaagattagctctgatgaagcttttctctccccaaagagaaaatgcttttctagcaactggggtgttgatgctttctgggttcagtgtctctcttcgtggggagcattgcaccgctctgtcaattttctttctctttatacttcccatggtaaaggaacccctctgctttggtgctctatgttcttcctggagatatgataatatgctgatttggctacagtcaagtcttgacctatcctgggagccgtgctgtttctatggtgattgcccatatatcagctgtcagctgttattcattgattttcttggtcaaaagctcagattactgagggcactatttatggttgccagaaagccctgtatcctgcccatatatttcttctcttctattctcttcctc

SEQ ID NO: 112682 - DNA, 244 bp, Homo sapiens
agctaacagcctcccccaaaccaaaagcaaatgcaaaagaacagaaaaaggaaaacagaagctgtaatacgcatcatctcttttccaagctaaatgttctctgagtctaagccactaattctgatttggaaaactaatattcccatccaaaatgaggaaagcaaccttctcttagaggcaaccttcctctaacggacagcattccagccttcccaaggtaggggcacctggggctgccagagcc

SEQ ID NO: 112683 - DNA, 275 bp, Homo sapiens
ctagtgacaacacataacaaagtaattttttataaagtgtatactctatcttgggccctggatataattaaagcttaaagtttttgtctgtttgcagtaaatatactaattttaaaatacatcttttaaagtagccattttaagatcagcttgtatggattcagggcattttaaaacaggaatttattatttggcttcatgaaagatgcatgtgaggagaaagtgaaatgctttgtccacatgacacagctggatgttttgggcatgcagatggg

SEQ ID NO: 112684 - DNA, 1710 bp, Homo sapiens
cccagagggagagtagcaaagggttaaaatccttttgattgacgttgtagcctccggtgccctgggctcaggcgcgcgccattggccgccagaccttgtgcctggcggccaatgggggggcgcggtccacgagcggtgccgcgtgtctcctcctcccattggctgaaagttactgtgggaaagaaagtttgggaagtttcacacgagccgttcgcgtgcagtcccagatatatatagaggccgccagggcctagggatcacacaggatccggagctggtgctgataacagcggaatcccccgtctacctctctccttggtcctggaacagcgctactgatcaccaagtagccacaaaatataataaaccctcagcacttgctcagtagttttgtgaaagtctcaagtaaaagagacacaaacaaaaaattctttttcgtgaagaactccaaaaataaaattctctagagataaaaaaaaaaaaaaaaaggaaaatgccagctgatataatggagaaaaattcctcgtccccggtggctgctaccccagccagtgtcaacacgacaccggataaaccaaagacagcatctgagcacagaaagtcatcaaagcctattatggagaaaagacgaagagcaagaataaatgaaagtctgagccagctgaaaacactgattttggatgctctgaagaaagatagctcgcggcattccaagctggagaaggcggacattctggaaatgacagtgaagcacctccggaacctgcagcgggcgcagatgacggctgcgctgagcacagacccaagtgtgctggggaagtaccgagccggcttcagcgagtgcatgaacgaggtgacccgcttcctgtccacgtgcgagggcgttaataccgaggtgcgcactcggctgctcggccacctggccaactgcatgacccagatcaatgccatgacctaccccgggcagccgcaccccgccttgcaggcgccgccaccgcccccaccgggacccggcggcccccagcacgcgccgttcgcgccgccgccgccactcgtgcccatccccgggggcgcggcgccccctcccggcggcgccccctgcaagctgggcagccaggctggagaggcggctaaggtgtttggaggcttccaggtggtaccggctcccgatggccagtttgctttcctcattcccaacggggccttcgcgcacagcggccctgtcatccccgtctacaccagcaacagcggcacctccgtgggccccaacgcagtgtcaccttccagcggcccctcgcttacggcggactccatgtggaggccgtggcggaactgagggggctcaggccacccctcctcctaaactccccaacccacctctcttccctccggactctaaacaggaacttgaatactgggagagaagaggacttttttgattaagtggttactttgtgtttttttaatttctaagaagttactttttgtagagagagctgtattaagtgactgaccatgcactatatttgtatatattttatatgttcatattggattgcgcctttgtattataaaagctcagatgacatttcgttttttacacgagatttcttttttatgtgatgccaaagatgtttgaaaatgctcttaaaatatcttcctttggggaagtttatttgagaaaatataataaaagaaaaaagtaaaggc

SEQ ID NO: 112685 - DNA, 699 bp, Homo sapiens
aattcgcggccgcgtcgacgcgaaagacgacagaaggggacacaggatccggagctggtgctgataacagcggaatcccccgtctacctctctccttggtcctggaacagcgctactgatcaccaagtagccacaaaatataataaaccctcagcacttgctcagtagttttgtgaaagtctcaagtaaaagagacacaaacaaaaaattctttttcgtgaagaactccaaaaataaaaaaaaaaaaaaaaaaaaaaatttggggggggccggggcccggaaaaagtttttaacccttggttggggcggcgggggcgccacgtaaggtgataaggtagacattgtgggctaataaacgtgtgttccctagaggagaagaactctcgggggccatagagactataggtcgcttgggagttctcctcacccaatatataaaaaaagccgccggggggggcaccccgagacgagtttctggaaaacaaaactcccagagagagggggagttctggagagagggctcaattagcggggagatctcatctctaaccggggagagttccacagggagaagcactccgaaaatattaaaattatagccccccgcgcggcggagtttaacacacgaagacggagagaagagaaaagaagaacaagagaaagaaaccgccgagaagacgaaaaggagagagagaaggg

SEQ ID NO: 112686 - DNA, 1490 bp, Homo sapiens
aattcgcggccgcgtcgacgcgaaagacgacagaaggggacacaggatccggagctggtgctgataacagcggaatcccccgtctacctctctccttggtcctggaacagcgctactgatcaccaagtagccacaaaatataataaaccctcagcacttgctcagtagttttgtgaaagtctcaagtaaaagagacacaaacaaaaaattctttttcgtgaagaactccaaaaataaaattctctagagataaaaaaaaaaaaaaaaaggaaaatgccagctgatataatggagaaaaattcctcgtccccggtggctgctaccccagccagtgtcaacacgacaccggataaaccaaagacagcatctgagcacagaaagtcatcaaagcctattatggagaaaagacgaagagcaagaataaatgaaagtctgagccagctgaaaacactgattttggatgctctgaagaaagatagctcgcggcattccaagctggagaaggcggacattctggaaatgacagtgaagcacctccggaacctgcagcgggcgcagatgacggctgcgctgagcacagacccaagtgtgctggggaagtaccgagccggcttcagcgagtgcatgaacgaggtgacccgcttcctgtccacgtgcgagggcgttaataccgaggtgcgcactcggctgctcggccacctggccaactgcatgacccagatcaatgccatgacctaccccgggcagccgcaccccgccttgcaggcgccgccaccgcccccaccgggacccggcggcccccagcacgcgccgttcgcgccgccgccgccactcgtgcccatccccgggggcgcggcgccccctcccggcggcgccccctgcaagctgggcagccaggctggagaggcggctaaggtgtttggaggcttccaggtggtaccggctcccgatggccagtttgctttcctcattcccaacggggccttcgcgcacagcggccctgtcatccccgtctacaccagcaacagcggcacctccgtgggccccaacgcagtgtcaccttccagcggcccctcgcttacggcggactccatgtggaggccgtggcggaactgagggggctcaggccacccctcctcctaaactccccaacccacctctcttccctccggactctaaacaggaacttgaatactgggagagaagaggacttttttgattaagtggttactttgtgtttttttaatttctaagaagttactttttgtagagagagctgtattaagtgactgaccatgcactatatttgtatatattttatatgttcatattggattgcgcctttgtattataaaagctcagatgacatttcgttttttacacgagatttcttttttatgtgatgccaaagatgtttgaaaatgctcttaaaatatcttcctttggggaagtttatttgagaaaatataataaaagaaaaaagtaaaggc

SEQ ID NO: 112687 - DNA, 1835 bp, Homo sapiens
cccagagggagagtagcaaagggttaaaatccttttgattgacgttgtagcctccggtgccctgggctcaggcgcgcgccattggccgccagaccttgtgcctggcggccaatgggggggcgcggtccacgagcggtgccgcgtgtctcctcctcccattggctgaaagttactgtgggaaagaaagtttgggaagtttcacacgagccgttcgcgtgcagtcccagatatatatagaggccgccagggcctagggatcacacaggatccggagctggtgctgataacagcggaatcccccgtctacctctctccttggtcctggaacagcgctactgatcaccaagtagccacaaaatataataaaccctcagcacttgctcagtagttttgtgaaagtctcaagtaaaagagacacaaacaaaaaattctttttcgtgaagaactccaaaaataaaattctctagagataaaaaaaaaaaaaaaaaggaaaatgccagctgatataatggagaaaaattcctcgtccccggtggctgctaccccagccagtgtcaacacgacaccggataaaccaaagacagcatctgagcacagaaagtcatcaaagcctattatggagaaaagacgaagagcaagaataaatgaaagtctgagccagctgaaaacactgattttggatgctctgaagaaagatagctcgcggcattccaagctggagaaggcggacattctggaaatgacagtgaagcacctccggaacctgcagcgggcgcagatgacggctgcgctgagcacagacccaagtgtgctggggaagtaccgagccggcttcagcgagtgcatgaacgaggtgacccgcttcctgtccacgtgcgagggcgttaataccgaggtgcgcactcggctgctcggccacctggccaactgcatgacccagatcaatgccatgacctaccccgggcagccgcaccccgccttgcaggcgccgccaccgcccccaccgggacccggcggcccccagcacgcgccgttcgcgccgccgccgccactcgtgcccatccccgggggcgcggcgccccctcccggcggcgccccctgcaagctgggcagccaggctggagaggcggctaaggtgtttggaggcttccaggtggtaccggctcccgatggccagtttgctttcctcattcccaacggggccttcgcgcacagcggccctgtcatccccgtctacaccagcaacagcggcacctccgtgggccccaacgcagtgtcaccttccagcggcccctcgcttacggcggactccatgtggaggccgtggcggaactgagggggctcaggccacccctcctcctaaactccccaacccacctctcttccctccggactctaaacaggaacttgaatactgggagagaagaggacttttttgattaagtggttactttgtgtttttttaatttctaagaagttactttttgtagagagagctgtattaagtgactgaccatgcactatatttgtatatattttatatgttcatattggattgcgcctttgtattataaaagctcagatgacatttcgttttttacacgagatttcttttttatgtgatgccaaagatgtttgaaaatgctcttaaaatatcttcctttggggaagtttatttgagaaaatataataaaagaaaaaagtaaaggcttttatgtcttcgaactgattcttccagaatatgtaaaaaggcttttggtggaatttgaattacatgtaattggtaattcaggaattgactcttttgttattaaaagaacatttgtaaaaatcca

SEQ ID NO: 112688 - DNA, 1456 bp, Homo sapiens
cccagagggagagtagcaaagggttaaaatccttttgattgacgttgtagcctccggtgccctgggctcaggcgcgcgccattggccgccagaccttgtgcctggcggccaatgggggggcgcggtccacgagcggtgccgcgtgtctcctcctcccattggctgaaagttactgtgggaaagaaagtttgggaagtttcacacgagccgttcgcgtgcagtcccagatatatatagaggccgccagggcctagggatcacacaggatccggagctggtgctgataacagcggaatcccccgtctacctctctccttggtcctggaacagcgctactgatcaccaagtagccacaaaatataataaaccctcagcacttgctcagtagttttgtgaaagtctcaagtaaaagagacacaaacaaaaaattctttttcgtgaagaactccaaaaataaaattctctagagataaaaaaaaaaaaaaaaaggaaaatgccagctgatataatggagaaaaattcctcgtccccggtggctgctaccccagccagtgtcaacacgacaccggataaaccaaagacagcatctgagcacagaaagtcatcaaagcctattatggagaaaagacgaagagcaagaataaatgaaagtctgagccagctgaaaacactgattttggatgctctgaagaaagatagctcgcggcattccaagctggagaaggcggacattctggaaatgacagtgaagcacctccggaacctgcagcgggcgcagatgacggctgcgctgagcacagacccaagtgtgctggggaagtaccgagccggcttcagcgagtgcatgaacgaggtgacccgcttcctgtccacgtgcgagggcgttaataccgaggtgcgcactcggctgctcggccacctggccaactgcatgacccagatcaatgccatgacctaccccgggcagccgcaccccgccttgcaggcgccgccaccgcccccaccgggacccggcggcccccagcacgcgccgttcgcgccgccgccgccactcgtgcccatccccgggggcgcggcgccccctcccggcggcgccccctgcaagctgggcagccaggctggagaggcggctaaggtgtttggaggcttccaggtggtaccggctcccgatggccagtttgctttcctcattcccaacggggccttcgcgcacagcggccctgtcatccccgtctacaccagcaacagcggcacctccgtgggccccaacgcagtgtcaccttccagcggcccctcgcttacggcggactccatgtggaggccgtggcggaactgagggggctcaggccacccctcctcctaaactccccaacccacctctcttccctccggactctaaacaggaacttgaatactggatgaaagcactcgacatgaagggatcctctagatagcc

SEQ ID NO: 112689 - DNA, 816 bp, Homo sapiens
cccagagggagagtagcaaagggttaaaatccttttgattgacgttgtagcctccggtgccctgggctcaggcgcgcgccattggccgccagaccttgtgcctggcggccaatgggggggcgcggtccacgagcggtgccgcgtgtctcctcctcccattggctgaaagttactgtgggaaagaaagtttgggaagtttcacacgagccgttcgcgtgcagtcccagatatatatagaggccgccagggcctagggatcacacaggatccggagctggtgctgataacagcggaatcccccgtctacctctctccttggtcctggaacagcgctactgatcaccaagtagccacaaaatataataaaccctcagcacttgctcagtagttttgtgaaagtctcaagtaaaagagacacaaacaaaaaattctttttcgtgaagaactccaaaaataaaattctctagagataaaaaaaaaaaaaaaaaggaaaatgccagctgatataatggagaaaaattcctcgtccccggtggctgctaccccagccagtgtcaacacgacaccggataaaccaaagacagcatctgagcacagaaagtcatcaaagcctattatggagaaaagacgaagagcaagaataaatgaaagtctgagccagctgatattttggttctcaaaaactgcattattaataatattttagtatacagagctattctacagtttttacattgtaaacatgactgtggttttgtatttgctaaatataggggttggactaaaatataataaatctgtaccttatcaaaaaaa

SEQ ID NO: 112690 - DNA, 315 bp, Homo sapiens
agttttgtgaaagtctcaagtaaaagagacacaaacaaaaaattctttttcgtgaagaactccaaaaataaaattctctagagataaaaaaaaaaaaaaaaaggaaaatgccagctgatataatggagaaaaattcctcgtccccggtggctgctaccccagccagtgtcaacacgacaccggataaaccaaagacagcatctgagcacagaaaggtaagggcggtacctgtatctctttgcagcccctcaaaattaagtaggggttggggggcttctttctgtcttgaaaccccgggatggcagattccatggg

SEQ ID NO: 112691 - DNA, 2112 bp, Homo sapiens
cccagagggagagtagcaaagggttaaaatccttttgattgacgttgtagcctccggtgccctgggctcaggcgcgcgccattggccgccagaccttgtgcctggcggccaatgggggggcgcggtccacgagcggtgccgcgtgtctcctcctcccattggctgaaagttactgtgggaaagaaagtttgggaagtttcacacgagccgttcgcgtgcagtcccagatatatatagaggccgccagggcctagggatcacacaggatccggagctggtgctgataacagcggaatcccccgtctacctctctccttggtcctggaacagcgctactgatcaccaagtagccacaaaatataataaaccctcagcacttgctcagtagttttgtgaaagtctcaagtaaaagagacacaaacaaaaaattctttttcgtgaagaactccaaaaataaaattctctagagataaaaaaaaaaaaaaaaaggaaaatgccagctgatataatggagaaaaattcctcgtccccggtggctgctaccccagccagtgtcaacacgacaccggataaaccaaagacagcatctgagcacagaaagtcatcaaagcctattatggagaaaagacgaagagcaagaataaatgaaagtctgagccagctgaaaacactgattttggatgctctgaagaaagataagctggagaaggcggacattctggaaatgacagtgaagcacctccggaacctgcagcgggcgcagatgacggctgcgctgagcacagacccaagtgtgctggggaagtaccgagccggcttcagcgagtgcatgaacgaggtgacccgcttcctgtccacgggaaatgctgctcgctcttttaattaaaaaacaaacactttctcagctactaagagtgaaaccccccgccctgcggggtctggcactcgctggtactgcgttctcccaggcgggagggcccggccttattcgctggggtccagagataatgcttgcgctccgtggccgggaggagggacccccagcactctgaagcagctgacacggggctcactttcctttcttgcctactctatgcagagctcgcggcattccaagctggagaaggcggacattctggaaatgacagtgaagcacctccggaacctgcagcgggcgcagatgacggctgcgctgagcacagacccaagtgtgctggggaagtaccgagccggcttcagcgagtgcatgaacgaggtgacccgcttcctgtccacgtgcgagggcgttaataccgaggtgcgcactcggctgctcggccacctggccaactgcatgacccagatcaatgccatgacctaccccgggcagccgcaccccgccttgcaggcgccgccaccgcccccaccgggacccggcggcccccagcacgcgccgttcgcgccgccgccgccactcgtgcccatccccgggggcgcggcgccccctcccggcggcgccccctgcaagctgggcagccaggctggagaggcggctaaggtgtttggaggcttccaggtggtaccggctcccgatggccagtttgctttcctcattcccaacggggccttcgcgcacagcggccctgtcatccccgtctacaccagcaacagcggcacctccgtgggccccaacgcagtgtcaccttccagcggcccctcgcttacggcggactccatgtggaggccgtggcggaactgagggggctcaggccacccctcctcctaaactccccaacccacctctcttccctccggactctaaacaggaacttgaatactgggagagaagaggacttttttgattaagtggttactttgtgtttttttaatttctaagaagttactttttgtagagagagctgtattaagtgactgaccatgcactatatttgtatatattttatatgttcatattggattgcgcctttgtattataaaagctcagatgacatttcgttttttacacgagatttcttttttatgtgatgccaaagatgtttgaaaatgctcttaaaatatcttcctttggggaagtttatttgagaaaatataataaaagaaaaaagtaaaggc

SEQ ID NO: 112692 - DNA, 862 bp, Homo sapiens
cccagagggagagtagcaaagggttaaaatccttttgattgacgttgtagcctccggtgccctgggctcaggcgcgcgccattggccgccagaccttgtgcctggcggccaatgggggggcgcggtccacgagcggtgccgcgtgtctcctcctcccattggctgaaagttactgtgggaaagaaagtttgggaagtttcacacgagccgttcgcgtgcagtcccagatatatatagaggccgccagggcctagggatcacacaggatccggagctggtgctgataacagcggaatcccccgtctacctctctccttggtcctggaacagcgctactgatcaccaagtagccacaaaatataataaaccctcagcacttgctcagtagttttgtgaaagtctcaagtaaaagagacacaaacaaaaaattctttttcgtgaagaactccaaaaataaaattctctagagataaaaaaaaaaaaaaaaaggaaaatgccagctgatataatggagaaaaattcctcgtccccggtggctgctaccccagccagtgtcaacacgacaccggataaaccaaagacagcatctgagcacagaaagtcatcaaagcctattatggagaaaagacgaagagcaagaataaatgaaagtctgagccagctgaaaacactgattttggatgctctgaagaaagatagctcgcggcattccaagctggagaaggcggacattctggaaatgacagtgaagcacctccggaacctgcagcgggcgcagatgacgggtgagggcggctcgccgcgtccccctgtgcgggcgtcccgctcgcctcgcggtgatttcttccagacttccgcccgt

SEQ ID NO: 112693 - DNA, 1264 bp, Homo sapiens
cccagagggagagtagcaaagggttaaaatccttttgattgacgttgtagcctccggtgccctgggctcaggcgcgcgccattggccgccagaccttgtgcctggcggccaatgggggggcgcggtccacgagcggtgccgcgtgtctcctcctcccattggctgaaagttactgtgggaaagaaagtttgggaagtttcacacgagccgttcgcgtgcagtcccagatatatatagaggccgccagggcctagggatcacacaggatccggagctggtgctgataacagcggaatcccccgtctacctctctccttggtcctggaacagcgctactgatcaccaagtagccacaaaatataataaaccctcagcacttgctcagtagttttgtgaaagtctcaagtaaaagagacacaaacaaaaaattctttttcgtgaagaactccaaaaataaaattctctagagataaaaaaaaaaaaaaaaaggaaaatgccagctgatataatggagaaaaattcctcgtccccggtggctgctaccccagccagtgtcaacacgacaccggataaaccaaagacagcatctgagcacagaaagtcatcaaagcctattatggagaaaagacgaagagcaagaataaatgaaagtctgagccagctgaaaacactgattttggatgctctgaagaaagataagctggagaaggcggacattctggaaatgacagtgaagcacctccggaacctgcagcgggcgcagatgacggctgcgctgagcacagacccaagtgtgctggggaagtaccgagccggcttcagcgagtgcatgaacgaggtgacccgcttcctgtccacgggaaatgctgctcgctcttttaattaaaaaacaaacactttctcagctactaagagtgaaaccccccgccctgcggggtctggcactcgctggtactgcgttctcccaggcgggagggcccggccttattcgctggggtccagagataatgcttgcgctccgtggccgggaggagggacccccagcactctgaagcagctgacacggggctcactttcctttcttgcctactctatgcagagctcgcggcattccaagctggagaaggcggacattctggaaatgacagtgaagcacctccggaacctgcagcgggcgcagatgacgggtgagggcggctcgccgcgtccccctgtgcgggcgtcccgctcgcctcgcggtgatttcttccagacttccgcccgt

SEQ ID NO: 112694 - DNA, 1778 bp, Homo sapiens
aggaaccggggggttgtcggtctataagcctcgcccgttccgctccctggggcttccccgagcgccgtcggtggtcatggctgccccagcctcccggcaggtccgacgcagagcccgggcagcgccgcggccccgctcggccgaggactggtggtgggaccggctggcgccgaggggctcggggtaccacctgctgcagtccgacagcatgctgctggtgctgtccgaacccggccccgcccggccccgcgcacagcggcgcgcttcccgccgcactccccggcagccgccccggggccccagcgccgcggccaagcccaaggccgggctcaggtccgaggcggcggccgcgcccgcacccgcaccggcacccacgcccacgcccgaggaagggcccgacgcgggctggggagaccgcattcccttggaaatcctggtgcagattttcgggttgttggtggcggcggacggccccatgcccttcctgggcagggctgcgcgcgtgtgccgccgctggcaggaggccgcttcccaacccgcgctctggcacaccgtgaccctgtcgtccccgctggtcggccggcctgccaagggcggggtcaaggcggagaagaagctccttgcttccctggagtggcttatgcccaatcggttttcacagctccagaggctgaccctcatccactggaagtctcagctggtaggtgagtgctgtcctcggctcactttcctcaagctctccggctgccacggtgtgactgctgacgctctggtcatgctagccaaagcctgctgccagctccatagcctggacctacagcactccatggtggagtccacagctgtggtgagcttcttggaggaggcagggtcccgaatgcgcaagttgtggctgacctacagctcccagacgacagccatcctgggcgcactgctgggcagctgctgcccccagctccaggtcctggaggtgagcaccggcatcaaccgtaatagcattccccttcagctgcctgtcgaggctctgcagaaaggctgccctcagctccaggtgctgcggctgttgaacctgatgtggctgcccaagcctccgggacgaggggtggctcccggaccaggcttccctagcctagaggagctctgcctggcgagctcaacctgcaactttgtgagcaacgaggtcctgggccgcctactccacggctctcccaacctgcgcttactggatcttcgtggctgtgcgcgcatcacgccggctggccttcaggatctgccatgtcgggagctggagcagcttcatctgggcctgtatggcacgtcagaccggctgactctagccaaggagggcagcccctttttgacccagaagtggtgccatacactgcgagaactggacttgagtggccaggggttcagtgagaaggacctggagcaggccctggctgccttcttaagcacccctgggggctcacacccagccctgtgctctcttaacctcaggggcacccgggtcacaccaagcactgtcagctctgtgatcagcagctgcccgggcctgctctacctcaacctggagtcctgccgctgccttccccggggtctgaagcgggcctaccggggcctggaggaagtccagtggtgtctggagcagctgctcaccagcccctcacccagctaggcagccacagacctgggacacctcagccagcttgcccaccctccacctttgcccaatttcagatatttgagcattttgttaaaataaaacatttttagga

SEQ ID NO: 112695 - DNA, 1796 bp, Homo sapiens
aggaaccggggggttgtcggtctataagcctcgcccgttccgctccctggggcttccccgagcgccgtcggtggtcatggctgccccagcctcccggcaggtccgacgcagagcccgggcagcgccgcggccccgctcggccgaggactggtggtgggaccggctggcgccgaggggctcggggtaccacctgctgcagtccgacagcatgctgctggtgctgtccgaacccggccccgcccggccccgcgcacagcggcgcgcttcccgccgcactccccggcagccgccccggggccccagcgccgcggccaagcccaaggccgggctcaggtccgaggcggcggccgcgcccgcacccgcaccggcacccacgcccacgcccgaggaagggcccgacgcgggctggggagaccgcattcccttggaaatcctggtgcagattttcgggttgttggtggcggcggacggccccatgcccttcctgggcagggctgcgcgcgtgtgccgccgctggcaggaggccgcttcccaacccgcgctctggcacaccgtgaccctgtcgtccccgctggtcggccggcctgccaagggcggggtcaaggcggagaagaagctccttgcttccctggagtggcttatgcccaatcggttttcacagctccagaggctgaccctcatccactggaagtctcaggtacaccccgtgttgaagctggtaggtgagtgctgtcctcggctcactttcctcaagctctccggctgccacggtgtgactgctgacgctctggtcatgctagccaaagcctgctgccagctccatagcctggacctacagcactccatggtggagtccacagctgtggtgagcttcttggaggaggcagggtcccgaatgcgcaagttgtggctgacctacagctcccagacgacagccatcctgggcgcactgctgggcagctgctgcccccagctccaggtcctggaggtgagcaccggcatcaaccgtaatagcattccccttcagctgcctgtcgaggctctgcagaaaggctgccctcagctccaggtgctgcggctgttgaacctgatgtggctgcccaagcctccgggacgaggggtggctcccggaccaggcttccctagcctagaggagctctgcctggcgagctcaacctgcaactttgtgagcaacgaggtcctgggccgcctactccacggctctcccaacctgcgcttactggatcttcgtggctgtgcgcgcatcacgccggctggccttcaggatctgccatgtcgggagctggagcagcttcatctgggcctgtatggcacgtcagaccggctgactctagccaaggagggcagcccctttttgacccagaagtggtgccatacactgcgagaactggacttgagtggccaggggttcagtgagaaggacctggagcaggccctggctgccttcttaagcacccctgggggctcacacccagccctgtgctctcttaacctcaggggcacccgggtcacaccaagcactgtcagctctgtgatcagcagctgcccgggcctgctctacctcaacctggagtcctgccgctgccttccccggggtctgaagcgggcctaccggggcctggaggaagtccagtggtgtctggagcagctgctcaccagcccctcacccagctaggcagccacagacctgggacacctcagccagcttgcccaccctccacctttgcccaatttcagatatttgagcattttgttaaaataaaacatttttagga

SEQ ID NO: 112696 - DNA, 2239 bp, Homo sapiens
aggaaccggggggttgtcggtctataagcctcgcccgttccgctccctggggcttccccgagcgccgtcggtggtcatggctgccccagcctcccggcaggtccgacgcagagcccgggcagcgccgcggccccgctcggccgaggactggtggtgggaccggctggcgccgaggggctcggggtaccacctgctgcagtccgacagcatgctgctggtgctgtccgaacccggccccgcccggccccgcgcacagcggcgcgcttcccgccgcactccccggcagccgccccggggccccagcgccgcggccaagcccaaggccgggctcaggtccgaggcggcggccgcgcccgcacccgcaccggcacccacgcccacgcccgaggaagggcccgacgcgggctggggagaccgcattcccttggaaatcctggtgcagattttcgggttgttggtggcggcggacggccccatgcccttcctgggcagggctgcgcgcgtgtgccgccgctggcaggaggccgcttcccaacccgcgctctggcacaccgtgaccctgtcgtccccgctggtcggccggcctgccaagggcggggtcaaggcggagaagaagctccttgcttccctggagtggcttatgcccaatcggtgaggggttccctctcttccttacccctggctccaggctccttccgtctccctgcaccaaggtgttgggtgggaaggactcgtgtgggaacattagtgcagctctgcctccgctgtcggcccaggttttcacagctccagaggctgaccctcatccactggaagtctcaggtacaccccgtgttgaaggtgagagctccaggctgtcctgcacatcagctgtgacactctgggactgttcagtactctaggaagtgggtcaggcaccttgggggcccaacgctgctccgtggggatgtctgcttgcctgcctggttctcttttcctgctgtttcctccagcagggaggtatcagaggcggggacacccaagtaggcctggcatgggcagaaaggaggtcacagctaaggcggtagagtggggttggcaccagccactttgtctgtttcccttgtggatcttagcctgtcgtctcccaaccccagctgcccctctgtctccccgcagctggtaggtgagtgctgtcctcggctcactttcctcaagctctccggctgccacggtgtgactgctgacgctctggtcatgctagccaaagcctgctgccagctccatagcctggacctacagcactccatggtggagtccacagctgtggtgagcttcttggaggaggcagggtcccgaatgcgcaagttgtggctgacctacagctcccagacgacagccatcctgggcgcactgctgggcagctgctgcccccagctccaggtcctggaggtgagcaccggcatcaaccgtaatagcattccccttcagctgcctgtcgaggctctgcagaaaggctgccctcagctccaggtgctgcggctgttgaacctgatgtggctgcccaagcctccgggacgaggggtggctcccggaccaggcttccctagcctagaggagctctgcctggcgagctcaacctgcaactttgtgagcaacgaggtcctgggccgcctactccacggctctcccaacctgcgcttactggatcttcgtggctgtgcgcgcatcacgccggctggccttcaggatctgccatgtcgggagctggagcagcttcatctgggcctgtatggcacgtcagaccggctgactctagccaaggagggcagcccctttttgacccagaagtggtgccatacactgcgagaactggacttgagtggccaggggttcagtgagaaggacctggagcaggccctggctgccttcttaagcacccctgggggctcacacccagccctgtgctctcttaacctcaggggcacccgggtcacaccaagcactgtcagctctgtgatcagcagctgcccgggcctgctctacctcaacctggagtcctgccgctgccttccccggggtctgaagcgggcctaccggggcctggaggaagtccagtggtgtctggagcagctgctcaccagcccctcacccagctaggcagccacagacctgggacacctcagccagcttgcccaccctccacctttgcccaatttcagatatttgagcattttgttaaaataaaacatttttagga

SEQ ID NO: 112697 - DNA, 2085 bp, Homo sapiens
aggaaccggggggttgtcggtctataagcctcgcccgttccgctccctggggcttccccgagcgccgtcggtggtcatggctgccccagcctcccggcaggtccgacgcagagcccgggcagcgccgcggccccgctcggccgaggactggtggtgggaccggctggcgccgaggggctcggggtaccacctgctgcagtccgacagcatgctgctggtgctgtccgaacccggccccgcccggccccgcgcacagcggcgcgcttcccgccgcactccccggcagccgccccggggccccagcgccgcggccaagcccaaggccgggctcaggtccgaggcggcggccgcgcccgcacccgcaccggcacccacgcccacgcccgaggaagggcccgacgcgggctggggagaccgcattcccttggaaatcctggtgcagattttcgggttgttggtggcggcggacggccccatgcccttcctgggcagggctgcgcgcgtgtgccgccgctggcaggaggccgcttcccaacccgcgctctggcacaccgtgaccctgtcgtccccgctggtcggccggcctgccaagggcggggtcaaggcggagaagaagctccttgcttccctggagtggcttatgcccaatcggttttcacagctccagaggctgaccctcatccactggaagtctcaggtacaccccgtgttgaagctggtaggtgagtgctgtcctcggctcactttcctcaagctctccggctgccacggtgtgactgctgacgctctggtcatgctagccaaagcctgctgccagctccatagcctggacctacagcactccatggtggagtccacagctgtggtgagcttcttggaggaggcagggtcccgaatgcgcaagttgtggctgacctacagctcccagacgacagccatcctgggcgcactgctgggcagctgctgcccccagctccaggtcctggaggtgagcaccggcatcaaccgtaatagcattccccttcagctgcctgtcgaggctctgcagaaaggctgccctcagctccaggtgctgcggctgttgaacctgatgtggctgcccaagcctccgggacgaggggtggctcccggaccaggcttccctagcctagaggagctctgcctggcgagctcaacctgcaactttgtgagcaacgaggtcctgggccgcctactccacggctctcccaacctgcgcttactggatcttcgtggctgtgcgcgcatcacgccggctggccttcaggatctgccatgtcgggagctggagcagcttcatctgggcctgtatggcacgtcagaccggctgactctagccaaggagggcagcccctttttgacccagaagtggtgccatacactgcgagaactggacttgagtggccaggggttcagtgagaaggacctggagcaggccctggctgccttcttaagcacccctgggggctcacacccagccctgtgctctcttaacctcaggggcacccgggtcacaccaagcactgtcaggtcagcatcccctaccccagtccctggagccagtgtggctgtcactgtgtctgcctggggcctggaagttgtgtcctgcctggcctgagacctccaggggtcagaggggcatgcatactgtccaagcccctgcgtggggtgggcctgaggacaccaggggaactgggcttggccttggtggctatgggtggcagagccaggtgtcgaacaccagcaggcacagctccctagcctggcccagcccttctgaggcaacagctcaacttcctgtggtctgccctccccacagctctgtgatcagcagctgcccgggcctgctctacctcaacctggagtcctgccgctgccttccccggggtctgaagcgggcctaccggggcctggaggaagtccagtggtgtctggagcagctgctcaccagcccctcacccagctaggcagccacagacctgggacacctcagccagcttgcccaccctccacctttgcccaatttcagatatttgagcattttgttaaaataaaacatttttagga

SEQ ID NO: 112698 - DNA, 2484 bp, Homo sapiens
aggaaccggggggttgtcggtctataagcctcgcccgttccgctccctggggcttccccgagcgccgtcggtggtcatggctgccccagcctcccggcaggtccgacgcagagcccgggcagcgccgcggccccgctcggccgaggactggtggtgggaccggctggcgccgaggggctcggggtaccacctgctgcagtccgacagcatgctgctggtgctgtccgaacccggccccgcccggccccgcgcacagcggcgcgcttcccgccgcactccccggcagccgccccggggccccagcgccgcggccaagcccaaggccgggctcaggtccgaggcggcggccgcgcccgcacccgcaccggcacccacgcccacgcccgaggaagggcccgacgcgggctggggagaccgcattcccttggaaatcctggtgcagattttcgggttgttggtggcggcggacggccccatgcccttcctgggcaggtaacgctggtgccgggcccgccgccgagcgtagcggcttgggccagacgtggtccgagcggtggcccgggcgggggcggagggcgaaagcatcggagcgcgcaccgctcagtccgagagcgcagccccttaggcgcccagttggagtcccaggagcccggctttgagccggggtgtctactgcgctgcgagaggggggcatcgcctacggaggggccggcaccctcagcacgctgtcctcccagggctgcgcgcgtgtgccgccgctggcaggaggccgcttcccaacccgcgctctggcacaccgtgaccctgtcgtccccgctggtcggccggcctgccaagggcggggtcaaggcggagaagaagctccttgcttccctggagtggcttatgcccaatcggtgaggggttccctctcttccttacccctggctccaggctccttccgtctccctgcaccaaggtgttgggtgggaaggactcgtgtgggaacattagtgcagctctgcctccgctgtcggcccaggttttcacagctccagaggctgaccctcatccactggaagtctcaggtacaccccgtgttgaaggtgagagctccaggctgtcctgcacatcagctgtgacactctgggactgttcagtactctaggaagtgggtcaggcaccttgggggcccaacgctgctccgtggggatgtctgcttgcctgcctggttctcttttcctgctgtttcctccagcagggaggtatcagaggcggggacacccaagtaggcctggcatgggcagaaaggaggtcacagctaaggcggtagagtggggttggcaccagccactttgtctgtttcccttgtggatcttagcctgtcgtctcccaaccccagctgcccctctgtctccccgcagctggtaggtgagtgctgtcctcggctcactttcctcaagctctccggctgccacggtgtgactgctgacgctctggtcatgctagccaaagcctgctgccagctccatagcctggacctacagcactccatggtggagtccacagctgtggtgagcttcttggaggaggcagggtcccgaatgcgcaagttgtggctgacctacagctcccagacgacagccatcctgggcgcactgctgggcagctgctgcccccagctccaggtcctggaggtgagcaccggcatcaaccgtaatagcattccccttcagctgcctgtcgaggctctgcagaaaggctgccctcagctccaggtgctgcggctgttgaacctgatgtggctgcccaagcctccgggacgaggggtggctcccggaccaggcttccctagcctagaggagctctgcctggcgagctcaacctgcaactttgtgagcaacgaggtcctgggccgcctactccacggctctcccaacctgcgcttactggatcttcgtggctgtgcgcgcatcacgccggctggccttcaggatctgccatgtcgggagctggagcagcttcatctgggcctgtatggcacgtcagaccggctgactctagccaaggagggcagcccctttttgacccagaagtggtgccatacactgcgagaactggacttgagtggccaggggttcagtgagaaggacctggagcaggccctggctgccttcttaagcacccctgggggctcacacccagccctgtgctctcttaacctcaggggcacccgggtcacaccaagcactgtcagctctgtgatcagcagctgcccgggcctgctctacctcaacctggagtcctgccgctgccttccccggggtctgaagcgggcctaccggggcctggaggaagtccagtggtgtctggagcagctgctcaccagcccctcacccagctaggcagccacagacctgggacacctcagccagcttgcccaccctccacctttgcccaatttcagatatttgagcattttgttaaaataaaacatttttagga

SEQ ID NO: 112699 - DNA, 1549 bp, Homo sapiens
aggaaccggggggttgtcggtctataagcctcgcccgttccgctccctggggcttccccgagcgccgtcggtggtcatggctgccccagcctcccggcaggtccgacgcagagcccgggcagcgccgcggccccgctcggccgaggactggtggtgggaccggctggcgccgaggggctcggggtaccacctgctgcagtccgacagcatgctgctggtgctgtccgaacccggccccgcccggccccgcgcacagcggcgcgcttcccgccgcactccccggcagccgccccggggccccagcgccgcggccaagcccaaggccgggctcaggtccgaggcggcggccgcgcccgcacccgcaccggcacccacgcccacgcccgaggaagggcccgacgcgggctggggagaccgcattcccttggaaatcctggtgcagattttcgggttgttggtggcggcggacggccccatgcccttcctgggcagggctgcgcgcgtgtgccgccgctggcaggaggccgcttcccaacccgcgctctggcacaccgtgaccctgtcgtccccgctggtcggccggcctgccaagggcggggtcaaggcggagaagaagctccttgcttccctggagtggcttatgcccaatcggttttcacagctccagaggctgaccctcatccactggaagtctcaggtacaccccgtgttgaagctggtaggtgagtgctgtcctcggctcactttcctcaagctctccggctgccacggtgtgactgctgacgctctggtcatgctagccaaagcctgctgccagctccatagcctggacctacagcactccatggtggagtccacagctgtggtgagcttcttggaggaggcagggtcccgaatgcgcaagttgtggctgacctacagctcccagacgacagccatcctgggcgcactgctgggcagctgctgcccccagctccaggtcctggaggtgagcaccggcatcaaccgtaatagcattccccttcagctgcctgtcgaggctctgcagaaaggctgccctcagctccaggtgctgcggctgttgaacctgatgtggctgcccaagcctccgggacgaggggtggctcccggaccaggcttccctagcctagaggagctctgcctggcgagctcaacctgcaactttgtgagcaacgaggtcctgggccgcctactccacggctctcccaacctgcgcttactggatcttcgtggctgtgcgcgcatcacgccggctggccttcaggatctgccatgtcgggctctgtgatcagcagctgcccgggcctgctctacctcaacctggagtcctgccgctgccttccccggggtctgaagcgggcctaccggggcctggaggaagtccagtggtgtctggagcagctgctcaccagcccctcacccagctaggcagccacagacctgggacacctcagccagcttgcccaccctccacctttgcccaatttcagatatttgagcattttgttaaaataaaacatttttagga

SEQ ID NO: 112700 - DNA, 1790 bp, Homo sapiens
aggaaccggggggttgtcggtctataagcctcgcccgttccgctccctggggcttccccgagcgccgtcggtggtcatggctgccccagcctcccggcaggtccgacgcagagcccgggcagcgccgcggccccgctcggccgaggactggtggtgggaccggctggcgccgaggggctcggggtaccacctgctgcagtccgacagcatgctgctggtgctgtccgaacccggccccgcccggccccgcgcacagcggcgcgcttcccgccgcactccccggcagccgccccggggccccagcgccgcggccaagcccaaggccgggctcaggtccgaggcggcggccgcgcccgcacccgcaccggcacccacgcccacgcccgaggaagggcccgacgcgggctggggagaccgcattcccttggaaatcctggtgcagattttcgggttgttggtggcggcggacggccccatgcccttcctgggcaggtaacgctggtgccgggcccgccgccgagcgtagcggcttgggccagacgtggtccgagcggtggcccgggcgggggcggagggcgaaagcatcggagcgcgcaccgctcagtccgagagcgcagccccttaggcgcccagttggagtcccaggagcccggctttgagccggggtgtctactgcgctgcgagaggggggcatcgcctacggaggggccggcaccctcagcacgctgtcctcccagggctgcgcgcgtgtgccgccgctggcaggaggccgcttcccaacccgcgctctggcacaccgtgaccctgtcgtccccgctggtcggccggcctgccaagggcggggtcaaggcggagaagaagctccttgcttccctggagtggcttatgcccaatcggtgaggggttccctctcttccttacccctggctccaggctccttccgtctccctgcaccaaggtgttgggtgggaaggactcgtgtgggaacattagtgcagctctgcctccgctgtcggcccaggttttcacagctccagaggctgaccctcatccactggaagtctcaggtacaccccgtgttgaaggtgagagctccaggctgtcctgcacatcagctgtgacactctgggactgttcagtactctaggaagtgggtcaggcaccttgggggcccaacgctgctccgtggggatgtctgcttgcctgcctggttctcttttcctgctgtttcctccagcagggaggtatcagaggcggggacacccaagtaggcctggcatgggcagaaaggaggtcacagctaaggcggtagagtggggttggcaccagccactttgtctgtttcccttgtggatcttagcctgtcgtctcccaaccccagctgcccctctgtctccccgcagctggtaggtgagtgctgtcctcggctcactttcctcaagctctccggctgccacggtgtgactgctgacgctctggtcatgctagccaaagcctgctgccagctccatagcctggacctacagcactccatggtggagtccacagctgtggtgagcttcttggaggaggcagggtcccgaatgcgcaagttgtggctgacctacagctcccagacgacagccatcctgggcgcactgctgggcagctgctgcccccagctccaggtcctggaggtgagcaccggcatcaaccgtaatagcattccccttcagctgcctgtcgaggctctgcagaaaggctgccctcagctccaggtacctggcgccctgcctctcccacctgtcaca

SEQ ID NO: 112701 - DNA, 577 bp, Homo sapiens
taccttctaacatttacatgtgtgttaagttactgaatgggtatgattatgtctccttttaaaagtatactggaggcaaaactttttttggcaagttaacttagatggagagagacctttaggagattttctcttttcctctgaggttattattggtggctgaattggaggttttagcactgtgttgtgttaaagatggctacactgttagggctttggatagttagactacccagaagcaaggaaagtgttgaggtgtggcctttcccatttaggccaggggactctgaatataatcaggaaacaccgcctgcctagtttggagtagattgcacttggtgttggaggaagggacttagaactaaaaaggatccattacctctaaagaaagacctgttagaataaaaactctccctcaagagaaacataactgtttctaaagatcaaaatcatttcggaaacttcgattattatcagtgcttcaacaatcaattcttcaactatatatagttcttaagtttcaattttgttaccaatccttcagtgtctgatctctccctaatacttcataggggcc

SEQ ID NO: 112702 - DNA, 579 bp, Homo sapiens
cgctgtttgtcaaattcattcatctgacccagatttagtcagcacctaccaggcactgttctaggagtgggggtacagtattgaacaaggtagacgagcttcctgcttttgtggagcccatgttccacagaataaacaagtagacatataaatacatgattttagacagttgtataatcagtgaagaaaatagagcaaagtaaatgacatgagaagaactgtaggtaccagaaggaagatctgaaggtgatttttgattgggtggcaggaaaggcctccctgaggaggtgacatttgtttcataggaaggagccagccattgtagtggctgagaaaagagctatccaatgtggaaacgaagcagctttggtacaagcccagcacgcaggcttttgtggctggagaagagtgaacaggagggaatgtcgggtcctggagttagtggataggcagggcgccatcgggttaggtttacgtgatcagaactgtcatgggagggttttcagcagggaaaccacaaaagctgctatgtagacggaccaaaacagaagggggcagccaggaacagacccaaggggg

SEQ ID NO: 112703 - DNA, 727 bp, Homo sapiens
attgtgtttgagacattgtacattttggttcttttcaccctcttcagcttcccaaagtgctgggattacaggcaagagcctgtagaagagtcatttgcctacttcattacattacctaggattagttagattcacttccctgctggggaaagcacttcatccaaaaacatttctgtgattttcttctcttttattgatagttgctaagtctgtctctgtagcacacatctcccatcaatatttctatttagttcgtttcaaactcaagtaccctgaaatattttaagtttaacatcccactccagtgcccaccagccttgtcctaataaaattaagttggtatcattaaacaaaacaaaaaaaaaaaaaaaaaaacaaaaaaaaaaaaaaaaaaaacaaaaaaaaaaaaaaaaaaaaaaaaaaacaaacaaaacaaaaaaaagacacaaaaaacaacaagaaagaagaaaaaaaaaacagtggggggggggggcgcgccgcgagagaggagacacgacacacggggggggggggggcaccaacgagaggggcgcagacgcccgccccacgctcactacaaagagacagtggttaagagcagaggagggagagactaccaacaaaaaaaaaaccgccggcggaacaacatgactggctcaaaaccccacggagtagtggagggcaacacggaggacataaaagaggcaccagcgcgcgaaaaaaagcg

SEQ ID NO: 112704 - DNA, 350 bp, Homo sapiens
attgtgtttgagacattgtacattttggttcttttcaccctcttcagcttcccaaagtgctgggattacaggcaagagcctgtagaagagtcatttgcctacttcattacattacctaggattagttagattcacttccctgctggggaaagcacttcatccaaaaacatttctgtgattttcttctcttttattgatagttgctaagtctgtctctgtagcacacatctcccatcaatatttctatttagttcgtttcaaactcaagtaccctgaaatattttaagtttaacatcccactcctatctttaattgtaccatatttcaagttgtcattaagaacccccaaa

SEQ ID NO: 112705 - DNA, 453 bp, Homo sapiens
actccagctgagtcgaccctgtctcaaaaaaacaagaagactgaggaagtcgtggagttgggggcaaagttgctgtaaaccaaaggatgagaaacagacaggctgctgggctaactggagaaagaaaatggctcaggtgaccacacaaatcgattcactcattctcccattggtcatcagtcacctcccacagcatcaccgtggaccctgctgacagccagaaccactccagctctaaaactctaactcccacacctcgccagctgcccacagcctctcctcttcccactcaccaactgcatgaatccctccgcttgtgctctctgacgacacaggcccctccagccactggccctctactttcttccagcccatcaccctcttcttcctcatgtccttccttatcacagctcagcgtggaggtgcagtgtctcagtaacggtcttttcaatg

SEQ ID NO: 112706 - DNA, 744 bp, Homo sapiens
ggtttaaaactagccacagattggtcatttttttaactttccactttaaagttagataaaatgtttaaatatgtttaacaaaggggacactacccaggagcctccagtgtttgcacagttgcaaatctgtctttattcttgacatagtaaaaataagtttaagcggattccttccaggaacatatttcaacatgtaagtcctaaaactgtataccattggttaatttttcttattgtagataaagaaaaatcgtaggttgtggtaacttggcatttttcataagaatatgtgcctaattcagagcacttgtgtaactacaggtgatttctttcttctactccaaaaactagtcttcgtaactatgaatgtttatagaaggtactcagtcttctgccaaggttggggaagggatgaatcagggcaggggctgcagagaaattgctgagaggcatattgagtttgtagaggggaagggaagggtttttcaggccgaggcattgaggctgagagaacagtggttctggggaagtgtaagtagattggtagtagcttaagaaactatgaaataattacaagaaataaagccaaaatggtagcccaggggtctttatgagtagtctcattctaagttaggatatttggaccttgagtcacatggcttcgagccattgaaaggtttacatgatgaagttaagattgacagatattcaaaggggagagtacaggtaaaggcagataggggg

SEQ ID NO: 112707 - DNA, 470 bp, Homo sapiens
atatttttgattaataactttaagatttgtaaaatattttgctaataaaccatgaaagatacagactattaactttagagtcttgtttttgtgctttctaaacaaatttatcagaacttaatacatccaaatcactgcaaagtagtcatatcaaaaaggtgatattcatggccaggcacagtggcgcatgcctgctatcccagcactttaggaggctgaggcaggcagatggcttgagcccaggagtttgagaccagcctgggcaacatggcacagccccgtctctctacagaaagtacaaaaatgaacgggcatggtggcacccacctgtagtcccagctactcaggaggctgagatgggagaatctcttgagtgtgggaggtggaggttgcagtgagccaagtttgcgccactgcactccagcctgggcaacagagccagaccctgtctttaaaaaaaaaaaaaaaaa

SEQ ID NO: 112708 - DNA, 360 bp, Homo sapiens
ccagggcagctgggctctggagctgggggtagagggagaggtgtgtgggacctgctttgccactcttctctcacccaatagaagatgaaaggacaacccctcactaccctgcccttcgactcccgtgcgagttcccactctttgtagtgggcagggaaaacatttatctgtgctcacaaatctcaatcaggggggcagccaggcgcagcggccctccttgggaataccttcccctttgaaaggtttatcaatccatctgccgcttggtcagccccagacaggaccatgattaattattcctgtctttcccaagttgactttgatggttgcttgttgaaacaagtcgtctgaattcaggaa

SEQ ID NO: 112709 - DNA, 1016 bp, Homo sapiens
taataattctaagcatgttgcttccagagtctgccatttcttccatttttggtatttttctaacagtggttttgtgctctcacctgtgaggattaagagcctgggataaaactcattttcagtctaaagatttaaactcatttgaattgagtagatgcttttgtgatgtctgcatctctcctgacttaatagttcccttcttcacattacttaatctgtccttttggttagaagatcatgctcttacctaaagatagaaggaagcaaaatgaacatggaactacattgccctgccttttctcctgtcaaatatggcatcaggctgagcagtggcttttcctgatattccccttattcaaaacatagctttgtcttgctttcagcatttttcactttcctcagatcattatggattctgactttaatccgtaagaattatacttttatatacaagtaggttatatacctctacccatcttttctaagctttctttgcaaatctagtcccatcagattctccctgtgtaacaaccaacttctttagatttcctctaattttcttttctttatagatttatttattattgcatagtcaaaatgtcatgttttagcatcttctgtggcctgtgaatcactgctctctataaccatgggaccactcccacccatccttttcccgatctttttttggatagttgttttcttaaaaaatctggaagcaggctgggtgcggtggctcacgcctgtaatcccagcactttgggaggctgaggctggtggatcacgaggtcaggcattcaagaccagcctgaccaacatggtaaaaccctgtctctactaaaaatacaaaaattagccgggtgtgatggtgtgtgcctgtaatcccagctatttgggaaactgagataggagaatcgcttgaacttgggaggcagaggttgcagtgagccgaggtcgcaccattgccctccaggctgaagcgacgcagcgagactccgtctccaaaaaaaaaaaaa

SEQ ID NO: 112710 - DNA, 739 bp, Homo sapiens
gagtcaattatctgttcaggcagtgggcagtgagggagtggggagaggtggaaggatttgtttctctttttttttttaattcctaaacatttccaccagagacataaaattatccaaaacaaataaatgcattattttgccctccatgttgctggttgctagggcacccatgcctaatttaaaatatatacatcttttgaatgtagcattttaagttttcagatttatgcaaggtatggagaggaagggagactgttagcatgttttaaaacaaggttaactccatatggagccctgccttctcaagcaatgaattttccaggattaattataaccgaagcaagatttagtcatggactaaaagtagctgcattatcatagaattcttaagtgttattcatataagttttgtatataggatgaacaaattataggtttctaactagaactgcaatgtcattccagaaactatgcaagggtattaaaatgcttattttacagttgttcctggcatttctataattaactaatgatttagtacatctggtgatttggaccaggaatgtgagcaaatcagaatatattaactagtagaggaggtagaatgtttcctattttgtagtgttaagaaagtagacagttaactgactcttaccctgaagaaaatgacaaagggtcagccaggtgcccttccttatcagagatcgtaagtttctatagtccttttgtatggaagtga

SEQ ID NO: 112711 - DNA, 173 bp, Homo sapiens
gactgttaatattccatttaagttttattttataggtagttctattgtctgtatgttttactttagaagcttgagtgtaaatttcttgttacattgttgatactggggatggaaatacaaaaaatacagaatttcatttgataacctgtattttgaatttggagacaagccca

SEQ ID NO: 112712 - DNA, 664 bp, Homo sapiens
ggtcccatgacaatagcattcactaaaaacttagctggtttttatctattgatttctgtggctccatacgccagtagctgcaccctaattattttgagacataaatatcttaaacccattctaattttgtggaagaatcacacctttattctcatttagttaagctactatgtctaacctaaatgatttattgagtgctaccttattcaaaggttttaacttcaaaggtatcagggctaagatattgtgatcttgttccaaggcttatttttttaacttctcttttgaaaaatttcaaatatacacaaaagtagtaagaatggtgtaattcccatatattcttttccttttcaccaattaataatatttttccacatttacattctctccctccttttagatttttctctttctttctggctttctttagacacacacacacacacacacacacacacacattgattgttgctgaaccattcaacagtaagttatcgtgattatattaaatcctaaatatttcagcatgtgatgaggacatgcttttatataaccacattatcataatcaaattcaaataatttaacattgatataacattcttatctaacatataggccatattaaaatgtattcaattaacccaatagtgctatttattttc

SEQ ID NO: 112713 - DNA, 184 bp, Homo sapiens
aaggtggccttctgcaacccaaggagagaggcctcaggagaaaccaaacctgctgacaccttgatcttggacttctaggtcctgaactgtgaggaaataaatctctgctgtttaagtagaacagtttgagttactttgttacagcagacccagcaaacttatccacacatcatgagtttgtggg

SEQ ID NO: 112714 - DNA, 487 bp, Homo sapiens
acatcttgaattttattatcttgatgatgtgtttatggcagttcattatgccactgtttctactattgtatatgtctgattttttccacaaaatgagttctaagatcatacattgtttaggtgtggcttaactcatttattaatcatgattgagtgaactttaactctaatattgagagaatttttaaagtattacaatttgtagtcagacactgtggctcatgcctgtaattccagcattttgagaggccaaggtggaggattgcttgagcccaggcattggagaccagcctgggtaacatggccaaactctgtccctacaaaaaatacagaaattagcaaggtgtggtggcatgcaccgtagtcccagctacttgagaggctgaggtgggaggatagctgagcccagaagatcaaggctgcagtgaaccatgatcgtgatcatgccaccgcactccattctgggtgacaggccaagaccctgtct

SEQ ID NO: 112715 - DNA, 628 bp, Homo sapiens
  misc_feature (545)..(545): n is a, c, g, or t
cttagcaacatagagggtgcaggggatcttagctagaactgttttattggactaatgggagtagcaacatgactgtagtagtagaggcaagattcaaagttgaagaggacaatatgaatgtaaatggaacggggaaggatggttactgaaaggctgctgtgtgttactgcatactcacttgctctcttcctctctctctcaagataggagaggagagagactaagaatatctttcagtgttgatgggagggatccagtagagactgagaggctgaagacacaagggaaaaggggatactcaatgacaaaatatttttctgagaagctggggtaggtgggtgaaggattagcttttgataagggaagaagacttccctgctcagttgtcaggaaggaaggagttaagtagggggtggtgagtacagaataggttcgtttgtagttttcatgatgggaggttgggggcattgcctaggggtggattccattttcttagggaggtctaggatagttgagaggttaatgtgcatgtatgataggctcantctgctctgctgagtcatgttctctaataaggcttagctgccagatccacattccaagaagcctagtggccaggctcactcaa

SEQ ID NO: 112716 - DNA, 399 bp, Homo sapiens
  misc_feature (121)..(121): n is a, c, g, or t
  misc_feature (147)..(148): n is a, c, g, or t
  misc_feature (193)..(193): n is a, c, g, or t
aatcaccacagatagccactgagaccctctctcaacttcatctgcatgtgtgagaggccagtttgaggtgtgagagtacttctccaatttggacttgcctttgtcatgtttcctgcctatntgagagagaccctgtgaaacccaggnngaagggaggcagtaaggttaatggcccagccatcttttgctgacncccatctctggggtctcaggtatgattctatcacccaaagacacctaaacaaatcaccagactacattccaatccccatgggacctgattattgcacacagcttctttcagcaatgagtcagaagagcagtttttcagaaccaactcacagtctgaaaaagcaacctcctttttcatatatacacttaacatcaaaaaaaaaaagc

SEQ ID NO: 112717 - DNA, 204 bp, Homo sapiens
cacttagggcctcgaactcctcacctgtgaatgagggacctgaccatggtcatccctgaagtcccagcatttaactcgtaacatgacaaaaagcaaaccagggctgggcacagaggctcacacctgtaatcccagcactttcagaggccgaggtgggtggatagcttgagatcaggagttcgagaccagcttggccaatatgat

SEQ ID NO: 112718 - DNA, 177 bp, Homo sapiens
ggactgggaaattaaaacatgattaagatactctttccatgcacaaaattgacagaaattgaaaagattgttaatattcagggttaggaatgtgaactggtagtgattctgaaagacaatttggcagtttaatatgtgccaacatttaattttaactttttttggtttgttttgttt

SEQ ID NO: 112719 - DNA, 355 bp, Homo sapiens
acttatccatcgtagggtgtgtttgtgttcttttgtctttgttatagatggagcctcattctgttgccctcgatcgtaatatacccggtattaaatttagtaagagaaaattgcactaacagctgaattttaggcttaactttgtgacactctctttcttgtatggaattgatcagctcaaactgagagctcatgactgggaaaatgacacagtctgttcttgcctcgttctaaattttaatggtaccaggcccactctgacactaattttacagtcactgtgccctctgattgtctagcaagaaccagcattcttcctttgcttccctgtgagcaaggcagctgtaggaccaag

SEQ ID NO: 112720 - DNA, 427 bp, Homo sapiens
attcaggttagagttcagtggaatgatcatagctcactgcacccataaactcgtggtcttaagcaatcctcctacctcagtctcccacatagctgggacattagccaccaagcctggctaatttaaaaaaaattcttagtagaggccgggtgcagtggctcacacctgtaatcccagcactttgggaggccgaggcaggcggatcatgaggtcaggagatcgcgaccatcctggctaacacggtgaaaccccgtctctactaaaatacaaaaaaaaaattaaccgggcttggtggtgggcacctgtagtcccagctactggggaggctgaggcaggagaatggcgtgaacccgggaggcggagcttgcagtgagccgagatcgcaccactgcactccagcctgggtggcagaacgagactccatctc

SEQ ID NO: 112721 - DNA, 393 bp, Homo sapiens
ctcttcctgtcaccgacgcttcgtcagtgtccacaggtcacgccacctctcttcctgtcaccgacgcttcctcagtgttcacaggtcacgccacctcgcttcctgtcaccatcccttcctcagcatcctcaggtcacaccacccctcttcctgtcaccgacgcttcctcagtgtccacaggtcacgccacctctcttcctgtcaccgacgcttcctcagtgtccacaggtcacgccacccctcttcctgtcaccgacgcttcctcagtgtccacaggtcacgctacccctcttcctgtcaccgacacttcctcagtatccacaggtcacgccacccctcttcctctcaccagcctttcctcagtatccacaggtgacaccacgcctcttcctg

SEQ ID NO: 112722 - DNA, 532 bp, Homo sapiens
taaaagttccaggacccttcctacatcccgagacattctaattctctgccgtttgtgtagcaattctttgaactgttgaaagatctcctgacaaattgttactgatattgtgttaagcaataatcttaaccttcccagtaaatgaactggaatgcccaattttaagtttctctatttatgaagaaacaaaatacaggggtcatagtcaggatactgcctatggtacattttaaaatttctgggtctactaggatataatctttcttaacctcttttgagatttgatgtcagttcaagggaagcattccattgatgtcaggaaggcagctatttgttgactgaaattctggtactctggcataagctcgttctaaaaatccacaaatatgttgttaatagaatgggaccatacttttcacttgggggcctacccgctagaggtgagatgtcatccttgagatgtttggaagactttgtgagatttttttttcttttgcaaactagacgtgcgccagcttctctgacctaaatg

SEQ ID NO: 112723 - DNA, 386 bp, Homo sapiens
catatataactttccaccttaacagaaagcaataaaggacccctggttttaagcccacaaggtctgaattttctttcctcttagaatcatagcatcttagatctggaagaaactttgatagtaagttgcttcaatttctgtactgttaaaaagaaactgagatattggcagactaatgccctcccacaatagagactagcatgttttacataactcaatagcacctcttttgaatgttttaagaaaggacatgggtttgtttcatggaacagaatgctatttgatcttttggtaattgcatgttatctaaaactgaaattgcctaatttcattatttcaataagcatttcttgagcaccaactgtgcagtggcaagtgctagggta

SEQ ID NO: 112724 - DNA, 232 bp, Homo sapiens
ccgcgcccggcctgtctataaatattttaaaaagcaaaaaaaaatcttagcttgataaccatatgagaataggcaatgactgcctttgtgttgcgtgctgttatcgcccctgttctaaccattgttccttttttcctgttgtctctgggaaccatgccatcccctttctatggttcctaaaggccagtatttatgtaatggataacagtcatattctcaaccttttcaaatg

SEQ ID NO: 112725 - DNA, 337 bp, Homo sapiens
atagagacataacctaccagtatccaggtttctgcaggggcctggaaggcatatacagtggctgcataaaccagatcaggggatcgaaggacaagcttagtccactggtccagagggaatcagtacagcttagtcttctcaaaaccccctttgctcagtttcttttttttttttgatatactattttatttaactttcaaaaagattttattaaagtaacaggatttgagagtcataacttcacacaatttgtgcgtatgagtattacaatttgtaatcaagtatatctgactccaaatcctatgtattttccactacatcttaatgccacaatgtt

SEQ ID NO: 112726 - DNA, 338 bp, Homo sapiens
cttacgtgttactacactccccattttagagatgaggaaactgtgacacacaaggctgttcatggtcaaggtcaggatggtgaggccaggtgtgggcttcaaggcccatgctcttcagcccacccatcactgccccataatagatgccttaaatataatgcatctgggtgcttggcaagggtaacatcatcactgtcagccacataaaggtcagccaaataaaataagaaaagccagtgacaaaataagaaaatctattgtttcttgagcacctaacatgagaggcagtgatgattaagagtgtgtgactttatgaaccatgtgaccttgaacaagtt

SEQ ID NO: 112727 - DNA, 367 bp, Homo sapiens
atgtgtgaagtacactctgtgatgctcgcacggtgatgacatctcctaatgatgcatttctcagaacatgctcctgtggtaaggaagcctgactgcagtctgagctcggactccctagaaccctcccctgccacaccgtggctattcccgatgtgcaggtagtggcttcattacattaaacacggcagtgagagctcctgccatgaaagttctgggtggagggtgggaccacccacatgtaagagaggttggcggtgagtggggcagctgaatgggaggccccttgcccatgctgggacccacttaattcctctgatttttagcagaatcagggcaaacttctaattattttggtactctgaagaaa

SEQ ID NO: 112728 - DNA, 776 bp, Homo sapiens
ttaaaatgtataatatgaagcagtggaacttccctgatagcacaatttaaatatttcctttttgacaaacgtgcatagttaaataaattaagtgaccaccaggtgtgactgaagagtggccagtgtctattcctagccccgaaggagcacagggatattgactgtgtcccttaaaaaaaacaaaacaaaacgtagggctttctttgtattggtttgaacatttctctttatcttgtgacctggccaactctggctatggctgcctcctgtctctcggtacattttctgtggcggtcaagaggagttattttaagccaccaatgggaaagtttaaagacataatccttggctgtaattgcgggagacgggaggctgagagtctgtgctgacttgccacctgtttccacggcagcaaggtgattgtgcatttcctgctgctggctgaggggccagcaaattttcatgtcgttgtgtcatggggaagttttcctgtctcaatgagagcacaccgtgcttgtggtcttgttcctgtgaccaggacatggagaactatggggagattgttctgggtgtgaagggaaattgctggccagtgcttagtgcacgggctttggagtcagagccaacttctccacctcctacctgtgtgaccttgggcctatccttctaatgcttggagtctcttctgtcctcatctgtatgatggggataacaagaatacctactttataggattgctgtggaggattaaatggatctgcatgacaaatgcttag

SEQ ID NO: 112729 - DNA, 1218 bp, Homo sapiens
agccaacaaggtagctacaaactcttgagaagccttgagacagaggtactcaatagagccattcctatgagaaacgtaagtatctgctgttttacaccgctaaggttttagctaatgtattatgccataatagataagttatatacaacctttatcaaataataaaagtaaccatcatcagtaatgagacaaatcaaaaaccatggcccacccaatagaacataatgaggagagtacagaattgcttctgggatatttctgacaaagatgtatatgcttcattcatacatgaggaaacatcacacatactcaagatgggagagccattctaaaaaataactaggcagaaatcttcaaaaatattaaagtcacggaaaccaagaaaaaatatgaacctgttccagattaaaggaaactaaacagacctaacattttaatacaatgtttgattttgaacttgaactttttgttatataagacactattgagacaagtgctaatgcttgaatagggctgaaggattagattataataatacattaatgcaaatttcctgattttaaacattgtagtttgattgcacaaggagaatgtctttatgtgtggaaaataaatagtcaacattctgtcttcaagcttctgaaaaaactctgcttttagggcatagatagaagtggatgataattcacctgttcctctgctactaattgagctgctctctgtttccatggctggctcatgggatgagagaatatatctagttttttatgtttcaatttgtctctctatggcatttttgtgaaaataaggaagtgtggagacttatatatgtttctaaattgtaatagttcattaatgtaaagtacagacacagtcttcacttttccttcttagaccgtttaaatatggccacgaaacaagtagtctctggttggctgggcactgtggctcatgtccttaacaccaacactttgggaggccgaggcaggcaaatcacttgaggtcaggagttcgagaccagcctggccaatgtggcaaaaccccatctcttctaaaaatacaaaaattagctgagtgcggtggtgcacaccggtaatcccagttactcgagaagctgaggcaggagaatcacttgaacctggaaggcagaggttgcagtgagccaagaccgcaccactacactccagcctgggcaatagagcaagactccatctcaaa

SEQ ID NO: 112730 - DNA, 558 bp, Homo sapiens
atcattagataatagtctggttcaatcctcttgttttacttgtgaggaaactgagaagcacagtaacttgtccatgtcaccgagttggttgggagacctgtgttctaatctcagttctgctggttgcttgttccattatgccttgcaatttctcagctgatggtggttctctcctctgggaaggagggggatggttgtgaaataggaaaaaagtgcttgagaatgtacagattacactcacattactgatctgctgcaactttctgctctaccaatcagatattttactttttcttagagatggagtttcactcttgttgcccaggctggagtgcagtggcgcaatctcgtctcaccgcaacctctacctcccaggttcaagcgattctcctgcctcagcctcctgagtggctgggattacaggcatgagccatcatgcctggctaattttgtatttttagtagagacggggtttctgcatgttggtcaggctgatctcgaactcccaacctcaggtgatccgcccaccttggcctcccaaagtgctgcgattacagg

SEQ ID NO: 112731 - DNA, 468 bp, Homo sapiens
cagtgtgacccagggcaactcagacaacctctggtgcctgtttactcagctgtgaaatgcggtaggaccttttgaggaaattgaaggagacgatccatgtaaaacttgggcctaggggtgcggtggacagcaaagctcaatggctgttagcgtcctttctcttcggagtgtggtgcagcaggaagggtaacgtaacaggagccctcctggctctgccatcgagatggagcctggtgtgcgctctctagcagaccttccagccctcacatcgctctacaatgattccgattctcatgtgtctggcatgtgccagtttctaacgtatctgcatgcaccaggttgtagtgaccttgaactttttgatagactgataaagagatgcagcacatagaggccaatgggcatctttccacaaactagccaatgctggtcacagtcagaagcaaaacgcccaccgacgggggctac

SEQ ID NO: 112732 - DNA, 377 bp, Homo sapiens
ctcagcctcccaaggtgctgggattacaggcgtgagctaccgtgcctagcattgtatcttttttttagagaaatgtctattcagatcttttgcccatatttaaattgggttacttatttttgttactgatttgtaggagttatttatatattttagatacaaatctcttatcaggttttttaaattgaaaaagcttgacatcagatatttgatttgcagatttccttgggtttttttttcatttgaaagatcgtagcttccaaatataaagattaaagataattttatttcttgctttccaatctaggtgttttttattgctttttctcttctaattgccctgactagaattttcagaacagtgttgaatagaagtg

SEQ ID NO: 112733 - DNA, 207 bp, Homo sapiens
aaatatttgaaaggaaaggcctgaaaatttattttaattgatgaaaaccaaaaatccacagatccaggaaggtcaatggatcctaagaagaagaaatattaaaaagaaaaagcacaaaagggcatatcataataaattttctgaacacatatgatgagacattttaaaaagcagtcagagagaaaagacattttgtacagagaaaca

SEQ ID NO: 112734 - DNA, 414 bp, Homo sapiens
ggagtggtgacagggtggccctgggcagggtgtggccggttccctcttgcctgtgttgaagcatggactcctctgggccctcagccatcagcccagcctccctcacggaagatggagaattccagacaaagctcatccttcctccaggaaagcctgctccatctgcagtaattgacggcctgagaagctctgctcttgggctgaaccccaagcaggaggaggaggccggggtcctcaggtgcccatctgggaggcccggggcagccagcaactgcctgtgtgtctgggatctcacaggagagggggttcccaagccgagcatcagcccgtcgtggcccatggactctgggttccccaggcgggggaaatgtgccagagccacggggaaagctgagctctgcggccctgcgagtg

SEQ ID NO: 112735 - DNA, 263 bp, Homo sapiens
tgccatagcagctatgctgtgctgtggggaattccccccagtccagaccacccagactcccctgagctggcaggccaaaatggcagactccagccacggaaatggtggctgcccttccctccaggaacttagtcatctcaggcagtctccagtcagctgccgctggccgggctggaattccaagtcagtagatcttatcttgtgagctgccgtgtgagtgcagcctgcagaacaccacttggctcccgggcttcagtctcctt

SEQ ID NO: 112736 - DNA, 204 bp, Homo sapiens
ctcatcaccaataggtcctcagagaaaaatgcaaattaaaaccatcatgcaataatgcttcacacccataagaatagctgaaacaaaatatcgtaatatgctaaatgttgatgaggatgtggagcaactaggactctcaaatgtttctggttggaatgtaaaatggtacagctactttaaaaaattagcagcttttaaaataag

SEQ ID NO: 112737 - DNA, 131 bp, Homo sapiens
  misc_feature (127)..(127): n is a, c, g, or t
ctgcttgatgtaggagggattaagttagtatttcccgtatcgaccaagacaaaattacaatatacgcataacaaagacaaacaccagttacttggctcaatatccaagttttaacctagcaaaaaanaaaa

SEQ ID NO: 112738 - DNA, 512 bp, Homo sapiens
aattctgcttggctaacatttttggaacgctttggaccatgttctctcaaagtctcactttaagggtgtgtctataacttaacatagggtccagatatgctctgaaagacttaacctcaaatgggatactgtcattttattaatgtatgctggagttggcttagtttcaatttgaggaatttcatgtgctgcaacttcttttcctagaaagtaatacttttgatgtttctcacaaattataatttctaggactctgagctgcctacttctacttactcctttttagttagggttgtgtgtgtgtgttgtccttactggttactgcttttacctcctagggtctttttttcaaggccattttcacttaaccttagctattaagcccaagtggaggtgctaaggtgatttgaaaaatggaaatatcttaatttaaattgcacaaacaaacactatcgtgcatatttgagaagtaaaatacaatgtaaatgggggcttttcaggcaccatgttaa

SEQ ID NO: 112739 - DNA, 466 bp, Homo sapiens
ctctaaccccaaaatcttaagcaagtttgaccgcccttccgcgtcaacacaccaagtgttctgcgttagcccaccagggaagtgagactgctgcatccatggtctctcaaaattaagcttcattgcattacacaccctagggcataaggaaaaactgttaacatgtaattctgcactgcttagagatgccaacttcttcaacagttcttggacctcattattttatattctgtaagtgtagatgtgatgtatgtcactttatatttttgggttacccactcttctttatatccagtaggaaagcatttaaatgcatgtttgtcgttatgtttctatttttcgtgattggtataaagatgaatggctctaggaatgtcatctagtccattaagctaccgcctgcctctctgatccctgatcgcttgctgtcagctcacccgagctcagctgtacctttgaagtgcag

SEQ ID NO: 112740 - DNA, 706 bp, Homo sapiens
catggtgccctccagtatacaaaggcagagacacagagccctcaggtagaacggggttccctagatggcatctcctacctccagagctcctgggtacccatcgagccccctaccttctgcctaagccagataggagtgacgatttttatactcagcgactttcggcctccttctgagagtgatgtcaggtcatcacccatagaagaaaggaagtgaaagaaaaagttcatgccttcttggagtgcagatgctcagagtgaaagaaacaacaagacttgagacagatgggtgccattgagcaaacccgaacatgcatgtctctctcatgtgagtgagtgcatgagactttattctccttatttccccagtgcagtgaaatctttctggataaaagaagtgggctaatggaaggagagacagaccaagtcccaatgacattgcctgaccattttcaccttcgccatcagcagtctccctcacagcattggtgtgggcaggtaagaagaaagcaaggccctgaaagaatatacattggaaaatgagcagtaatttgatactcttgtggaagagcatgactcttcgccccagaaaggccaatgacacctttactacagcgtaaagatcaaagccagggactgtgaaactgcctcatgatgtttctcccatgagacctgtgtctggatgtttatatggaacaaaacatgga

SEQ ID NO: 112741 - DNA, 415 bp, Homo sapiens
  misc_feature (3)..(3): n is a, c, g, or t
  misc_feature (8)..(8): n is a, c, g, or t
  misc_feature (28)..(28): n is a, c, g, or t
  misc_feature (74)..(74): n is a, c, g, or t
  misc_feature (130)..(130): n is a, c, g, or t
agnaaaangaaggcaaaaaggtaaaggnaattgtgggcaaatttatgaacccccagtagattttacaatatggnaatttatgttgtttaccagtatataaacacctaagttttgtgttaaatgtgaatcnggaataaaagtatccccacaggcatctgacacaaattcccagaattagcccaaagaattgtttatttgaggcccaggcaatccccagcattttgggaagccaagttgggctgatctcgaactcctgacctcaggtgatccacctgcctcagcctcccaaagcgctgggattacaggcaggagaattgcttcagcccgggaggcggatgttgcagtgaaccaagattgcacccttgtactccggcttgggcgacagagccagactctgtctcgaaaaaaaaaaaat

SEQ ID NO: 112742 - DNA, 357 bp, Homo sapiens
gtcctggcacacggtgtattccagtcttccctgctggcccatctgaatcctccctctctgctagtgggaacctggctcccctgactcctctagcatctgctcagccctggtgcacgtgcgagaattgtccacccaggcccgggggggaaagccctggagtgcagcgtttgtgtacagctccttctggccttgcggtctccactcagaacattttccggagttgcttaggcggctcctgccctctggccagtgtgtttctgtttcacatccgtgcgtgtggagcctgtattctatctgcatcccccaacctcctggtcgggtcttcccccaatagtttgtgcacattgaagttcatct

SEQ ID NO: 112743 - DNA, 191 bp, Homo sapiens
ggaagctgttagacatctttatttggtcccgatgccactgttggccaccctgtggtgaagtctggagcctgcagccattcgccctccacgctgctcagtccacagggccttggtcttgcttgattccagtcttgatgtgcggcacccatcactgattctgaaaccacagccccgtgctctctggaggccaa

SEQ ID NO: 112744 - DNA, 370 bp, Homo sapiens
tccctacaggcctctcccctgagctctgcaagtcctgtgttcagttggctcctcagctctctgctgggatattaaacaggcgtctccacatccacatttccataggtgacttcctaaacccctgaacacattcccttgcagtcctacatgtctcagatgagggtgacagggtacttctggggacttagccaaacttgacagcatgtatttttaaaatgagaaatgaattccattatttgtaaatgttgtaatttataacgtaaagaaaagttgtgtgtatacatgaaaggcgtgagaaaatacatcatttccaaaattcttttgaagtgtgggagaaaaatatttcaagacctcatccctatggatctgt

SEQ ID NO: 112745 - DNA, 757 bp, Homo sapiens
aggataagatcaaagaaactattttttagctacatgtcctttttgatgtgacagtctccccttcttctgtgaattaaatctttttgtccaaagtaactacctatgtctgtgactcaatgtttgaccctcaatctactaaggtctaagtgaaagaagctaagctgaagaaaagtgaacttcataactttgaaacgtgaaagagggaaaatgaagaatattgtttccaatgtcctctgcaatctcattacctgcttctttgttaagacaggattttacacatccacaggtgcttcaccacacctgtgtatgtgccaagttttaaggcgtaatgtgcatttcccttttttacatgagctgtagttctttctagcttcgtcctctctggagattttgtttaattagtcaaagactttagactatgacatttcagacaatggtaaattggtgagacagagtctttataggcatagattcttttcagtttccctgaaatggcaacacttttgaacaatcttgaaacccagcatgtctgttctctgggaagagtaaatagtttggaatttaaaagtaccttttggtggcagattgcaaagtaaatctccctggggaagtgcactctagggagtcaggagaagagactctctaatttagagttccaaccctcctaccactgttttataatttaacctatggaagttcctattaatgcccagttttcttctttgtgaatgagcagcttttgttagatgagatcaga

SEQ ID NO: 112746 - DNA, 191 bp, Homo sapiens
tggtgtgcagtgtacgtgtctgtgtgcgtttcccagcagctccatcaaggcagtaaaacattaagcactcaagagtttgggctttgaggtgaaaatctctgcatttaaaaccagactctgccagacatggtgactcatgtccgtaataccagcactttaggaggccaaggccaaggtgggtggattgcttg

SEQ ID NO: 112747 - DNA, 438 bp, Homo sapiens
acatcaatagacagatgcctcttctggatgagttcatgggtttcagcctgagtggaaatattcagttatagatgagcatgtgattttcacctgtgttttgatcaaagagtctgaagtttctgatgaagtgttatattcgctttcaatggtatctaactggccataaacatgtgggaaaatatcaaacttgaggcaacttgactgaagtggacaggggaaggggactgtctttgttggggtgaagtgtgagataataaaatgcatacatttaatagttaagaacatctaaaggccaaaccttccttatatgcaccaagcagccattaaaacaatatgatttgtgtatgaggaaactgattaatcagtagcaaaccactcactaatgagtttagtggccttcaatatgttttttagccttgctagacctccttgtagttg

SEQ ID NO: 112748 - DNA, 426 bp, Homo sapiens
gcgttgacactcaaatatgtgacaccagtgggtactcagacctctaggtcttccttggcaaatatgagtggtcttaccagagaacgggagtggatggagatggagagctttgaacctcaaagtggagagaagacattgccatggcaaaggaggttagcatacaggcttggtgaattagagctgggcatggtggctcaggcctgttatcccagcactttgggaggccgaggagggcagatcacttgaggtcaggagttcgagaccagcctggccaacatgtcaaaacccccgtctctactaaaaatacaaaaaaattagctgggtggggtggcgggcacctgtaatcccagctactcgggaggctgaggcaggagaatcgcttgaaatgggaggcagaggttgtggtgaaccaagatcttgccactg

SEQ ID NO: 112749 - DNA, 252 bp, Homo sapiens
tgtatttggagattagacctttaagaaggtaattaaggttaaacaggtcataagggtgggctgtaatccaaaaggtctggtatccaccaaagacctttttctctcttcttgcacatacagaggaaaggccttgtgaggatgtgacaaaaaggtggtcacctgcaagccagaaagagaggtctcaccaaaactacccctgctgttacccggatcttggactttgggccttcagaatggtgagaaaatatctat

SEQ ID NO: 112750 - DNA, 281 bp, Homo sapiens
ggcgcagctgtgggactgtttcaacagcaattcttgtggcaaacctgggattgcctggttttgttttctgttgccaggggagacccccaagtgacaaaatctagaggaacagatcagaaaaagtaaatatatgggccggaaagcaaagagaaagtaaaaggagggaaggcactggggttgaacacaaatgaccagccctgtgtgtgaagactgccagcagccagcacaactgccagggccccagctgagccatgctggggatgcaagccagcagtcgcatg

SEQ ID NO: 112751 - DNA, 426 bp, Homo sapiens
taaaagacgttagagttctccatgtaatgccctacgtggcgctagaggagtagcaacttattggggaaatgtttactacccttattagtaaaaaggagacatattaatgattcactttaaaggacactttaatgataaattgttaaattataaaattgaatacttattaaaacatacataaaaccatataacatatatacagcgctaatgaacaatttacttttccatggagtttaataaacctactttaataaattatctttcaagttaaattaacaatggcacctatgtttttttcccccctaagtatttaagttcaggtgcaatgaatttctctatcacaactttaggtcaactcataaaactaattttgcagagtagaatacagttaattcttgttttctgcctagtattcttcaaagatag

SEQ ID NO: 112752 - DNA, 201 bp, Homo sapiens
tgtatgtgtgtgaatgtgggtgtatgtgactgtgagtgtaagtgtatgtgtgagtgtgtgagcatgtgtgtgaatgcatgtgtatgtgtgtatgtgtgtgaatgatagtttgtaagtgtatgtgtgtgtgaatgtgatagtgtgtgagtgcatgtgtaagtgtatgcgtgtatgtggtgtgtgtatgtgtgaatgtgtggg

SEQ ID NO: 112753 - DNA, 645 bp, Homo sapiens
agctgatggcttcccagagatgcctcacagtcctgcgcagacagagagaatgcagaagctggcaaaggatcctccacacgcaagatcagaggacgtcccagatcatcttttctttgtggatactgcaggtctacgtgaaatagtgtgtttttgcggggtgctgtcccttaggacaagtgaagggctgatgagaaaggaaactgcgtgagccaggtgtacagtaaggagcagacaacatggcactggccaagtggaaaggctgtttgcataataagattacgatggggtggcctgccttccctgtgtgctacgtaaacatcacacctgatccaaccaatctgcaggccctacataaatcagacaccgcctcctccagcctgcctataaaatctggtacactccacgtgggccagaagtcccatttggatgcccctctctttcgcaagagagagagctgttctcctttctctttcttttgcctattacattccgctcctaaagtcacttctcatgtatgtccacgtccttaatcttcttgatgcaagacaatgaacccgggtatttaccccagacaacaacaccacttcactaggagttaaaagaacttgaaatgcaaattcatggtcatctggttccaaagcccat

SEQ ID NO: 112754 - DNA, 541 bp, Homo sapiens
gcgtatgaccagctactctcacagtgacaaatttttttaagcaggaaggagaccgcttaagtgatgaagatctctacaaattccttgctgatatgagaaggccatcttctgtcttacggcgactaagacctattacagctcagctcaagatagacatttctcccgcacctgaaaatccccattattgcctaactccggagctgcttcaagtgaagctttaccctgacagtagagttagacctaccagagaaatcttagagtttcccgcaagatggtttatgttccaaacactacttacagaaatcttctctacatataccctcagagtcttaattttgccaatcgtcaaggttctgctaggaaatataacagtgaaagtccagtttatgtatgggagaggatccaagcaatgccatgccggtaatctttggtaaatctagctgttcagaattttcaaaggaagcctatacagccgtagtatatcataacaggtctcctgattttcatgaagaaatcaaggttaagcttcctgctactttaa

SEQ ID NO: 112755 - DNA, 291 bp, Homo sapiens
cagacttctttatgttttgcttgtgacagcagtacttggctatggcagttaaatggactgtaagatgttagcttgatttggagtaccctgagtagctgcacaggtagacaaagtacaaagatattgacagcttttttcttcctttagaagaataacatatctaaaacaactcttaaagcaagagagctgcagttgcacactaagaaaatactgcaatactgccatgacttggttataggtgatgctaacataaatgggatattctgtttctcattgcaccagtcatgcaga

SEQ ID NO: 112756 - DNA, 363 bp, Homo sapiens
gctaggagactcagggacaaatctaagtcttcacttaagtaactcatttatccgaggcacctaccaatatctattttatctttttcctttaagaagacaggccgggcgcagtggctcacacctgtaatcccagcactttgggaggccgaggcaggcagatcacctgaggtcgggagttccagaccagcctgaccaacatggagaaaccccgtctctactaaaaatacaaaattagcggggtgtggtagcatgtacctgtaatcccagctactcaggaggctgaggcaggagaattgcttgaacccgggaggcaggggctgcggtgagctgagatcgcaccattgcgctccagcctgggcaaca

SEQ ID NO: 112757 - DNA, 182 bp, Homo sapiens
aggacttactcatttattccaagcgctcagagagtagactaggtccacagtgtgactcagggaggcaggagggctcactgaaaaaatgacccatctaacaaaaggtggggaaggtggggaagtggtagaagaacaaaacagggagtgaagcacggtgggaagtcatgagggctttctgctgg

SEQ ID NO: 112758 - DNA, 490 bp, Homo sapiens
acctggttaatttttatatctttggtagagatggggttttgccatgttggccaggctggtctcaaactcctggcctcatgtgatctgccctcctcggcctcccaaagtgctgggattacagatgggagccactgtgaccagctttacccattatttcttagtaaaattttattacagattttgtatttcttagatgtgctgtagacacgtatcactattagcacttaaaacagtgatatatagtagtacttggtaagtatttgttgaataaattatcaaatttacgagctagaaaggcacacttgagaaataaactaaagagaaactctttttggagtctcgctctgtagcccaggctggagtgcagtggtgtgatcttggctcactgcaacctctgtctcctgggctcaaaccattctcccacctactcaggaggctaaggtggtcgacgcggccgcgaattagaagtagtagtcgacccgggaatttc

SEQ ID NO: 112759 - DNA, 892 bp, Homo sapiens
acacgggacattctccaaaatagaccgtatgatagggcacaaaacaagtctcagtaaatttaagaaaatcagaattatatcaagtactctctcagaccacagtggaataaaattggaaattaattccaaaaggaacactcaaaagcatgcaaatacatggtaattaaataacctactcctgaatgattgttgggtcaacaatgatatcaagagggaaatttaaaaattctttgaactgaacgataatagtgacacaacctatcaaaaactctgggatacagcaaaagtggagctaagaagaaaattcatagcattaaatgcctatatcaaaaagtctgaaagagcacaaataaacaatctaaggtcacacctcacagaattggagaaactagaacagtccaaatccaaacccagcagaagaacagaaataacaaaatcagaacaaaactaaatgaaattgaaagcaaaaaaatacaacagataaatgaaaaagctggttctttgaaaagataaataaaattgataagcattagcaagattaatcaagaaaagaagagagaagatccaaataagctctattagaaatgaaatgggagatattaccagtgataccacagaaatacaaaaagattattcaagactactatgaacaatcttcaacatccataagatagaaaactacaggagatcgataaattcctggaattataaaaccttcctgggatttcaattaggaagatatagagactctggaacaagaccaatcagaagcagaaggactgacaacggtctttacaaaatgggcaaacaaaagtccggacagatgattcacaccttgaatctacccgaattccaagaatggacccactctattaaactattccggtgagaa

SEQ ID NO: 112760 - DNA, 286 bp, Homo sapiens
atgggagttggggacccctgctttatttaatcacttataacttataatcacttagatgctctaagtcatctggggggtgagaaggttggaaaagaaaaagtacattagtgagtgagtaaagattatctgggattgtttcttagatgaggatctatttgatgttggtgttggtctactgtgaactaaatataactgcattggagcctaagcgcagatgtctgcgtcatggtttattactcctgtgttcgtttcaaggagctcctgtgatacctgctgtctccaccta

SEQ ID NO: 112761 - DNA, 345 bp, Homo sapiens
aagtgctcagcagtataatgtaagcactccagtgttaagtattactatgactactacactctctagcaagcacgctggcttatcatgccagaagccacttcaaaataccttctacgtctcctaggtaccccgtttcctcccttccttcccactcccaatacctggacttgcccagtacttaataggaagagatgttgccaggcagaaagttcttaactgctaaatacacaaaccaattttcatcaatatctatctcctctttcttttctattactgaaacaaaaaatagcccactttctcccaaaagtcaatccagccacaggtggactaagcctatcccttcca

SEQ ID NO: 112762 - DNA, 600 bp, Homo sapiens
caccagatgctcccaccacaccagatgctcccaccttacttccttttaaaattatattgaaatcctagtcctagattttcttgagaatttctctagtatattacatagaattatattttaaagccacacactaaagacagtttaggagtgatttaaaaaatggaatttcactttgattctgttaattcaagaagaggatcttcaaacactgtaatttaaaaaaaacagagacttgctacacgaatactttaagcaagagctaaattcctgaacagtttaactcctcctatcatttttactcagcagaatttcaaatagcagcttgtgtacccaagttatttacatattttcttccttaatcatctccttttcaaaggacatagagttcatttaacaaccagttattatgtcctagttttattgctatttttatttgctttctttaatgaatgaatcatttccaaaaccagtttgtaaagtaatactcatttccgctatttcacgtaaaaagcacaggtccaacaattgcactctttaccaccccttcccgtatgtctcaccaccaaatcactataagacatcctaaattacaaacagatt

SEQ ID NO: 112763 - DNA, 632 bp, Homo sapiens
gatgttgtttttaaaaatactgaccttacagtcctttccatctttatttttgagtgacagcagaatcccgagtataagaaaatgtgattaattctcccatattgaagtcatttaatcatgctttgcctaacagctgctttctattcagtacactgaacataaaattctggagtgcctttgtgctatcataaattgtaaatgtgaaccattcttcctcttaagtatcatatggtattgctgttttgaatttgtcagtttggtagggggtttttctagagattgctgttgtagtcggctaggagggccttcttctgggacgaaactctctccctcattctctatatcactgtgatatttagtattatattattataatatttagtattatttgtttgcagtaaagaagtgggggaaaattggtttgacttgtcatccttttatttctatggcatattgaaaaagtggacaaatagggccaaaacaaagcagtgggattcttacttggctcttttaggtcagaaagaaccagtttaataaatttcagttcaacaaatttgtactgactctattcacagcaccatgtggagaaataaggataattaagacttcatttccgccctgtctggtaggat

SEQ ID NO: 112764 - DNA, 205 bp, Homo sapiens
ggaaagaaatttccggaagtaaatacagcaattaataatgtttataagctgggcatggtcgctcaggccagtaatcccagtgacttaggaggctgaggtgggaggattacttgaaacccacagtttgagaccagcctgggcaacatagtgagaccctgtctctaaaaaaataaaaatagaaataaagtagtgcttattgtttgca

SEQ ID NO: 112765 - DNA, 464 bp, Homo sapiens
ctagcaccatgataccctggaaaaaacctctatgtgactggccaggagtagactgacatgtttttggcacaagaaatgttgactttagaaaggcctgaagggaaatgaacaactttctggtctcccagcaataatcaactggaaaacatgaagagttaatttaaaaaaagaaaaccaaaaaagcaaaacaaaacaaaaccaacaccaaaaaccattcacaacagttacaagcatataaaatacttaggatttaattcagtaagaaatatgaaggcttggtaacataacactaaggggccatgctttgttcaccattatgactgtaatacctacagaggttctagcacaatgcaaacactttacaaatatttactgagacaatagtgtatatgaaggacccaagttaagtgtagtgaaaagcatgttctttgattttgcaaagatgtcagtctaaaaaaataaag

SEQ ID NO: 112766 - DNA, 336 bp, Homo sapiens
tccacaatgagatgccactacacacctgttagcatggataacataaaaaatgttgaggcaaggcacagtggctcatgcctataatcccagcactttgggaggcagaggcgggtggatcacgaggtcaggagatcgagatcatctggctaacgcagtgaaaccccgcctttactaaaaatacaaaaaacatagccaggcatggtggcgggcacctgtagtcccaactactcgggaggctgaggcaggagaatgccgtcaacccagtagacggagtttgcagtgagctgagatggagccacagcactccagcctgggcgacggagcgagactccatcc

SEQ ID NO: 112767 - DNA, 370 bp, Homo sapiens
ccatggcatgtagtgaggacaagaatgactctctggaaataggtatgagttactcctgcaaatctcttgccagttttttggaaatgcaaatgctgtctgtcaagatgaagttgataaagctttttggtattaacgcttcttaggtattaaagaaacaactacctttttttgtgactattttatagtgggagttgggttggcaaggaggactgaagtcaatatgtatttttatatgcgttgtgctccggggaggaaatttttgcctacgtgtgtaggtcttaaaatacagttatttgaaaagattcaggtaaagaatcaggaaaccaattttccaaactttgagtctaatgtacagtcatgagtcaaacag

SEQ ID NO: 112768 - DNA, 374 bp, Homo sapiens
aaatttatgcttgaaatggctcagagtttgtgtatgtggagcatattggaggctgattgtatctgtgagtttaggaaagacttaacttgatcccttgtgcaatgaagtctttcaaagaaaacgagggttttttgtttttttttttttttctataaggtagagtggatattcaggctcagattttagctaaattaagaaggacctttctctgtccagaatagtatcacaaaattaagactggctctggaagagagacagaggatgccctcttttcattgtcatacaccatttgaattgtgtttgataaatttatattgtgaccttgaaaatgaaaccactcagaaatcctggttaatttctgccccatgcgtcag

SEQ ID NO: 112769 - DNA, 497 bp, Homo sapiens
agcaaaaattgaacaactgttctcaccagaaggctgatactctttttccccaccattttctaatttatactttaaaaagtgaaaaccattcttcacctgtgggggtgcaaaaacaaggggcaggtcagaccgagcccgcgagtagtagattgctgacccttgtccaagaagatgctgacaaaaccacaaaaatactaattgcagggggcagcagaatatgaatagaacaggtgaggaagcagggcacatggacaacataggaacacggtcagacattacagaatccttgggaatttgctgcagttaagtttcgtttggtggtggtagcagtgatgtgtgtttgtgtgtttcagatcacccatctaattggaaggtcacaaaagctaatatttctagactggagaagtttaacgaaatgtgagcttgagtccctaagccaaaatgtggggggaatattgtgacaaagaagtgctgtaattattggatggattactcca

SEQ ID NO: 112770 - DNA, 181 bp, Homo sapiens
ctgctgtgagggctgtgggcggtcctgagactggagccagcccccaggctcagctcagctcggggacctcgtgcccgggctttcctggggaggaaggtgttggatctcctgcctctctgtattcattcacactttgggtttctctctcttccgcgcattctaacatctgcaggattttttt

SEQ ID NO: 112771 - DNA, 485 bp, Homo sapiens
aggtcgtaacttttagtcatagctactcctgggcaaaattcttcttacagagacaatattaattacaataccacattgtgtatatattttgaaaagaggctggttgcagcagctcacgcctgtaatcccagcactttgggaggctgaggcgggtggataacctgaagtcaggagttcaagaccagcctggccaacatggcaaaaccccatctccactaaaaataccaaaattagccaggcgtggtggagcaagcctgtagtcccagctactcaggaggctgaggcaggagaatcgcttgaacccaggaggcagaggttgcagtgagctgagattgtgccactgcactccagcctgggcgacagagtgagactgtttcaaaaaaaagaaaaagaaaagaaggtattttgtgtttttgtgctacccgttcagcaaaataatgaaattcattgtttctaaacttttttttctgattaaatacaagagt

SEQ ID NO: 112772 - DNA, 395 bp, Homo sapiens
tcctgccctaccctaactgatcagttgaccctgggacattcttctcctggacagtgagtctcatggtctctccaccatgcaccttgtgaccccctcccctgctgacaacagataaccacctttgactgtaactttccactgcctacccgagccctataaagctgcccctcccctatctccctttgctgactctcttttcggactcagcccacttgcacccaagtgaataagcagccttgttgctcacacaaagcctgtgcaggtggtcttctatacggactcgtgtgacaagcttgcctttcccttttcaatactttgtttccactatgcttatgcccggatgatatagttctatttttataatctttcaggtgtaaaataaaattctaatatga

SEQ ID NO: 112773 - DNA, 787 bp, Homo sapiens
agaaaaaagggggagaaaggagagaaaggaaagcgcgaggagccgccgccaccaccagcgcaacagtcctggagctgtgaggagattcgggccgtcaccctgcctcccctgcgtcccgccaccggccgcttctgtcctcggacccattccaacaatctcgtaaaacatggtggattactatgaagttctaggcgtgcagagacatgcctcacccgaggatattaaaaaggcatatcggaaactggcactgaagtggcatccagataaaaatcctgagaataaagaagaagcagagagaaaattcaagcaagtagcggaggcatatgaagtgctgtcggatgctaagaaacaggacatctatgacaaatatggcaaagaaggattaaatggtggaggaggaggtggaagtcattttgacagtccatttgaatttggcttcacattccgtaacccagatgatgtcttcagggaattttttggtggaagggacccattttcatttgacttctttgaagacccttttgaggacttctttgggaatcgaaggggtccccgaggaagcagaagccgagggacggggtcgtttttctccgtgttcagtggatttccgtcttttagaagtggattttcttcttttgatacaggatttacttcatttgggtcactaggtcacgggggcctcacttcattctcttccacgtcatttggtggtagtggcatgggcaacttcaaatagatatcaacttcaactaaaatggttaatggcagaaaaatcactacaaagaga

SEQ ID NO: 112774 - DNA, 260 bp, Homo sapiens
acaaatcactttggggagccaaggtgacctcgtctctaatttagaaaagtaaataaaaataatataaactagtccatcttgaatagttaccgtcaacatgcatgaattcagtgccttatcagaactgcctggtgaagcagggagtagtatctgttttacggggggcggggggtagctgaggcagagagcttaagtgaatgtcctatgtcacacagtgagcagatgatggggtttgaactcgaacctaggtcttgaaccca

SEQ ID NO: 112775 - DNA, 315 bp, Homo sapiens
tgaaggctattgaatttgggggccttgctttcataacctgcttccttactgaattacctgattgtttgcatcagtttttcagttgattcttttgaatattcaggtattaattagagcatctgcacataatttcacctctgtttataattgtaaactcacatgtctttctctccagttgactaataaattcagtaaaacaatttcagtaaaatgttacatagtggtggtgagagtgggcatacttgtcttgtttctgacattagtgggaacgagaggcatgatttttagcaaccgtttattatttcattctgtgga

SEQ ID NO: 112776 - DNA, 418 bp, Homo sapiens
gctgtctctggcctcagtgactttcacacagaataccatgggcactccgtgtccttttgctgcagggttcctctgccatagctttgggatgggggtagagaatgctcacccccagcctctggagcctggagtcgggggcaaggccattttgtcctgcacgtatcccccactgtcccgttctcgggcagggtgggtgcagacaccaacctcctccacctcccatgctgtctcattccttcacacagtcgctcaccgcctctcactggggacccgtgaggagttctcaaatcacctggcagaggaaataccaccagtgccctggactacgacaaggacatgaagtatccatttccaaagtctatccacaggcaggacttagtctgtttgttccttatccccaccctgagcagtgttgtta

SEQ ID NO: 112777 - DNA, 644 bp, Homo sapiens
ggaattgctgggttgtatggtttaaccatttgaggaactgccaaacttttctaatgcaggtgcactattttacattcccatgagaatgcattggagttctgatttctccacatcctcaccagcactttttattattatctgactttttgattatagccatcctagtgggcatgccatctgttcttgagataagtttagaatcatttttatcccattgatatttttaatgagattgctttgaatttatggatcatttggacatgttttcagtggttaaggcttactatttaagaagagcatgctttttcaattaataaagtattctttaatgttccttagctttagctttatttagcagtccacatttaaagggtattaactatggaaatttttttttttttgatacagggtctcactctgttgcccaggctggagtgcagtggtatgatctcagctcactgcaacctctgcctctcaggctcaagctatcctcccacctcagcctctttggtaactggggctacaggcatgtgccaccacacctggataatttttgtattttttgtagagatggagttttgccatgttgcccaggctggtctggaactcctgggctcaagcaatccacctgcctcagcctccca

SEQ ID NO: 112778 - DNA, 642 bp, Homo sapiens
cacttaaactattttcacagggatgcagcatagttcagaatgccaaatgcccaatccccttggcttaatgagtcacttgtttctaactaactccaggcctttatttattgctctattataggccttataccacattggttttggttttatgttgtgtccatgtctgtctcttctaattggccatgagcagcagaaggacataaatgacctatttttcagctctctcaccttcaaacctaccactgtgcctgacataaagcagatattcagtaactgagaatgagaaggaaagaaaaggactcagggtaaacctcggttttgtttaagattctgcaaaggggaagaactggctttcaccacccaggcttctgaagtgtgtagagagggttgtgaatccgcactgaccgtgttctcttgcataaataagtccaggcacagtatcttcagtggtgaaaacagaagttacctgccttgagaagcacagtcaccacaacccagtctgcagggaatcagatgtcgtgtgtctttcgtttgcccctcttgatgtgggtccctttaatcatttgttgttggactgtggaggcagtgggggacattgtgttaaaaatcattcttcatcttgggaagcgcaggcccctgttg

SEQ ID NO: 112779 - DNA, 867 bp, Homo sapiens
ggtgagtgatcaggtaatggttgaatgaactaataagtcgtgtaagcaagcttcacgagagttgaagtggtctttagctttttcattgaatccacttgtccttggatcagatttacctgattttggattaattcagtggatttcatttactattaacatttgtaggctagacccagcacagtttgctaaatgaagagcagcaacagtactggttttcaaaccttggctcttctctatcctcgctgtcctagccccacgtgatcagcagttcagtgcaaattgaagacagatggaagcacctctgtgagggcagcccaaatccccgctagctccaaccgactgctttctcctgtgcctagttgatttttaccttttgtgcttggaaagttgagcatcactgcaactctggctggggcattggatttttataaaactttatttcaagccctgaatgactgtgttctccaatctggtagaatacagctggagaaaggcagctggctgggtgcccaagagaagggaatttcttcctagcactgtgacggagtggagcatcggaaggctgaactagaaaagggcgcataagtaggaaatagaaactgaaaagccatcccaggatatttgagttgttcaaaagcaggctggtagtttgggcatgtctcaggcacaaagtgactcgtgaacatttgatagatgagctgtacctgtgtgtgtgcttgagaagagacttcgagctgcttttatctgcatgctgggtttggttccattatactcactggaccctctgtgctcttctggggttcctcttggcatttgcctttgtgaacaggcaacacaagtgatggccacaggccctgcctgtctcta

SEQ ID NO: 112780 - DNA, 922 bp, Homo sapiens
ggtgagtgatcaggtaatggttgaatgaactaataagtcgtgtaagcaagcttcacgagagttgaagtggtctttagctttttcattgaatccacttgtccttggatcagatttacctgattttggattaattcagtggatttcatttactattaacatttgtaggctagacccagcacagtttgctaaatgaagagcagcaaaatttgagattttcttgagcttggtgaacctttcctaggtcagagggcaaggcaacagtactggttttcaaaccttggctcttctctatcctcgctgtcctagccccacgtgatcagcagttcagtgcaaattgaagacagatggaagcacctctgtgagggcagcccaaatccccgctagctccaaccgactgctttctcctgtgcctagttgatttttaccttttgtgcttggaaagttgagcatcactgcaactctggctggggcattggatttttataaaactttatttcaagccctgaatgactgtgttctccaatctggtagaatacagctggagaaaggcagctggctgggtgcccaagagaagggaatttcttcctagcactgtgacggagtggagcatcggaaggctgaactagaaaagggcgcataagtaggaaatagaaactgaaaagccatcccaggatatttgagttgttcaaaagcaggctggtagtttgggcatgtctcaggcacaaagtgactcgtgaacatttgatagatgagctgtacctgtgtgtgtgcttgagaagagacttcgagctgcttttatctgcatgctgggtttggttccattatactcactggaccctctgtgctcttctggggttcctcttggcatttgcctttgtgaacaggcaacacaagtgatggccacaggccctgcctgtctcta

SEQ ID NO: 112781 - DNA, 319 bp, Homo sapiens
tctgcaaccccccatgaagcgttcctcaaggtaacccctaacccaggactctccttactcctaccccatcagcaactactcagcaaacccactatttcctctgagtccatgactccctgaaatactggctccacctttctccccaaacctaggcctgattactcccgtgtctcctcgttggccccagcagccacattcggaataatcctaaccagcacttatgagggctgactctgtgccagcccttgtaggaacttagtgtaaatgccagagcagattttcttccttccccatggcctctgcaaggactagaagaaaa

SEQ ID NO: 112782 - DNA, 265 bp, Homo sapiens
tactcaactgcaccttcttcttttctaaaaaagcctttgggagcttggaagtataggccctctcttccagccccatcaaaatttgtttcccttcttcctgccttccctttctctatgcagacccaggccaagagcactaagggtgcttggagatccgtaaagggctgttggctttgacttcttctctctcttttatcatctactccaaacttctgctcttcctagaaccctttgctaggtgtggttttgttgcccaggctggagt

SEQ ID NO: 112783 - DNA, 249 bp, Homo sapiens
aaccaagtacccgtaaataaatgcaaggcaggtaaagtgtgaaataataagtaaaagagtagaaatctatgtaattggaaatcagaagacaatagaaaagaatcaacaaaacaaaaattgattctttggaaaaaataataaaattgatgagcttatggcaggactggccaaaatttaaaaagagaggacacaaggcaaaaatatcagccatataaagactaaaatgcagtactatgagcagcttctact

SEQ ID NO: 112784 - DNA, 279 bp, Homo sapiens
tggctgtggggaagaacagactggagacagccagcacaggagctggagaccagttggggggctgctatagtcatccaggtgagacgggttggcggcttacttgataaaagtggccatattcttgctatatttactttcagggtacagccaaggatgtcccaatggagtccacgtgaggtgtaaaagagagaagtcaagggtgactccgagctttctggcctggcaagtgaaagaatggagctgctatcttttcttttttttttctgagactgagtctcg

SEQ ID NO: 112785 - DNA, 533 bp, Homo sapiens
gcagacggagcccaactgagggacgccccacaaacacccgagcagcgcccctcaaggctgctgaggtcatcaaggaccgggaaaagctgagaaacgtcactcaggaggagcccgtggaagagagacagaatgtcacgtggtgtcctggagagaaagggaccttcagtaactaagggaatctggagaaagcctggatgtcagctgactcgacgtcccaacactggctcactgattgtgacaaagggaccatgagaattaggacgccagcgagagggaaactgggggaggggcacgcaggaactccctgatctgtcttcacattttttttctgtaaatataaaacattctacactgggattgcaggcgtgaaccactgcgcccggccctatgttagttttttatagttttaaactatattagttttttccaagagtcagcttttgacttggatcttcctattacatctttgtttctgtttgtttagtatgtagttttttgagagagtctcactctgtcgcccaggttggagtgta

SEQ ID NO: 112786 - DNA, 677 bp, Homo sapiens
atgagccactcgcagcacagcccttacctccagtcctaccacaacagcagcgcagccgcccagacgcgaggggacgacacagatcaacaaaaaactacagtgattgaaaacggggaaatcaggttcaatggaaaagggaaaaagattcggaagcctcggaccatttattccagcctgcagctccaggctttaaaccatcgctttcagcagacacagtatctggcccttccagagagagccgaactggcagcttccttaggactgacacaaacacaggtgaagatatggtttcagaacaaacgctctaagtttaagaaactgctgaagcagggcagtaatcctcatgagagcgaccccctccagggctcggcggccctgtcgccacgctcgccagcgctgcctccagtctgggacgtttctgcctcggccaagggtgtcagtatgccccccaacagctacatgcctggctattctcactggtactcctctccacaccaggacacgatgcagagaccacagatgatgtgagttgcccaagggaacaccctagggaaacgtctgaacaaggaaaagaggatccgggacctgcttgtatctgcgaaaaggagccaaaggagcaggcttaggagagctcataagtgtggcaagaagccgactaggctcattctctctccctc

SEQ ID NO: 112787 - DNA, 808 bp, Homo sapiens
cacattgttcgggccagggactgggtcaaggagattacgcagacgctgggagcacacgggcagagtggaccaagagaggtcggggcatcatagggatttttcgaggtaacccttattgggctttggggagattcgttgcatgccacgccaggagcagggagatggcagcagtagcctcccgggtgaccgctcctctgtattatttgcttacagatcaacaaaaaactacagtgattgaaaacggggaaatcaggttcaatggaaaagggaaaaagattcggaagcctcggaccatttattccagcctgcagctccaggctttaaaccatcgctttcagcagacacagtatctggcccttccagagagagccgaactggcagcttccttaggactgacacaaacacaggtgaagatatggtttcagaacaaacgctctaagtttaagaaactgctgaagcagggcagtaatcctcatgagagcgaccccctccagggctcggcggccctgtcgccacgctcgccagcgctgcctccagtctgggacgtttctgcctcggccaagggtgtcagtatgccccccaacagctacatgcctggctattctcactggtactcctctccacaccaggacacgatgcagagaccacagatgatgtgagttgcccaagggaacaccctagggaaacgtctgaacaaggaaaagaggatccgggacctgcttgtatctgcgaaaaggagccaaaggagcaggcttaggagagctcataagtgtggcaagaagccgactaggctcattctctctccctc

SEQ ID NO: 112788 - DNA, 878 bp, Homo sapiens
ataggctggctgtgctccaggttgtgtgtcgttgtctcattgtggatgctgaggatgttagcactctgaaggaagcttttgtgtcatctgacaggaatcattgaacactgactggactccagcacaatgcagctcgttttcactgtctgaatttcgtctgcacccatgaaaagcaagtcagaggtgtgagaagactgcttcaccttggacttgcctttgttgtgttttgtgttttttctagagagccactgcaaggcccaggatgaagagagacagtgagaagatcccaaccatttatcactgacaccggcatctgtggtctcaggtatgattctatcacccaaagagccctgaaaaactcaccagattatattccattccttatgggattcaattcttatgcacaaccactttctggaatgtagtcagaaaagcagtttccattggccaactcacagtctcgaaacacccttttcatcaatgctgtccgaccacgaagatggctggaagcggccctgaggtcaagatttgtagggtctcgcagtgggtattctcaggtagcctgctttccaataccaggctgactctgcctgtatgattctttttctgcttaggcaggctgacagcactgatagcacagtgctgtcatggtgaatgtcaccgttgacttgtggcaattccctgtggcttggcaaagaaggagacctccatggatgagcattggccatggactgtcacctctcttttctgtgggatccactagatattcccatgaatttaaaagtgagcagacatgagccagcctgaagaaaagtcaagcagagccccaggaataaaccgcgaaattcccaaggattcaaaaagatctgaagaattcc

SEQ ID NO: 112789 - DNA, 326 bp, Homo sapiens
ttatgttttaaattgttagagtttagaaacttgagattgagtttgctgcctgcattaaaatgatgcttaaacattaaactgcagtggccttaaatattaacaagttgattagaattactaagttcttttcaagctttacatatacagacaaatttcttatgcaaaatagaaggtaacccctgtacgtaagtctagaatttcagcagtccccaaaactgactgagcattagaatcactctgattttaaaatacatatgtggttttccgagatctactaacagagcctccataatgtagcctagagaaacgagttttcagatgtagtg

SEQ ID NO: 112790 - DNA, 400 bp, Homo sapiens
aaatgaggacacgtcagtcgggatttgggaggtggaaatgcaagtgttctgaaagatctctcaagcagctcttctcagtagttctgggtgggggccaagatcttgcctttctaacaagcccccaggtgattaataagctgccagtctgcccaccgcacactgggtagcaaggcacagagagtgccttcacaggttttttcaaaatccccacctgttcgagcattcagcggatactcgtaggatatatctatattctttctggagtttcatccatcgctaaggcaaaatcaggcaccactgcaaatattttgttgctttttgaagaagtatgtgatccaacatccttctctcataaacaaccttctggggagctcagggatttataggcagtgtgaggaac

SEQ ID NO: 112791 - DNA, 321 bp, Homo sapiens
ggaaaaccccctgaagggaaaacataggcaaggtgggagacaagaaatctgagtttacatcttaactttgttactaactgctatggtctgaatgtctgtgttctgccaaaattcatatcctgaaacctaatcaccaaggtgatggaaggtgggggggctttaagaggtaattaggtcatgagggcagagtgctcgtgaatgggattagtgcccttataaaacaggactgagggagctttttagcccctctgcccttccatcatatgagaacacagctagaaggggccatctttgaaatagaaagcaagtcctcaccagacc

SEQ ID NO: 112792 - DNA, 244 bp, Homo sapiens
caaatatataagagaaaaaccagaataaatctaccaaagagtttggccttgaatacaaacttctgcaaagtgtcaactccaaactgacatgagaaattaatccatttggagggctatgtggggtttttcggttcatttttggtttagagagagggtctcgctccctttttcttgttgttgttgttgttttttgagacggagtttcgctcttgttgcccaggctggagtgcaatggcgcgatctc

SEQ ID NO: 112793 - DNA, 394 bp, Homo sapiens
tatcagctcggtacggcatactggacttctgactaatattttcccattcctcagcgctccctactcccccaacccccggaaactaccattctactctctgcttctacgagttcatcatttttacattccacatacaagtgagattatacagtagtagtcttcctatgcctggtttatttcacttaacataatgtcttctaggtttatccatattgccacatatgacatgattccattcttaaggctcaatagtgttccactgtgtgttggccatctgtctggaccgcactcctctaactcttcactcttgaaaaaatcttacatctttcaaagcccagatccagttcatttctgtgaagctttccctgacccatccaaggagaattaattactc

SEQ ID NO: 112794 - DNA, 474 bp, Homo sapiens
tctctcctcctgcatccccaatcccacacagcattcctagacttccttctcaactttttctttacaaacattcacctgacattatgggatatatatgcttattcatttatagtctgtctccaccttctccccaacacccactgcccagaatataaactccctgagggcggagatgtttctctcttttgttgactggtctgtcctcaaggcctaaaactgtacccagcacagagcagaaactcaaaaaatagttgttgcatgcttgggcaggaaatagacaaatttaacctggtctcttgttctttgtctgcatttctgagattttttttacaatgagcatgcactatttttttttaaatgacacaataatgtgtttatcttgttagcctttcattttagttgtttaaatttttaatttttctatgttaagatgacagcaataactctttcctgagttgtaagggaggaaaaggc

SEQ ID NO: 112795 - DNA, 394 bp, Homo sapiens
aaatttacttaactattttctctatcatctccattcttctgataagcctacccagtaattaaaaaaacttagttcttgtgctgttattgaatttccatttgcttcttgttatggttttttaattctgtgctgagatttcttatcttttctttcattgtgagtacatatttctttactcctttgaatgtcatttactttaaaatcctgctctgccaataccaacacctggggcacataagagttggtttccattgattgtctattttattggagaataattttaaataattttaatttaaaataatttaaaattctactgcggacattgtgaatactaggttgctgtgagttcccaccctttcttctagctcctgcctgcctccagatgattcag

SEQ ID NO: 112796 - DNA, 329 bp, Homo sapiens
tgggagaggagtggctggcttacagggcatgtgtgtctccaacttttgcaggtaaggccagtttcccaaagtatttgtactaattgacataccaactctgagttccagatgttccacatccttgccagtacttgatattaagttttttgtttctgttttcattttagccacactggtaggtagatagtggtatctcactgtggctttaatttttatttcccttataactaatgatgatgggcacttcttaatgtacatactgggtttttggatgtgcttttgcaaagtgctgttcacgtcttttactaatagaaaaattgggttatttt

SEQ ID NO: 112797 - DNA, 618 bp, Homo sapiens
tttttatacagaaaggagaatgcagaatggtcagactaccatgcactgttaaatttgatttcaagaaattacaggaaaactttccaaagttccatctcacagaaattatttttacaaagaattccaagataagtttagttttatggaagacttttatgtggtttttactcactcttcatctcagacatcgacagatgattacatcacttatttagctagtaaatttattaatataaaaactcagagacattccaatatccacattgcttacaccattaggcatagattcagtgtcagctatgacaattgaaaataagctgttttgtgatttaaaggtttaaatttctctaaccaaactgcttgatccagatgcaggactgcaaatgttaatatttgttctggaagaacaatcaaataagacttaagaggaaaaggaatggccacaatccacctgaaattttttttaaaaagtgtgcagcctactaaatcagaatgaaaatagaagtacaagattataaacaaaatgcaatcaaacttttcttaagcttacctaaagttatttcatctgaaaatttcaagcaactttgttcaacattaaattgacaatctaaactaaca

SEQ ID NO: 112798 - DNA, 313 bp, Homo sapiens
ttataaacattgaaaaattgtgcaatagagcttcattaggatactttattctatctaaaaagaagatctttcttttgttattaagctatttgcaagatttaattgttgctattccacagagaatggttgacagtggattattattcctcattacactttaaaagacaacctgcttaaactaaagacagacactctccctcatttggagttatatttacttaattattgtcctgttttcttaaagagatttaagtgggttttttagaagtcactagattcactgggcccagagacaacattatcattttctata

SEQ ID NO: 112799 - DNA, 489 bp, Homo sapiens
ggcctcccaaagaaggtctcatcattttgggtgataatcttgtctctatagtctgactgctgctctctgcctctagctcttttcagtttagctttctctttggaattccttgcattgaagtctgcttctgagtgtcttagttttattgtcacatgcagccacttggctccaaggaacccccaaggtctgagtttaccactctcttccatcactatcatcttccccctgttagggaaaggtagtctaagggccatcatggaatgattggagaagtaaaggtttaacagcattgtgtgggctacagaaaaaaaagtgtacaaaggaagagagacaggaagaggtctggcgataaaagtcatactaagtaacttttaaatcttatttaagacacttccaggcacgtctaacaagccagtctagtagctccaccaacaatctaactgtacaagagcggtgaggacctccagcagaccagtttggttcactaag

SEQ ID NO: 112800 - DNA, 249 bp, Homo sapiens
cttgtgcttatatgtatggacacttgcatgcacatgtgcacacatatatcacctttctacaaaaatgggtttttactgtacatactgatttgtaacttgcttgtttaactcgacactatattgtgagcatcttgcagcatcagtaactccgagtaagtgaaaaagacatctggtgggaaaaggccaacatcgtgccatgtaaatacagtgttttagttaaaataactggtttctaggacaaaccagaat

SEQ ID NO: 112801 - DNA, 107 bp, Homo sapiens
ggataacaagaaaatagttatgaatgttttttcagtctttaagggagggtataatagtgggaagaacttggtgattttaaaaataaaacaataaaaattaaaagtcc

SEQ ID NO: 112802 - DNA, 200 bp, Homo sapiens
gaggccccccagtgtgacctagaaggaggagaggtagggctgaaccccctttccaggccttcagatgccttgacaggcccgatgtcctaacaggatgccctctgtctcccctcgggacacccctgctcttcccatccgtctccatcaaccaccccacagtgccaagctgagggaccctcccagagcagtgactggaacct

SEQ ID NO: 112803 - DNA, 401 bp, Homo sapiens
gggtttacaagtgctctgaactctggagagaatttggagaaaagccatcaagttgattaaagaaattaatgaagcaataaacaacaagaagcaataaactattattgcatgggaaaatggacaggaaatcttaatacactgtagtaaggacagtgactaattattcttccactcttcttaagatggtgaaagaactaacagactaaaactacggagttcatacgaagaattccctaagaatgaggtctgttaaaaggtggtggattattctttgatcaatttttcaaaaagaatcctatgacgtgtgtctaagggttgctttacgaagtgcttgatctaaaccacctgagtcctctaccatcatatgaaaatgtcttcctcagaaactttgataactctat

SEQ ID NO: 112804 - DNA, 387 bp, Homo sapiens
aacaagctatacatatggtatgtagtaggctataccatctaggtttgtgtaagtatacccataatattctttcgcaaaacagtgaaactgcctatgactcatttctcagaacgtatccctgttgttaagcaatgcatgactgcgagtatttactagtgctctttaactcaccttaagcaataaaattcacaaaataacagttttcatacattagttatattttctgaatgcatattaaaataaataaccattaaaatataaaacgttctggtggggcatggtggctcatgcctgtaatcccagcactttgggaggttgaggtggggaggatcacctgaacttaggagtttgagactagcttggacaacacagcaaaaccccatctct

SEQ ID NO: 112805 - DNA, 1243 bp, Homo sapiens
  misc_feature (394)..(394): n is a, c, g, or t
tcaataggtctagcatggggcataggaatctgtatttttaggaatgataaaggaaaattgcttaaaatagggtaaattataacttacaaatataaaatgaacacttgtctaagatttttgtttaactcgtttgtttaatgagggagccagtaagatgttatactgagttttatggaaaattaaaagagccacacatatctaggcactaaggaacactgaaataaatttgcttgataggttcaaaactgaattcttgatggaaggtgggaaaaggaaaattaattatacttccaccaaaaaaaaaaaaaaacaaaaaaaaaaaacaacagtcgttgggccgcgccctgcgagcccctcgggaaaaagccttccgagaaacccaatagcgtgtggngacgccgcgggacgcacagtggtgttacgtgcgcacacggtgggcaaaaacgaggataccctacaggaaaacacccgcgggccccatggaaacacagagcgcgccgcggggaaactcctcacacacaactataaaaaaagacgccgccgggggtgagcaacacacagaaggcgtttccgggaacacacaacctccacagagagggacagccccacgagaggcacactaagcgagaaccaccatcaacacaggggacgccccaacaggacgaacgcaccaaacatcactcaaattcacccccgcaaactggttggggggaaaaaacacaagcaacacgaaacaacacacagacagacaaaaacaagaaagaacaacaacaaaaaaagaacaaacgaaaccagacaaaaagcaagagagagaaaaagcagaagacaacagacacaccaccaaaaagaaccacgcacacgagcaaaagaaacgaaacagaacaacaaagacgaaaacgaacaacagcaacgaacgagacgaaaacaagaaacgacagacagcggcgagagcacggggagcacagcagaggagaaagcagacaccaaaaggcgagcagaggagggagcgcggcaagacagagagagaaagacagaagcagcgaagaggagagcgccgaaagacgccggagcagggcaggcaaggagggagaggagaagaacaacagaacacccacggagaggagaaagaggaggaaccagagaagaagaacaaacacagcaagcaagagcgacgacgacgaacgaggaagcgagaggcgagggggcaagagagggagcagccaagcagcagccacggaagaag

SEQ ID NO: 112806 - DNA, 554 bp, Homo sapiens
cacagtggctcacgcctgtaatcccaacactttgggaggcagaggcgggcagatcacttgaggttaggagttcgagaccagcttagccaacatggtgaaacctcatttctactaaaaatacaaaaaatagctgagtatggtggcacatgcctatagtcccagctactccagaggctgaggcaggagaatcacttgaactcaggaggcagaggttgcagtgagccaagatggtaccactgcactccagcctgggcaacagagggagactctgtctcaaaaacaaaacaaacaaaatgaatgcagggcatctgagtggcacacatggtggaccacagtaggtacagtggtggcactacccagcaaaagagctcttcacccaatgtgctagaagccaatactatgacatcagatttttgagaaaaggaaaggtttgtattgcaagttaacaaggagacaggagtccagctcaaatttgtcttatgctgactttaaggcaataattttcttagaaaaggtgtagggcgtggattctgggattagcaggcgattggtgg

SEQ ID NO: 112807 - DNA, 851 bp, Homo sapiens
gaacctggtttcaggtagggtttttcagtgaggcagattctagtttctgttccgaaaacaattggtttttagagagaaatgctgaaggtgctgttgcctttttgcttctctttgtctgcttgttcataagcagcagagtacaatctgtaaaggggagtatgaatagtgtttctgtttttgtttaagagtaagaaattgccagagaaaataattagggcttggatcagcttatttaaagcaatcatcttcacactaagatattactttggtttatttcagagcttgtttctgtgtgtcactttgcccccttctgcaatttgtgccctttgattttcagttcttaaaatttggaggcgagatttccccagaggattatctttctaaatcaaatcctctttatcaagaatctaaatttaaaattgcgtgttttgataaacatgcaggttaaatgtttagaacactacttagagaagatgctggggcccatgcctgccttcttagaaatccacagaaaggaactagggctgccagtatttgttgtatcattgggccataataggtttgtcatcttgataggctgttttcaccaaatatttgccaagaaaagagactttaagaattaaatgtaggccttaaacttgttctacttctgcattcaatagatatctgtttctgtttcattttaaaaagatgttagaccagctgggcgcgctggcttacgcctgtaatcccagcactttgggaggctgaggtgggtggatcacttgaggtcaggtgttcaagaccagcctggccaacatggtaaaaccccgtctctactaaaaatacaaaaattagctgggcgtggtgtc

SEQ ID NO: 112808 - DNA, 422 bp, Homo sapiens
ctcctaccacagacttcctgctgatccacctgcctcctcccttcagggccccttgggttgtaatcactgatgcaccattgttaggcggcagggtgatttaaggtgaattgggcctttgcacggcctgcttggttaaaagctggagcataagtcatcgcaccattctgtgtgcgtgtgtgtgtgggcatgtgtgtgcatgtgtgcacgtgtgtgcctgtgtgtgcctgtgtgtgtgtgcccatcttcgtcttccttcccctcccagccttccctgcctgggctttggggctccctgtgctgtgaatttcactttgctgggttacttccagtgcatgctgctagtcattcttgcttgacctttaaatttttctctttagggaaaatatgatcattagtctgtgttctccagcagatgtatacca

SEQ ID NO: 112809 - DNA, 788 bp, Homo sapiens
ggccattttaatcaacattgggacttccctgttaaaatcttggctgagttcagtgagtttcacaaacacataaaaagcaagcttaaatactggcagagggtggcctgaaaaggaaattcagctttcttgctgaatattattattaatcaaaataagtataaggatcaaataattataattgcattaaactctttggggacttgagacttctgtcatttctataaactaagaatagctattattgaattcacttatgaatcacaattccttacacttatttgtcatcttacacatcacaaaatgctttcacctgttatgatttggtttgatgttcacagtgcaaatgtgcaggacaggtattattagccccgtttaatagatgagtgagttgaacttacgaatggtcaagagctctttccataggcaacattgcctctaagatcctcttagctgtccctttgtgatgaataatcacttctttgctcaaggaagaactaggccttcaaaggttgctgtcattttatataaatgttgactgaaggtgtgcacaacctgacctggaaatacaagaagtatgtcattgacatatctttatgatattcaagcaggttaccttttttctaccaataataattgaaataaattaaagagagtacagattaaacatatgttttcaattgatggtgggaatgtaaagaggctcttaatgaatttgttaacggctgtttccattttgctcaatgctcggttatcaatgccaatgagttttggactttgatcataataac

SEQ ID NO: 112810 - DNA, 1866 bp, Homo sapiens
cagattataaatctacccacattgaattctgaatagatttggaaaattgatctgcttgcctactaagtacaatttgtttctgcctgtggattctgggggttttccatcattaacacattgaggttattctgtctggcagtgatagggaacaaacattggcctatttatttcagcaaaggagttagttgctaggaaacatttcaactttagtcaggtattgccaatagactgcaaccacctgaaaatatcttagagaaattctcggttatattgactttacagagttaattagatcttagtctaccacccggtccactcgggcttctataccaaaacaccttagacagggacagtgtaattataaaggactaaaatttgttaattatagttcacgaagctgagaagtccaagatcaagtcaccaacagattctggtgtctagtgagggctgctctctgtttctaagatggcaccctgttgctgcattctcacatggcggaaggcagaaggtcaacagggacccaaccgagcccttttaaaaggtcaccaatccaattcatgagaatggtgccttcatgacttaatcacatcctaaaggccccatatctgaatactgtcaaaatgggtcttagtttccaacaaatgaatttgggggcacacatacctttaaaccatggctcctactaagcacatttctgttaaatcatactgcctgaattctttccccgttattgcaagtcacaagcagaagataatttactcgcaaaattattttttttgcaaatctatttcagtttttatgaataaagacagattcactcaaataattcacataaatgtatttgtaaacgttatacctgaggaggaaatgaatataaaaaaaaaaagttgattgatttaagggcactgaaactgctcatcaattatttaacaagtacatacggagcttctacactgggccagtagttacgctaggtacgatggtctcaataagcaacaaaaattattttctacaagatgcttaaggtcaattatacatatggaatgtttgattataggatccagagtactatggagaggggtagtagggacactgaactcagttttaatggtcaggaaattaggggaagtaacttttaaactaagaaagtttgctggacaaaaggcaagtgagattatttcaggcaaaggaaagaacataaacagaagtcacctcaggggtctgaaatgtggctaggccactggttttgtgttccttcgtgagtgaaagacatgcagggggtaggacatctaaagagtggttagatcatacagtgccttagccacattaagaagttcaggttggggccagacatggtggttgacaccagtaatcccaccactttgagaggctgaggtgggaggaggtaggaaagatcaagtgtcctttcctacacatagttctctctcagtctctaggaatcaggtggtggacttctctaaagctgcacttttttttttttttttcccaagcagcatggcttgcctgattgttctctaggaactagtctagccttttcagatgagaaagttactttgtctacacagaagttttctcatggtgatttggtatctccctcatcaccaaaacctggatacatggtagatggcctaaaattgttgaattatctatctttcaaatttacagtgtgaatcgatttacgtttcaggtcctgaaagctatcaaaataaccaaagtccatttatctgaggagatggtattaataattagttgtgtaagtaaaaaagtcaataaaagatgaagcatatctgtaaaaaagatgaatatatttaaaataaattaagggtgaattttaaaaaaaagtta

SEQ ID NO: 112811 - DNA, 337 bp, Homo sapiens
acgatgccactttggaggcgatgtctgcattaggtgaccctgttctcttggctccaactaattataccaagggtcacatgtctcagattccctttctcaaaaacacaaagaaaataaaatgtcatcagatggctggggaaggtggagctggctacaagatcagagtttgcccaaaggcaagtcagtgttgctggagcctgtcagatgaatccagtctgcaaaaaaacaagaaagaagcagatgttcagggagaagaggagataagagactgtgaaagcccagagaagtgatggagaaaaaatatctgatgacattccagatttggaaagtccagaac

SEQ ID NO: 112812 - DNA, 808 bp, Homo sapiens
  misc_feature (44)..(46): n is a, c, g, or t
  misc_feature (49)..(49): n is a, c, g, or t
  misc_feature (53)..(53): n is a, c, g, or t
  misc_feature (76)..(76): n is a, c, g, or t
  misc_feature (83)..(83): n is a, c, g, or t
tggccctcagctttgccaacacatggcctgccgtctcctcagcnnnggntgcngaaatcgaagccataaaactggntgagcanaagcacagggaggagcggaggcggagggccacggtggtggtgggggacctgcaccctctcagggatgccctgcccgagctgctggggctcgaggctggcagccggcgccaagcccgcagcagggagagcaacaagccccggccctcagagctcagccggatgagcgcagcccagagacagcagcttctcgaggaagaaaggacccggtttcaggagctgctggccagtccggcctacagagccagccccctggtggccatcgggcagacgctggcccggcagatgcagctggaagatggcggccagctctgaccagggcagcgggcatgccacaactcctcaggacacatgtgggccaagtagagagcgccggcccctcaaggaccatggcctgagcctggtggacgcccttccctctggtcggttgtggggctcaataaatggctctgtgaacttcccctgcactgccagggccgttcccatgagctgcttccctgattcacagggctgggcacaccctgggacagctgcccccactctcctcaggacaacaagccacatccctccactgggggccccagcccccacgcagtcagggtggaccgtgcacagggtttgtggggactgcagttgtggaggccccaagtccgtccctgagcaggcgctggtgcccacaagatagtctgctggctgtgttgggaaggaattgtgcctgggtgtggccc

SEQ ID NO: 112813 - DNA, 737 bp, Homo sapiens
  misc_feature (44)..(46): n is a, c, g, or t
  misc_feature (49)..(49): n is a, c, g, or t
  misc_feature (53)..(53): n is a, c, g, or t
  misc_feature (76)..(76): n is a, c, g, or t
  misc_feature (83)..(83): n is a, c, g, or t
tggccctcagctttgccaacacatggcctgccgtctcctcagcnnnggntgcngaaatcgaagccataaaactggntgagcanaagcacagggaggagcggaggcggagggccacggtggtggtgggggacctgcaccctctcagggatgccctgcccgagctgctggggctcgaggctggcagccggcgccaagcccgccgaggaagaaaggacccggtttcaggagctgctggccagtccggcctacagagccagccccctggtggccatcgggcagacgctggcccggcagatgcagctggaagatggcggccagctctgaccagggcagcgggcatgccacaactcctcaggacacatgtgggccaagtagagagcgccggcccctcaaggaccatggcctgagcctggtggacgcccttccctctggtcggttgtggggctcaataaatggctctgtgaacttcccctgcactgccagggccgttcccatgagctgcttccctgattcacagggctgggcacaccctgggacagctgcccccactctcctcaggacaacaagccacatccctccactgggggccccagcccccacgcagtcagggtggaccgtgcacagggtttgtggggactgcagttgtggaggccccaagtccgtccctgagcaggcgctggtgcccacaagatagtctgctggctgtgttgggaaggaattgtgcctgggtgtggccc

SEQ ID NO: 112814 - DNA, 421 bp, Homo sapiens
gaaaataataaaagtggtatttggatgagataattttcctttaaatttattcctcagaatgatgtaaattttccagctggaaggtcatctttctatacatgcatgcatctatacaaatggttaaacagttactctctcaatttgctgagataggaaaggtggatataaatataagcaagggtctgattaaaacaaaacaaaacaaacaaaagacaagagaagcactgcattgttggccagaaattccttttaagtcagacttaagtccacggaaagctggacctaagcagtgaaggatgtaagggaacagagagagactctgcttggccgagtttgctattctcatttgtctatgtcaatacggctacataaagttcacaactatttgcacatagctataaatatagcatgaataaaacac

SEQ ID NO: 112815 - DNA, 472 bp, Homo sapiens
aaagagggggctctgtgcccggcatgtctctgaagactgattgaacctatgcaccagttgttgctttaagtcgctttattttctgtctttggtgtctctggatgtaggagccccctgctttctctgtccgcagaactccatactgggtcccctacgtgttcctccttccctaggacagcaacaaaaacacacaattttccctctctagcaggtctctaagtctcctgattcctgaaactgcctcagactccccctagagggagggaggcccctgaggctttcttgccatcatagcctcttctgggcctcagtttcccctctgtaacctgatcctagtacttggataaactccgacgaggtgtggggggttgttgtctgtgacctccctgaaatatcttagacatttggggtactgagcatttatctggggttaaataaaatctttacatcttaagacattcgattgaccaaa

SEQ ID NO: 112816 - DNA, 990 bp, Homo sapiens
tgttcctgccaggaaaacatgtagaaccacttaactcagactagaggatcaagatcccttcctggaagaagagagctaatttttgaaaaacaaataagactaagccaggcaattaagaatccagacgctgcactcagcaaaagaaatgacataaaccaaggtgcagagagtggagaaggcaggaattcatctaggtcactgaggttcaatgacccagtacaaggtgagggctgttaagggatggggcaggagaggttggcagaggccacaacacacgggccttatatgagcaatgccatactaaggagcttggactcattcctgtagacagtggggaaccattaatacttttaaaataataccactcttctccttgttttatacacatgacagataaaatcacccaaagccagttcatctggacaaacactaccctttggcatatttccatgtgtgtacatgcatccattgatgatttttaaacagagaagtgacataattgggtcttcattttagagagattactgtacctcaatggttttcaaccaacggtgattttgttacccaaaggacatttggcaacatttgaaaacatttttgggtcagatgtggtggccgcctgtaatctcaacactttgggaggctgaggcgggagactcacttgaggccaagagtttgaaattagcctggtcaacatagtcaggctgcacctctacaaaacattaaaaaattagccaggcatggtggtacacacttgtagtactagctacttaggaggctgaggcaggaggattgcttaagcccagaaggtcaagcttcagtgagctgtgattgtgccactgcactccagcctgggcaacagagcaagaccctatctcaataaaaagaaaacatttttggtttccacaactgaagaggggagggtgcaattgggatccagtgggtagaggccaggggtgctgctaaacatcctacaatgctcacaacaga

SEQ ID NO: 112817 - DNA, 296 bp, Homo sapiens
gataggtctggctccaatcatcacatcgtgctcttacttcattatgggccaagaactaaggcaaggaaatggctgctgctttgtttctccagcccaaatgtgtggggttttttcccagatctgaagcatgcgtggactaaaggcataaggaagaccaaaggatgtgtaatggcttcgctgtgatgaaatcaatctaccctacaacttaactatgaccccagcatgaataaggctctgtgtgtgaaaagtgaatgggtagcaatgtggggtcatggaaaatgctcctggcatcattt

SEQ ID NO: 112818 - DNA, 340 bp, Homo sapiens
tgtctcagcacattggtgttccacaggaatgcaaaggcgcgtctgccctttagtaagtctgtatccactgacacccatgctcctggtaaaatcggaacctctattaaagtagctgtaagttaattattattgagcaatgttttggcatagccactatagactgcctgctgaaaacctggaccaggactggatccgtaaggtctgccttcagccgcttttccttgtatcagttataattagatctctttaccactgataggcttaatggttaatcaacacaaatatggacttttccttaaacattccagaaaccttaataattatacttgaaaaaagtgtg

SEQ ID NO: 112819 - DNA, 94 bp, Homo sapiens
tttgttttaaatttttttattgatacataatagatgtacctattttggggagtacatatgataacttaatacattcatagaattcacaaagatc

SEQ ID NO: 112820 - DNA, 289 bp, Homo sapiens
catttcttacaagcaacaacaacaaaatgctcagaagctatactcagtagtctcagtgactgaaaaagtccggcttttaactgccatccaatccaaacaacccacttctttagaaagctatgcaaaatattgaccccttactgaattattttactattcaacattaaactatctaaaagagaaaagtaattaatcgctaagtttagttaagcaatttagctgacatagtaaatatttactcttcacatctcacaggaagtcttgacaagcatttgctgctattctgctg

SEQ ID NO: 112821 - DNA, 458 bp, Homo sapiens
ggtgacaaagtccacttttcttttccctctgctcttctcaagtggaaggagtctctccccaaagccaccactgctaggaatgtgctgcattacacctgataccagtatgtctgagtctcacccaaggcctgcagcataccacctgggtaccactgctggttcttcaaggcctaagagctctttagtcagtaggtaatggatcctgcctaaactgggtccttcccttcaaggtagtaggttcctttctggcccagagtatgtctagaaatttcatccaagggctaggtcccggaatgggagcctcacgactatgaccagtacgctatcatactgtggctgagctgctatccaagatgcaagacagttgtccttactcttccctctcttctcctcaagcagaaatcaagggtctcttttgaagatgcaagctatgctgcctggggttggtaggagggcat

SEQ ID NO: 112822 - DNA, 796 bp, Homo sapiens
gtggagctcaggcagtaatgtgagcaatggggaatggctgtaaatacagatgaagcttcactcacttgcctgccactcaaaacaggccacagaccagtaccgtgtagaagtaccaatctgtagcctgggggttgaggaccgcagctataaaggacactcattctgctgtccgcacttctcccaataactaccaggaaagggtcacagtcagaatgaatttagccattcaccttcagtaccaatgcattgtcctaaagaggtaacagttccactggcttcaaatcttttgtatcatttgtgtcttccttccctctcttctcttcctctctcattcacacttttctcttctttctccccaatctctcaactcctttccttccttgcttccctgaccactaccttttcaacatctgtcttttgacctttccctttcccttctttattcctatccctgccaccatcctgtgtaaagtgctatcagttctactccattcttccctctacctctgcccttaaccctagttccaggtccaggtagttccttaccccaccctctggacaaggctgcttctgggctataatctcttttcaagatattttatcctacatgcagctgccaagttatttcccctacaacagcaatctattcataacacagccctgctcaaaaacctttaagggtttacatttcctatggagtaaaaaccaagtcgtaagcctcatgttccagagccaagacagtatggttctattcatcttttgcagcctgggcatgctctggttttctttagacatg

SEQ ID NO: 112823 - DNA, 589 bp, Homo sapiens
gtgtgtgtgcaggtgtggtgtacttggagctgtgtgtgtgcacaggtgtagtgggtgcactcagggccatgtgtgtgtgcagccatgtgcacaggtctggcgggggcactggggccatgtgtgcagtgtgtgtgcaggtatggtgggtgcgcttggccaccctcgtttctgtctcctctgggcccccaagcacgcttttgtgctgactggatctgctggcgaatgtgaggccggaaggagggcaaggacgtgaagcccatgtaaacagacctgtcatggccactgttgttgctgcttcagtgggagggatttgagcgggtctgtcctgtctgtgatgcccctaagagttctggaagagccaggagagcccctccggggccagttcgtgagcctggagccccccatgtgggcccagggaggccgcctgggtctgggtctggatccttcttgggggaaggttcaggtctgtgccatgcagcttctggctcaggtgggtccgctctgggcaggaagctgcccaggtgcgagggggatggacactggagcttcgtcccatggcaagctcatttccttccatttctacactgaa

SEQ ID NO: 112824 - DNA, 205 bp, Homo sapiens
gctgctgatgactcgtagaggatccccccggctctgatctttggtatgaacacaatatgccacttaatatttccacaaaggaaaagtaaggctcgtcagtatgttaaaagaccagctcaagagcaaggcaaattctctccacctcgaaatctactttcccctgaaagatctctgttctgtggcaaaaaccgagggtttgaagagt

SEQ ID NO: 112825 - DNA, 799 bp, Homo sapiens
cagagatgatgggacaacctgcctaaagagaggagcttcccactgtagggcctcctttctgctgagagctgaagagatgatgggacaatctgcctgcagagaggagccacccattctagtctaggacctctctgctgagagctgcagacagcaggacaaccagctgcagagaggagctgccctctctgctgatagctgaacacctgttgggatgaccagctgcagagaggagccactctcactgctgagaaaatacttgctggggtgacctgcctgcataaaggagctaccctctctgctaggagctgaacactcatcaggatacccttgctacagagaagagctgtccactgtgggtctttgagctgttctattgctcagtaaagttcctctttgtcttgctcaccctccatttgttgtctgaggacctcattcttcctggtcacagaacaagaacttgggacccttgaatggtgagggtaaaagagctctaacacaagcagagctgaaacatgccccttgctcaccatgttgcaggtgaaggaagggagataagagctgtggcccttctgggagcccagacctgggagctccccaagctagggctgtgactccttctttggggccctgtggttcctggcatcttcaagcttctgagtgccactccattccccggtgccggccggggaagctgtttgtggtgcaactggtccagccacagcctcgcagagagctggcacttatgccagcacctggagctgcccaccctgtggcagcagctgacatgtctgactgggca

SEQ ID NO: 112826 - DNA, 329 bp, Homo sapiens
cagacagaagggcttccaaatcagatccctaaccaagaactccaagagtatcccttccaaactatcctcctgttctctgtctgagaaatctccccaaaatcttcctgattgagaagtctcccaaaccaagactcttcctactaattagagagagccaaccgagaatctcaaatgaaccaaactgagaaagatgcccctcagtggggctacagaccgacaccccaccatggggcaacagaaaaaccaagaccccctccccaaaggaatcaaaccaatcgggaaaaggaaggaggcgttggccgtgcctaggatattcaccaatccagaca

SEQ ID NO: 112827 - DNA, 751 bp, Homo sapiens
gtgcacgctgatttcctccggctttagtgttgaagctgattggatccttggttttctgatcactgcacggggcacactggttacactctgtttacagtgcagacttcagagtgcatagctgagaccacatgtttttctcccagggaggggtcaaggtttggagcaggagctgccaggatccaagacggggtagaaaatgcatggtttcaggccacactgccctcctgccctcctgccttcctgagacccttccttcacttgtttttggtgggaaacagggtagggtggggtggtgggagacattgttagtgtgaaccagtaggagacagagtcctggtgagccggtgggagatggggccgggtgagccggtaggagatggcaccaggtgggatggtgggagatggtgttagtgagccagtaggagacagcgtctggcgggccagtgggagacagggtccggtgggcccatggaagactgggtctgggtgcgccggtgggagatggcgccgggtgagccagtaggatttataggggcagggcctgcagcgacgagctaagtgcaagctcactgtggattctgggcatcgtaatagggagatgtattttcaatgcttgtctgtagttcagattaatgcgttttcctaggctcacagcttaactcctggctctgcctcttatgttgtgatgtgaggaaaggagtccaatttccttcagcccaggtttcttcctctgtcaaacagggatcctcac

SEQ ID NO: 112828 - DNA, 446 bp, Homo sapiens
tgggtataaaatgtcaatcctgtataaattctttcagaaaactgaacagaatacttcagaaatcattctgaagctacattactgattccaacaccaaaacattacaagaaaactacaactatcccatgaacataagttcaaaaattctcaacaaaattttagcaaatcaaatccaacaaaatataattagaatagtatattgtgaccaagttcagtttatcccaggaatgtaagtctaatttcataattgaaaatcaatgtcattcaccacattggcagactaaaaatgaaaaaccacctatttcaatatatgcagtaaaaaagcatttgaaaaatatccaacatccaaccctgataaaacctctcagcaaatgagaaatcaaagagaacttccacaacgtgataaaaagcacctacaaaaaacctacagctaagatcagacttaa

SEQ ID NO: 112829 - DNA, 535 bp, Homo sapiens
atgttactaagcaaaagaagctaatatgaaaagccacatattgtaggattccaactataaaacattctggaaaaggcaaaactatggagacaataaaaagatcagtggttgccagagattatgagcaatgaaggaatgagtagatgaagcataaaaaatgttttatggcagtgaaattattctgtacattataataatggatacatgttattgtacatttgtcagagcccataaatttatatattgtgatacaatccattttacatttgtccaaaaccatggagtgtacaacaccaagagtgaaccttatgtaaattatggactttgggtgatcatgatgtgtcaatgtaggtccctaaaatgtaaaaaatgtgccattctggtgggggatattgataataagggagactgtgcatgtgtgaaggtaagggggatatgggaaatgtctatttcttctttgcaattttgctatgaaactaaaactcatctaaactcactaaagtctgtaaaataaaaatatgatggagaataacag

SEQ ID NO: 112830 - DNA, 171 bp, Homo sapiens
cacgacaaacgcatcataaaataataccactcttaaagatataaattatgtaattgctaataaatgttttttcttctgaataattttaccctagtaattttcttcaacctgacagggtttcatggagaattcgaaccatgagtatatgcaaatgataaggtcaggattcat

SEQ ID NO: 112831 - DNA, 776 bp, Homo sapiens
gggaaggaaagtacacttggaagaaggccaaacccagttttcatattttattttcgcattgagaatcagtcagatttacttcagcctcaaaagtgtgtttatgtaaaattaaatgagcactagcagcaagctgcactttttttttcccaaatgggaaacgggttaaatatgtgtaggaagtcctgggccatgccctccaagtgcccatgtgtgaaaacaaccaggatcaacacagcaaaagctctgagagctcaacggcaatgtggaatactctgaggtttcaaactggcctccagggctgggtgcggtggctcatgcctgtaatcccaacactgtgggaggccgagatgggaggaacacttgagcccaggagttcaagatcagcctgggcaacagagtgagaccttgtctctactaaatataaaaaattagctgggcgtggtagtgtgtacctctggtcccagctactcaagaggctgaggaggaggagtgattgagtctgggagattacagctgcagtgagctatgactgggccattgcactccagccagggcaacagagcaagaccctgtctccaaacaacaacaaaaacaaaaacaaattggcctctgggttgcacaaaggtgggggaggccagaggagctctgcaaaaactttgaaaactaaattgatcttagaaccagagccctgctggccacagaaagtgcatcctgaatctaaacaggttgagtgcctgctaatacagaatatttaaacaggaactacagtctcataa

SEQ ID NO: 112832 - DNA, 173 bp, Homo sapiens
ggtgggcacccaaatggcatttactgaatgaatgaattttgggaaatccttttagcctggtgcatgggctctgtatttagttttatctgatttttatttattttatttagtttccagcccaaatttaacgtctagttatccatggctgtgtaagaaccccccatccccaccaa

SEQ ID NO: 112833 - DNA, 237 bp, Homo sapiens
tggtgtttcctactggagaggactcagggtggatgatctggctagactggaaaaagagttgccctgttggaggacagtgagagagacagcaagacctaggctgggtgtggtggctcacacctataatcccagtactttgggaggtcaaggtgggaggattgcttgaggccagcctgggcatcacagtctctacaaaaaaataaaaaactagccaagtgtaggggtgtagtcccagct

SEQ ID NO: 112834 - DNA, 327 bp, Homo sapiens
aaaatgctacaggaagcaggaacaaagttaatgaaaatataaatgcacttttctcctcgtcttccataaccactcactgattagaggcacagtccatttgagatgaggctgctgcctgtgtgtgtgggagggttgaatattttttgctctgggaggagcaactgtgatagccccaaatccctgacagcctctcttcatagactgcaggtctagtgtgcaggtgatagtgctaaactcccagtccaagggagtctaaaggaggaagccgtgaagaaaaaggaaagtgaaacagtggactaggacagaaggacattactattaatacta

SEQ ID NO: 112835 - DNA, 804 bp, Homo sapiens
catttgccagggtgctctctgggccactttacctgcctgattaattacccctgtactctgggtgatactgaaaataaaatgagacaactggtttggcatcaatacaataaaaaatagatgctgttcgtaaaacgaacagacaaaaacccaccctagctgtacttgtgagtactcactgaatatcacccctacctgttttgtttcactaagtagtggactcatcttttgtcacagacctagtggaagatagtgagtgggaaaaatatgttgatgctttacatgtgatttccattggcagctatcattgttagattttctttctccatatacaagttatggagaattcagatatgtttccagacttcttcaacatgcctttctagaataagaagggtttcatgcttttaaagtacaaaagaaaaagtgactcattctgtcaccatgtacaagaattgataagtatcacatttaggtctttttggaatgttttcatagaatttaaagaaaacagcatgattcaataagcagagaacctaaataagcagagaactttccattttgttttaaccatacacttgaagggaaatcacttaattgttcagtttcccccaccagcaaaatgcaagccctatcacctaaaatatttggattggacagttgattattttaccctgtagttccatgggcagtaagtgggggagcttagggtttttattccatgtgtgctctgcagccagcattcgttgagtggtgcagtatggaaagggcacaaggctgctcctgctactagcttatcaaaaggtg

SEQ ID NO: 112836 - DNA, 416 bp, Homo sapiens
gggcgaatctataagaatcccgggttgatatacgtgggaaacaatagcaactcaataaatgcagggccactgagtatttggagtgtttatttgtaggactgaggtaaccctagtcggtaaaaacaaacaaaaaacctcatgagtcaaggtgctgtgggagaaggacacaaggagggtagatttgggtctcactgaaggagggtcttagcatctgtatggggagttcgtccctctccctgacacattattttgtctctgccactctccatgaagggctctggaggtggagaagatgaccatttttctccttgtgggactataatgagatcgccatcatctcaggaggagacaccgtggttgatgggaaatgagttttcctgtgttggtatttttccaactaaaggaagaataagttg

SEQ ID NO: 112837 - DNA, 278 bp, Homo sapiens
atccgccagccttggcctcccaaagtgctgggattgcaggcgtgagccaatgtgcctggccggaatgatggacatttctaaaatgtatcattaggccacccttcacctaaattctccaaaggcttcaactcacctccaggaacggagtcactcactcattcatttattcattcgtttgccaccttcaggaggctcaaggagtaacaatttcaatttcatcccttccctcttctctgctttagttttcccaacaggatttaacaccatctgacatcctg

SEQ ID NO: 112838 - DNA, 436 bp, Homo sapiens
gcttagagagaaagttaaggcaatttaagagtctactgtccaagggatttatctcccagaagcgcatggaaaacatcacaacactacctctataaattggactcatggcaggattccaaggaattcagtatgccatcaacattaagcaatataatcagaactaaactcaacaaaatttttctttcagtgataatcctaatttttggtaaattatcggggaacctgcccccaataattcaaagtgagtccttttctattttccctaagtgtcggctggtctgagaaataaagggaaagagtacaaaagagagaaattttaaagctgggtgtctggggagacatcacatgcccaagccgcaaaaccagcaagtttttattagtgattttcaaaaggggagggagtgtacgaatagggtatgagtcacagagatcacat

SEQ ID NO: 112839 - DNA, 684 bp, Homo sapiens
gctctgtctaaacatcattccaacctttgcaaatcttatagactacccatccatgaaaaacgctttgataccaagaattaaaaatgcttgtctacaaacatcttcccttgcggttcgtgtaaattcattagtgtgcttaggaaagattttggaatacttggataagtggtttgtacttgatgatatcctacccttcttacaacaaattccatccaaggaacctgcggtcctcatgggaattttaggtatttacaaatgtacttttactcataagaagttgggaatcaccaaagagcagctggccggaaaagtgttgcctcatcttattcccctgagtattgaaaacaatcttaatcttaatcagtagtttagcatggatgtggtctgccttcccatttgtttcatgttcaattctttcatttccgtcatataagaaatgcttaatagattggagtctgaacataagactaaactggagcaacttcatataatgcaagaacagcagaaatctttggatataggaaatcaaatgaatgtttctgaggagatgaaagttacaaatattgggaatcagcaaattgacaaagtttttaacaacattggagcagaccttctgactggcagtgagtccgaaaataaagaggacgggttacagaataaacataaaagagtgagtttccttac

SEQ ID NO: 112840 - DNA, 781 bp, Homo sapiens
gataggaaaagaaggctgctattcttttatcatacttttaaaaatcttataaatatataaagactgatttcgacatgtatttgttacagaatctaaatatattacatgcataaatcagaatggaaagttctttcatcacttacaattagtgtgacaattttttaagggcagaagaaaactattttaatatgttttcatgtttaattcaggaagtggaagtctcattccataaagtaacatttttggtgatagttgagttttgtatgctctaaatataagtccttcctattttagggatctgtcaataagttgaaagtgaatttcgaattttgatgttaatttctgcatttttttcctccctttgaagaggagactctacctttccatatcattcttgaataataccattctcaaggtgctgtagaagtacagagacgaagggcagaatactgaatgcataacagaataactctaggtcgacagatcaaatatccctccaaaaatgtgtttaaacaaactttcagtataataaaaagatttaaaagctccagacaatccctacttaaaaaaatcaaatgtaacacaacataccagaagaatctgggaaagttttggaccctgttacgacagtttaatgtagatattaaagagtcctggagagagtacttactgccccatggacaactataataaaagattcccctacatgcacacacacacgcacatacacacatatatgatatgggctaattaatggcaccgattttcagcgctaatcaca

SEQ ID NO: 112841 - DNA, 678 bp, Homo sapiens
aaacacaccctcactcctttcctatagcggagctctgtcccctgcagcactccagggagtgtgttgggaaaccactctgagatccagtgccacccacctcttcactggcatctgtccccacctccacaacctgtgcatccctccacctcagaaccgcccttagggcccgcccccgcccccatcaggtcacactgtttcccaatccaagtccttgttccctttgctcatccattgaggttcatcccagggagaaccattctcttcccacaaaaccttgcgtgatcttggtgtccactgtgccaccaaattgcactggatggccctcctgtgacccctccttcccaggacgtgttagatgaagctcctgattcgatggtcagtttctccagcaccgtgagctccccgaggataggcactgtctgtgctcctccagtgcccggcacgcagaaaccattctatttactcgatgaaggacgtgcccatccagaacccccagtaagagcttcaggacgtaggacgggaggcagctcctttttcgaggaggctggaggccttgtgtgggagggggagctgtactttcctgggttagcagtgacctgtgactctccccttcccactgtgggtcctgcctcttatgcaggcccctcagcgttggtgccaggcccttgttatcccact

SEQ ID NO: 112842 - DNA, 390 bp, Homo sapiens
attgttaatttgtggtgtatcttgtcctttgggatcttcttcatatgtgttaacatatattgctttttcccccaaagtgccatcatttttcacttatattttgtaacctacttttctgactaatattacttggatatattccacagacagtacatacagagctactctataatgtttaatgctgcatagaattacattgtatggatgaattgttatttagttaacctgacgatggacttttgggttgtttctgttattaatagctatgtgggccaaagcaggaggattgcttgaggctaagagtttgagaccagcctgggcaacgtagtgagatgctatttctagaaaaaagtaaaaaattagctggtgtggtgctacatgcctgtagtc

SEQ ID NO: 112843 - DNA, 818 bp, Homo sapiens
atttattttctttgcttttctttttttttgagacagagtctcactctgtcgcccaggctggagtgcaatggcgcatctcggctcactgcaacctccgcctcctgggttcaagtgattctcctgcctcagcctcccaagtagctgggaatacaggcaagcaccaccacgcccagctaatttttatatttttaggtagagacagggtttcctcatgttggccaggctggtctcgaactcctgacctcaagtgatccgcccgccttggccttccaaagtgctgggattacaggcatgagccactgtgcctggcctgattacttgaaattcatgagtattgatttaaaatgcttctgacagccaggatttgtctgtccatctattcattcagttattcacttaacattttttgaatctctatagttgtgccagaacttgtataagcaccacaaaatgcaaagaggtataagataatgcccctgcttgcaataagctcacattctaacattcaaaatgactagcacatagtagatgttcaataaacatttgttgactaaattcagtgaaagagttgatgaatgagagacagccatatcaatgaatcataaaaatctgacagggatatgttcaagccagaggagattatggaagcttggaggaggattacctgaccacctagtctgagggaatcaaagcttgtagaagagataacgcataataggagtcttaaagaataggagcttaaagaattagaacagtgtgagcaaaaataggtaagcactagaaacagcagtcaggcataaggcaaaacaaaatgaaac

SEQ ID NO: 112844 - DNA, 422 bp, Homo sapiens
attgaggcttttttgtggcctatggtctggtttatgtttaatgtacacttgagtagaatgtgtattgtgctgttgttgagtggggtgttctgtaaatgtctgttaggtttttagtgtctgctgatcaagtttttctaactcctcgttgatcttctgcctcgctctcctgtctgttaggagcctggccctgccaacaccttgattctggacttccagcctcccaaactgagacagttaatttcagtgtgaaaccaccccatttcttctgttacaaccaccctgacacaggctgattgagcttaacctactgtggaaataagtggcaacctcagatagtgcttgaaggaggcggaacagattggccattttgtgtgagtgcatgtgtgcgtgtgtgtgcgtgtgtgtgtgtgagtgcatgtgtg

SEQ ID NO: 112845 - DNA, 810 bp, Homo sapiens
agtggtggtgggtgcctgtaatctcagctactcgggaggctgaggcaggagaatcgcttgaacctgggaggcagaggttgcagtgagccgagatggagccactgcactgcagcctgggtgacaagagcgaaactctgtctcaaaatattaggaaaaaaaaagagagagagcctcttttccatctccccgccacagagttgtcttcagtaatttcattcccttttttcctgaggattcactgggtttctgggtcccagaggggaagttctcttcaaggtacagaaaccacgactccgcagagaaccgcagagaaccgcagagatggcagcatgaccagaccacggacaggtgtgtagaagctgctgggctgaaacttgggctgaacttccgctgcaggttgacttattcccatcagcaccaaagccgctggagggggtcatccactagcaaatgaagtgggggcacggattggaggctgtttcagaaggtcccactgagccacggactcaaggcctggccacagccctcccaagcgaggcccagatcatatttcaccacgctcagaaaaccttgccagctcatttcagtccacagtgactttgctttctttaggatctctcttgcactgtccaactcagagaatttcaaatctgaatggattccaatgatggagctaaatcaggcctcacctcagttttttaattacaatcaatagggctgggtcccagcatctgtgtcttaatgttcctccatgtgatcctcatgctgaaaggctggtatttgaaaatccctttttttggggagtgaagg

SEQ ID NO: 112846 - DNA, 365 bp, Homo sapiens
agtctcagcatcaccgtgaaccactggcacatgaagagccctcttgcctcagcattccatgaccatttggtgcagttactgcattagccacttttatcattctcccatagatgaacatatgccatttaaaaaaaacagcttttttgagataccattcacatagcatacaatcatccacttaaagtgcaccattcagcccgggtgaggtggctcacgcctgtaatcccagcactttgggaggccgaggcgggcggatcacgaggtcaggagatcgagaccatcctggctaacatggtgaaaccccgtctttactaaaaatacaaaaaattagccgagcatggtggcaggcgcctgtagtcccagct

SEQ ID NO: 112847 - DNA, 339 bp, Homo sapiens
taaaaagatttttttaagttgttttattccaaatggttagtcttcactacttcaactgaaatgtttttgtgcaaatgatattttataaaggtatttcagtagtttaacttatcttttaggtttatttgaaaatgtatatcacctttaaagatgcttggtagaatgcctatttcaaaaacaagcattctttgtggatttggcctatagtggagggaaaggggaaaaaacagaacttctaaacaccttaaatattaaacatattaaatctgtttctggaggagttccactttcagtaatgttagctaaagtaatttggattgatgctctaaaaaatgagaa

SEQ ID NO: 112848 - DNA, 403 bp, Homo sapiens
gcagtcagtcatcattaaaatctactcttcccatcttctgcagcaaaaattcatacttgccttcttgtacatatggctgctcagttactggcttcttttcccaaccaccatgcagctatgtttcactttgtgcatagtacgcaatgcaagcaaaaaagacaatgtgcctcttaagagattttggccttaaaacatggaatgcctgctttctcatgtttttttcacctgtctgagaactggaacatagatgatgcttgatgatgtgttggaagaactacaagatggaaggaaatggggtctctgaatgatagtgagaagtaaaaccactcagctggcttggactgctcactcatgactgttacatgggataaaaataaacatctatgttttttaagacactata

SEQ ID NO: 112849 - DNA, 450 bp, Homo sapiens
attccctgcattgaatgcctgtctgttgacattgtctgtaaaaattgtgggaagttttctgcaccctgaaatttctgttatgcggattaaatatccactatccatgtttttccaagtcttacagtagaaaggggtaaatgcagcccgtcacagcagcctgttgttcgtcctgcaaatgtgtttccatcacattacacaaagcctctttgtcttcgtggttctaccctactaataagtttttaaaaaaattatgtaatgtgtgtatatacaaatacctatatgtatgtgtgtacacatacagctgatatctgctgagattatgtatgcatgaactatagaattaacttgtaattttaagaaaataaattattttgtaaagataaatctcatgtttaagaagaggaattacagttgaatcatttagggatgcctcagcctaaacataatatg

SEQ ID NO: 112850 - DNA, 383 bp, Homo sapiens
ttgagatggagtcttgctttgtggcccaggctggagtgcggtggcgcgatctcggctcactgcagcctctacctcctgggttcacgccattctcctgcctcagcctcctgagtagctgggactacaggtgcccgcgaccacgcctggctacttttttgtatttttagtagagatggggtttcaccgtgttagccaggatggtctcgatctcctgacctcgtgatccgcccatctcggcctcccaaagtgctgggattacaggcgtgagccaccgcgcccggcctgaaatcctatatatgaaaaaaatccaaaccaagctgaacaaacaagttaacatttttattaaaataatgtagtaatatgtatactcagttttactcagg

SEQ ID NO: 112851 - DNA, 233 bp, Homo sapiens
gttagcgtgacatgagagtatggaatgcggtgttggttctgagcggtcgtgactcagagtcgctgctggtaaaccctagagaatcaagagaacaaaaacaacactagcaataaaacctatcgaaaatgctaagtttgagatgccgagaacaccctggcagagtcaatggcatcaagagagatatgtgcactggaagtgagggattcacggccatcggtgggtcagaacataag

SEQ ID NO: 112852 - DNA, 565 bp, Homo sapiens
ccaggaaaacagagttttctctgaagctctgcctcgtagacttctaaccactagcattgccacacctggatctcgtggccatccctagctgcaagggcccccagcaatgtgaccgtcttagtggggcacatggccacctcagtagagtcaggcagctgacagataccaggtaggcagagagcattgtctccaaagctaggtagggtttggatgcatggaaaagatttgggaaaatggcattcagattgggagaatagcataagcagaggcacagaggtgggagagttcagggtacaagggagggccaagactgtcacaaataactttaatcctcttcacactggtgtaagcaaaaaggagaatgtttcagtggggctcgcttcaggtgcagctggatccagggcttctaaaacccatcaggactctgcttcatcctctcagctctctttgctctttctgttagggacaggatggtccccagcagctcctgatagacttccctctagcttcacatccctcaagaagagagcacctctttcccacggctctaacaggaatccagggc

SEQ ID NO: 112853 - DNA, 465 bp, Homo sapiens
gggaggcctctgggagaagaatgaaagggcaggctgttcaggaacctgaaggcagcctggatacctcagcatgggtgttgttagggaggcgctcctcagaactgccaggataggcactggacaagttatgacaaccaggtggcccccagcaaggggcctcccttctctgatcctcagtctacccctggacaacaggcctggcaatctacttcacagcatcaggcggagctgatgaaacggccccaagcccggggttaggcacacagtcttcgctcagtagagtaggtattattgttatcattgttattattgaaagtgcttaagggcctgggatctggagccgcacagtctgagttcaaatcctggctcttgacagctcggtgtggtgacccaagcctgtaatcccagcactttgggaggccaaggtaggaggaccacctgaggtcaggagttgaagaccagcct

SEQ ID NO: 112854 - DNA, 222 bp, Homo sapiens
tgggcaccggggcaggggtgaggcagcaggtgagaggctggcgcctggcttgaatagactgctcagagccacagccagtggctcctctgttttatgggtggttttaatgcacagatgggttggttttaaaggggctctaaatcatggcacagtgagagcccccacaccccagagccccctaggaggctgtatctgtgagtgactgtggtatgggcacaagtg

SEQ ID NO: 112855 - DNA, 396 bp, Homo sapiens
accagaggatcccggtctagcctcgccaagtgaattacatgccagagagaattcaaatctctgtcagcctgccttgtgaattacatgccagggagaattcaaatctctctcagcatgagaacaccagtggggttggctggaggccccgcttgggaggtccctcactgggcaggacctcaagacctccacactagggagaattcaaatctctgtcagccccagaacactggcgggggtggctgcaggcccccgttgggaggtccctcactgggcaggaccccgatacctcgatgccagggagaattgaaatctctgtcagccccagaatattggcgggggtggggggagttggctggaggcctgagttggaaggaccctcactgggcaggaaccgga

SEQ ID NO: 112856 - DNA, 203 bp, Homo sapiens
tacattaatagaagcttaacactcaaagttttaatttttattttttgctgttgttgaactgaactgttagactgaacaccaggtatgttgaattttaacattaccatttatttcctagtagtttactcattttgtttgccagcagatgacatcttgttagccaacaagtagcagcagatgtcaaagtttagaaaataatattt

SEQ ID NO: 112857 - DNA, 690 bp, Homo sapiens
tttagatgtttccttgattaaagatggctggtttttttttttcatgtgttgggtaaaggatatgtttaatgtttacagattaaattggtagacttaattcaaactaacaataatgtagcttatggttcatggaagcatatcatttttagtgaataatttttactaggttacaagtattctgatggttagcatggtaggataaagaaaaacaattctaatagtagtgagagcagaattctacgaggtgatcagttaatgctcagggcattgaggataggttaggctttagtaatacagtgttaaagacctaaaaacataaaatatggcataggattaaagttaagtaagatgagagactttgtctatctggtattatcttctagttaaccagatcagaattgaaattttttctctcttgatacataaatgagagaaacattcctccttcgttaacatccaatttattatagatacagtaactgtttttgtgaatcaaggtttggtttacaccaaattttagtttaaggatatttatgttcatttatgaatagtgaaaaatcttgaggccgggtgcagtggctcacggctgtaatcccagtactttgggaggctgaggcaggcagatcacttgagatcaggagttcgagaacctggccaacatggtgaaactcccgtctctactaaaagtac

SEQ ID NO: 112858 - DNA, 340 bp, Homo sapiens
atagaactgagagatgaaataggcaattcaatatttagaagagttggagattttaatactcttctctcaacagttgataggataagtaaacagaaaacaggatacagaagacaggaataaagcaatcagccaactcaatctaattgacatctgcagaatacccaacaacagtagaaaacacattattctaaagtgcattggtaacattagccagggtgaatagtatactggcccacaaaaatgaaatgttttaataaatatggaagaattgaaattatatggtatgttttgcaactacaaaggaattaaaaatcatggagagaaataaggaagaaataag

SEQ ID NO: 112859 - DNA, 125 bp, Homo sapiens
gcagaaggggaaaagatttgttaatcttctacccatactgggcctcccagaggttttcttcctgctttaagcagtcatgagaggttcagcttttgcaactaagtatcctgactggtagtgctgct

SEQ ID NO: 112860 - DNA, 325 bp, Homo sapiens
ggtcgaccatgaatcttaactggaaagagaacagtaaaagatatttggggtgaaaattggaacaactaaaatatcaccatatgttagattatattgtggtattatggttaactttttatggtgttataatggtatataggaaatatttttatttttagaagattcatgtactgcattctgagtaggtttctttcatccatttgaatctagaacatttcccttgcctcctttcccccttaattttgctattaatgacactgacttttgatgtgagtccaggttagtcatagattgtctcacatttgggatttgtctgattgtttcc

SEQ ID NO: 112861 - DNA, 207 bp, Homo sapiens
tttaatctttttttttacctttaaactttttattttgaaatagttttagacatacagaggagttataaactcagcacagagttcctatatataccacattcagctatccctaatgttagcatcttataaatacacagcacaatggccaaaactatgaaaccaacattggtaacacactattaacaaaatgcagactttgttcagatc

SEQ ID NO: 112862 - DNA, 635 bp, Homo sapiens
gacggggttttgccacgttggtcaggctggtctcgaactcctgacctcaggtgattcacccaccttgaccttccaaagtgctgggattgcaggcttgagccactgcccccagccagaagtaattacttttaaaactatataaagacactaccgaaggcaagacatgaattctagatgagcaactactggaaggagggacaaaaagcatttcctagaggccagacactcagacatctcatccccacagtagctctcatctcaggaaacagctttgtcttcaggggaggagaaataccaggggcagggcactactgaaattcaggtctgtccagcttcaaaactcatgctcttgaccccctccgtacttctgtttcaggatgtaactgctctggcccaaagttttctcatctgtaaaatgtgggtaataataactttccccttacaattgtcgtgaaaagtaagtaactcctaaaaattgtcttgctcagtgccagacccagagttagtgcttcatatgcagtagctatttcatttgtattaaactatactgtcatggtttggcatacataaaaagaaaaaacagcacacatcatactgttttgaagactcagtaaatgacaacagccagaatattt

SEQ ID NO: 112863 - DNA, 214 bp, Homo sapiens
ataaggcaggttggacaagtttgctagagtctgtgtgacatttaaatatcttcgttaacccagctgtttaaggtatatgctcattgcttttcagaaattttgaattttaaaaatatctgaaaatggttgagtgctgaaagttaacagtgcaggcagttatcattgagaacacctgactttcacacattttaacaccactaacattggctagtcc

SEQ ID NO: 112864 - DNA, 185 bp, Homo sapiens
ttcgagaggctgaggtggaaggattgcttgagctagggagtttgaggctgccatgagctatgatcgcgcctctgcacaccagcctgggttacggagtgagactgtctcaataaataaataaaactgtcacagtaatttttttgtggtaaaatatatgtaacacagaatttaccattttaatcatt

SEQ ID NO: 112865 - DNA, 365 bp, Homo sapiens
gaagaaagcaaatatcaaagttgcttctaaacatcactgattttgctagctctatcacttcatttttttctatcaagtttttaagataaccttgtgtgactcaggccattccttgtttgcacgttcaccatcaatacaagtcagccaagacgagtgtcgctagagcttccagtgtctttcacattctagccctcttcaaccacaaattataaaaacgtggctctgctcaagcacacgttttaaattaaacctttttgttttttacatgaattttttaggtctttttttcaggttattattttctgagacagtccaataaaaatttattttaaaatgtatttgtggtaatttgatgacagcctcaa

SEQ ID NO: 112866 - DNA, 287 bp, Homo sapiens
gagtaagagggcctacactttatcattttaatgctaagtagtaatggagtgggaataaagtatccaaattgagagataattaatagtcagttttggataattgtttactcaatcagcagataatgaaggagcataccagtttccttcccataggccagggaggatatgctggtggataataggacagggcttttgctctcccagagctctctaacgggataagcccgagataggctacactagttgaataggaaagataggatcttggtagaaagagactctatcga

SEQ ID NO: 112867 - DNA, 644 bp, Homo sapiens
ggggattctcctgatggaggtgctcgttctggctgtgaagcagctgttcccagagtttgagtttatgtggcttgtggatgaagccaagaagaacctgcctttggagctggatttcctcaatgaagggaggaatgctgagaaggtgtcccagatgctcaggcattttgacttcttgaaggtcccccgaatccactgggacctgtccacggagcgggtcctcctgatggagtttgcggatggcgggcaggtcaatgacagagactacatggagaggaacaagatcgacgtcaatgagatctcacgccacctgggcaagatgtatagtgagatgatcttcgtcaatggcttcgtgcactgcgatccccaccccggcaatgtactggtgcggaagcaccccggcacgggaaaggcggagattgtcctgttggaccatgggctttaccagatgctcacggaagaattccgcctgaattactgccacctctggcagtctctgatctggactgacatgaagagagtgaaggagtacagccagcgactgggagccggggatctctaccccttgtttgcctgcatgctgacggcgcgatcgtgggactcggtcaacagaggcatcagccaagctcccgtcactgccactgagg

SEQ ID NO: 112868 - DNA, 402 bp, Homo sapiens
catgtggaagggaaagatgggcgtataggctggcagacctgtccccgggttgcactgcctgggtggcatgtttttatgaggaaaaacaagagaggtcttgttaatttgtttgtttttattcctttctccttagcctctccactttcaaacagtgttgtttttccagaaaaattagttatgtggtaatggaaagaattactgtgtttggattaactagaggctgcccggaatgatgaggtacaaaagtgacaggctatggtatgatctcattgacagcattttctccagctcaactgcctttctacaaacaaacacatgtaggaaatggttcccagcagaagttcttagcaggtgtttgcagagctgttgaaaagttgttgcagtgattggtgctggaaggag

SEQ ID NO: 112869 - DNA, 716 bp, Homo sapiens
ggctagtctctgttccggagattctgatttgataggtcccaaatgagtcctgtattttttaaaagcttcgcaagtgcattaaactaccaacttatgagatgtgggcaagatacagtcaaaggcaagttcataattttgtaatatttcttcataaaagaagaatgaataaaaataaatgaaataggcaataaccttaaaaagttatgaagagaacaataaaagaaaatgtatagactgaaataaaaatgaagacgagtaaaattcagtaacttagagaactaaaaacaaatagaaggaaaaattcaatccaggaagcagctcttaaactaacaagacatgagcttctgataaatatatgaacaaaaatatatgccaagatatctgaaaatctggatgaaatagacaatttatgtgaaagcagttatgagcattgactcaaaaacttcagaaatatcagatatagtctattaactcaaatatttatcaagtacttactatatatcaggcactgacctaggcagagggtccagcactggacaaattaggcaaaaatctcagccattgtggcatttactttctgtgaacctaagtctgacagcccacatacagagggcaataacccaatcacatatattgggttggaaaaatgtaagcacaagaccaggaaactatattcaaaagtaccttagaatgactactcatccacactcattcca

SEQ ID NO: 112870 - DNA, 261 bp, Homo sapiens
catggatccaaggtttagcacagaggcgttgatgcacatcagtgtggctttccagaactccactttccctagccttgctttggggtgaagatgaggccctggggtgcctgcctcatagccacatccactgctccttgctgggcagcaaggagctcaggcaagcaggctgggtcctgaggtacgcgtggtaattcgtctgaaccgattaagggaatctctcctctttgcagatgaagagtagtgggatggggcatctttcct

SEQ ID NO: 112871 - DNA, 299 bp, Homo sapiens
tatcagtcaaatattactaaattaattattaggagcctcatttaacacattttataacatctaaaatctaccaatacatctgaaaaatggagaaaaattataaacaaaaataaatagaacattttctgtaatcatatttaatagctacattgtttacattttattgtatctacatttgtgatactagagattatattagatattaatatctagaatactagatattagaaatatcccatacatctagttttaattgaagtatagttcatttgaagcatagtctcaataatttgaacttg

SEQ ID NO: 112872 - DNA, 489 bp, Homo sapiens
ccacagctgatgctctctggaaagcaccacctcctggcaggaggtcaaccagcacaaaaatagaacattaaaccaccaaggctaagaaccctcacagagtccattgcaccccccacccccagccacctccacctgaacagccactagcatcgacagctgagagactcatagacagttcacatcacaggactctgtgcagacaatccccagtatgagcccagagccaggtagactcaatgggtggctagacccagaagagagagagcaatcattgtggtttggctcacaggaagccacacccataggaaaagatgaagagtactacatcaagggaatatcctatgggataaaagaatctgaacaacagcctatagctctagaccttccctctgacagagtctactcaaatgagaaggaagcagaaaaccaaccctggtaatatgacaaaacaaggctcttcaacagccccccaaaatcacactagtccac

SEQ ID NO: 112873 - DNA, 514 bp, Homo sapiens
ggcaggaatgtctggtttgcccaaggcacagaaaggaggcttggctggatcagaatgagtaagagggagaagagtagaagatgaagtcagatgtgacagggagtttgattatgtagagctttagaggccgctgagaggacattgacttcactatgagtggaaagctattgaatggttataacgacataatctgacacttgcatttaacatgagaccatgctggcttctgtgtttaggtttgatcttggccaggcaaaggcaagagggggtagaccatttaggaggcttttagcagtaatttaggtgagctttggtggtcatatggactaggatcataggagtggagatgatgagaggtggtcagattctggttttattttgatgttaaaggccacagcattggatatgagggagaaggtgagtagtagagggtggcaccagggcttttgtcttgggcacctgtgagatatatttgctatctacaaagatgggaagactgcaggatagatggatt

SEQ ID NO: 112874 - DNA, 303 bp, Homo sapiens
cacagtttggattcccttctgcagccagtatgaagttatgtgtgatggtgagattgtgccacttgaaggaccagactggcctgaaaattagtgtcatcttaggagttcaggtggtaaaggtagatgttgaggtcaaaatacagaactttgctttcaggcaggggtgagctggtgagggtttgtcaggaggagtgatgtgaaagcagtgtgtctgtgtcaagttggaagcaacaagggctgaacccgagtcttggcggtgagaatgaaaagagagggctgcattggcaaatcagtagaatggga

SEQ ID NO: 112875 - DNA, 816 bp, Homo sapiens
tggcaactgatttatcaagcctgagaatacagaagacttaaacaatataatgggaagtttgatctcatcaagatttacaacacattatacgcaacagcttcacaatacacattctttcagactcatgcagaatacgtaggagaactgatgacatggggtcagaaagcaagtctcagcaaattttaagagactggtatcaaatatatatttgtttactacaaagcaattaaattagaaatcaatagactaaaggtaactggaagaacccatgtgtgtaggcactaggaatttatacttctaaataactctcagaaacaatattgggaattgagaaatactcgtaagtaaataacagaaacgctacctatcgaaacctgtgggatgcagctcaaacatcactgaaatgcctgtgacattaggcaagaaggctgaaatttaatgaaccaagcatctaacttaagttaggaaaaacccaaaagaataaatacaaaatcaacaagaaaaaaaaaaaaaagaagcaaaaaaactttggtggggggcttgggccttggaaaggtttttagaagccatttggttgggggcacgggccccactgttagtgtacacagtgaacacgtttgccaaagcggggtccaagggggaaaaccgggggcaacgaaacaaagggcgggggagttctcccgccccatttaaaaaagcgccgcgggggaaaccgcgagacgttttcgtgaaacaaattcccgaaagggaagatacaggaagacacctaagggggactcatcaacagggggatccaagacgaagccgaatctcatc

SEQ ID NO: 112876 - DNA, 671 bp, Homo sapiens
gttttttgtagtgacgggtctcactatgttgcccaggctggtcttgtactcttgggctcattcattcctcccaccttggcctctcaaagtgttgggattgcaggtgtagccattgcacctggcctgtttccactttttattagctcagagtggttgagtggtgatggagacaatgaatttcagctgtccagaaagagattgaaaacacctacctgccctaaaagctgtgttgcagtttctagaggctcgtggagcccctactactgctttcagtccaccccgatggcccatgggtcagcatggtctgttgggagcagacctacatcttaagtttcataaatgcccgatttctaaaaacaccaactgaaagcagaaagagtaatttcacctaatgtcctgccagatctcagcagatcactgcagctggggaactgggtcccgctttactgaggggaccttcgtgtagttggtgcggaggtgcctggatttggttagcacgcttcagggtggtgtctgaaccctttacacgcctgctaacagcactgccttgttgaggtgtgaactgtctagctgagtggaggccagagccaggggacctctcaggagtctgtggacctctcaggagtctgtggacggggaacacggggctggaaggggccgaggtggaaaag

SEQ ID NO: 112877 - DNA, 313 bp, Homo sapiens
gtggtgggtgtgtgtagtcccagctacttgggaggctgaggcaggagaatggcgtgaacccaggaggtggagcttgcagtgagccgagatcatgccactgcactccagcctggcgacatagacccctgtgcccagccagctgcctagaaatttctggacttcaaccacactgtaattttttttttttaatcagtttcttctatttccttgaactcagtttccaggaacttctggtttggaaattagagacctgccttccaggttagtctacagaaagtctagttgtgttccactgtgtcttcattgtcctgca

SEQ ID NO: 112878 - DNA, 249 bp, Homo sapiens
tgtagctcaaggtgaaataagggaatgtccagtactgacttctgaaagaaatttcctcccttaaaaaaacaaaaaacaataagaaaaacttgtgaagagaaggcctcttttatgtattttttgtttcttgtttgtttgttgttgttgttgttgttgtttttgagacaaaagtttcactgtcgcccaggctgcagtgcagtggcgcgatctcggctcactgcaacctctgcctctctggttcaagtgatt

SEQ ID NO: 112879 - DNA, 303 bp, Homo sapiens
aacagatgcctacaccttattatctccagagattcttctagggcatctgtacttttgggaaagatccctaggtggataggaaaatggactagaactagaagactttatcatctctagatctcttctaaaaattatctcatgagtctgacactttcaagtcctatacagaatggtagtcgggccagtaatatgcccttcaagcttaatatctggcctccaggttgtcagaatattataatgcattgtaaaatgaatcttgagcatctgtttatgtatttccctgagcaggtcaagtgggatcaa

SEQ ID NO: 112880 - DNA, 390 bp, Homo sapiens
tctaagatttaataaatacgtttatttataaaattaaaactatgggttactataaatgagtttagaggattttgaggcatataaataagttccaggagcatttcgagaaattcatgatgcaaggtctccatctaacaagtagagcagttggtgcagatgagatgagcctgatcgccaaccagcctggaggaaccatgagctctctctgcactccttgtcttcgcctttgcatggttctttaccggttatccaggcctatcatgcccagtatttccttccatcctgaccacatccctgcgtgggaagtaggtcacatcaatggtaaatatgctgtcgttatgcagatgtagaaaccgaggctcagagaggtgaagtgacttacccaaggtc

SEQ ID NO: 112881 - DNA, 225 bp, Homo sapiens
atgaataaatggatgaatgaataaatgcacatgtgtgttaggtacctggctaagatcagactgcatattgcctaaagaattctttttctcaacttgaaaatttttagccaatgtgaaaattatgtttgcgactgtcacttcatcattgccaggttcaaacactgcagtgaattttttttttttaaccaaaaggccactctctaaccacctgaggaaaagcaacta

SEQ ID NO: 112882 - DNA, 364 bp, Homo sapiens
  misc_feature (364)..(364): n is a, c, g, or t
gcacttaggattgagcggggacacagcagtgccggctcctggcccccacgggcctgactcagcttgtcctcccctggtcggccgtgctgccttctggttcctctgcgctccaagcttctgcccatctccagacctttgcccctgctgtttcctctgcttgacagtccctcccacctgcacatgcgcatgcacgcacacacacacacacgtgtcacacacttggccgggacgtattgagtgtatttgggttgcaagcaacagaaacaggccctggctaattgaaggggggataacaaaggatgactcaccaagtaggagactttgaattttgatgtgggatgatgaggtgaacatggcaggcagn

SEQ ID NO: 112883 - DNA, 219 bp, Homo sapiens
aagaaggaatgcttgtgaaaagcctgtgaggagagggagagggagaggggctgaggggctgaggatgccctgcgtgtacctggaaatgggacctccccagaggctgtgggtttgcagccacgcctcatttcctcttggaaggggccctaccactaagctgcggggcccactttgccgcctctaaaacgtgccagtggctgggtttgcagtaaggaacag

SEQ ID NO: 112884 - DNA, 1313 bp, Homo sapiens
taaaattgtataaatccatagagcaccatattgataagctttatgagaagaacttatctatttacataatttattctcctgttattagtctactgtggataataattttaaaattactatattcccttagggatattttaactgtaagataattttcatagttgattatattaagtatagaatctttaaaagcttttctgattttattcagccatgtgccatttgcttaaagattccctagaaacatacacttcaatgtatatatagaaaataactgtgaatacttaatatgtggtattataagccagttatgccttgggcatttagattttcatgcttggattttcattagtaacctgtagtataactgtatcctttcttgaaccatgaatttaagtgcccacattactggatagtagagatgcccatattaagtaaacatcagtctaaggaaatatttaaagtgatgatttttcttcagcttctgttttctgacttaaagtttgtgggacataaactgtagagctttttaaactggccaagaaaaaatattattggcagaaagtttggtatatggattctacataggctaaggtaaataacttatggtctttttaaaatacattactggcattttacaatcagtcaccatttctgtatagaaacattcttttctcaacaaatgtacgttgacaaccctgttatattttaatatataactctggctatctgggttaaaatgatactccaaagcctaatgactatagtaaaactgatgtgacacatttagcttctaaggtagatgttggccctcccttacatggagatcaccttacctatctaaaatgatcatcagatgctttattaagactctttaatgactagatttcatttatttaaaatataaacatgtcattttgccctaaattcaacaaaataaattcaacaaagccttgaataatagtaaacaatgattattttttcttatgagaaaaactagttttgtaattgaataattttaaatcaggaagaatccagctttccccaaggttttgtctttagtgttattttttcagtgttagagagcttctggttgtttctttatattaatagacgcaggccaaccataaaaatctttgacaatattctgtctctatctttggatgtaaaaggacattaaatagtaatacgtacagttggacccacagttgcatgagttcaaactactagttttgtataacactgtgtacatagtcagactgtttcaacttttgtggtatttagcttcacaattataacctttaactgcatgc

SEQ ID NO: 112885 - DNA, 543 bp, Homo sapiens
tgcttataataaatctgttgttgggcatggtggctcatgcccgcaatcccagcccgcaatcccagcactttgggaggctgagacgggtggatcacctgaggtcaggagttcgagaccagcctggccaacatggtgaaaccccgtctctactaaaaatacaaaaattagccaagtgtggtggcgggtgcctgtaatcccagctactcaggaggctgaggcaggagaatcctttgaacccgggaggcggaggttgcagtgagccaagattgtaccattgcactccagcctgggtggctgggtgacacagtgaaactccgtttcaaaaaaataaaaaataaaaataaataaatctgtcacctgttaacataaatgacattgtatggaaaatgatgtttccaatacaaaaaaaaaaaaaagtgagagagatagcattattttagatatttgcaaatctctttaatgtctgcttagtaagaaacagctggattctcatatttgcttctgcgttcactctgttacaataatgtaaagaaattctggact

SEQ ID NO: 112886 - DNA, 496 bp, Homo sapiens
taaattagcccagggcagtagcacatgcctgtagtcccaactactcaggaggctgaggcaagaaagatggcttgagcccaggagttcgaggctgcagtgaaccatgatcacaacagtgcactccagtctaggtgacacagtgagaagatcctgtctctaaacaaacaacaacaacaacaacaaaacaattgactgtatttgtgagggtttaattctggactctttttcaccaatctacgtggttaccgtcttgtgtcacaccatcttgtgtcacagtatctcaattcttgtacctttacagtaaatcttaaaatcaagtaagatgagtcttccaattttttgtttcaaagctactttgccttttcatctaaattttacaacaatcttgtctatatctacaaaaggtcttgcttgggagttgacttagaattcactaatactatagatatactagggagatttgaaatcataactagggatgagtcttctaatccat

SEQ ID NO: 112887 - DNA, 222 bp, Homo sapiens
ggaggcagaggtgttgactcctggatgttattcttgggctgcggaagggagacagtgctggaattcttcttctgtcattgttaattgagcctctccgcttgcagagagaatcttaccccactcctctcctgacttccctcttcactttcccctctgactaacccttacctgcatagagccaagacagccggccaggacctgtggccagggttgggtagggaa

SEQ ID NO: 112888 - DNA, 384 bp, Homo sapiens
ttattgttgttggcaagattcagtttcttgcagttctaagactgatgtccctgttttcttcatggccattagccaggagccactctcaggtcctagaggccacctgtcttccttgacatgtggttcctccattttcaagccaacaacagtgcctctaacccttctcatgcttcacacttttctgatgtccccttctgcaaccataaagaaaacactctgcttttaaagggctcatgtgactcatgtgactagatcaggcccacccagacaatcgctcttacagtcaactatgccatatattataaccttctcacataagtaaaatttatcacattcacagtcccatggaatatgcagcgtatactagggagatatatactagag

SEQ ID NO: 112889 - DNA, 836 bp, Homo sapiens
ggatgttttcaatcctgtcccagttgctttaaagaaaattggaacataaatgttaaaaaacatattgaaacaacactcgatggtgtttccaagcagagttaccaagtggtttcattacattgatatgtattgcaagaggaatcccttgttacagagagcatccagaaaaaaaaaaatatgtgtgagttatgggccttaaatgcctacgctggatcctcatgggaaaacatgccctacttagtacaggcggctctcttttttgaaggctttctgagcttagaaagcgtgggatttggcctcaatattttttatatggaatgtgagaaaccgttagtacttaaaacattgatgtcggtagatttgaccttgtggtttcaagaattttcaagcaacctgaaatttcagggtagtcggtagtttgtacttttgttgagacaggatatttaatctgaatgtgctgtgaagctggctttgggtaggagtcacttaatccagtgtggctactctgtcattctcatattattccatcatccttcacctaggaactcttatgaagtgatagtagtggacaggccatttgtccacagtgattgcaccatccccagttttctcccatcctcttaataattcttgatattcattcaagtttctccttccacttccccattacagctcaagtgggcattgattggactaggtccaagcatttggtttagaagtgagccagtgacttaaaaataatgcaatcaaagcagccttaaaggacctatgtattggttagatattgctgtgtaacaaaccactccaaaactcagttgctttaaacaataaacatt

SEQ ID NO: 112890 - DNA, 192 bp, Homo sapiens
actgttctaggtattggagattcaggatgagcctgatgaggagagttcctgccctcaagcggttcattttcttgggaaggaggagagcagtaaacaagcatttggtgtcctaactgcttcaaagggcaaatgaggcagggtaggtgagagaaggtcaaataggtggtgaggatggagtgagctgggctgagg

SEQ ID NO: 112891 - DNA, 462 bp, Homo sapiens
  misc_feature (39)..(39): n is a, c, g, or t
ctcagatcactcctaccaactccctgctttaagcagatngaccatacttactttcttgagaaaaataaaatcatcagaacagagtctacttttctacccaataaaaatctcacacactcttcttcctttctcttataatagaagacctgtttttcccttctgaagtcagtccttccatctgtgctttgaagccattctcctcctaccttctgatgaacattgtactatcaataattcatttttcttgaatatttatcctttccctctcaaataatatttttaaataagcttgtctctccaaagtttaaataaccttgcctcaaaatctccaggcttcatgccattttgctcgccttcacaaatttcctggaggagttgtctataaactcttgatctccattccttacctcttgttcaatccataaccacttgatctggttttattcttcattacttgataag

SEQ ID NO: 112892 - DNA, 300 bp, Homo sapiens
gtgatgagatgttgaaatcctgccatagagtttcacattcgtccatagttaatttcatggtaattttttttaaagacacaggtgaagggaagagtgggaaaggaaagagggagaatgtgatcatcgtgtgactgaaaatcaggttatcaaatggataaattaggaggtaccatttgaatttcacaggcatctttcactttagaaatagattaaccacataataacaactgtagtgtagagtattaactacttaacaaaagaggattgagggtggaagtttaactgttatttcaatgtcca

SEQ ID NO: 112893 - DNA, 408 bp, Homo sapiens
tttgccaaggtcctctgtagcccaccccgccagcatctgtgagtcggcggctgggtagtgctgccggcctgcaacgggccggaaattaaaaaaaggcccaggagccagtttcctgaggggagataaagagctggggttcgttctaggcggagcagtgcttggtagagctagacattgaacttggagccacagtctctgagcattccctccgtccctgggaacgtttcctttcttttgttccctaagggctagagaggacattaactttataaaactggagtggaagtgggcacaaaagaacagtcagaggacttcagacctctcctcatctcttaagctagtgacaccaccattcaccagataaggggtcggttaatggctttctttcctaccctactcccaggtgca

SEQ ID NO: 112894 - DNA, 460 bp, Homo sapiens
aaattattttcacaaggatgtgatcaagatcaaacctttcttattttaaaagacttccaaaattcccatagtctgtctccaattattgcattatcttttttcccttcacagctacttttaagaatttcttacctcctttttattcctgaccctacttttatctgtttgcagcctgagattatcagtgactttcattttgctaaatcccgttgaattttttcagtacttgcctaacttggctcttgagtagcactaaatatttaattatttcatttttcttatattttcttcctttggtttccatgtcattgtactctggtggttttctgtcttctgtatgggtgccctttcggtcttctttgcagacttgtctgtctctgtctgaacgtagaatcttgggatttcttaagatgccattcttagaacaacacagatgagtaattaaatgatatactttttt

SEQ ID NO: 112895 - DNA, 883 bp, Homo sapiens
cagtgccgaaaaatcacaatgatttgagttcttcaaaaacctttgattggctgcattggctctgttctgcatattactagacttcttacatgatcacaagtaaccactaattggttaaaaccaaagagagagagagagagagtgtgtgtgtgtgtgtgtgtgtttggttggggggtgttgtgttagcttccaggtgaatgcattatctgttaatcctgtttattgatctgtttttataagtgctccatgattctctgaaaacagtatactatgtatctaatttttggatacaggatggacatacgtactcaaactgtgtttttcaatttgtactgtatttgtttctctcgacctgacttagtgatagaggtatattaaagtcttccactagcatggtagattaacaattctttctgtaattctgtcatttttactttatatatgtttatgtgtaatgtaactaggtgcgtagaggtttagatattctcctgtgaatttatttattttcagtaggggccataccttttcataccaaataattgtaatatgaaaatatattaacaaaaagagatcaaacatttcgctagcccatcctatagaccaggcgctcttcaaagtgccttataaatattaactgcgtcctcactataagcttgcaaactgtgctattactgtctccaacttacagatgggaaaactggcatggaaatgtctaggttgcttgcctgagttcaccagctagtaagtggtagagcacagattggaatccagacaggtgattctcataaccactagcctgttcattgagtacattccatgtggctaagcactgtttgagatgccatgtctagagcagtgaatgaaactcaagttttgccattga

SEQ ID NO: 112896 - DNA, 252 bp, Homo sapiens
aaaaaaaaaaaaaagccatagaaaatcttgacaaaatatatttctttgatttagaaacaaaatggcaagtttgtttgtggttgaaccggaatatttcttcaaatttggggtcaggtgccagttaaggcaaataaatgccttttaggtatctgaagggcccctttctggcttgaatgttatgtaatacagttctgtagtgttacaggtgctatattttgttgattagtattctgcagtaggaggcttggtatg

SEQ ID NO: 112897 - DNA, 379 bp, Homo sapiens
actggttttcaaactgccccccagagccccagagtgacgggcaagatgaaacacaggggggacccctcaataccccaccttcaaattataacagcacatgttccagcaacgccacttctgggtatatatgcaaaataattgaaagctgggtctcaaaaacatatttgtacacccatgtttacagaattattcaccatagccgagagttggaagcaacccaaatgcccatctacagatgaatagatcaacaaaatatgatatatacacacagtggaacattattcagtcttgaaaaaggaaggaaattctgacacgttacaacacgaatgaaccttgaaaagttgtgaaataagccagtcacaaaaagataaaatgctgt

SEQ ID NO: 112898 - DNA, 409 bp, Homo sapiens
tttttccagaacaagggttgggttggagagttaaagcatgcagtgttccttctttgactaccacttcccattgttttaccgaagaaaaataaaagaagccttagtccatattacaatgattctatttagatttttcctgaaacttttgagtcacttaaaccaaactgattgttcctgttcccaagaagtctgaatcccatcatgagtgtatatacacttatcagagtttagaagagggtgggctgaacacacaatatgtccgggaaaatgggccctgactgagtagttagaagtggcacggatttgtgtcaatggtggctccgtcatgactggttgttttgctttggctaagccaataacccactctgtgctcctgtataatcacctgtgaaacgaacataaactttga

SEQ ID NO: 112899 - DNA, 801 bp, Homo sapiens
gaaattgccaagaactagtaaatggagaagtcagggccccttgccttagagagggtaagggatgtccccaagtcacaccccggcagttgggagtggggaactcagcactggagccgcctccctctggaggagggatcctttgccttccctgagaaggacccttgctgcaaacacgagtggatatgagccaggggcacggccaggctgcctctgccaccctctctccccagcccagggtagacaggtcacaccaaccccaggctgtgcctcaattcacagtgccggggaggcaggggacaggcacttctggagccccctgcctggtgtgcacctttgctgtgccctgcgcgggctgggaggccttgggcaaaggtgttcatcttacagtgcctcagtttcctcccctgtgaaataggggaatgatggtgccacatcagaggctagttcccaggttgttagtcccgagggcttaggagaggccccgctgacgggaagcgctgcctgcaggttgggtctcattgtcttttgtcatcctctgcaggacaaggtgctggctggcactctgaggcaggaattggacaggtgtgggctcctgtcaggctctgaaacttccccagtgccttgctgggggtcagcggggcaatatccccctgactctccttatctgggagtaggtcctgatgactgccgcctcccaggggtgctgggggtccctaagagtgctgcaacaagcttgtgtccaggcctggaaagcgcccagctgctactgaggccagggctgcagccaggctgcccctcccc

SEQ ID NO: 112900 - DNA, 234 bp, Homo sapiens
tctctgaaggcaatgtgttttgccatagccagttcacatgacaaacaataacatgtctaggcaaaatgcatgtcttggaagcaccagagaaaatactaacttaagatttccattatatgataaaaatttgttgagtatctcgtatgtgacagacattttgctaagggctagggacacaaagatgcaaaaggcagaagtctctgacataatggtgagggcaacagtttagaagtg

SEQ ID NO: 112901 - DNA, 544 bp, Homo sapiens
agtgatccgcccacctcagcttcccaaagtgctgggattacaggtgtgagccaccatgcccagctttccgctcctttttatgacagccatgggaacaccctcatgctggtctagcattttgaggaattcattcacaggaaccccaagtaggttctgctgtcaggtacatggtgaggatgtaatgattgggcctactaggtcagtaggcaagttttggagactcttctgtttaaggaaatgcaactccaaagtcatgatagaccctagaaagtttaaagccagtggaattaaagctgtcatgttccctgagtttgggggtcacattactattagtataaactttgccttaaatggcttgtcaagtcttagccatgcctatgatgttttcttctgcaacataattcctcattaggttcctctcttttaaagagaaatagtggacccaattctcttgggtctttacaacatagtcttactcctgcagggagcaaagctttctttctctagctggccctgtaaggagcagtgagagtccttgcccacc

SEQ ID NO: 112902 - DNA, 748 bp, Homo sapiens
gaaaggaaaggcacttcctcaccgctaatgggtcttgcattaaataccatcaagacatcaacaggctattatcctcagtgttcctcccatgagaattagtggtcagacattgcagagggcatcagaagcgggtagatgaaatagcgaaaggaaacaggctagcagaccaaagagctaagtcagcagtaagaaggccccaaggtcccaaaacacttgaggcccctctgatttgggagggctacataagggaaataaagcctcagtattcccctacagagatagaatgggccacctctcgaggtatacttttcaaccctcaggatggttacaatcagaagattgcaaagtacgcttgccagcctccagccaatggaagattcttaaaatcctccactgagcctttcacttaggaaagcataagacatcagtgcatccaaagattgttctcaggagaaaatctactaaaaatggtcaaataggttgttaatactcgtgaaaccctcttaaaaataatccctttaacagatgacttcttccccaccacaatcaaaggatgggaagttactcaggggaggactggcagatagacttcacccatatgcccaaaataaatggcattcaatgtcttttggtgtgggtgcataccttcattaactgggtagaggcattcccatgcccaacagaaaaggcctctgaggtggtgagaatactaattagttaaataattcctcactttgggctccctaag

SEQ ID NO: 112903 - DNA, 144 bp, Homo sapiens
actcaattgtggtaatcatttcacaatgtatgtgtatatcaaaacatcacatcatacaccttatacatatgtacaatttaatttgtcaactatacctcaataaaactgaaacacatatacatgtgcatgcgcgcacacacacac

SEQ ID NO: 112904 - DNA, 434 bp, Homo sapiens
agctagaaacaatatagtaagaatatttaagctgggatggagtgggcagggtcctggcgcctgcctggcatttagccctggctccagcccagccaacccagcaaacagggccttgacttcctcttcctgggtgggaatgaaccccagatcaattcagtcagcctttcttgggactagtaaccatagtaacataaacaataacaaaaacaacaatagaagctaccatttattcttaaatatgccggcagttatactagtcactttacatgcatttcctcacctaatctttacaattgccttgcaaaatgcaggctgttattatttccattttgaaaatgaggagactgaggctcagagaggttaaataatctgctcttggccacacaacagctaagcagtggagtccggatctgaacccagccctctggctgaga

SEQ ID NO: 112905 - DNA, 445 bp, Homo sapiens
gccttgcacagagggatctggctatggcagcctctctggaggcttcacctgccataaagatgtttgctccacactactaaaccgtctccttctcttgtatacttctcaatgtcttctgcctctgtcctacacgtgggctgacatgctaccaaaacttctttcttcctggctcttccccccagcctccccatgttttgtttgtttgtttgtttgttttttagttatccttcaaaccttggctcaagagtttatctttccaggaaacactcccttgctcaccaattaatttatatgccattacattctctctcccaccgtacagtaggcttttgagggcagaccccttgccttgctaatttatctcttgtgccctcagaatctagcacattgtgtcatacatactagttccaggaaaactgcaaaagactctgaaaggagcaaaatg

SEQ ID NO: 112906 - DNA, 477 bp, Homo sapiens
gaaaccagagaggtttagaaacctgtagacattgtgcatcccccaatgcctttccccttaaaaaaatattatattctagtccagtccatcaaataaagtctacattcattagaaacatattctcttggtttttataatttcagttttttccagacacagtgcatatgcagatttgttacttttgtacagtgcaccctggtagtgagcatagtacccagtaggtagttattcagcccatgctcccctctctcccccacccccatagcctgcagcatgtcttgttcccatgttaatgttcctgtgtgctcagtgtttaggttccacttataagtgagaatgtgtggtatctggttttcttttccagcactaatttgcttaggattatgtccttagctccatccatgttgctgcaaaggacataatttcattcttttttatggaggcatagtattccatagtgtatatgtaccacatttt

SEQ ID NO: 112907 - DNA, 157 bp, Homo sapiens
tctccggttaccagggactcaactcagatgtcacctcctcagagaggtctgtcccctactgatgcccacctccccttcatgttgccctgttttccttctaaacacagcactgcccactagttggtacttttctggtttatttgcacctcttttttca

SEQ ID NO: 112908 - DNA, 128 bp, Homo sapiens
cagaggtgctcaggcatgactttaaaagacactatctgggccggaaaaacgtagaaatataaaacatttatagcacttgttttaagtgatgtgaatccatatgcccaaagctcttatactctgtcttt

SEQ ID NO: 112909 - DNA, 1818 bp, Homo sapiens
gtcgcgtcggaacgtgactggatggtagtgtgctggccggtctgcctccgggagaaccgagcgcttccggtggtttggctttgaatgacagcaagaactctgtctttaatggcttcattggtagcgtatgatgattcggactcggaggctgagacagagcatgcaggaagttttaatgctaccggccagcagaaagacacttctggtgtggccagaccacctgggcaggattttgcatctggtacactggatgtgcccaaagcaggggcacagcccacaaagcatggctcctgtgaagacccagggggctatcgccttccattggctcagcttgggagaagcgatcggggatcttgccccagccagaggctacagtggcccgggaaggagcctcaagtcaccttccccatcaaagagccttcttgttcttctctgtggacgagccatgttccagccagccacatgcccctggcagctgcccgctttaagcaagtaaaactctccaggaactttcccaagtcatctttccgtgctcaaagtgagtctgaaaccgtaggtaaaaatggcagctcttttcagaagaaaaaatgtgaggactgtgtggtaccctatactcccagaagactaagacagcggcaggcattaagcacggagacaggcaagggtaaagacgtggagccacaggggccccctgcagggcgtgccccagcccctctctacgtgggcccgggagtgtctgagtttattcagccgtatttgaatagccattataaagaaaccacagttccccggaaagtgcttttccacctgagaggccacaggggccctgtcaacaccattcagtggtgtccagtcctttctaagagccacatgcttctctccacttctatggataaaactttcaaggaacccagctatttagtggtcgaagtgactttagaatcactaccttgaaattccatccaaaagaccacaacatctttttatgtggaggcttcagctctgaaatgaaagcttgggatataaggactggcaaggtgatgagaagctacaaggcgaccatccagcagaccttggacatcctgttcctccgggaaggctccgagttcctgagcagcacagacgcttccacccgggactcagctgaccgcaccattattgcctgggatttccggacctctgccaaaatctccaaccagattttccacgagaggttcacctgccccagcctcgccttgcacccgagagagcccgtgttcctggcacagaccaatggcaactacctggcccttttctccactgtgtggccctaccggatgagcagacggcggcgctatgaagggcacaaggtggagggctactcagtgggctgcgagtgctccccaggcggtgacttgctggtgacgggcagcgccgatggccgggtcctgatgtacagcttccgcacagccagccgagcatgcacactgcaggggcacacacaggcctgtgtcggcaccacctatcaccccgtgctgccctccgtcctcgccacctgctcctggggaggggacatgaagatctggcactgagctttttgtcactgaaccttcccgatgccagctgggctcttggactcccctcttcctcaagggtagatgagaggaacgagcacagaggttggctgtgggtcctgggtaccaccttctgagcctcagtttcctcatctgtaaagtggggagaaaagtctgtttgcctcaggagtgtgaggactacactagtgaaagcgcctggcgggcagccggcgatgcccaataaatgtgtgttttgctgtttgtt

SEQ ID NO: 112910 - DNA, 1963 bp, Homo sapiens
gtcgcgtcggaacgtgactggatggtagtgtgctggccggtctgcctccgggagaaccgagcgcttccggtggtttggctttgaatgacagcaagaactctgtctttaatggcttcattggtagcgtatgatgattcggactcggaggctgagacagagcatgcaggaagttttaatgctaccggccagcagaaagacacttctggtgtggccagaccacctgggcaggattttgcatctggtacactggatgtgcccaaagcaggggcacagcccacaaagcatggctcctgtgaagacccagggggctatcgccttccattggctcagcttgggagaagcgatcggggatcttgccccagccagaggctacagtggcccgggaaggagcctcaagtcaccttccccatcaaagagccttcttgttcttctctgtggacgagccatgttccagccagccacatgcccctggcagctgcccgctttaagcaagtaaaactctccaggaactttcccaagtcatctttccgtgctcaaagtgagtctgaaaccgtaggtaaaaatggcagctcttttcagaagaaaaaatgtgaggactgtgtggtaccctatactcccagaagactaagacagcggcaggcattaagcacggagacaggcaagggtaaagacgtggagccacaggggccccctgcagggcgtgccccagcccctctctacgtgggcccgggagtgtctgagtttattcagccgtatttgaatagccattataaagaaaccacagttccccggaaagtgcttttccacctgagaggccacaggggccctgtcaacaccattcagtggtgtccagtcctttctaagagccacatgcttctctccacttctatggataaaactttcaaggtggaacgccgtggactccgggcactgcctgcagacctactccctgcacacagaggcagtgcgggccgccggtgggctccctgtggccggcgcatcctcagtggtggctttgacttcgcgctgcacctaacagaccttgaaacaggaacccagctatttagtggtcgaagtgactttagaatcactaccttgaaattccatccaaaagaccacaacatctttttatgtggaggcttcagctctgaaatgaaagcttgggatataaggactggcaaggtgatgagaagctacaaggcgaccatccagcagaccttggacatcctgttcctccgggaaggctccgagttcctgagcagcacagacgcttccacccgggactcagctgaccgcaccattattgcctgggatttccggacctctgccaaaatctccaaccagattttccacgagaggttcacctgccccagcctcgccttgcacccgagagagcccgtgttcctggcacagaccaatggcaactacctggcccttttctccactgtgtggccctaccggatgagcagacggcggcgctatgaagggcacaaggtggagggctactcagtgggctgcgagtgctccccaggcggtgacttgctggtgacgggcagcgccgatggccgggtcctgatgtacagcttccgcacagccagccgagcatgcacactgcaggggcacacacaggcctgtgtcggcaccacctatcaccccgtgctgccctccgtcctcgccacctgctcctggggaggggacatgaagatctggcactgagctttttgtcactgaaccttcccgatgccagctgggctcttggactcccctcttcctcaagggtagatgagaggaacgagcacagaggttggctgtgggtcctgggtaccaccttctgagcctcagtttcctcatctgtaaagtggggagaaaagtctgtttgcctcaggagtgtgaggactacactagtgaaagcgcctggcgggcagccggcgatgcccaataaatgtgtgttttgctgtttgtt

SEQ ID NO: 112911 - DNA, 2172 bp, Homo sapiens
gtcgcgtcggaacgtgactggatggtagtgtgctggccggtctgcctccgggagaaccgagcgcttccggtgcgtgtggtgagcggcgggccccgggctggaggggccgggactgggcagcgcctaaagcgccccgtgccgcttaacgcggtctctcatagccgctcgccttcctttcacttcctgttccttcagaaagcgctgtgccttggaccaaccttacttcttactattgacagctcagctaactcctattcatccttcaaaacccatctctggtggtttggctttgaatgacagcaagaactctgtctttaatggcttcattggtagcgtatgatgattcggactcggaggctgagacagagcatgcaggaagttttaatgctaccggccagcagaaagacacttctggtgtggccagaccacctgggcaggattttgcatctggtacactggatgtgcccaaagcaggggcacagcccacaaagcatggctcctgtgaagacccagggggctatcgccttccattggctcagcttgggagaagcgatcggggatcttgccccagccagaggctacagtggcccgggaaggagcctcaagtcaccttccccatcaaagagccttcttgttcttctctgtggacgagccatgttccagccagccacatgcccctggcagctgcccgctttaagcaagtaaaactctccaggaactttcccaagtcatctttccgtgctcaaagtgagtctgaaaccgtaggtaaaaatggcagctcttttcagaagaaaaaatgtgaggactgtgtggtaccctatactcccagaagactaagacagcggcaggcattaagcacggagacaggcaagggtaaagacgtggagccacaggggccccctgcagggcgtgccccagcccctctctacgtgggcccgggagtgtctgagtttattcagccgtatttgaatagccattataaagaaaccacagttccccggaaagtgcttttccacctgagaggccacaggggccctgtcaacaccattcagtggtgtccagtcctttctaagagccacatgcttctctccacttctatggataaaactttcaaggtggaacgccgtggactccgggcactgcctgcagacctactccctgcacacagaggcagtgcgggccgccggtgggctccctgtggccggcgcatcctcagtggtggctttgacttcgcgctgcacctaacagaccttgaaacaggaacccagctatttagtggtcgaagtgactttagaatcactaccttgaaattccatccaaaagaccacaacatctttttatgtggaggcttcagctctgaaatgaaagcttgggatataaggactggcaaggtgatgagaagctacaaggcgaccatccagcagaccttggacatcctgttcctccgggaaggctccgagttcctgagcagcacagacgcttccacccgggactcagctgaccgcaccattattgcctgggatttccggacctctgccaaaatctccaaccagattttccacgagaggttcacctgccccagcctcgccttgcacccgagagagcccgtgttcctggcacagaccaatggcaactacctggcccttttctccactgtgtggccctaccggatgagcagacggcggcgctatgaagggcacaaggtggagggctactcagtgggctgcgagtgctccccaggcggtgacttgctggtgacgggcagcgccgatggccgggtcctgatgtacagcttccgcacagccagccgagcatgcacactgcaggggcacacacaggcctgtgtcggcaccacctatcaccccgtgctgccctccgtcctcgccacctgctcctggggaggggacatgaagatctggcactgagctttttgtcactgaaccttcccgatgccagctgggctcttggactcccctcttcctcaagggtagatgagaggaacgagcacagaggttggctgtgggtcctgggtaccaccttctgagcctcagtttcctcatctgtaaagtggggagaaaagtctgtttgcctcaggagtgtgaggactacactagtgaaagcgcctggcgggcagccggcgatgcccaataaatgtgtgttttgctgtttgtt

SEQ ID NO: 112912 - DNA, 441 bp, Homo sapiens
aggaaggtgtggctttgcctgacatatttgtctatttttgccaaaaatctttaccatcaaaaaaccagaactaggtcacccaggttcttctagctttaaaggaagcaggtaaatcaagatacaaactgtcaccactggctgagaacaaacatgatctattacctaagactggacaaatgtagtctcttagcaattaaagttcttttagtgacaacaagaacaaacaggaatggctactgagtaggaaaatagcagtgctggccacacttctattttttcatagtacttactacttactatctggagttaacttatgctaaataaataaatgtttattgcttatctgtgactcactgcttatctggacagatgagtcacctgattctgtgtaaccataaagaagctaggaaacacagaaaagcacatggatattggtagaaa

SEQ ID NO: 112913 - DNA, 826 bp, Homo sapiens
ttaacaggccatgtctgagactctcattggtaaaaagttactgggactgagtacaggagatgaaggcatattaaaaagaaaaccttctatatttggcagttctgagcccagagtctaaaatagccaggccaaacaattccattgtcatggccactgggccaaggggactgactcaaaatgtaaactgtgaaaggtactgagtgtgtagttctctagggagaaaggccaagcaacccatccccgaggagccctcgaccactgctcagagagctggtgggagaatcattctcattcactagggagggaagctagatgttcagaaaaaactctcaacttcttatgtacacacgcgcacacacacaaggtaaggcagtcattcaagttccaatatttctaatcaattgaatcaaatttaatttgcagagaaggaataatttctgtgactttattactttataagcactccaagtttagacagtctctatgtaaaccattctgaccctgcctccgttccaggcagtttcagagttggactgctctgctcctcttcactttgtgcagcacgtgttgtaagaacattcatttggcattaatacccactgccttgttttgaaaatgatctttccatttttatctcctcaccttctcatgagctccttgaaaacagaaaccacatgtcatgtcatacttctctgtacctcacagaactcttccacagccagactcactacatgctgtagaatgactcaatgaatgaagtaccgcaaacatctgaattttaaataaggggcctagttccctacttcttctagcttctgtgtgcttg

SEQ ID NO: 112914 - DNA, 881 bp, Homo sapiens
tagataaagtcgttgaatactagcgtgttgtcatacactttttctcagagtttttaaagagtacttcgctgaaatgatgccatcaggaaagagatatttttacctctatcacctatcaatgcgagaccatagcaggctatagtgcagtaatatcatcatggctcactgcaatctcgacttctccagctcaaacaatcctcccacctcagcctcccaagcagttgggactacaggcacgtgtcattacacccaggctatctgcaatacatgactctggaagctagggtgctctatgctgtgatgctatcaaatcttcatggatttttccaggatcctcaaaacagagtgagactccttcaaaaaaaattaataaaagcaagcacatagggtgcacatttgcccttccctcttgggatccagggtgatcccacaggtgctgttcatccccaagtttgacctggacgtgttccagtgttatgtcgcagtgtttctcccttttttggtactgggatttctccccagaaacaaaccatatgtatccaaagtagtgggcttgctatacaagatgactagtggaaacctcaagtagaggtacgatttcctagaatcgatctggtgcaggatattaccagggccaaagtaaaacgagcaaacgctccatcctgcagactcaggggtgcaggccctcacttatgcatcaatcttataccttcctgttgggcctccatggtattacaaaaggtgtagattgacatttcgcccaagatgggtccgggaaaagtgcactgggtcgtacattggtggggttgtaccctacagggaagcttcagatatatcggaacctctggaactccactgtgaaagtattcccccactagggg

SEQ ID NO: 112915 - DNA, 198 bp, Homo sapiens
tgggtccttatgcaagcaactctgagctgggacctcagctaaggaaggtgagagcagcaccacaaggctactttccagcccactgctgagaccagtgctagcgggcagactagcctttctgccaaaacactagtgtgtacagttctttctggaccccatggcaaatggttttggtggcaggatcatgggcaaacaggg

SEQ ID NO: 112916 - DNA, 299 bp, Homo sapiens
gtcagaagaaaaatcacagtcctcctcccgcagcccctttccctcttggagctgattatttggggtttatcttctgtagtagaagaagaaatcgatttggtgtttgtccccagttcctgtcacggagccgctaacacctttggaaattcctgatcggtaggcgtgtcttgtcgttcattatatgctctgttagagaactcccgagtttatgctaatgcagtggtctagggtagagccccgggggagcctcagggtggggctggtaagtaagacctaaagactgaagggttgggactttc

SEQ ID NO: 112917 - DNA, 539 bp, Homo sapiens
  misc_feature (15)..(15): n is a, c, g, or t
cgggagacaacttanggctaggtacgaggcctgggtggtgtccttcctgagagcaaaggtcaaggaccccctctgtgaaggctcagcagaggtgggatcccacgccccctcccggcccctccctgccctccattcagggagaaacctctccttcccgtgtgagaagggccagagggtccaggcatcccaagtccagcgtgaagggccacagcccctcttggctgccaagcacgcagatcccatggacatttggggaaagggctccttgggctgctggtgaacttctgtggccaccacctcctgctcctgacctccctgggagggtgctatcagttctgtcctggccctttcagttttataagttggtttccagcccccagtgtcctgacttctgtctgccacatgaggagggaggccctgcctgtgtgggagggtggttactgtgggtggaatagtggaggccttcaactgattagacaaggcccgcccacatcttggagggcatctgccttactgattaaaatgtcaatgtaatctaa

SEQ ID NO: 112918 - DNA, 611 bp, Homo sapiens
ggggttaaacagagcccgtcttcaaggaaaggcagtttattgatttagttgttgatttagttattgatttagttatgaagctgtggattataaaaaggctggtttgaaagaaggaagccacattctgtgggggcctatgactgacacccctggggagagttgggccaaggctagctggcctgtgagcctcagcagcactgcagggggcctgggaggggtgtgcaggggggtcccaggtgcgccaggagtcagggtatgcagggggctccagggtgtgcaggggttaggagagctgagcaactttctggaacttatcccgggaactcatttccagagaccccataggctcactgcagaaccatgcttggtatatatggggcgtgtagagggcgcttggggaacagaatcctgcgtttcccccgagggagggaagacatgcaggggaacagggaggaaacgctgcggcagggcagatggcatgggtacatcctccaccgccactctccccctggcaagagtcctggccactccccataaaacgagtacccaccacacccaggcacaaaggggacggtaggtggggtgagtccctgctgtctggctgagatctg

SEQ ID NO: 112919 - DNA, 605 bp, Homo sapiens
cttcagatgccagtcccaagtacagctgtccctttgtatccttgggggatgggatccagtacctccaaaacaccagaatccacaaggccagagtccctgatacaaaatggcatcccagttgcagataaccccctcctctggacttaaatcacctcttgattacttataacacctgaaccctgtgaaccccaggcaatgacagcaggatcctgaagcccatgcaggctctgaaccacgcggccatccagaaggggctgcaggcacctgccactaccgcagaggactgaggggccttggcccagcagggaccccagggccttgggggactgtgtgagctggaaacgtggctggccagatgggcagcaccatggagccccctgggggtgcgtacctgcacctgggcgccgtgacatcccctgtgtgcacagcccgcgtgctgcagctggcctttggctgcactaccttcagcctggtggcccaccggggtggctttgcgggcgtccagggcaccttctgcatggacgcctggggcttctgcttcgccgtctctgcgctggtggtggcctgtgagttcacacggctccacggctgcctgcggctctcct

SEQ ID NO: 112920 - DNA, 538 bp, Homo sapiens
ggtcccggcaggggctccacaggggaccaggggtcagatgtctctctaagatggggacaggcacgcaagctgctattccggggctctgatcacggctgtctatttatagcgctggggggagccgcctcacatagacagcagagaggctgccctgctgcaatgtcaccgtcgtcactgcctctgcaggctgcaggcacctgccactaccgcagaggactgaggggccttggcccagcagggaccccagggccttgggggactgtgtgagctggaaacgtggctggccagatgggcagcaccatggagccccctgggggtgcgtacctgcacctgggcgccgtgacatcccctgtgtgcacagcccgcgtgctgcagctggcctttggctgcactaccttcagcctggtggcccaccggggtggctttgcgggcgtccagggcaccttctgcatggacgcctggggcttctgcttcgccgtctctgcgctggtggtggcctgtgagttcacacggctccacggctgcctgcggctctcct

SEQ ID NO: 112921 - DNA, 158 bp, Homo sapiens
gaattcaagcttctaacgatgtacggggacgaggccctgcctgtgtgggagggtggttactgtgggtggaatagtggaggccttcaactgattagacaaggcccgcccacatcttggagggcatctgccttactgattaaaatgtcaatgtaatctaa

SEQ ID NO: 112922 - DNA, 1883 bp, Homo sapiens
cgacgggggcggggcctgggtgcgggtgccgcgtggcggccgcagcgctgagggagccggtgccatctgtgggggctttgggccagggtctccggacagcatgagcgtgggcttcatcggcgctggccagctggcttttgccctggccaagggcttcacagcagcaggcgtcttggctgcccacaagataatggctagctccccagacatggacctggccacagtttctgctctcaggaagatgggggtgaagttgacaccccacaacaaggagacggtgcagcacagtgatgtgctcttcctggctgtgaagccacacatcatccccttcatcctggatgaaataggcgccgacattgaggacagacacattgtggtgtcctgcgcggccggcgtcaccatcagctccattgagaagaagctgtcagcgtttcggccagcccccagggtcatccgctgcatgaccaacactccagtcgtggtgcgggagggggccaccgtgtatgccacaggcacgcacgcccaggtggaggacgggaggctcatggagcagctgctgagcagcgtgggcttctgcacggaggtggaagaggacctgattgatgccgtcacggggctcagtggcagcggccccgcctacgcattcacagccctggatgccctggctgatgggggtgtgaagatgggacttccaaggcgcctggcagtccgcctcggggcccaggccctcctgggggctgccaagatgctgctgcactcagaacagcacccaggccagctcaaggacaacgtcagctctcctggtggggccaccatccatgccttgcatgtgctggagagtgggggcttccgctccctgctcatcaacgctgtggaggcctcctgcatccgcacacgggagctgcagtccatggctgaccaggagcaggtgtcaccagccgccatcaagaagaccatcctggacaaggtgaagctggactcccctgcagggaccgctctgtcgccttctggccacaccaagctgctcccccgcagcctggccccagcgggcaaggattgacacgtcctgcctgaccaccatcctgccaccaccttctcttctcttgtcactagggggactagggggtccccaaagtggcccactttctgtggctctgatcagcgcaggggccagccagggacatagccagggaggggccacatcacttcccactggaaatctctgtggtctgcaagtgcttcccagcccagaacaggggtggattccccaacctcaacctcctttcttctctgctcccaaaccatgtcaggaccaccttcctctagagctcgggagcccggagggtcttcacccactcctactccagtatcagctggcacgggctccttcctgagagcaaaggtcaaggaccccctctgtgaaggctcagcagaggtgggatcccacgccccctcccggcccctccctgccctccattcagggagaaacctctccttcccgtgtgagaagggccagagggtccaggcatcccaagtccagcgtgaagggccacagcccctcttggctgccaagcacgcagatcccatggacatttggggaaagggctccttgggctgctggtgaacttctgtggccaccacctcctgctcctgacctccctgggagggtgctatcagttctgtcctggccctttcagttttataagttggtttccagcccccagtgtcctgacttctgtctgccacatgaggagggaggccctgcctgtgtgggagggtggttactgtgggtggaatagtggaggccttcaactgattagacaaggcccgcccacatcttggagggcatctgccttactgattaaaatgtcaatgtaatctaa

SEQ ID NO: 112923 - DNA, 1965 bp, Homo sapiens
cgacgggggcggggcctgggtgcgggtgccgcgtggcggccgcagcgctgaggggtgggtacgacccgcgcacggtagctgggttggggtcgggctccgggaatggtgggcggcggtcgccgggtggggcgcgacgagccggtgccatctgtgggggctttgggccagggtctccggacagcatgagcgtgggcttcatcggcgctggccagctggcttttgccctggccaagggcttcacagcagcaggcgtcttggctgcccacaagataatggctagctccccagacatggacctggccacagtttctgctctcaggaagatgggggtgaagttgacaccccacaacaaggagacggtgcagcacagtgatgtgctcttcctggctgtgaagccacacatcatccccttcatcctggatgaaataggcgccgacattgaggacagacacattgtggtgtcctgcgcggccggcgtcaccatcagctccattgagaagaagctgtcagcgtttcggccagcccccagggtcatccgctgcatgaccaacactccagtcgtggtgcgggagggggccaccgtgtatgccacaggcacgcacgcccaggtggaggacgggaggctcatggagcagctgctgagcagcgtgggcttctgcacggaggtggaagaggacctgattgatgccgtcacggggctcagtggcagcggccccgcctacgcattcacagccctggatgccctggctgatgggggtgtgaagatgggacttccaaggcgcctggcagtccgcctcggggcccaggccctcctgggggctgccaagatgctgctgcactcagaacagcacccaggccagctcaaggacaacgtcagctctcctggtggggccaccatccatgccttgcatgtgctggagagtgggggcttccgctccctgctcatcaacgctgtggaggcctcctgcatccgcacacgggagctgcagtccatggctgaccaggagcaggtgtcaccagccgccatcaagaagaccatcctggacaaggtgaagctggactcccctgcagggaccgctctgtcgccttctggccacaccaagctgctcccccgcagcctggccccagcgggcaaggattgacacgtcctgcctgaccaccatcctgccaccaccttctcttctcttgtcactagggggactagggggtccccaaagtggcccactttctgtggctctgatcagcgcaggggccagccagggacatagccagggaggggccacatcacttcccactggaaatctctgtggtctgcaagtgcttcccagcccagaacaggggtggattccccaacctcaacctcctttcttctctgctcccaaaccatgtcaggaccaccttcctctagagctcgggagcccggagggtcttcacccactcctactccagtatcagctggcacgggctccttcctgagagcaaaggtcaaggaccccctctgtgaaggctcagcagaggtgggatcccacgccccctcccggcccctccctgccctccattcagggagaaacctctccttcccgtgtgagaagggccagagggtccaggcatcccaagtccagcgtgaagggccacagcccctcttggctgccaagcacgcagatcccatggacatttggggaaagggctccttgggctgctggtgaacttctgtggccaccacctcctgctcctgacctccctgggagggtgctatcagttctgtcctggccctttcagttttataagttggtttccagcccccagtgtcctgacttctgtctgccacatgaggagggaggccctgcctgtgtgggagggtggttactgtgggtggaatagtggaggccttcaactgattagacaaggcccgcccacatcttggagggcatctgccttactgattaaaatgtcaatgtaatctaa

SEQ ID NO: 112924 - DNA, 2175 bp, Homo sapiens
cgacgggggcggggcctgggtgcgggtgccgcgtggcggccgcagcgctgaggggtgggtacgacccgcgcacggtagctgggttggggtcgggctccgggaatggtgggcggcggtcgccgggtggggcgcgacggtagcccagttctgggcggggtgggaacccagacgggggacccctaggcgccgggccctccctctccccgtacttttcccccttcccagtcatttcttctgcggaacctccacccctccagtgggtgcgggaccctaggcagcaggccaggcaccgccgctctgactgggggccccgaagcagttaacgggccggacagcaaagtggaaaagccggtgccatctgtgggggctttgggccagggtctccggacagcatgagcgtgggcttcatcggcgctggccagctggcttttgccctggccaagggcttcacagcagcaggcgtcttggctgcccacaagataatggctagctccccagacatggacctggccacagtttctgctctcaggaagatgggggtgaagttgacaccccacaacaaggagacggtgcagcacagtgatgtgctcttcctggctgtgaagccacacatcatccccttcatcctggatgaaataggcgccgacattgaggacagacacattgtggtgtcctgcgcggccggcgtcaccatcagctccattgagaagaagctgtcagcgtttcggccagcccccagggtcatccgctgcatgaccaacactccagtcgtggtgcgggagggggccaccgtgtatgccacaggcacgcacgcccaggtggaggacgggaggctcatggagcagctgctgagcagcgtgggcttctgcacggaggtggaagaggacctgattgatgccgtcacggggctcagtggcagcggccccgcctacgcattcacagccctggatgccctggctgatgggggtgtgaagatgggacttccaaggcgcctggcagtccgcctcggggcccaggccctcctgggggctgccaagatgctgctgcactcagaacagcacccaggccagctcaaggacaacgtcagctctcctggtggggccaccatccatgccttgcatgtgctggagagtgggggcttccgctccctgctcatcaacgctgtggaggcctcctgcatccgcacacgggagctgcagtccatggctgaccaggagcaggtgtcaccagccgccatcaagaagaccatcctggacaaggtgaagctggactcccctgcagggaccgctctgtcgccttctggccacaccaagctgctcccccgcagcctggccccagcgggcaaggattgacacgtcctgcctgaccaccatcctgccaccaccttctcttctcttgtcactagggggactagggggtccccaaagtggcccactttctgtggctctgatcagcgcaggggccagccagggacatagccagggaggggccacatcacttcccactggaaatctctgtggtctgcaagtgcttcccagcccagaacaggggtggattccccaacctcaacctcctttcttctctgctcccaaaccatgtcaggaccaccttcctctagagctcgggagcccggagggtcttcacccactcctactccagtatcagctggcacgggctccttcctgagagcaaaggtcaaggaccccctctgtgaaggctcagcagaggtgggatcccacgccccctcccggcccctccctgccctccattcagggagaaacctctccttcccgtgtgagaagggccagagggtccaggcatcccaagtccagcgtgaagggccacagcccctcttggctgccaagcacgcagatcccatggacatttggggaaagggctccttgggctgctggtgaacttctgtggccaccacctcctgctcctgacctccctgggagggtgctatcagttctgtcctggccctttcagttttataagttggtttccagcccccagtgtcctgacttctgtctgccacatgaggagggaggccctgcctgtgtgggagggtggttactgtgggtggaatagtggaggccttcaactgattagacaaggcccgcccacatcttggagggcatctgccttactgattaaaatgtcaatgtaatctaa

SEQ ID NO: 112925 - DNA, 1945 bp, Homo sapiens
cgacgggggcggggcctgggtgcgggtgccgcgtggcggccgcagcgctgagggagccggtgccatctgtgggggctttgggccagggtctccggacagcatgagcgtgggcttcatcggcgctggccagctggcttttgccctggccaagggcttcacagcagcaggcgtcttggctgcccacaagataatggctagctccccagacatggacctggccacagtttctgctctcaggaagatgggggtgaagttgacaccccacaacaaggagacggtgcagcacagtgatgtgctcttcctggctgtgaagccacacatcatccccttcatcctggatgaaataggcgccgacattgaggacagacacattgtggtgtcctgcgcggccggcgtcaccatcagctccattgagaagaagctgtcagcgtttcggccagcccccagggtcatccgctgcatgaccaacactccagtcgtggtgcgggagggggccaccgtgtatgccacaggcacgcacgcccaggtggaggacgggaggctcatggagcagctgctgagcagcgtgggcttctgcacggaggtggaagaggacctgattgatgccgtcacggggctcagtggcagcggccccgcctacgcattcacagccctggatgccctggctgatgggggtgtgaagatgggacttccaaggcgcctggcagtccgcctcggggcccaggccctcctgggggctgccaagatgctgctgcactcagaacagcacccaggccagctcaaggacaacgtcagctctcctggtggggccaccatccatgccttgcatgtgctggagagtgggggcttccgctccctgctcatcaacgctgtggaggcctcctgcatccgcacacgggagctgcagtccatggctgaccaggagcaggtgtcaccagccgccatcaagaagaccatcctggacaaggtgaagctggactcccctgcagggaccgctctgtcgccttctggccacaccaagctgctcccccgcagcctggccccagcgggcaaggattgacacgtcctgcctgaccaccatcctgccaccaccttctcttctcttgtcactagggggactagggggtccccaaagtggcccactttctgtggctctgatcagcgcaggggccagccagggacatagccagggaggggccacatcacttcccactggaaatctctgtggtctgcaagtgcttcccagcccagaacaggggtggattccccaacctcaacctcctttcttctctgctcccaaaccatgtcaggaccaccttcctctagagctcgggagcccggagggtcttcacccactcctactccagtatcagctggcacgggctccttcctgagagcaaaggtcaaggaccccctctgtgaaggctcagcagaggtgggatcccacgccccctcccggcccctccctgccctccattcagggagaaacctctccttcccgtgtgagaagggccagagggtccaggcatcccaagtccagcgtgaagggccacagcccctcttggctgccaagcacgcagatcccatggacatttggggaaagggctccttgggctgctggtgaacttctgtggccaccacctcctgctcctgacctccctgggagggtgctatcagttctgtcctggccctttcagttttataagttggtttccagcccccagtgtcctgacttctgtctgccacatgaggagggaggccctgcctgtgtgggagggtggttactgtgggtggaatagtggaggccttcaactgattagacaaggcccgcccacatcttggagggcatctgccttactgattaaaatgtcaatgtaatctaaaaaaacaaaaacaaaacccacagcacacctaacagggggcagacaaacggaattgcactgcc

SEQ ID NO: 112926 - DNA, 2592 bp, Homo sapiens
cgacgggggcggggcctgggtgcgggtgccgcgtggcggccgcagcgctgagggagccggtgccatctgtgggggctttgggccagggtctccggacagcatgagcgtgggcttcatcggcgctggccagctggcttttgccctggccaagggcttcacagcagcaggcgtcttggctgcccacaagataatggctagctccccagacatggacctggccacagtttctgctctcaggaagatgggggtgaagttgacaccccacaacaaggagacggtgcagcacagtgatgtgctcttcctggctgtgaagccacacatcatccccttcatcctggatgaaataggcgccgacattgaggacagacacattgtggtgtcctgcgcggccggcgtcaccatcagctccattgagaagaagctgtcagcgtttcggccagcccccagggtcatccgctgcatgaccaacactccagtcgtggtgcgggagggggccaccgtgtatgccacaggcacgcacgcccaggtggaggacgggaggctcatggagcagctgctgagcagcgtgggcttctgcacggaggtggaagaggacctgattgatgccgtcacggggctcagtggcagcggccccgcctacgcattcacagccctggatgccctggctgatgggggtgtgaagatgggacttccaaggcgcctggcagtccgcctcggggcccaggccctcctgggggctgccaagatgctgctgcactcagaacagcacccaggccagctcaaggacaacgtcagctctcctggtggggccaccatccatgccttgcatgtgctggagagtgggggcttccgctccctgctcatcaacgctgtggaggcctcctgcatccgcacacgggagctgcagtccatggctgaccaggagcaggtgtcaccagccgccatcaagaagaccatcctggacaaggtgaagctggactcccctgcagggaccgctctgtcgccttctggccacaccaagctgctcccccgcagcctggccccagcgggcaaggattgacacgtcctgcctgaccaccatcctgccaccaccttctcttctcttgtcactagggggactagggggtccccaaagtggcccactttctgtggctctgatcagcgcaggggccagccagggacatagccagggaggggccacatcacttcccactggaaatctctgtggtctgcaagtgcttcccagcccagaacaggggtggattccccaacctcaacctcctttcttctctgctcccaaaccatgtcaggaccaccttcctctagagctcgggagcccggagggtcttcacccactcctactccagtatcagctggcacgggctccttcctgagagcaaaggtcaaggaccccctctgtgaaggctcagcagaggtgggatcccacgccccctcccggcccctccctgccctccattcagggagaaacctctccttcccgtgtgagaagggccagagggtccaggcatcccaagtccagcgtgaagggccacagcccctcttggctgccaagcacgcagatcccatggacatttggggaaagggctccttgggctgctggtgaacttctgtggccaccacctcctgctcctgacctccctgggagggtgctatcagttctgtcctggccctttcagttttataagttggtttccagcccccagtgtcctgacttctgtctgccacatgaggagggaggccctgcctgtgtgggagggtggttactgtgggtggaatagtggaggccttcaactgattagacaaggcccgcccacatcttggagggcatctgccttactgattaaaatgtcaatgtaatctaaatgcaaaagtctacagattcaaatgttagtctcatgcaacccctccccacccctgccagaaacagaataatgtttgaccaaacactcaggcaccctgtagcccagtcaagtggacacatacaatcacccattccaggaggcccacaggattggaggagctgctgagggttgggttacaagggccaggggtgctctggttccttcaaccaacacatagttactgagtatggagacagcaagatgaggcccccttccctccagaggcagtgcacactgtgtgaggggagctgggctgggtagcagcagggtgtcagggtgtgcaggggggtcccaggtgcgccaggagtcagggtatgcagggggctccagggtgtgcaggggttaggagagctgagcaactttctggaacttatcccgggaactcatttccagagaccccataggctcactgcagaaccatgcttggtatatatggggcgtgtagagggcgcttggggaacagaatcctgcgtttcccccgagggagggaagacatgcaggggaacagggaggaaacgctgcggcagggcagatggcatgggtacatcctccaccgccactctccccctggcaagagtcctggccactccccataaaacgagtacccaccacacccaggcacaaaggggacggtaggtggggtgagtccctgctgtctggctgagatctg

SEQ ID NO: 112927 - DNA, 1794 bp, Homo sapiens
cgacgggggcggggcctgggtgcgggtgccgcgtggcggccgcagcgctgagggagccggtgccatctgtgggggctttgggccagggtctccggacagcatgagcgtgggcttcatcggcgctggccagctggcttttgccctggccaagggcttcacagcagcaggcgtcttggctgcccacaagataatggctagctccccagacatggacctggccacagtttctgctctcaggaagatgggggtgaagttgacaccccacaacaaggagacggtgcagcacagtgatgtgctcttcctggctgtgaagccacacatcatccccttcatcctggatgaaataggcgccgacattgaggacagacacattgtggtgtcctgcgcggccggcgtcaccatcagctccattgagaagaagctgtcagcgtttcggccagcccccagggtcatccgctgcatgaccaacactccagtcgtggtgcgggagggggccaccgtgtatgccacaggcacgcacgcccaggtggaggacgggaggctcatggagcagctgctgagcagcgtgggcttctgcacggaggtggaagaggacctgattgatgccgtcacggggctcagtggcagcggccccgcctacgcattcacagccctggatgccctggctgatgggggtgtgaagatgggacttccaaggcgcctggcagtccgcctcggggcccaggccctcctgggggctgccaagatgctgctgcactcagaacagcacccaggccagctcaaggacaacgtcagctctcctggtggggccaccatccatgccttgcatgtgctggagagtgggggcttccgctccctgctcatcaacgctgtggaggcctcctgcatccgcacacgggagctgcagtccatggctgaccaggagcaggtgtcaccagccgccatcaagaagaccatcctggacaaggtgaagctggactcccctgcagggaccgctctgtcgccttctggccacaccaagctgctcccccgcagcctggccccagcgggcaaggattgacacgtcctgcctgaccaccatcctgccaccaccttctcttctcttgtcactagggggactagggggtccccaaagtggcccactttctgtggctctgatcagcgcaggggccagccagggacatagccagggaggggccacatcacttcccactggaaatctctgtggtctgcaagtgcttcccagcccagaacaggggtggattccccaacctcaacctcctttcttctctgctcccaaaccatgtcaggaccaccttcctctagagctcgggagcccggagggtcttcacccactcctactccagtatcagctggcacgggctccttcctgagagcaaaggtcaaggaccccctctgtgaaggctcagcagaggtgggatcccacgccccctcccggcccctccctgccctccattcagggagaaacctctccttcccgtgtgagaagggccagagggtccaggcatcccaagtccagcgtgaagggccagccagggacatagccagggaggggccacatcacttcccactggaaatctctgtggtctgcaagtgcttcccagcccagaacaggggtggattccccaacctcaacctcctttctgaggccctgcctgtgtgggagggtggttactgtgggtggaatagtggaggccttcaactgattagacaaggcccgcccacatcttggagggcatctgccttactgattaaaatgtcaatgtaatctaa

SEQ ID NO: 112928 - DNA, 1670 bp, Homo sapiens
cgacgggggcggggcctgggtgcgggtgccgcgtggcggccgcagcgctgagggagccggtgccatctgtgggggctttgggccagggtctccggacagcatgagcgtgggcttcatcggcgctggccagctggcttttgccctggccaagggcttcacagcagcaggcgtcttggctgcccacaagataatggctagctccccagacatggacctggccacagtttctgctctcaggaagatgggggtgaagttgacaccccacaacaaggagacggtgcagcacagtgatgtgctcttcctggctgtgaagccacacatcatccccttcatcctggatgaaataggcgccgacattgaggacagacacattgtggtgtcctgcgcggccggcgtcaccatcagctccattgagaagaagctgtcagcgtttcggccagcccccagggtcatccgctgcatgaccaacactccagtcgtggtgcgggagggggccaccgtgtatgccacaggcacgcacgcccaggtggaggacgggaggctcatggagcagctgctgagcagcgtgggcttctgcacggaggtggaagaggacctgattgatgccgtcacggggctcagtggcagcggccccgcctacgcattcacagccctggatgccctggctgatgggggtgtgaagatgggacttccaaggcgcctggcagtccgcctcggggcccaggccctcctgggggctgccaagatgctgctgcactcagaacagcacccaggccagctcaaggacaacgtcagctctcctggtggggccaccatccatgccttgcatgtgctggagagtgggggcttccgctccctgctcatcaacgctgtggaggcctcctgcatccgcacacgggagctgcagtccatggctgaccaggagcaggtgtcaccagccgccatcaagaagaccatcctggacaaggtgaagctggactcccctgcagggaccgctctgtcgccttctggccacaccaagctgctcccccgcagcctggccccagcgggcaaggattgacacgtcctgcctgaccaccatcctgccaccaccttctcttctcttgtcactagggggactagggggtccccaaagtggcccactttctgtggctctgatcagcgcaggggccagccagggacatagccagggaggggccacatcacttcccactggaaatctctgtggtctgcaagtgcttcccagcccagaacaggggtggattccccaacctcaacctccttcccgtgtgagaagggccagagggtccaggcatcccaagtccagcgtgaagggccacagcccctcttggctgccaagcacgcagatcccatggacatttggggaaagggctccttgggctgctggtgaacttctgtggccaccacctcctgctcctgacctccctgggagggtgctatcagttctgtcctggccctttcagttttataagttggtttccagcccccagtgtcctgacttctgtctgccacatgaggagggaggccctgcctgtgtgggagggtggttactgtgggtggaatagtggaggccttcaactgattagacaaggcccgcccacatcttggagggcatctgccttactgattaaaatgtcaatgtaatctaa

SEQ ID NO: 112929 - DNA, 1512 bp, Homo sapiens
cgacgggggcggggcctgggtgcgggtgccgcgtggcggccgcagcgctgagggagccggtgccatctgtgggggctttgggccagggtctccggacagcatgagcgtgggcttcatcggcgctggccagctggcttttgccctggccaagggcttcacagcagcaggcgtcttggctgcccacaagataatggctagctccccagacatggacctggccacagtttctgctctcaggaagatgggggtgaagttgacaccccacaacaaggagacggtgcagcacagtgatgtgctcttcctggctgtgaagccacacatcatccccttcatcctggatgaaataggcgccgacattgaggacagacacattgtggtgtcctgcgcggccggcgtcaccatcagctccattgagaagaagctgtcagcgtttcggccagcccccagggtcatccgctgcatgaccaacactccagtcgtggtgcgggagggggccaccgtgtatgccacaggcacgcacgcccaggtggaggacgggaggctcatggagcagctgctgagcagcgtgggcttctgcacggaggtggaagaggacctgattgatgccgtcacggggctcagtggcagcggccccgcctacgcattcacagccctggatgccctggctgatgggggtgtgaagatgggacttccaaggcgcctggcagtccgcctcggggcccaggccctcctgggggctgccaagatgctgctgcactcagaacagcacccaggccagctcaaggacaacgtcagctctcctggtggggccaccatccatgccttgcatgtgctggagagtgggggcttccgctccctgctcatcaacgctgtggaggcctcctgcatccgcacacgggagctgcagtccatggctgaccaggagcaggtgtcaccagccgccatcaagaagaccatcctggacaaggtgaagctggactcccctgcagggaccgctctgtcgccttctggccacaccaagctgctcccccgcagcctggccccagcgggcaaggattgacacgtcctgcctgaccaccatcctgccaccaccttctcttctcttgtcactagggggactagggggtccccaaagtggcccactttctgtggctctgatcagcgcaggggccagccagggacatagccagggaggggccacatcacttcccactggaaatctctgtggtctgcaagtgcttcccagcccagaacaggggtggattccccaacctcaacctcctttcttctctgctcccaaaccatgtcaggaccaccttcctctagagctcgggagcccggagggtcttcacccactcctactccagtatcagctggcacgggcgaggccctgcctgtgtgggagggtggttactgtgggtggaatagtggaggccttcaactgattagacaaggcccgcccacatcttggagggcatctgccttactgattaaaatgtcaatgtaatctaa

SEQ ID NO: 112930 - DNA, 1498 bp, Homo sapiens
cgacgggggcggggcctgggtgcgggtgccgcgtggcggccgcagcgctgagggagccggtgccatctgtgggggctttgggccagggtctccggacagcatgagcgtgggcttcatcggcgctggccagctggcttttgccctggccaagggcttcacagcagcaggcgtcttggctgcccacaagataatggctagctccccagacatggacctggccacagtttctgctctcaggaagatgggggtgaagttgacaccccacaacaaggagacggtgcagcacagtgatgtgctcttcctggctgtgaagccacacatcatccccttcatcctggatgaaataggcgccgacattgaggacagacacattgtggtgtcctgcgcggccggcgtcaccatcagctccattgagaagaagctgtcagcgtttcggccagcccccagggtcatccgctgcatgaccaacactccagtcgtggtgcgggagggggccaccgtgtatgccacaggcacgcacgcccaggtggaggacgggaggctcatggagcagctgctgagcagcgtgggcttctgcacggaggtggaagaggacctgattgatgccgtcacggggctcagtggcagcggccccgcctacgcattcacagccctggatgccctggctgatgggggtgtgaagatgggacttccaaggcgcctggcagtccgcctcggggcccaggccctcctgggggctgccaagatgctgctgcactcagaacagcacccaggccagctcaaggacaacgtcagctctcctggtggggccaccatccatgccttgcatgtgctggagagtgggggcttccgctccctgctcatcaacgctgtggaggcctcctgcatccgcacacgggagctgcagtccatggctgaccaggagcaggtgtcaccagccgccatcaagaagaccatcctggacaaggtgaagctggactcccctgcagggaccgctctgtcgccttctggccacaccaagctgctcccccgcagcctggccccagcgggcaaggattgacacgtcctgcctgaccaccatcctgccaccaccttctcttctcttgtcactagggggactagggggtccccaaagtggcccactttctgtggctctgatcagcgcaggggccagccagggacatagccagggaggggccacatcacttcccactggaaatctctgtggtctgcaagtgcttcccagcccagaacaggggtggattccccaacctcaacctcctttcttctctgctcccaaaccccctttcagttttataagttggtttccagcccccagtgtcctgacttctgtctgccacatgaggagggaggccctgcctgtgtgggagggtggttactgtgggtggaatagtggaggccttcaactgattagacaaggcccgcccacatcttggagggcatctgccttactgattaaaatgtcaatgtaatctaa

SEQ ID NO: 112931 - DNA, 1833 bp, Homo sapiens
ggccacggtctccatgctctgctcctctggccgcagcagaaccctgtgaaccccaggcaatgacagcaggatcctgaagcccatgcaggctctgaaccacgcggccatccagaaggggcgtcttggctgcccacaagataatggctagctccccagacatggacctggccacagtttctgctctcaggaagatgggggtgaagttgacaccccacaacaaggagacggtgcagcacagtgatgtgctcttcctggctgtgaagccacacatcatccccttcatcctggatgaaataggcgccgacattgaggacagacacattgtggtgtcctgcgcggccggcgtcaccatcagctccattgagaagaagctgtcagcgtttcggccagcccccagggtcatccgctgcatgaccaacactccagtcgtggtgcgggagggggccaccgtgtatgccacaggcacgcacgcccaggtggaggacgggaggctcatggagcagctgctgagcagcgtgggcttctgcacggaggtggaagaggacctgattgatgccgtcacggggctcagtggcagcggccccgcctacgcattcacagccctggatgccctggctgatgggggtgtgaagatgggacttccaaggcgcctggcagtccgcctcggggcccaggccctcctgggggctgccaagatgctgctgcactcagaacagcacccaggccagctcaaggacaacgtcagctctcctggtggggccaccatccatgccttgcatgtgctggagagtgggggcttccgctccctgctcatcaacgctgtggaggcctcctgcatccgcacacgggagctgcagtccatggctgaccaggagcaggtgtcaccagccgccatcaagaagaccatcctggacaaggtgaagctggactcccctgcagggaccgctctgtcgccttctggccacaccaagctgctcccccgcagcctggccccagcgggcaaggattgacacgtcctgcctgaccaccatcctgccaccaccttctcttctcttgtcactagggggactagggggtccccaaagtggcccactttctgtggctctgatcagcgcaggggccagccagggacatagccagggaggggccacatcacttcccactggaaatctctgtggtctgcaagtgcttcccagcccagaacaggggtggattccccaacctcaacctcctttcttctctgctcccaaaccatgtcaggaccaccttcctctagagctcgggagcccggagggtcttcacccactcctactccagtatcagctggcacgggctccttcctgagagcaaaggtcaaggaccccctctgtgaaggctcagcagaggtgggatcccacgccccctcccggcccctccctgccctccattcagggagaaacctctccttcccgtgtgagaagggccagagggtccaggcatcccaagtccagcgtgaagggccacagcccctcttggctgccaagcacgcagatcccatggacatttggggaaagggctccttgggctgctggtgaacttctgtggccaccacctcctgctcctgacctccctgggagggtgctatcagttctgtcctggccctttcagttttataagttggtttccagcccccagtgtcctgacttctgtctgccacatgaggagggaggccctgcctgtgtgggagggtggttactgtgggtggaatagtggaggccttcaactgattagacaaggcccgcccacatcttggagggcatctgccttactgattaaaatgtcaatgtaatctaa

SEQ ID NO: 112932 - DNA, 1705 bp, Homo sapiens
tcaggcggtaccgcccggaattagggatcagcgctgagggagccggtgccatctgtgggggctttgggccagggtctccggacagcatgagcgtgggcttcatcggcgctggccagctggcttttgccctggccaagggcttcacagcagcaggcgtcttggctgcccacaagataatggctagctccccagacatggacctggccacagtttctgctctcaggaagatgggggtgaagttgacaccccacaacaaggagacggtgcagcacagtgatgtgctcttcctggctgtgaagccacacatcatccccttcatcctggatgaaataggcgccgacattgaggacagacacattgtggtgtcctgcgcggccggcgtcaccatcagctccattgagaagaagctgtcagcgtttcggccagcccccagggtcatccgctgcatgaccaacactccagtcgtggtgcgggagggggccaccgtgtatgccacaggcacgcacgcccaggtggaggacgggaggctcatggagcagctgctgagcagcgtgggcttctgcacggaggtggaagaggacctgattgatgccgtcacggggctcagtggcagcggccccgcctacgcattcacagccctggatgccctggctgatgggggtgtgaagatgggacttccaaggcgcctggcagtccgcctcggggcccaggccctcctgggagctgcagtccatggctgaccaggagcaggtgtcaccagccgccatcaagaagaccatcctggacaaggtgaagctggactcccctgcagggaccgctctgtcgccttctggccacaccaagctgctcccccgcagcctggccccagcgggcaaggattgacacgtcctgcctgaccaccatcctgccaccaccttctcttctcttgtcactagggggactagggggtccccaaagtggcccactttctgtggctctgatcagcgcaggggccagccagggacatagccagggaggggccacatcacttcccactggaaatctctgtggtctgcaagtgcttcccagcccagaacaggggtggattccccaacctcaacctcctttcttctctgctcccaaaccatgtcaggaccaccttcctctagagctcgggagcccggagggtcttcacccactcctactccagtatcagctggcacgggctccttcctgagagcaaaggtcaaggaccccctctgtgaaggctcagcagaggtgggatcccacgccccctcccggcccctccctgccctccattcagggagaaacctctccttcccgtgtgagaagggccagagggtccaggcatcccaagtccagcgtgaagggccacagcccctcttggctgccaagcacgcagatcccatggacatttggggaaagggctccttgggctgctggtgaacttctgtggccaccacctcctgctcctgacctccctgggagggtgctatcagttctgtcctggccctttcagttttataagttggtttccagcccccagtgtcctgacttctgtctgccacatgaggagggaggccctgcctgtgtgggagggtggttactgtgggtggaatagtggaggccttcaactgattagacaaggcccgcccacatcttggagggcatctgccttactgattaaaatgtcaatgtaatctaa

SEQ ID NO: 112933 - DNA, 1704 bp, Homo sapiens
gagtaggctagtagaggcggtgtgaatcgggcgagggggagccggtgccatctgtgggggctttgggccagggtctccggacagcatgagcgtgggcttcatcggcgctggccagctggcttttgccctggccaagggcttcacagcagcaggcgtcttggctgcccacaagataatggctagctccccagacatggacctggccacagtttctgctctcaggaagatgggggtgaagttgacaccccacaacaaggagacggtgcagcacagtgatgtgctcttcctggctgtgaagccacacatcatccccttcatcctggatgaaataggcgccgacattgaggacagacacattgtggtgtcctgcgcggccggcgtcaccatcagctccattgagaagaagctgtcagcgtttcggccagcccccagggtcatccgctgcatgaccaacactccagtcgtggtgcgggagggggccaccgtgtatgccacaggcacgcacgcccaggtggaggacgggaggctcatggagcagctgctgagcagcgtgggcttctgcacggaggtggaagaggacctgattgatgccgtcacggggctcagtggcagcggccccgcctacgcattcacagccctggatgccctggctgatgggggtgtgaagatgggacttccaaggcgcctggcagtccgcctcggggcccaggccctcctgggagctgcagtccatggctgaccaggagcaggtgtcaccagccgccatcaagaagaccatcctggacaaggtgaagctggactcccctgcagggaccgctctgtcgccttctggccacaccaagctgctcccccgcagcctggccccagcgggcaaggattgacacgtcctgcctgaccaccatcctgccaccaccttctcttctcttgtcactagggggactagggggtccccaaagtggcccactttctgtggctctgatcagcgcaggggccagccagggacatagccagggaggggccacatcacttcccactggaaatctctgtggtctgcaagtgcttcccagcccagaacaggggtggattccccaacctcaacctcctttcttctctgctcccaaaccatgtcaggaccaccttcctctagagctcgggagcccggagggtcttcacccactcctactccagtatcagctggcacgggctccttcctgagagcaaaggtcaaggaccccctctgtgaaggctcagcagaggtgggatcccacgccccctcccggcccctccctgccctccattcagggagaaacctctccttcccgtgtgagaagggccagagggtccaggcatcccaagtccagcgtgaagggccacagcccctcttggctgccaagcacgcagatcccatggacatttggggaaagggctccttgggctgctggtgaacttctgtggccaccacctcctgctcctgacctccctgggagggtgctatcagttctgtcctggccctttcagttttataagttggtttccagcccccagtgtcctgacttctgtctgccacatgaggagggaggccctgcctgtgtgggagggtggttactgtgggtggaatagtggaggccttcaactgattagacaaggcccgcccacatcttggagggcatctgccttactgattaaaatgtcaatgtaatctaa

SEQ ID NO: 112934 - DNA, 1790 bp, Homo sapiens
cgacgggggcggggcctgggtgcgggtgccgcgtggcggccgcagcgctgagggagccggtgccatctgtgggggctttgggccagggtctccggacagcatgagcgtgggcttcatcggcgctggccagctggcttttgccctggccaagggcttcacagcagcaggcgtcttggctgcccacaagataatggctagctccccagacatggacctggccacagtttctgctctcaggaagatgggggtgaagttgacaccccacaacaaggagacggtgcagcacagtgatgtgctcttcctggctgtgaagccacacatcatccccttcatcctggatgaaataggcgccgacattgaggacagacacattgtggtgtcctgcgcggccggcgtcaccatcagctccattgagaagaagctgtcagcgtttcggccagcccccagggtcatccgctgcatgaccaacactccagtcgtggtgcgggagggggccaccgtgtatgccacaggcacgcacgcccaggtggaggacgggaggctcatggagcagctgctgagcagcgtgggcttctgcacggaggtggaagaggacctgattgatgccgtcacggggctcagtggcagcggccccgcctacggggctgccaagatgctgctgcactcagaacagcacccaggccagctcaaggacaacgtcagctctcctggtggggccaccatccatgccttgcatgtgctggagagtgggggcttccgctccctgctcatcaacgctgtggaggcctcctgcatccgcacacgggagctgcagtccatggctgaccaggagcaggtgtcaccagccgccatcaagaagaccatcctggacaaggtgaagctggactcccctgcagggaccgctctgtcgccttctggccacaccaagctgctcccccgcagcctggccccagcgggcaaggattgacacgtcctgcctgaccaccatcctgccaccaccttctcttctcttgtcactagggggactagggggtccccaaagtggcccactttctgtggctctgatcagcgcaggggccagccagggacatagccagggaggggccacatcacttcccactggaaatctctgtggtctgcaagtgcttcccagcccagaacaggggtggattccccaacctcaacctcctttcttctctgctcccaaaccatgtcaggaccaccttcctctagagctcgggagcccggagggtcttcacccactcctactccagtatcagctggcacgggctccttcctgagagcaaaggtcaaggaccccctctgtgaaggctcagcagaggtgggatcccacgccccctcccggcccctccctgccctccattcagggagaaacctctccttcccgtgtgagaagggccagagggtccaggcatcccaagtccagcgtgaagggccacagcccctcttggctgccaagcacgcagatcccatggacatttggggaaagggctccttgggctgctggtgaacttctgtggccaccacctcctgctcctgacctccctgggagggtgctatcagttctgtcctggccctttcagttttataagttggtttccagcccccagtgtcctgacttctgtctgccacatgaggagggaggccctgcctgtgtgggagggtggttactgtgggtggaatagtggaggccttcaactgattagacaaggcccgcccacatcttggagggcatctgccttactgattaaaatgtcaatgtaatctaa

SEQ ID NO: 112935 - DNA, 2190 bp, Homo sapiens
cgacgggggcggggcctgggtgcgggtgccgcgtggcggccgcagcgctgaggggtgggtacgacccgcgcacggtagctgggttggggtcgggctccgggaatggtgggcggcggtcgccgggtggggcgcgacggtagcccagttctgggcggggtgggaacccagacgggggacccctaggcgccgggccctccctctccccgtacttttcccccttcccagtcatttcttctgcggaacctccacccctccagtgggtgcgggaccctaggcagcaggccaggcaccgccgctctgactgggggccccgaagcagttaacgggccggacagcaaagtggaaagttagaccagctgggaccaggggaggtgggcacccggctgcgggaggagcggccaggctggcactgcccccctaacttgctctcgatcctgccggtctcgtcccgcagagccggtgccatctgtgggggctttgggccagggtctccggacagcatgagcgtgggcttcatcggcgctggccagctggcttttgccctggccaagggcttcacagcagcaggcgtcttggctgcccacaagataatggctagctccccagacatggacctggccacagtttctgctctcaggaagatgggggtgaagttgacaccccacaacaaggagacggtgcagcacagtgatgtgctcttcctggctgtgaagccacacatcatccccttcatcctggatgaaataggcgccgacattgaggacagacacattgtggtgtcctgcgcggccggcgtcaccatcagctccattgagaagaagctgtcagcgtttcggccagcccccagggtcatccgctgcatgaccaacactccagtcgtggtgcgggagggggccaccgtgtatgccacaggcacgcacgcccaggtggaggacgggaggctcatggagcagctgctgagcagcgtgggcttctgcacggaggtggaagaggacctgattgatgccgtcacggggctcagtggcagcggccccgcctacggggctgccaagatgctgctgcactcagaacagcacccaggccagctcaaggacaacgtcagctctcctggtggggccaccatccatgccttgcatgtgctggagagtgggggcttccgctccctgctcatcaacgctgtggaggcctcctgcatccgcacacgggagctgcagtccatggctgaccaggagcaggtgtcaccagccgccatcaagaagaccatcctggacaaggtgaagctggactcccctgcagggaccgctctgtcgccttctggccacaccaagctgctcccccgcagcctggccccagcgggcaaggattgacacgtcctgcctgaccaccatcctgccaccaccttctcttctcttgtcactagggggactagggggtccccaaagtggcccactttctgtggctctgatcagcgcaggggccagccagggacatagccagggaggggccacatcacttcccactggaaatctctgtggtctgcaagtgcttcccagcccagaacaggggtggattccccaacctcaacctcctttcttctctgctcccaaaccatgtcaggaccaccttcctctagagctcgggagcccggagggtcttcacccactcctactccagtatcagctggcacgggctccttcctgagagcaaaggtcaaggaccccctctgtgaaggctcagcagaggtgggatcccacgccccctcccggcccctccctgccctccattcagggagaaacctctccttcccgtgtgagaagggccagagggtccaggcatcccaagtccagcgtgaagggccacagcccctcttggctgccaagcacgcagatcccatggacatttggggaaagggctccttgggctgctggtgaacttctgtggccaccacctcctgctcctgacctccctgggagggtgctatcagttctgtcctggccctttcagttttataagttggtttccagcccccagtgtcctgacttctgtctgccacatgaggagggaggccctgcctgtgtgggagggtggttactgtgggtggaatagtggaggccttcaactgattagacaaggcccgcccacatcttggagggcatctgccttactgattaaaatgtcaatgtaatctaa

SEQ ID NO: 112936 - DNA, 2006 bp, Homo sapiens
cgacgggggcggggcctgggtgcgggtgccgcgtggcggccgcagcgctgaggggtgggtacgacccgcgcacggtagctgggttggggtcgggctccgggaatggtgggcggcggtcgccgggtggggcgcgacggtagcccagttctgggcggggtgggaacccagacgggggacccctaggcgccgggccctccctctccccgtacttttcccccttcccagtcatttcttctgcggaacctccacccctccagtgggtgcgggaccctaggcagcaggccaggcaccgccgctctgactgggggccccgaagcagttaacgggccggacagcaaagtggaaagttagaccagctgggaccaggggaggtgggcacccggctgcgggaggagcggccaggctggcactgcccccctaacttgctctcgatcctgccggtctcgtcccgcagagccggtgccatctgtgggggctttgggccagggtctccggacagcatgagcgtgggcttcatcggcgctggccagctggcttttgccctggccaagggcttcacagcagcaggcgtcttggctgcccacaagataatggctagctccccagacatggacctggccacagtttctgctctcaggaagatgggggtgaagttgacaccccacaacaaggagacggtgcagcacagtgatgtgctcttcctggctgtgaagccacacatcatccccttcatcctggatgaaataggcgccgacattgaggacagacacattgtggtgtcctgcgcggccggcgtcaccatcagctccattgagaagaagctgtcagcgtttcggccagcccccagggtcatccgctgcatgaccaacactccagtcgtggtgcgggagggggccaccgtgtatgccacaggcacgcacgcccaggtggaggacgggaggctcatggagcagctgctgagcagcgtgggcttctgcacggaggtggaagaggacctgattgatgccgtcacggggctcagtggcagcggccccgcctacgcattcacagccctggatgccctggctgatgggggtgtgaagatgggacttccaaggcgcctggcagtccgcctcggggcccaggccctcctgggggctgccaagatgctgctgcactcagaacagcacccaggccagctcaaggacaacgtcagctctcctggtggggccaccatccatgccttgcatgtgctggagagtgggggcttccgctccctgctcatcaacgctgtggaggcctcctgcatccgcacacgggagctgcagtccatggctgaccaggagcaggtgtcaccagccgccatcaagaagaccatcctggacaagatgtcaggaccaccttcctctagagctcgggagcccggagggtcttcacccactcctactccagtatcagctggcacgggctccttcctgagagcaaaggtcaaggaccccctctgtgaaggctcagcagaggtgggatcccacgccccctcccggcccctccctgccctccattcagggagaaacctctccttcccgtgtgagaagggccagagggtccaggcatcccaagtccagcgtgaagggccacagcccctcttggctgccaagcacgcagatcccatggacatttggggaaagggctccttgggctgctggtgaacttctgtggccaccacctcctgctcctgacctccctgggagggtgctatcagttctgtcctggccctttcagttttataagttggtttccagcccccagtgtcctgacttctgtctgccacatgaggagggaggccctgcctgtgtgggagggtggttactgtgggtggaatagtggaggccttcaactgattagacaaggcccgcccacatcttggagggcatctgccttactgattaaaatgtcaatgtaatctaacttagcgtcgagttcctcacttacttttatcctttactcttgtatgatttatactcctt

SEQ ID NO: 112937 - DNA, 1626 bp, Homo sapiens
cgacgggggcggggcctgggtgcgggtgccgcgtggcggccgcagcgctgagggagccggtgccatctgtgggggctttgggccagggtctccggacagcatgagcgtgggcttcatcggcgctggccagctggcttttgccctggccaagggcttcacagcagcaggcgtcttggctgcccacaagataatggctagctccccagacatggacctggccacagtttctgctctcaggaagatgggggtgaagttgacaccccacaacaaggagacggtgcagcacagtgatgtgctcttcctggctgtgaagccacacatcatccccttcatcctggatgaaataggcgccgacattgaggacagacacattgtggtgtcctgcgcggccggcgtcaccatcagctccattgagaagaagctgtcagcgtttcggccagcccccagggtcatccgctgcatgaccaacactccagtcgtggtgcgggagggggccaccgtgtatgccacaggcacgcacgcccaggtggaggacgggaggctcatggagcagctgctgagcagcgtgggcttctgcacggaggtggaagaggacctgattgatgccgtcacggggctcagtggcagcggccccgcctacggagctgcagtccatggctgaccaggagcaggtgtcaccagccgccatcaagaagaccatcctggacaaggtgaagctggactcccctgcagggaccgctctgtcgccttctggccacaccaagctgctcccccgcagcctggccccagcgggcaaggattgacacgtcctgcctgaccaccatcctgccaccaccttctcttctcttgtcactagggggactagggggtccccaaagtggcccactttctgtggctctgatcagcgcaggggccagccagggacatagccagggaggggccacatcacttcccactggaaatctctgtggtctgcaagtgcttcccagcccagaacaggggtggattccccaacctcaacctcctttcttctctgctcccaaaccatgtcaggaccaccttcctctagagctcgggagcccggagggtcttcacccactcctactccagtatcagctggcacgggctccttcctgagagcaaaggtcaaggaccccctctgtgaaggctcagcagaggtgggatcccacgccccctcccggcccctccctgccctccattcagggagaaacctctccttcccgtgtgagaagggccagagggtccaggcatcccaagtccagcgtgaagggccacagcccctcttggctgccaagcacgcagatcccatggacatttggggaaagggctccttgggctgctggtgaacttctgtggccaccacctcctgctcctgacctccctgggagggtgctatcagttctgtcctggccctttcagttttataagttggtttccagcccccagtgtcctgacttctgtctgccacatgaggagggaggccctgcctgtgtgggagggtggttactgtgggtggaatagtggaggccttcaactgattagacaaggcccgcccacatcttggagggcatctgccttactgattaaaatgtcaatgtaatctaa

SEQ ID NO: 112938 - DNA, 1204 bp, Homo sapiens
aattagctagtacgagcgtgtttaatcggccgaggctgggcgccaggccctctgggggctgccaagatgctgctgcactcagaacagcacccaggccagctcaaggacaacgtcagctctcctggtggggccaccatccatgccttgcatgtgctggagagtgggggcttccgctccctgctcatcaacgctgtggaggcctcctgcatccgcacacgggagctgcagtccatggctgaccaggagcaggtgtcaccagccgccatcaagaagaccatcctggacaaggtgaagctggactcccctgcagggaccgctctgtcgccttctggccacaccaagctgctcccccgcagcctggccccagcgggcaaggattgacacgtcctgcctgaccaccatcctgccaccaccttctcttctcttgtcactagggggactagggggtccccaaagtggcccactttctgtggctctgatcagcgcaggggccagccagggacatagccagggaggggccacatcacttcccactggaaatctctgtggtctgcaagtgcttcccagcccagaacaggggtggattccccaacctcaacctcctttcttctctgctcccaaaccatgtcaggaccaccttcctctagagctcgggagcccggagggtcttcacccactcctactccagtatcagctggcacgggctccttcctgagagcaaaggtcaaggaccccctctgtgaaggctcagcagaggtgggatcccacgccccctcccggcccctccctgccctccattcagggagaaacctctccttcccgtgtgagaagggccagagggtccaggcatcccaagtccagcgtgaagggccacagcccctcttggctgccaagcacgcagatcccatggacatttggggaaagggctccttgggctgctggtgaacttctgtggccaccacctcctgctcctgacctccctgggagggtgctatcagttctgtcctggccctttcagttttataagttggtttccagcccccagtgtcctgacttctgtctgccacatgaggagggaggccctgcctgtgtgggagggtggttactgtgggtggaatagtggaggccttcaactgattagacaaggcccgcccacatcttggagggcatctgccttactgattaaaatgtcaatgtaatctaa

SEQ ID NO: 112939 - DNA, 1168 bp, Homo sapiens
ggacgcgtgggtcgcggacgcgtgggtcgacccacgcgtccgacctgattgatgccgtcacggggctcagtggcagcggccccgcctacgcattcacagccctggatgccctggctgatgggggtgtgaagatgggacttccaaggcgcctggcagtccgcctcggggcccaggccctcctgggagctgcagtccatggctgaccaggagcaggtgtcaccagccgccatcaagaagaccatcctggacaaggtgaagctggactcccctgcagggaccgctctgtcgccttctggccacaccaagctgctcccccgcagcctggccccagcgggcaaggattgacacgtcctgcctgaccaccatcctgccaccaccttctcttctcttgtcactagggggactagggggtccccaaagtggcccactttctgtggctctgatcagcgcaggggccagccagggacatagccagggaggggccacatcacttcccactggaaatctctgtggtctgcaagtgcttcccagcccagaacaggggtggattccccaacctcaacctcctttcttctctgctcccaaaccatgtcaggaccaccttcctctagagctcgggagcccggagggtcttcacccactcctactccagtatcagctggcacgggctccttcctgagagcaaaggtcaaggaccccctctgtgaaggctcagcagaggtgggatcccacgccccctcccggcccctccctgccctccattcagggagaaacctctccttcccgtgtgagaagggccagagggtccaggcatcccaagtccagcgtgaagggccacagcccctcttggctgccaagcacgcagatcccatggacatttggggaaagggctccttgggctgctggtgaacttctgtggccaccacctcctgctcctgacctccctgggagggtgctatcagttctgtcctggccctttcagttttataagttggtttccagcccccagtgtcctgacttctgtctgccacatgaggagggaggccctgcctgtgtgggagggtggttactgtgggtggaatagtggaggccttcaactgattagacaaggcccgcccacatcttggagggcatctgccttactgattaaaatgtcaatgtaatctaa

SEQ ID NO: 112940 - DNA, 645 bp, Homo sapiens
tcacaaagtgatgtaaataataaacattaaaattttcccaagtaatgatgacttaagcgttcaaaatccagttatgtgctttgttatgaaaacagtccaaacaaaaattcttttgttgttttctgttctctttttcaaaatacataaatcctactgaagttagtctattttttcccacttcagaacaccctcgtgccgaattcggcacgagcccctcccggcccctccctgccctccattcagggagaaacctctccttcccgtgtgagaagggccagagggtccaggcatcccaagtccagcgtgaagggccacagcccctcttggctgccaagcacgcagatcccatggacatttggggaaagggctccttgggctgctggtgaacttctgtggccaccacctcctgctcctgacctccctgggagggtgctatcagttctgtcctggccctttcagttttataagttggtttccagcccccagtgtcctgacttctgtctgccacatgaggagggaggccctgcctgtgtgggagggtggttactgtgggtggaatagtggaggccttcaactgattagacaaggcccgcccacatcttggagggcatctgccttactgattaaaatgtcaatgtaatctaa

SEQ ID NO: 112941 - DNA, 419 bp, Homo sapiens
agattacattgacattttaatcagtaaggcagatgccctccaagatgtgggcgggccttgtctaatcagttgaaggcctccactattccacccacagtaaccaccctcccacgcagatcccatggacatttggggaaagggctccttgggctgctggtgaacttctgtggccaccacctcctgctcctgacctccctgggagggtgctatcagttctgtcctggccctttcagttttataagttggtttccagcccccagtgtcctgacttctgtctgccacatgaggagggaggccctgcctgtgtgggagggtggttactgtgggtggaatagtggaggccttcaactgattagacaaggcccgcccacatcttggagggcatctgccttactgattaaaatgtcaatgtaatctaa

SEQ ID NO: 112942 - DNA, 334 bp, Homo sapiens
cttcagatgccagtcccaagtacagctgtccctttgtatccttgggggatgggatccagtacctccaaaacaccagaatccacaaggccagagtccctgatacaaaatggcatcccagttgcagataaccccctcctctggacttaaatcacctcttgattacttataacacctgaaccctgtgaaccccaggcaatgacagcaggatcctgaagcccatgcaggctctgaaccacgcggccatccagaaggggtgagataaatgttggggaaaccatccccgacccccgcgagccccaggagcccaggctgccgcctcctgcctcctacaccc

SEQ ID NO: 112943 - DNA, 2283 bp, Homo sapiens
cgacgggggcggggcctgggtgcgggtgccgcgtggcggccgcagcgctgaggggtgggtacgacccgcgcacggtagctgggttggggtcgggctccgggaatggtgggcggcggtcgccgggtggggcgcgacggtagcccagttctgggcggggtgggaacccagacgggggacccctaggcgccgggccctccctctccccgtacttttcccccttcccagtcatttcttctgcggaacctccacccctccagtgggtgcgggaccctaggcagcaggccaggcaccgccgctctgactgggggccccgaagcagttaacgggccggacagcaaagtggaaagttagaccagctgggaccaggggaggtgggcacccggctgcgggaggagcggccaggctggcactgcccccctaacttgctctcgatcctgccggtctcgtcccgcagagccggtgccatctgtgggggctttgggccagggtctccggacagcatgagcgtgggcttcatcggcgctggccagctggcttttgccctggccaagggcttcacagcagcaggcgtcttggctgcccacaagataatggctagctccccagacatggacctggccacagtttctgctctcaggaagatgggggtgaagttgacaccccacaacaaggagacggtgcagcacagtgatgtgctcttcctggctgtgaagccacacatcatccccttcatcctggatgaaataggcgccgacattgaggacagacacattgtggtgtcctgcgcggccggcgtcaccatcagctccattgagaagaagctgtcagcgtttcggccagcccccagggtcatccgctgcatgaccaacactccagtcgtggtgcgggagggggccaccgtgtatgccacaggcacgcacgcccaggtggaggacgggaggctcatggagcagctgctgagcagcgtgggcttctgcacggaggtggaagaggacctgattgatgccgtcacggggctcagtggcagcggccccgcctacgcattcacagccctggatgccctggctgatgggggtgtgaagatgggacttccaaggcgcctggcagtccgcctcggggcccaggccctcctgggggctgccaagatgctgctgcactcagaacagcacccaggccagctcaaggacaacgtcagctctcctggtggggccaccatccatgccttgcatgtgctggagagtgggggcttccgctccctgctcatcaacgctgtggaggcctcctgcatccgcacacgggagctgcagtccatggctgaccaggagcaggtgtcaccagccgccatcaagaagaccatcctggacaaggtgaagctggactcccctgcagggaccgctctgtcgccttctggccacaccaagctgctcccccgcagcctggccccagcgggcaaggattgacacgtcctgcctgaccaccatcctgccaccaccttctcttctcttgtcactagggggactagggggtccccaaagtggcccactttctgtggctctgatcagcgcaggggccagccagggacatagccagggaggggccacatcacttcccactggaaatctctgtggtctgcaagtgcttcccagcccagaacaggggtggattccccaacctcaacctcctttcttctctgctcccaaaccatgtcaggaccaccttcctctagagctcgggagcccggagggtcttcacccactcctactccagtatcagctggcacgggctccttcctgagagcaaaggtcaaggaccccctctgtgaaggctcagcagaggtgggatcccacgccccctcccggcccctccctgccctccattcagggagaaacctctccttcccgtgtgagaagggccagagggtccaggcatcccaagtccagcgtgaagggccacagcccctcttggctgccaagcacgcagatcccatggacatttggggaaagggctccttgggctgctggtgaacttctgtggccaccacctcctgctcctgacctccctgggagggtgctatcagttctgtcctggccctttcagttttataagttggtttccagcccccagtgtcctgacttctgtctgccacatgaggagggaggccctgcctgtgtgggagggtggttactgtgggtggaatagtggaggccttcaactgattagacaaggcccgcccacatcttggagggcatctgccttactgattaaaatgtcaatgtaatctaa

SEQ ID NO: 112944 - DNA, 1869 bp, Homo sapiens
tcaggcggtaccgcccggaattagggatcagcgctgagggagccggtgccatctgtgggggctttgggccagggtctccggacagcatgagcgtgggcttcatcggcgctggccagctggcttttgccctggccaagggcttcacagcagcaggcgtcttggctgcccacaagataatggctagctccccagacatggacctggccacagtttctgctctcaggaagatgggggtgaagttgacaccccacaacaaggagacggtgcagcacagtgatgtgctcttcctggctgtgaagccacacatcatccccttcatcctggatgaaataggcgccgacattgaggacagacacattgtggtgtcctgcgcggccggcgtcaccatcagctccattgagaagaagctgtcagcgtttcggccagcccccagggtcatccgctgcatgaccaacactccagtcgtggtgcgggagggggccaccgtgtatgccacaggcacgcacgcccaggtggaggacgggaggctcatggagcagctgctgagcagcgtgggcttctgcacggaggtggaagaggacctgattgatgccgtcacggggctcagtggcagcggccccgcctacgcattcacagccctggatgccctggctgatgggggtgtgaagatgggacttccaaggcgcctggcagtccgcctcggggcccaggccctcctgggggctgccaagatgctgctgcactcagaacagcacccaggccagctcaaggacaacgtcagctctcctggtggggccaccatccatgccttgcatgtgctggagagtgggggcttccgctccctgctcatcaacgctgtggaggcctcctgcatccgcacacgggagctgcagtccatggctgaccaggagcaggtgtcaccagccgccatcaagaagaccatcctggacaaggtgaagctggactcccctgcagggaccgctctgtcgccttctggccacaccaagctgctcccccgcagcctggccccagcgggcaaggattgacacgtcctgcctgaccaccatcctgccaccaccttctcttctcttgtcactagggggactagggggtccccaaagtggcccactttctgtggctctgatcagcgcaggggccagccagggacatagccagggaggggccacatcacttcccactggaaatctctgtggtctgcaagtgcttcccagcccagaacaggggtggattccccaacctcaacctcctttcttctctgctcccaaaccatgtcaggaccaccttcctctagagctcgggagcccggagggtcttcacccactcctactccagtatcagctggcacgggctccttcctgagagcaaaggtcaaggaccccctctgtgaaggctcagcagaggtgggatcccacgccccctcccggcccctccctgccctccattcagggagaaacctctccttcccgtgtgagaagggccagagggtccaggcatcccaagtccagcgtgaagggccacagcccctcttggctgccaagcacgcagatcccatggacatttggggaaagggctccttgggctgctggtgaacttctgtggccaccacctcctgctcctgacctccctgggagggtgctatcagttctgtcctggccctttcagttttataagttggtttccagcccccagtgtcctgacttctgtctgccacatgaggagggaggccctgcctgtgtgggagggtggttactgtgggtggaatagtggaggccttcaactgattagacaaggcccgcccacatcttggagggcatctgccttactgattaaaatgtcaatgtaatctaa

SEQ ID NO: 112945 - DNA, 1883 bp, Homo sapiens
aaagtaggctaggtacgaggctgggtgtgactccgctctacggtggacacagcggccctgggaagcagctccgggctttgggccagggtctccggacagcatgagcgtgggcttcatcggcgctggccagctggcttttgccctggccaagggcttcacagcagcaggcgtcttggctgcccacaagataatggctagctccccagacatggacctggccacagtttctgctctcaggaagatgggggtgaagttgacaccccacaacaaggagacggtgcagcacagtgatgtgctcttcctggctgtgaagccacacatcatccccttcatcctggatgaaataggcgccgacattgaggacagacacattgtggtgtcctgcgcggccggcgtcaccatcagctccattgagaagaagctgtcagcgtttcggccagcccccagggtcatccgctgcatgaccaacactccagtcgtggtgcgggagggggccaccgtgtatgccacaggcacgcacgcccaggtggaggacgggaggctcatggagcagctgctgagcagcgtgggcttctgcacggaggtggaagaggacctgattgatgccgtcacggggctcagtggcagcggccccgcctacgcattcacagccctggatgccctggctgatgggggtgtgaagatgggacttccaaggcgcctggcagtccgcctcggggcccaggccctcctgggggctgccaagatgctgctgcactcagaacagcacccaggccagctcaaggacaacgtcagctctcctggtggggccaccatccatgccttgcatgtgctggagagtgggggcttccgctccctgctcatcaacgctgtggaggcctcctgcatccgcacacgggagctgcagtccatggctgaccaggagcaggtgtcaccagccgccatcaagaagaccatcctggacaaggtgaagctggactcccctgcagggaccgctctgtcgccttctggccacaccaagctgctcccccgcagcctggccccagcgggcaaggattgacacgtcctgcctgaccaccatcctgccaccaccttctcttctcttgtcactagggggactagggggtccccaaagtggcccactttctgtggctctgatcagcgcaggggccagccagggacatagccagggaggggccacatcacttcccactggaaatctctgtggtctgcaagtgcttcccagcccagaacaggggtggattccccaacctcaacctcctttcttctctgctcccaaaccatgtcaggaccaccttcctctagagctcgggagcccggagggtcttcacccactcctactccagtatcagctggcacgggctccttcctgagagcaaaggtcaaggaccccctctgtgaaggctcagcagaggtgggatcccacgccccctcccggcccctccctgccctccattcagggagaaacctctccttcccgtgtgagaagggccagagggtccaggcatcccaagtccagcgtgaagggccacagcccctcttggctgccaagcacgcagatcccatggacatttggggaaagggctccttgggctgctggtgaacttctgtggccaccacctcctgctcctgacctccctgggagggtgctatcagttctgtcctggccctttcagttttataagttggtttccagcccccagtgtcctgacttctgtctgccacatgaggagggaggccctgcctgtgtgggagggtggttactgtgggtggaatagtggaggccttcaactgattagacaaggcccgcccacatcttggagggcatctgccttactgattaaaatgtcaatgtaatctaa

SEQ ID NO: 112946 - DNA, 2024 bp, Homo sapiens
cgacgggggcggggcctgggtgcgggtgccgcgtggcggccgcagcgctgagggagccggtgccatctgtgggggctttgggccagggtctccggacagcatgagcgtgggcttcatcggcgctggccagctggcttttgccctggccaagggcttcacagcagcaggcgtcttggctgcccacaagataatggctagctccccagacatggacctggccacagtttctgctctcaggaagatgggggtgaagttgacaccccacaacaaggagacggtgcagcacagtgatgtgctcttcctggctgtgaagccacacatcatccccttcatcctggatgaaataggcgccgacattgaggacagacacattgtggtgtcctgcgcggccggcgtcaccatcagctccattgagaagaagctgtcagcgtttcggccagcccccagggtcatccgctgcatgaccaacactccagtcgtggtgcgggagggggccaccgtgtatgccacaggcacgcacgcccaggtggaggacgggaggctcatggagcagctgctgagcagcgtgggcttctgcacggaggtggaagaggacctgattgatgccgtcacggggctcagtggcagcggccccgcctacgcattcacagccctggatgccctggctgatgggggtgtgaagatgggacttccaaggcgcctggcagtccgcctcggggcccaggccctcctgggggctgccaagatgctgctgcactcagaacagcacccaggccagctcaaggacaacgtcagctctcctggtggggccaccatccatgccttgcatgtgctggagagtgggggcttccgctccctgctcatcaacgctgtggaggcctcctgcatccgcacacgggagctgcagtccatggctgaccaggagcaggtgtcaccagccgccatcaagaagaccatcctggacaaggtgaagctggactcccctgcagggaccgctctgtcgccttctggccacaccaagctgctcccccgcagcctggccccagcgggcaaggattgacacgtcctgcctgaccaccatcctgccaccaccttctcttctcttgtcactagggggactagggggtccccaaagtggcccactttctgtggctctgatcagcgcaggggccagccagggacatagccagggaggggccacatcacttcccactggaaatctctgtggtctgcaagtgcttcccagcccagaacaggggtggattccccaacctcaacctcctttcttctctgctcccaaaccatgtcaggaccaccttcctctagagctcgggagcccggagggtcttcacccactcctactccagtatcagctggcacgggctccttcctgagagcaaaggtcaaggaccccctctgtgaaggctcagcagaggtgggatcccacgccccctcccggcccctccctgccctccattcagggagaaacctctccttcccgtgtgagaagggccagagggtccaggcatcccaagtccagcgtgaagggccacagcccctcttggctgccaagcacgcagatcccatggacatttggggaaagggctccttgggctgctggtgaacttctgtggccaccacctcctgctcctgacctccctgggagggtgctatcagttctgtcctggccctttcagttttataagttggtttccagcccccagtgtcctgacttctgtctgccacatgaggagggaggccctgcctgtgtgggagggtggttactgtgggtggaatagtggaggccttcaactgattagacaaggcccgcccacatcttggagggcatctgccttactgattaaaatgtcaatgtaatctaaaaataactattatttctttgttaatttaaatactgagcgtttaatattctgaactgtattggatcctccctttttgtttaaaaaaaaatctctggggggggccccggcccctaaatccctaatagggacttttttcaaaag

SEQ ID NO: 112947 - DNA, 1942 bp, Homo sapiens
cgacgggggcggggcctgggtgcgggtgccgcgtggcggccgcagcgctgagggagccggtgccatctgtgggggctttgggccagggtctccggacagcatgagcgtgggcttcatcggcgctggccagctggcttttgccctggccaagggcttcacagcagcaggcgtcttggctgcccacaagataatggctagctccccagacatggacctggccacagtttctgctctcaggaagatgggggtgaagttgacaccccacaacaaggagacggtgcagcacagtgatgtgctcttcctggctgtgaagccacacatcatccccttcatcctggatgaaataggcgccgacattgaggacagacacattgtggtgtcctgcgcggccggcgtcaccatcagctccattgagaagaagctgtcagcgtttcggccagcccccagggtcatccgctgcatgaccaacactccagtcgtggtgcgggagggggccaccgtgtatgccacaggcacgcacgcccaggtggaggacgggaggctcatggagcagctgctgagcagcgtgggcttctgcacggaggtggaagaggacctgattgatgccgtcacggggctcagtggcagcggccccgcctacgcattcacagccctggatgccctggctgatgggggtgtgaagatgggacttccaaggcgcctggcagtccgcctcggggcccaggccctcctgggggctgccaagatgctgctgcactcagaacagcacccaggccagctcaaggacaacgtcagctctcctggtggggccaccatccatgccttgcatgtgctggagagtgggggcttccgctccctgctcatcaacgctgtggaggcctcctgcatccgcacacgggagctgcagtccatggctgaccaggagcaggtgtcaccagccgccatcaagaagaccatcctggacaaggtgaagctggactcccctgcagggaccgctctgtcgccttctggccacaccaagctgctcccccgcagcctggccccagcgggcaaggattgacacgtcctgcctgaccaccatcctgccaccaccttctcttctcttgtcactagggggactagggggtccccaaagtggcccactttctgtggctctgatcagcgcaggggccagccagggacatagccagggaggggccacatcacttcccactggaaatctctgtggtctgcaagtgcttcccagcccagaacaggggtggattccccaacctcaacctcctttcttctctgctcccaaaccatgtcaggaccaccttcctctagagctcgggagcccggagggtcttcacccactcctactccagtatcagctggcacgggctccttcctgagagcaaaggtcaaggaccccctctgtgaaggctcagcagaggtgggatcccacgccccctcccggcccctccctgccctccattcagggagaaacctctccttcccgtgtgagaagggccagagggtccaggcatcccaagtccagcgtgaagggccacagcccctcttggctgccaagcacgcagatcccatggacatttggggaaagggctccttgggctgctggtgaacttctgtggccaccacctcctgctcctgacctccctgggagggtgctatcagttctgtcctggccctttcagttttataagttggtttccagcccccagtgtcctgacttctgtctgccacatgaggagggaggccctgcctgtgtgggagggtggttactgtgggtggaatagtggaggccttcaactgattagacaaggcccgcccacatcttggagggcatctgccttactgattaaaatgtcaatgtaatctaacttagcgtcgagttcctcacttacttttatcctttactcttgtatgatttatactcctt

SEQ ID NO: 112948 - DNA, 2579 bp, Homo sapiens
cgacgggggcggggcctgggtgcgggtgccgcgtggcggccgcagcgctgagggagccggtgccatctgtgggggctttgggccagggtctccggacagcatgagcgtgggcttcatcggcgctggccagctggcttttgccctggccaagggcttcacagcagcaggcgtcttggctgcccacaagataatggctagctccccagacatggacctggccacagtttctgctctcaggaagatgggggtgaagttgacaccccacaacaaggagacggtgcagcacagtgatgtgctcttcctggctgtgaagccacacatcatccccttcatcctggatgaaataggcgccgacattgaggacagacacattgtggtgtcctgcgcggccggcgtcaccatcagctccattgagaagaagctgtcagcgtttcggccagcccccagggtcatccgctgcatgaccaacactccagtcgtggtgcgggagggggccaccgtgtatgccacaggcacgcacgcccaggtggaggacgggaggctcatggagcagctgctgagcagcgtgggcttctgcacggaggtggaagaggacctgattgatgccgtcacggggctcagtggcagcggccccgcctacgcattcacagccctggatgccctggctgatgggggtgtgaagatgggacttccaaggcgcctggcagtccgcctcggggcccaggccctcctgggggctgccaagatgctgctgcactcagaacagcacccaggccagctcaaggacaacgtcagctctcctggtggggccaccatccatgccttgcatgtgctggagagtgggggcttccgctccctgctcatcaacgctgtggaggcctcctgcatccgcacacgggagctgcagtccatggctgaccaggagcaggtgtcaccagccgccatcaagaagaccatcctggacaaggtgaagctggactcccctgcagggaccgctctgtcgccttctggccacaccaagctgctcccccgcagcctggccccagcgggcaaggattgacacgtcctgcctgaccaccatcctgccaccaccttctcttctcttgtcactagggggactagggggtccccaaagtggcccactttctgtggctctgatcagcgcaggggccagccagggacatagccagggaggggccacatcacttcccactggaaatctctgtggtctgcaagtgcttcccagcccagaacaggggtggattccccaacctcaacctcctttcttctctgctcccaaaccatgtcaggaccaccttcctctagagctcgggagcccggagggtcttcacccactcctactccagtatcagctggcacgggctccttcctgagagcaaaggtcaaggaccccctctgtgaaggctcagcagaggtgggatcccacgccccctcccggcccctccctgccctccattcagggagaaacctctccttcccgtgtgagaagggccagagggtccaggcatcccaagtccagcgtgaagggccacagcccctcttggctgccaagcacgcagatcccatggacatttggggaaagggctccttgggctgctggtgaacttctgtggccaccacctcctgctcctgacctccctgggagggtgctatcagttctgtcctggccctttcagttttataagttggtttccagcccccagtgtcctgacttctgtctgccacatgaggagggaggccctgcctgtgtgggagggtggttactgtgggtggaatagtggaggccttcaactgattagacaaggcccgcccacatcttggagggccttgtgctatcagatctgtccatggccctttacagatataataagtcggtacaccagaaccaccagatgtactgacttctgtcatgcacatgacggagggacgccatgacatgatgtgggagggcatggctcaaccatgtgtcgtgggcaactacgtggaggcactttcaacctgattagcaacaaggcccgccccaacatcatagaagaggaaatctgggcataacagaatacaatgtcaacatgtaatctacaacaacagaaacaaaaacacacgaaaagacatccgcagagagacatatgaccagagcaggagaaacggagagagaactcatcatcaacaacggcaaacgccgcgccagcgccccaagcatcagacaaaagagaggaaaccgaagagacaaccaaagacgggagcgaacaacgcacagaacacgcagtaacacgaccaacgaccggcgagaccaaggcgaagcacgaggcgcaggaggacggagagcgacaggaccgggacatcacacttgtgcacacaacccgcgccgacgcaacgccagagagcaccacaagacttcccgcccaaaacaaccaacagattggacaaacagaactcagaaaaccctccacacaccaggtccagcgcatcacagagagaaggacgagaagcagcagaagccgagcgacccgcagacccaacgcgcagccaacgacgccgcacacccgcaggccccggtg

SEQ ID NO: 112949 - DNA, 1560 bp, Homo sapiens
  misc_feature (1428)..(1428): n is a, c, g, or t
cgacgggggcggggcctgggtgcgggtgccgcgtggcggccgcagcgctgagggagccggtgccatctgtgggggctttgggccagggtctccggacagcatgagcgtgggcttcatcggcgctggccagctggcttttgccctggccaagggcttcacagcagcaggcgtcttggctgcccacaagataatggctagctccccagacatggacctggccacagtttctgctctcaggaagatgggggtgaagttgacaccccacaacaaggagacggtgcagcacagtgatgtgctcttcctggctgtgaagccacacatcatccccttcatcctggatgaaataggcgccgacattgaggacagacacattgtggtgtcctgcgcggccggcgtcaccatcagctccattgagaagaagctgtcagcgtttcggccagcccccagggtcatccgctgcatgaccaacactccagtcgtggtgcgggagggggccaccgtgtatgccacaggcacgcacgcccaggtggaggacgggaggctcatggagcagctgctgagcagcgtgggcttctgcacggaggtggaagaggacctgattgatgccgtcacggggctcagtggcagcggccccgcctacgcattcacagccctggatgccctggctgatgggggtgtgaagatgggacttccaaggcgcctggcagtccgcctcggggcccaggccctcctgggggctgccaagatgctgctgcactcagaacagcacccaggccagctcaaggacaacgtcagctctcctggtggggccaccatccatgccttgcatgtgctggagagtgggggcttccgctccctgctcatcaacgctgtggaggcctcctgcatccgcacacgggagctgcagtccatggctgaccaggagcaggtgtcaccagccgccatcaagaagaccatcctggacaaggtgaagctggactcccctgcagggaccgctctgtcgccttctggccacaccaagctgctcccccgcagcctggccccagcgggcaaggattgacacgtcctgcctgaccaccatcctgccaccaccttctcttctcttgtcactagggggactagggggtccccaaagtggcccactttctgtggctctgatcagcgcaggggccagccagggacatagccagggaggggccacatcacttcccactggaaatctctgtggtctgcaagtgcttcccagcccagaacaggggtggattccccaacctcaacctcctttcttctctgctcccaaaccatgtcaggaccaccttcctctagagctcgggagcccggagggtcttcacccactcctactccagtatcagctggcacgggctccttcctgagagcaaaggtcaaggaccccctctgtgaaggcanaaggtggattccggccttccggcctcgctcataaggaaaacctctcggagaaagcaaggcggtcacacgaaggcaccctggaacgacagatggcaggctggggatgacccggcccgcgggcatgcgccctag

SEQ ID NO: 112950 - DNA, 1579 bp, Homo sapiens
cgacgggggcggggcctgggtgcgggtgccgcgtggcggccgcagcgctgagggagccggtgccatctgtgggggctttgggccagggtctccggacagcatgagcgtgggcttcatcggcgctggccagctggcttttgccctggccaagggcttcacagcagcaggcgtcttggctgcccacaagataatggctagctccccagacatggacctggccacagtttctgctctcaggaagatgggggtgaagttgacaccccacaacaaggagacggtgcagcacagtgatgtgctcttcctggctgtgaagccacacatcatccccttcatcctggatgaaataggcgccgacattgaggacagacacattgtggtgtcctgcgcggccggcgtcaccatcagctccattgagaagaagctgtcagcgtttcggccagcccccagggtcatccgctgcatgaccaacactccagtcgtggtgcgggagggggccaccgtgtatgccacaggcacgcacgcccaggtggaggacgggaggctcatggagcagctgctgagcagcgtgggcttctgcacggaggtggaagaggacctgattgatgccgtcacggggctcagtggcagcggccccgcctacgcattcacagccctggatgccctggctgatgggggtgtgaagatgggacttccaaggcgcctggcagtccgcctcggggcccaggccctcctgggggctgccaagatgctgctgcactcagaacagcacccaggccagctcaaggacaacgtcagctctcctggtggggccaccatccatgccttgcatgtgctggagagtgggggcttccgctccctgctcatcaacgctgtggaggcctcctgcatccgcacacgggagctgcagtccatggctgaccaggagcaggtgtcaccagccgccatcaagaagaccatcctggacaaggtgaagctggactcccctgcagggaccgctctgtcgccttctggccacaccaagctgctcccccgcagcctggccccagcgggcaaggattgacacgtcctgcctgaccaccatcctgccaccaccttctcttctcttgtcactagggggactagggggtccccaaagtggcccactttctgtggctctgatcagcgcaggggccagccagggacatagccagggaggggccacatcacttcccactggaaatctctgtggtctgcaagtgcttcccagcccagaacaggggtggattccccaacctcaacctcctttcttctctgctcccaaaccatgtcaggaccaccttcctctagagctcgggagcccggagggtcttcacccactcctactccagtatcagctggcacgggcccctttcagttttataagttggtttccagcccccagtgtcctgacttctgtctgccacatgaggagggaggccctgcctgtgtgggagggtggttactgtgggtggaatagtggaggccttcaactgattagacaaggcccgcccacatcttggagggcatctgccttactgattaaaatgtcaatgtaatctaa

SEQ ID NO: 112951 - DNA, 1719 bp, Homo sapiens
cgacgggggcggggcctgggtgcgggtgccgcgtggcggccgcagcgctgagggagccggtgccatctgtgggggctttgggccagggtctccggacagcatgagcgtgggcttcatcggcgctggccagctggcttttgccctggccaagggcttcacagcagcaggcgtcttggctgcccacaagataatggctagctccccagacatggacctggccacagtttctgctctcaggaagatgggggtgaagttgacaccccacaacaaggagacggtgcagcacagtgatgtgctcttcctggctgtgaagccacacatcatccccttcatcctggatgaaataggcgccgacattgaggacagacacattgtggtgtcctgcgcggccggcgtcaccatcagctccattgagaagaagctgtcagcgtttcggccagcccccagggtcatccgctgcatgaccaacactccagtcgtggtgcgggagggggccaccgtgtatgccacaggcacgcacgcccaggtggaggacgggaggctcatggagcagctgctgagcagcgtgggcttctgcacggaggtggaagaggacctgattgatgccgtcacggggctcagtggcagcggccccgcctacgcattcacagccctggatgccctggctgatgggggtgtgaagatgggacttccaaggcgcctggcagtccgcctcggggcccaggccctcctgggagctgcagtccatggctgaccaggagcaggtgtcaccagccgccatcaagaagaccatcctggacaaggtgaagctggactcccctgcagggaccgctctgtcgccttctggccacaccaagctgctcccccgcagcctggccccagcgggcaaggattgacacgtcctgcctgaccaccatcctgccaccaccttctcttctcttgtcactagggggactagggggtccccaaagtggcccactttctgtggctctgatcagcgcaggggccagccagggacatagccagggaggggccacatcacttcccactggaaatctctgtggtctgcaagtgcttcccagcccagaacaggggtggattccccaacctcaacctcctttcttctctgctcccaaaccatgtcaggaccaccttcctctagagctcgggagcccggagggtcttcacccactcctactccagtatcagctggcacgggctccttcctgagagcaaaggtcaaggaccccctctgtgaaggctcagcagaggtgggatcccacgccccctcccggcccctccctgccctccattcagggagaaacctctccttcccgtgtgagaagggccagagggtccaggcatcccaagtccagcgtgaagggccacagcccctcttggctgccaagcacgcagatcccatggacatttggggaaagggctccttgggctgctggtgaacttctgtggccaccacctcctgctcctgacctccctgggagggtgctatcagttctgtcctggccctttcagttttataagttggtttccagcccccagtgtcctgacttctgtctgccacatgaggagggaggccctgcctgtgtgggagggtggttactgtgggtggaatagtggaggccttcaactgattagacaaggcccgcccacatcttggagggcatctgccttactgattaaaatgtcaatgtaatctaa

SEQ ID NO: 112952 - DNA, 2119 bp, Homo sapiens
cgacgggggcggggcctgggtgcgggtgccgcgtggcggccgcagcgctgaggggtgggtacgacccgcgcacggtagctgggttggggtcgggctccgggaatggtgggcggcggtcgccgggtggggcgcgacggtagcccagttctgggcggggtgggaacccagacgggggacccctaggcgccgggccctccctctccccgtacttttcccccttcccagtcatttcttctgcggaacctccacccctccagtgggtgcgggaccctaggcagcaggccaggcaccgccgctctgactgggggccccgaagcagttaacgggccggacagcaaagtggaaagttagaccagctgggaccaggggaggtgggcacccggctgcgggaggagcggccaggctggcactgcccccctaacttgctctcgatcctgccggtctcgtcccgcagagccggtgccatctgtgggggctttgggccagggtctccggacagcatgagcgtgggcttcatcggcgctggccagctggcttttgccctggccaagggcttcacagcagcaggcgtcttggctgcccacaagataatggctagctccccagacatggacctggccacagtttctgctctcaggaagatgggggtgaagttgacaccccacaacaaggagacggtgcagcacagtgatgtgctcttcctggctgtgaagccacacatcatccccttcatcctggatgaaataggcgccgacattgaggacagacacattgtggtgtcctgcgcggccggcgtcaccatcagctccattgagaagaagctgtcagcgtttcggccagcccccagggtcatccgctgcatgaccaacactccagtcgtggtgcgggagggggccaccgtgtatgccacaggcacgcacgcccaggtggaggacgggaggctcatggagcagctgctgagcagcgtgggcttctgcacggaggtggaagaggacctgattgatgccgtcacggggctcagtggcagcggccccgcctacgcattcacagccctggatgccctggctgatgggggtgtgaagatgggacttccaaggcgcctggcagtccgcctcggggcccaggccctcctgggagctgcagtccatggctgaccaggagcaggtgtcaccagccgccatcaagaagaccatcctggacaaggtgaagctggactcccctgcagggaccgctctgtcgccttctggccacaccaagctgctcccccgcagcctggccccagcgggcaaggattgacacgtcctgcctgaccaccatcctgccaccaccttctcttctcttgtcactagggggactagggggtccccaaagtggcccactttctgtggctctgatcagcgcaggggccagccagggacatagccagggaggggccacatcacttcccactggaaatctctgtggtctgcaagtgcttcccagcccagaacaggggtggattccccaacctcaacctcctttcttctctgctcccaaaccatgtcaggaccaccttcctctagagctcgggagcccggagggtcttcacccactcctactccagtatcagctggcacgggctccttcctgagagcaaaggtcaaggaccccctctgtgaaggctcagcagaggtgggatcccacgccccctcccggcccctccctgccctccattcagggagaaacctctccttcccgtgtgagaagggccagagggtccaggcatcccaagtccagcgtgaagggccacagcccctcttggctgccaagcacgcagatcccatggacatttggggaaagggctccttgggctgctggtgaacttctgtggccaccacctcctgctcctgacctccctgggagggtgctatcagttctgtcctggccctttcagttttataagttggtttccagcccccagtgtcctgacttctgtctgccacatgaggagggaggccctgcctgtgtgggagggtggttactgtgggtggaatagtggaggccttcaactgattagacaaggcccgcccacatcttggagggcatctgccttactgattaaaatgtcaatgtaatctaa

SEQ ID NO: 112953 - DNA, 1858 bp, Homo sapiens
cgacgggggcggggcctgggtgcgggtgccgcgtggcggccgcagcgctgagggagccggtgccatctgtgggggctttgggccagggtctccggacagcatgagcgtgggcttcatcggcgctggccagctggcttttgccctggccaagggcttcacagcagcaggcgtcttggctgcccacaagataatggctagctccccagacatggacctggccacagtttctgctctcaggaagatgggggtgaagttgacaccccacaacaaggagacggtgcagcacagtgatgtgctcttcctggctgtgaagccacacatcatccccttcatcctggatgaaataggcgccgacattgaggacagacagtcaccatcagctccattgagaagaagctgtcagcgtttcggccagcccccagggtcatccgctgcatgaccaacactccagtcgtggtgcgggagggggccaccgtgtatgccacaggcacgcacgcccaggtggaggacgggaggctcatggagcagctgctgagcagcgtgggcttctgcacggaggtggaagaggacctgattgatgccgtcacggggctcagtggcagcggccccgcctacgcattcacagccctggatgccctggctgatgggggtgtgaagatgggacttccaaggcgcctggcagtccgcctcggggcccaggccctcctgggggctgccaagatgctgctgcactcagaacagcacccaggccagctcaaggacaacgtcagctctcctggtggggccaccatccatgccttgcatgtgctggagagtgggggcttccgctccctgctcatcaacgctgtggaggcctcctgcatccgcacacgggagctgcagtccatggctgaccaggagcaggtgtcaccagccgccatcaagaagaccatcctggacaaggtgaagctggactcccctgcagggaccgctctgtcgccttctggccacaccaagctgctcccccgcagcctggccccagcgggcaaggattgacacgtcctgcctgaccaccatcctgccaccaccttctcttctcttgtcactagggggactagggggtccccaaagtggcccactttctgtggctctgatcagcgcaggggccagccagggacatagccagggaggggccacatcacttcccactggaaatctctgtggtctgcaagtgcttcccagcccagaacaggggtggattccccaacctcaacctcctttcttctctgctcccaaaccatgtcaggaccaccttcctctagagctcgggagcccggagggtcttcacccactcctactccagtatcagctggcacgggctccttcctgagagcaaaggtcaaggaccccctctgtgaaggctcagcagaggtgggatcccacgccccctcccggcccctccctgccctccattcagggagaaacctctccttcccgtgtgagaagggccagagggtccaggcatcccaagtccagcgtgaagggccacagcccctcttggctgccaagcacgcagatcccatggacatttggggaaagggctccttgggctgctggtgaacttctgtggccaccacctcctgctcctgacctccctgggagggtgctatcagttctgtcctggccctttcagttttataagttggtttccagcccccagtgtcctgacttctgtctgccacatgaggagggaggccctgcctgtgtgggagggtggttactgtgggtggaatagtggaggccttcaactgattagacaaggcccgcccacatcttggagggcatctgccttactgattaaaatgtcaatgtaatctaa

SEQ ID NO: 112954 - DNA, 1311 bp, Homo sapiens
cgacgggggcggggcctgggtgcgggtgccgcgtggcggccgcagcgctgagggagccggtgccatctgtgggggctttgggccagggtctccggacagcatgagcgtgggcttcatcggcgctggccagctggcttttgccctggccaagggcttcacagcagcaggcgtcttggctgcccacaagataatggctagctccccagacatggacctggccacagtttctgctctcaggaagatgggggtgaagttgacaccccacaacaaggagacggtgcagcacagtgatgtgctcttcctggctgtgaagccacacatcatccccttcatcctggatgaaataggcgccgacattgaggacagacacattgtggtgtcctgcgcggccggcgtcaccatcagctccattgagaagaagctgtcagcgtttcggccagcccccagggtcatccgctgcatgaccaacactccagtcgtggtgcgggagggggccaccgtgtatgccacaggcacgcacgcccaggtggaggacgggaggctcatggagcagctgctgagcagcgtgggcttctgcacggaggtggaagaggacctgattgatgccgtcacggggctcagtggcagcggccccgcctacgcattcacagccctggatgccctggctgatgggggtgtgaagatgggacttccaaggcgcctggcagtccgcctcggggcccaggccctcctgggggctgccaagatgctgctgcactcagaacagcacccaggccagctcaaggacaacgtcagctctcctggtggggccaccatccatgccttgcatgtgctggagagtgggggcttccgctccctgctcatcaacgctgtggaggcctcctgcatccgcacacgcggtgggcccccgcgctgcccgcttccctggtctccagtccttgcatggcagaggcctctctcacacacatctgctcattcacgcactcagcagatacgtattgagctccagcccagtgttgcgcaggacacagggggccccgaggttccctgggttactgtgggcagtgcccctccccaccttccgtttcctgcgaggagggaacatccatagagggacccggatgctgtgccctgtgctccccacataggttcaccattgtcatagctaggagtgtcatttgagccaggggccacaccagtggggtggcgggggtggcagccaccattaggaaacttctgtgggggcccaccttcctcctgcctcggtgggggattaagttagaccagtaggacacgcagcaacatccaggc

SEQ ID NO: 112955 - DNA, 1366 bp, Homo sapiens
tcttagtagcccgggttaatcggacgaggggagcagctgctgagcagcgtgggcttctgcacggaggtggaagaggacctgattgatgccgtcacggggctcagtggcagcggccccgcctacgcattcacagccctggatgccctggctgatgggggtgtgaagatgggacttccaaggcgcctggcagtccgcctcggggcccaggccctcctgggggctgccaagatgctgctgcactcagaacagcacccaggccagctcaaggacaacgtcagctctcctggtggggccaccatccatgccttgcatgtgctggagagtgggggcttccgctccctgctcatcaacgctgtggaggcctcctgcatccgcacacgggagctgcagtccatggctgaccaggagcaggtgtcaccagccgccatcaagaagaccatcctggacaaggtgaagctggactcccctgcagggaccgctctgtcgccttctggccacaccaagctgctcccccgcagcctggccccagcgggcaaggattgacacgtcctgcctgaccaccatcctgccaccaccttctcttctcttgtcactagggggactagggggtccccaaagtggcccactttctgtggctctgatcagcgcaggggccagccagggacatagccagggaggggccacatcacttcccactggaaatctctgtggtctgcaagtgcttcccagcccagaacaggggtggattccccaacctcaacctcctttcttctctgctcccaaaccatgtcaggaccaccttcctctagagctcgggagcccggagggtcttcacccactcctactccagtatcagctggcacgggctccttcctgagagcaaaggtcaaggaccccctctgtgaaggctcagcagaggtgggatcccacgccccctcccggcccctccctgccctccattcagggagaaacctctccttcccgtgtgagaagggccagagggtccaggcatcccaagtccagcgtgaagggccacagcccctcttggctgccaagcacgcagatcccatggacatttggggaaagggctccttgggctgctggtgaacttctgtggccaccacctcctgctcctgacctccctgggagggtgctatcagttctgtcctggccctttcagttttataagttggtttccagcccccagtgtcctgacttctgtctgccacatgaggagggaggccctgcctgtgtgggagggtggttactgtgggtggaatagtggaggccttcaactgattagacaaggcccgcccacatcttggagggcatctgccttactgattaaaatgtcaatgtaatctaa

SEQ ID NO: 112956 - DNA, 1646 bp, Homo sapiens
cgacgggggcggggcctgggtgcgggtgccgcgtggcggccgcagcgctgaggggtgggtacgacccgcgcacgagccggtgccatctgtgggggctttgggccagggtctccggacagcatgagcgtgggcttcatcggcgctggccagctggcttttgccctggccaagggcttcacagcagcaggcgtcttggctgcccacaagataatggctagctccccagacatggacctggccacagtttctgctctcaggaagatgggggtgaagttgacaccccacaacaaggagacggtgcagcacagtgatgtgctcttcctggctgtgaagccacacatcatccccttcatcctggatgaaataggcgccgacattgaggacagacacattgtggtgtcctgcgcggccggcgtcaccatcagctccattgagaagaagctgtcagcgtttcggccagcccccagggtcatccgctgcatgaccaacactccagtcgtggtgcgggagggggccaccgtgtatgccacaggcacgcacgcccaggtggaggacgggaggctcatggagcagctgctgagcagcgtgggcttctgcacggaggtggaagaggacctgattgatgccgtcacggggctcagtggcagcggccccgcctacggagctgcagtccatggctgaccaggagcaggtgtcaccagccgccatcaagaagaccatcctggacaaggtgaagctggactcccctgcagggaccgctctgtcgccttctggccacaccaagctgctcccccgcagcctggccccagcgggcaaggattgacacgtcctgcctgaccaccatcctgccaccaccttctcttctcttgtcactagggggactagggggtccccaaagtggcccactttctgtggctctgatcagcgcaggggccagccagggacatagccagggaggggccacatcacttcccactggaaatctctgtggtctgcaagtgcttcccagcccagaacaggggtggattccccaacctcaacctcctttcttctctgctcccaaaccatgtcaggaccaccttcctctagagctcgggagcccggagggtcttcacccactcctactccagtatcagctggcacgggctccttcctgagagcaaaggtcaaggaccccctctgtgaaggctcagcagaggtgggatcccacgccccctcccggcccctccctgccctccattcagggagaaacctctccttcccgtgtgagaagggccagagggtccaggcatcccaagtccagcgtgaagggccacagcccctcttggctgccaagcacgcagatcccatggacatttggggaaagggctccttgggctgctggtgaacttctgtggccaccacctcctgctcctgacctccctgggagggtgctatcagttctgtcctggccctttcagttttataagttggtttccagcccccagtgtcctgacttctgtctgccacatgaggagggaggccctgcctgtgtgggagggtggttactgtgggtggaatagtggaggccttcaactgattagacaaggcccgcccacatcttggagggcatctgccttactgattaaaatgtcaatgtaatctaa

SEQ ID NO: 112957 - DNA, 1488 bp, Homo sapiens
cgacgggggcggggcctgggtgcgggtgccgcgtggcggccgcagcgctgagggagccggtgccatctgtgggggctttgggccagggtctccggacagcatgagcgtgggcttcatcggcgctggccagctggcttttgccctggccaagggcttcacagcagcaggcgtcttggctgcccacaagataatggctagctccccagacatggacctggccacagtttctgctctcaggaagatgggggtgaagttgacaccccacaacaaggagacggtgcagcacagtgatgtgctcttcctggctgtgaagccacacatcatccccttcatcctggatgaaataggcgccgacattgaggacagacacattgtggtgtcctgcgcggccggcgtcaccatcagctccattgagaagaagctgtcagcgtttcggccagcccccagggtcatccgctgcatgaccaacactccagtcgtggtgcgggagggggccaccgtgtatgccacaggcacgcacgcccaggtggaggacgggaggctcatggagcagctgctgagcagcgtgggcttctgcacggaggtggaagaggacctgattgatgccgtcacggggctcagtggcagcggccccgcctaccctggccccagcgggcaaggattgacacgtcctgcctgaccaccatcctgccaccaccttctcttctcttgtcactagggggactagggggtccccaaagtggcccactttctgtggctctgatcagcgcaggggccagccagggacatagccagggaggggccacatcacttcccactggaaatctctgtggtctgcaagtgcttcccagcccagaacaggggtggattccccaacctcaacctcctttcttctctgctcccaaaccatgtcaggaccaccttcctctagagctcgggagcccggagggtcttcacccactcctactccagtatcagctggcacgggctccttcctgagagcaaaggtcaaggaccccctctgtgaaggctcagcagaggtgggatcccacgccccctcccggcccctccctgccctccattcagggagaaacctctccttcccgtgtgagaagggccagagggtccaggcatcccaagtccagcgtgaagggccacagcccctcttggctgccaagcacgcagatcccatggacatttggggaaagggctccttgggctgctggtgaacttctgtggccaccacctcctgctcctgacctccctgggagggtgctatcagttctgtcctggccctttcagttttataagttggtttccagcccccagtgtcctgacttctgtctgccacatgaggagggaggccctgcctgtgtgggagggtggttactgtgggtggaatagtggaggccttcaactgattagacaaggcccgcccacatcttggagggcatctgccttactgattaaaatgtcaatgtaatctaa

SEQ ID NO: 112958 - DNA, 1096 bp, Homo sapiens
accacaaagattccagtgggaagtgatgtggcccctccctggctgatgggggtgtgaagatgggacttccaaggcgcctggcagtccgcctcggggcccaggccctcctgggagctgcagtccatggctgaccaggagcaggtgtcaccagccgccatcaagaagaccatcctggacaaggtgaagctggactcccctgcagggaccgctctgtcgccttctggccacaccaagctgctcccccgcagcctggccccagcgggcaaggattgacacgtcctgcctgaccaccatcctgccaccaccttctcttctcttgtcactagggggactagggggtccccaaagtggcccactttctgtggctctgatcagcgcaggggccagccagggacatagccagggaggggccacatcacttcccactggaaatctctgtggtctgcaagtgcttcccagcccagaacaggggtggattccccaacctcaacctcctttcttctctgctcccaaaccatgtcaggaccaccttcctctagagctcgggagcccggagggtcttcacccactcctactccagtatcagctggcacgggctccttcctgagagcaaaggtcaaggaccccctctgtgaaggctcagcagaggtgggatcccacgccccctcccggcccctccctgccctccattcagggagaaacctctccttcccgtgtgagaagggccagagggtccaggcatcccaagtccagcgtgaagggccacagcccctcttggctgccaagcacgcagatcccatggacatttggggaaagggctccttgggctgctggtgaacttctgtggccaccacctcctgctcctgacctccctgggagggtgctatcagttctgtcctggccctttcagttttataagttggtttccagcccccagtgtcctgacttctgtctgccacatgaggagggaggccctgcctgtgtgggagggtggttactgtgggtggaatagtggaggccttcaactgattagacaaggcccgcccacatcttggagggcatctgccttactgattaaaatgtcaatgtaatctaa

SEQ ID NO: 112959 - DNA, 207 bp, Homo sapiens
gctctttgattttaaatcagactgaaaattctccatccagttccttgtcttcatgtctagacaattataataaaaacaaaatatccatatctctgcttccacttcccattctgctttctttttctgtgcacagcagattccagagatagtaccagctttgctaaggccactcgctgctaaacacaaaatccacctgtagctcccctt

SEQ ID NO: 112960 - DNA, 290 bp, Homo sapiens
ccggcgtggtggcacatgcctgtaatcccagctactcgggaggttgaggcaggagaattgcttgaacacgggaggcggaggttgcagtgagctgagatcgtaccactgcaatccaacctgggcaacaagagcaaaatcccatctcaaaaaaaaaaaaaataaaaaaaataaagaactctggtgtcacacactcaggttccgatccagatccccactcgctagctgtgtgactttgagcaaactgtttcacctttcttccctcagtctctccatccccaagtgggggtaat

SEQ ID NO: 112961 - DNA, 532 bp, Homo sapiens
cagaaccttcacagacaggtaggaagtgcatacccagaaaagacaggacatgctcaggcagtcctactcactccaagttcagctcatcctaacaaagacaacttgccaaattagatgggcaactcacattcttctcaatccctccccaccggaggaacaagcacctcaactgaaacatgccccagtcaccacccacgtccccaagtcagcaccttgacctggtttccacatctccatcactagcatggaactcttgttggggtcataaagcttacttcttttgctttttgtcttacttcttacctatgtttcacagtttagaaagaacatttcttactaagacaaaaactgtattgtacagacacttggaccttgctgacatgagtcacgttttacaacaaaatgcacatgccttagaaatctggcacataagggcttccaagaccatcaagcagttgttctcaaacttcagtgtgctaaagactgactgaggtgcttatttaaaatgcaaatttgggggccccaaccagag

SEQ ID NO: 112962 - DNA, 130 bp, Homo sapiens
caggcaggatggcccctgtttctcaggccttgggttttattgctaggataccaggctgctagaatccgatggagttatatcgaggggctgaggcatacaggagcgtgaattctgctgagccgggcggatc

SEQ ID NO: 112963 - DNA, 359 bp, Homo sapiens
ctcaaattattactgggggcttcaaagcatttaaatagaattaaattcaagtttatgagtattcatattcctaaatgatacaaaagcaggatctttcctattgagagttatagggcataaatattaaaatctttagtaaggccaggcgcagtagctcacgcctgtaatcctagcactttggaagaccaaggcaagtggatcacctgaggtcaggaattcaagaccagcctggccaacatggtgaaaccccatctctactaaaaataccaaaattagccaggcgtggtggcaggcacctgtagtcccagctgcttgggaggctgaggcaggagaatcgcttgaacccaggaggcagtggt

SEQ ID NO: 112964 - DNA, 736 bp, Homo sapiens
gaggcctttcccacagggtatgagaaagccactgtggtcatttcttcccttctgtcagacataattcctcgtttggcttttccacctctatacagtccgataacggacaggcctttattagtcaaatcacccaagcagtttctcaggctcttggtgttcagtgaactaacggtctttttaaaacacacttcaccaagctcagccaccaacttaaaaaggactggatacttttaccactttcccttctcagaattcgggcttgtcctcaaaatgttacagggtacagcccatttgagctcctgtatagatgctccttttattaggccccagtctcattccagacatcagaccaacttggactgcaccccaaaaacttgtcatccctactgtcttctgtctagtcatactcctattcaccattatcaactactcataaatgccctgctcttctttacactgccggtttacactgtttctccaagccatcacagctgatatctcctggtgctatccccaaaccgccactcttaactcttaaagtaaataaataatctttgctggcagggctatgctgaacccccttgagcactctctaattggatgtcctaggtcctcccaattcttagtcatttaatacctgtttttctccttctcttatttggaccttgtgtcttctgtttagtttctcaattcataacaaaactgtatccaggccatcaccaatcattctatatga

SEQ ID NO: 112965 - DNA, 459 bp, Homo sapiens
catctttattcttttcagtttttttctccgttgcccaggcttggagtgcagtggcgtgatctcggttcactgtaacctccacctcttgggttcaagcgattcttctgcctcagctattgaggaggctaaggcaagagaattgcttgaactcaggaggtggaggttgcagcgagccaagatcgcaccactgcactccagcctggacaacgagagcgaaactccatctcaaacaaacaaacaaaaaaaattgaaaagtgttcatgtacagaagttaaacaaaatgtatcctaaatataaataattaattctgacagagtaactaggaaatgcctcacagaggagctggtttttgaactagaccataaaggataagtaggatttccataggaagaaagagcagtcaaggctgaggaaaagcatgattaaggacaggagcaagatttaaaaaaaaaaaaaaaa

SEQ ID NO: 112966 - DNA, 504 bp, Homo sapiens
gaaatggctgcccactaaaaccgtgtgttaagatgtgatgctagcatccccctttatcatcgtaagaagcagtgtgatgtgatagcttagagcctggatgccagagctagctggcccagtaaccagctgtgtgacctcaggcaagtgataccagctctctgtttccttatctgtagcatggggatgataataggactttattcctagggttgttctgatgatcaattgatatacagaaagtgcctacccggaagatgctatatgagagttagctattattattttcataaagcttgccttgaccatgttaatccagtttaaaagtcctcatgttgacattttaaagattgcgaaggcttctctagacagtttatagcatataaggaatgaacaattgaagaagttaagatcttaacatgtctttaaaaagaggtggagacatgcagaaaatatacatgcaaatgcaaagttctttataacataagttagactgtatcatcaagc

SEQ ID NO: 112967 - DNA, 427 bp, Homo sapiens
tcccataaaactcagtttaaggtgttcttttggaagctttccatgtcacactgtggcaagggccttcccattctggggtggatgcccctctgcctttccccagcatcctatgtggacgtcttgggtcaccttttacaatacatggacatacctggctctcctatttgccttgccttcctgtcacctctttgaagacaggaacttggttttgttcatctctatgccttgagcatttggcttagtgcctggtataagtaaatatttcagagcaaggttgggggtagaggggtcccttattcattcattcattggtttattcaatattttaggagctggggataaaacaaaaccccattctcaagctttcatgaaacttacattctgaaattggcatgggggtgaggaatggagtaaatagacattaaca

SEQ ID NO: 112968 - DNA, 498 bp, Homo sapiens
gtttcatcgggctccattggccaagccttgactcaggcaggcttgaaaccggtagaactgtccagtttttcggtagacagcctgcaaggggccgctgtgtgcccagggtcacagctctgtggagccatgggaggtgggagctggacgctggaggggaaggtcggggccaaactgaacatagcatcacatatccaggggagaaacttggacctggtctatggtaggcggggaggggtctgtgtttgtaaatattccagcagcctggtggaggatgctttggtgggcagaggtggaagaatgggggccgtgacattggaggcagtggtctgtagcagtgggaggggcaatggcagtggcagcagacatagggagattaagggtaaccccagctagtcttggggactggcgtggaggaagagggtggtgtctaggagacgaggagcaagaaggacgaggggctttggggttagacagagtggacagaactccaggttcctg

SEQ ID NO: 112969 - DNA, 469 bp, Homo sapiens
aactaaatccatttgcaatggcccttctggcatggtgaagtaaatggaaatggccccttccatgtcattgataaagacaccacggttcagaacataaagagagaaaattacattctaaacactgaggcggcctcttggccacagttttaccccttgtgctgaattttgtgtcacattaaggattcacactgaaagaaatctctttctataatcctgcaatctagttcaaaagcacacatacataaagcaaccagggaacatacaaaacagggataaagtgacattagcggtggcaggaattcatcaagaaaatactatgtgtcaagtgctcagctaagcattttcccactgaaccctcacagcaaattgggatgtacaatgacactgcagtcctcatcatagggatgaggaaattggggtttcaaggactttaagctgctttcctaagagcatagttcatggagggtta

SEQ ID NO: 112970 - DNA, 824 bp, Homo sapiens
atggtctcaatctcttgacctcgtgatctgcccgttttggtctcccaaagtgatgggattacaggcgtgagccaccgcgccaggctgagatggggtttcaccacgttggccaggctggtctggaactcctgacctcaggtgatccgcctgccttggactcccaaagtgctgggattacagacgtgagccaccgtgcccggccagttctatgagttttgatgaatgtgtcctgcttcttcccaggctccaccatctcttcccctaaaggcaaccaccattctgatttctctcaccaaagactggaccaggtatagttagttactgctgtgcctggcttcactctcactttttttttttttttctttttttgagacatagtctcgctctgtagcccaggctggagtgcagtgtggcacaatctcagctcactgcaaccttcacctcccaggttcaagcgattctcctgcctcagcctctcgagtagctgcgactacaggtgcccaccaccacacctggctaatttttgtatttttagtagagatggggtttcaccttgttggccaggctggtctcgaactcctgacctcaagtgatccacctgcctcagcctcccaaggtgctgggattgcaggccggccttacctggtatggtttttaggttcatgttgatgcctggagtttcagtaattccctcccattcgttgctgagtagcactgcaacacatgcaggcagctatttggggatcttttcacctgttgatgggtgtctggactgtttccagtttttggctgttacaaatgaagcctctgtgagccacgtacaa

SEQ ID NO: 112971 - DNA, 877 bp, Homo sapiens
atggtctcaatctcttgacctcgtgatctgcccgttttggtctcccaaagtgatgggattacaggcgtgagccaccgcgccaggctgagatggggtttcaccacgttggccaggctggtctggaactcctgacctcaggtgatccgcctgccttggactcccaaagtgctgggattacagacgtgagccaccgtgcccggccagttctatgagttttgatgaatgtgtcctgcttcttcccaggctccaccatctcttcccctaaaggcaaccaccattctgatttctctcaccaaagactggaaaaatatcccaatacctggatgtatgcctcacgtgtcccgctggccccagcacccaggtatagttagttactgctgtgcctggcttcactctcactttttttttttttttctttttttgagacatagtctcgctctgtagcccaggctggagtgcagtgtggcacaatctcagctcactgcaaccttcacctcccaggttcaagcgattctcctgcctcagcctctcgagtagctgcgactacaggtgcccaccaccacacctggctaatttttgtatttttagtagagatggggtttcaccttgttggccaggctggtctcgaactcctgacctcaagtgatccacctgcctcagcctcccaaggtgctgggattgcaggccggccttacctggtatggtttttaggttcatgttgatgcctggagtttcagtaattccctcccattcgttgctgagtagcactgcaacacatgcaggcagctatttggggatcttttcacctgttgatgggtgtctggactgtttccagtttttggctgttacaaatgaagcctctgtgagccacgtacaa

SEQ ID NO: 112972 - DNA, 396 bp, Homo sapiens
agtcaattaagtacaaaagtttttactatgactatgcagtgaggtccaaactgtactaaatttgaagttccctgccaaagagaaatgtaagcttccctggtggtataagtcagaatttcatgacatcagccagataaccacaaaagaatatatcttttagtgctagatgcttctaagcctttctccacccaactaaccaacattcacttactgatttacttatttctttaacaaacacactccatttcatagccacattctttcaaagctgacaggttgagatacatctaaaacacaaaatctccaacatacattttcttcttcaatgttgtgagatgtatttttctaaaacactgttctgcacatactaccattccaatattaaaaacaagttag

SEQ ID NO: 112973 - DNA, 606 bp, Homo sapiens
cacagcccttttggcatcacccatttatttaactaggataaaaacgaatattggtatagcgattccacagtttacaaagtgcttttgtatccactgtctcacttgatcaagcaaaaggaaaccagaggaccggagtgctgtcctgagtctaccttgatttgctaggcgacttgagggagacttttagcctcaaagggccacttaagtggaaattctaaaacagtacctattctgatcctaactcaagggaatgctgtgaatatgcatgagataaagacctcccaatatatgaagaactgggtgatttttggagaaagacattatatactcaatttcttttttaattaactttccttgaaagtattgcttaatagtttttacattctccatgtaacagactttctggatctggtgttcagtctgtacaccagatgtagatcttttttaccttctcctagaccttaaaattcctggcaacatgcctccaccctggattggggaataaaaaatgaaaagttttttttttttctttttgactttaaattttattaaagtttgaggtttttcaaactgatgtgctttatttaaaattcaagtgagacattt

SEQ ID NO: 112974 - DNA, 335 bp, Homo sapiens
gggattgacagccacctgtgaagactcacctgctaggatctggctggctgtcttggtcgctgatcatgtccgaagaagtacaccactttcttaatcatgcagcttttaaaaatctcctcagccccacacttgagggtctctctcctagattctaatgtctagccctacacgaatgcagtatgctgcccttgatgtgataggacaacagaggacctgcacacatgctactggtcctgactgtgttttccttccataaacactgttctggcaagctggttttatgtgctgctggaccatttgcttatgtttgcacaataaaccagaaattaaacttt

SEQ ID NO: 112975 - DNA, 713 bp, Homo sapiens
gaaattaattcctttgaattcagcatttcttgaacacctactctgaaccaggtggtgtgcttgacaagggctaactacaaaaaaagaggaaaggcccacagtctaggaaggtaaataaggcttaagtattgtgaattttattgtcttctacatctgctaaaaaattaatttcagtaataattggtgttctgttttagtttataaatgtgaatattcaagtgtccagtactttaatcctttgatgagtattattttagcaattttattttagagtggatagggtgtagggtgtgcttttgcagtcttagtatttttaagcaagcacaaatgcattacactaagatactttatataacctccagaaaatatctgccatttttgtttatgctgctatagaaagttaattaaatgaataccttcacatgaaaaaaatatccatggaatgtgcaatccttatgcctttatacacctttccagttaagcggtgaacttgatgagagcctgtcactgttgctccttaatcagtaggaaggggtcatcttgagtgacatgaggcactctttccctgaggcatttatcacgtagctttcacgccaattgcacctcctgctgacgtggagcttgcaaaactaggaatgataattgtttttatgacaaatgtggattgagttagaaaggtcagtgatagcgttattagaattaagctctgcctg

SEQ ID NO: 112976 - DNA, 440 bp, Homo sapiens
gagagctaaaggaaaagggaactcatatgtattgaatatcagtgactatgtcatatgctgtgttgtgtggtttatctcatttaatcatcacagcagccctgtgaaagatgaatatgattatttttattttttacagatgaagaaccaagatttaggaatataatatatcttgcttaaggtcatactagtgaggaaataaatctacatcagtcttttcaataccatgctagatgtgatgatatcattttagaaccatatgtttgatatatggaccaccatactgaaacctcagggcacatttttgtccactaataatatatatcaaggaatgtcatttcacagatgcatggatacggaaaatgtgtgtgtgtgtgtatatatatgtatgtgtatatatatgtgtgtgtgtatttgtatgtgtgtgtgtgtatacacacaca

SEQ ID NO: 112977 - DNA, 208 bp, Homo sapiens
tgcagcttgctgctgctggtcgtactctgaggtatccccggctgcacccctagactcttagttatcctttcagaccctgtccaggggtaaaacacgtggagaaacgagaagtagaaggtggggaaccctccattgctcttcacctcctgctccccaacccctacaagacagcctgggtatgggaccagcgctactttttttttttttt

SEQ ID NO: 112978 - DNA, 313 bp, Homo sapiens
ttggtaaatgcctctttagctccccatgaacagctgctgtcctttccccactggggcactcaggaggaggtgctcctgccctgcagcctcagccctcaagattcagcctgtcatagcctgatccaagctcagggataaggcagccaaagacctcagagctgcagctccatccccttactcagagttcctctgaataaatcatcacatgggtccagttatgaaaattccttctctgctactcgtgccttgctgtggtaggcagagcacggctttcagggacagacaaagcaggattttgcctcttactgcctga

SEQ ID NO: 112979 - DNA, 186 bp, Homo sapiens
tgctgggattacaggcgtgaaccaccatgcccggccagcacagcactcttgcgtttgtaccgcagcagcaatactttcaacacgctgcagggggacggctcctttgaatggcctttgtcagtgacgatccactcctaaaaaacccctcacaccctggggcctccttgaccatgcctcttttttttt

SEQ ID NO: 112980 - DNA, 241 bp, Homo sapiens
tagacttcatccctgcttccaggtactcacacacaacctggttagagaggtaagatcatgacatatcaaatcgtcagagctcaattaccatggtgtatggatgagtgccacactatgaggaaatggagggcatacacttattagtaataacccatataagtaagctccttactccttcttatgcacccacatagcacttaacagcttacaaagacagatctcattctatccaaaagttcaa

SEQ ID NO: 112981 - DNA, 302 bp, Homo sapiens
catgagttttagagactatcatctggcttgttaatgtccagggaacaactgcagtcagtgaagttaggttaacttccagctgccgggagattgcactccgggaaatcggggaggtgttcagtgagagcgtactgggaggggctggcttcaggatttggatttgtgctgagtgatttgagagagagttctgtttaccttggattgtgggctttcaggacacaggacattctgtgattgaatattttactactttttatccaggaggcaggggagtaggggcacggagtgaggctagagctgtc

SEQ ID NO: 112982 - DNA, 149 bp, Homo sapiens
agcagttgaaagaggaaaagggagtatgtttttatggaaacctcaaatgcccttccacatctcctgtgaattacctctgtgttcaggcagccgagctagacagctgcgaggagaggcgtgtggttttgatgggggccttggaaagaaaa

SEQ ID NO: 112983 - DNA, 794 bp, Homo sapiens
agtttgaaagaaggatgagcaggctctctgccatctgcccaccaacttttcaagttacttttacccaccttcaaaattacatctgcttttagcaagaattactgatgtgataaagatgggagtgttcaccatgcaagggcaggggatcccctgctgctccaccatcagatttgggacaccaccccccccggccccaccagagggcatcagctatgcctagcaattacgcccccgtggctaaattaaactcccattggctaaattaggctcgaagagaggggcacctgctgctaagctgtgtatgttgtcccctaggactcccaccgtttgctgagctccacatgacaacagcagacgacaggccgcactgatcccacctggcttacaggtgctgtcacacaggctcccttgctccttcattcaaccattgtttacatgtcgttcaggactgctgactaaacactttcaagcacagtggacccttgaacaacgcaggttcaaactgtgcaggtccacccacagggatgtttttcaatcagagttataccaagtgtccctgcctctcctgcctcccttcccacttcctccatgtcttcctctctgccaccctgaggcagcaagaccagcccctcctcctcagccactcaacatgaagacaacgaggatgaagacttctatgataatccacttccacttagtaaatgctttctcttatgatattcttaatgacattttattttcccaagcttagtttattgtaagaatacagtataaatacacatacaaaaaaaaaa

SEQ ID NO: 112984 - DNA, 809 bp, Homo sapiens
ctcctgggtacaccagccagcccacggcacagagcctgcctgttggtctctacccacaggggatcccctgctgctccaccatcagatttgggacaccaccccccccggccccaccagagggcatcagctatgcctagcaattacgcccccgtggctaaattaaactcccattggctaaattaggctcgaagagaggggcacctgctgctaagctgtgtatgttgtcccctaggactcccaccgtttgctgagctccacatgacaacagcagacgacaggccgcactgatcccacctggcttacaggtgctgtcacacaggtacgccttcttgtgaatcatcagtcaccatttgcccctcgcagcaaccctgtcttggaggaaggtccttgccgacacccgcctctccccacccttaggctcccttgctccttcattcaaccattgtttacatgtcgttcaggactgctgactaaacactttcaagcacagtggacccttgaacaacgcaggttcaaactgtgcaggtccacccacagggatgtttttcaatcagagttataccaagtgtccctgcctctcctgcctcccttcccacttcctccatgtcttcctctctgccaccctgaggcagcaagaccagcccctcctcctcagccactcaacatgaagacaacgaggatgaagacttctatgataatccacttccacttagtaaatgctttctcttatgatattcttaatgacattttattttcccaagcttagtttattgtaagaatacagtataaatacacatacaaaaaaaaaa

SEQ ID NO: 112985 - DNA, 1039 bp, Homo sapiens
agtttgaaagaaggatgagcaggctctctgccatctgcccaccaacttttcaagttacttttacccaccttcaaaattacatctgcttttagcaagaattactgatgtgataaagatgggagtgttcaccatgcaagggcaggggatcccctgctgctccaccatcagatttgggacaccaccccccccggccccaccagagggcatcagctatgcctagaaggggaccacaacagactcgacaggatccaccggttgggcccaaggcaggaggaagggcggcgcccccaaactcccaggacgcctgcagcaccccccacgcgccgctctccgcctctggggagcatcctgccaccccccgacacacacaccccggctacatcccgccttctcacgcttggtcaggcgctctggagatgtcggagatccaggcttttcctaaagagtcaggattggaaggcggactcccaccgtttgctgagctccacatgacaacagcagacgacaggccgcactgatcccacctggcttacaggtgctgtcacacaggtacgccttcttgtgaatcatcagtcaccatttgcccctcgcagcaaccctgtcttggaggaaggtccttgccgacacccgcctctccccacccttaggctcccttgctccttcattcaaccattgtttacatgtcgttcaggactgctgactaaacactttcaagcacagtggacccttgaacaacgcaggttcaaactgtgcaggtccacccacagggatgtttttcaatcagagttataccaagtgtccctgcctctcctgcctcccttcccacttcctccatgtcttcctctctgccaccctgaggcagcaagaccagcccctcctcctcagccactcaacatgaagacaacgaggatgaagacttctatgataatccacttccacttagtaaatgctttctcttatgatattcttaatgacattttattttcccaagcttagtttattgtaagaatacagtataaatacacatacaaaaaaaaaa

SEQ ID NO: 112986 - DNA, 442 bp, Homo sapiens
tatgtacaaggttattctttgcagaactgttagtaacaataaaaaaccgtaagcaacagaggactccctatatatagcatagtatagaaaggattactggctgggcgtggtgactcacacctataaacccagcactttggaagaccgcagcaggtggttcccttgagcccaggagttcgagaccaacccgggcaacaaaagaaaaccccatctctaaaaaaatacaaaaatcagccaggcatacaccagcatgcctgtagtcccacactttgggaggccgaggcgggcggatcacctgaggtcaggagttcgagaccagcctgaccaacatagagaaaccccgtctctagtaaaaatacaaaactagtcgggcatggtggcacatgcctgtaatcccagccacttgggaggctgaggcaggagaatcgcttgaatccaggag

SEQ ID NO: 112987 - DNA, 628 bp, Homo sapiens
tgctgacatttaaactcaggaaccacaccgtacatttccatttgaaaaaggttttctgtcgtccactaatgcctttaacacatcttcttaatgcctgatattaaatgtagattatttagcttaggaaaggcaaatgaatttcctgtttttcatgtaaattaatatgttccctcttagctgtaaataaaactttatggtaaatacaacttcataaagaatttttctatatcataatgtaaactgaaaatataagtatggttgtacttttcaatacttctaagacatcccatagttgccatggtaatggtataaggagtattattttaaattattttattttattttattttttgagacagggtcttgacctgtcacccaggctggagtgagtgcagtggcaaaatcatagctcactgcagccttgacctcccaggctcaaaccatccccccagcttagcttcccgagtatctgggactacaggcatgtgccaccacacccaactaatttttgtattttttgcagagacagggtttcactatgttgcccaggctggtcttgaactcctgggctcaagcaatcctctagcctcagccacccaaagtgctgggactacaggtgtgagctacc

SEQ ID NO: 112988 - DNA, 296 bp, Homo sapiens
atcaaaggagggtgactgacatttactgcatatttactgtgtgctaggtaccatacaattttctcttgtaataataatgataataacaacaaatggcatttatttagctttattattattataacctatgcatgaaactcattgatttagatacattagttcatttaatccctgtaagaatcattcaagatagatcttattgtcttttttcttttcttgcagatatgagtactattggctagagaagtttagtaactttcctgaagttttacagaagataagtatagagtgggaac

SEQ ID NO: 112989 - DNA, 458 bp, Homo sapiens
catgagggtggcttaggggaactggggaaggccaccacgcaacacagattcccatggcatcacagagggccaagggtcccaaggggactgtctgcctctacccaaggtgtggtccctttttaagcaggttgacccaggaggctccagtttcacactggctgctggggcttatctgataacagacttcccgcattcattctcaggagaaggccttaggtgcccaatcaacagcataatgacccaggcctggagccaggaatcctcacccatagcccattgcctgtggccgactgagagcctttatgggagagttcgtgggcagtctggtggctatggcgacacatgtgtgtgtgcgtctgtgtgggtgaatgcttgagcccgcacccctgggcctgtgtgaggatttgtgtgtgtgtgtgtgtgtgtgtgtgtgtgtgtgtgtgtctatgagtttgtga

SEQ ID NO: 112990 - DNA, 205 bp, Homo sapiens
cttctatcgtgagccccttacactgcttataccacttgagactccccaggctcgaactgatgcccacgcctggccaagctgggccagtcagatggtctctccagggaatctaaaacttgcacctagagggacagatgacagaagggatagaaggggcatccagagccatcgtgagaacagaggaatggcaggttcaggcacagga

SEQ ID NO: 112991 - DNA, 298 bp, Homo sapiens
ctcaagtctgcactttgtgttctttatacacaactctggcagattccatgctgcccctctaataacactgcgtttgcttgcatgccacagtgctttcctgagtgagcaataaagaggtgttagtgacacctcaggtgctcagagctgtcctttccaaccctgagcttgtcgtgtaattgagaggttgtcacctgcttggaggtgggagcatctgtgggaaggttcaggctgtgtccttatcactaaacgaggaggggaggaaggagctgcaccaggctgctagcaacaaagcagggct

SEQ ID NO: 112992 - DNA, 411 bp, Homo sapiens
cgcagagacaagcttttggaaaaatattaatagcaacaaggtatgtctatgagaaaaaccattattattccaaactttcaaaggcgccttggaaaaagggacctttgcagaagaatcggaagttcgaaaggaggagtaacttgctggggatgagaaagagccctgtggctacgtggtgtcaggaagtgggattgtcagcctcagctccttcactgaacaactgtgtgaacttggtgaagtcactgtatctctcttcaccttaactccctcaccagtacagtggaggtgttggttagagaccttcacaagtctcttctagttctaaagttctgtaatcccaactgaaatggatttaaatctatactctcatgagatttttctatgaggcctcagcatcccttctttctcttc

SEQ ID NO: 112993 - DNA, 800 bp, Homo sapiens
gcagcacgggaagaagcagctggacccgctcaccatctacggcatccggtgtcaccttttctataaatttggcatcacagaatccgactggtaccgaatcaagcagagcattgactccaagtgccgcacggcgtggcggcgcaagcagcggggccagagcctggcggtcaagagcttctcgcggagaacgcccaactcgtcctcctactgcccttcagagccgatgatgagcaccccacctcctgccagagagctcctgcagccacagccgcagccgcaggccctgcactacgcgctggccaacgtgcagcaggtgcagatccaccagatcggagaagacggacaggtgcaagtaatcccacagggacacctccacatcgccaaggtgccgcagggggagcaagtccagatcacgcaggacagcgagggcaacctccagatccatcacgtggggcaggacggtcagcttctagaggccacccgcatcccctgcctcctggccccatccgtcttcaaagccagcagtggccaggtgctgcagggtgcacagctgatcgccgtggcctcctcggaccccgcggcagcgggcgtggatgggtcgccactccagggcagcgacatccaggttcagtacgtgcagctggcgccagtgagtgaccacacggccggggcacagacggccgaagccctgcagcccacgctacagccggagatgcagctcgagcacggggccatccagattcagtgagcgggtgcccaatggcaccaggagccctcgccggtccgctacggccggcccc

SEQ ID NO: 112994 - DNA, 312 bp, Homo sapiens
tttcatatgagtggaatttttagtgggaagctcagagaaaaggaagaggagacaatagtaatataggttgcattttgggtgttgtataggagcttcaaaggaatgtgcttagctatatttagaataaatgatcacctagaatagtggttctcaaactcttaaaagttattgaagatcctaaagaactttttctaatgtggcttataactatgtattatttaccatattagaaattagaactaagaaatgtaaaatcacaagaaaatataaaccctcacaatgatgacttcgttatgcatcgggtagactctg

SEQ ID NO: 112995 - DNA, 589 bp, Homo sapiens
aagatagtatatatctgaagtagattctgaaaagttagtatgtatatagtaattctaggaaaaccactaagaaaataactcaaaaatagaaaaaaaactattaaacaaataaaatatttaagtagaaacatatatttaatgcaaaagaaaacaataaagaaggaaaagagtcaaaacaaatgagacaaaaagtaaagtggcagaccaaaatttagctctatcaataatagcattaaatgaaaataatccaattaaaagacaaggattggcagagtaaataaaaaacaaaaagaaaaacaacacatgatttaatcatatgctgtgtagaggggacactttagattcagagatagaaacaagttgaaagtaaaagaatgggaaaagatattacgcaaacagcactcataagagagctagagtggccatcctaataggaaaaataaacctatatatatacacacatatatatatataactacagataatgagagatactttattataatgaaagtggtcaattttatgaggaatgtatatgagttcaaagcataaatgcagcctacaaaagagccatgacttacatgaagca

SEQ ID NO: 112996 - DNA, 451 bp, Homo sapiens
ccaatgcaaagatgtgtgggaaagccaagcaaaaagtaactggaacagacgtgaaggcctgaagtgtgagtgtgctccccttatcctgaccatagttgcagcagcaggtagtgaaagagctcaaggtggttgattaccatctctgactaatctttaatggagtaggaagctatacagttagaggggtatctcctgcaagtcaggcttcaaaataaaaaggtggggggaaaaaccggagccatcaggaactacacattgcagaggagacagacttggtggtttagtgcaggaaagttagtaaacaaaacaaaaaacaactcatcatcaccaccaaccttagtgggggaaaagtcagaatccagagttgccaaaagcacattgttttaaatgtttagtatcacaacaaaaattaaaagacatgtagagaaacaaagtttgacccatactaagg

SEQ ID NO: 112997 - DNA, 539 bp, Homo sapiens
ttcttttcacaaggcacaaagaagatgtcagtgttcagcatctttcatcttgctgatttatctagatcttgagacactcaatctcaaaacaattaaaagcatagtagtctatggctatacacaggctggtgtctttctgctcatgctccttacatattagtaatgtctggtaccatgatattacacaccagtaatgagtcacccctcataatgttacaattttttatgtttaagtagtatatatttgctttagataatgaaacaccccacagaatagaaagatcaagggatgttaggagtcaaataaagctacatagaacaggattggtctctggatctcaaggtaaagctaattaaattgggttgaggcttgtcatttggaaatgatagtaagttttctttcctggctatgaaaaaaataagagagttagttgggttgccatttccagaagcaaagcaatctttatctgcttttttttttttcttttcccccctttctctgttattttaatcttccctgtgcattatgtagcctggct

SEQ ID NO: 112998 - DNA, 603 bp, Homo sapiens
ccacaagatattcccctgaaataggaatcagtggtctgctgtatgagtttcccttttatgtttcttttccacagtttgcagggtaaaagataatactcctctagtttccttctttgtactccccctattatcttctcatgccataagctcaaaaacctatgtattttggatacctacattgattatatgtttatatctaaaatccaactagaatagttaaacaatgatagcaacaataacaacagcaatttaattaattatttaattaaactcatgatcttgaatctcagcaacacagacccacctgcatctccagtgtccattcagtgtctatcttattcatgtatatggaaggtctgatggatttatactgatttaatactttcttcttcttcttgtttgaacccacaagccccatcccgatgtcagaatataaattttttttttttttgctggtcttctttatgcactttgctagaattttcaacagaaagtttctattattaacagccagttgaattcagtaagtatctaccctgcatgaaatatataacacctagtacatgtgtaatataataataatttgtaataaatagtacctgt

SEQ ID NO: 112999 - DNA, 387 bp, Homo sapiens
acctccatactgttttctataatggtgcaccaaactaccttccctccaacagtgtacaaagatttccttttctccatacccttgccaacacttgttatctcttgacttttgataatggctgtcctaagagctgtgaggtgatagctcattgcagtatggatttgcattaccctgacagttaataatgttgagcaccttttcacatacttgtggccatttttatgtattctttggagaaatgtctactaatactttctcaaaaccactgacctagcttatataattgattctcaggagttgagctagcagaggtctgattatattagttcttcacaataaaaaaccaatgatgattcataacaagttttagaattaagtgtatgtggc

SEQ ID NO: 113000 - DNA, 171 bp, Homo sapiens
atatccttttcttgacttttcccacatattcctgtagtttttagagcatctttaagatggctgtttaagtctgtttctagtggatctgccatctaccctttctcagggtcagtttctgttggatttgtagttttcttttggatggaccatacttcactgtttctttgtgtg

SEQ ID NO: 113001 - DNA, 350 bp, Homo sapiens
aaaacgggcactgtctgggggaaatgattcaacaaaccttatttatctggttgttcgtccctggtgtctgggcttaccgggttcttcaccttggagatggttatagggaaggatagaggagcaagtgtttaaagatctacttgttaatattcttctaatattactgtgtacgcatccgccctgccccattctattgacctgagcacctggcattctaaagtatctctgttaactcccccagttggtctggccaaggagtactcggcacgcttggttccagaaacagaataccctgccggctggtgatggtaaaggtagaggcggggttttgtaggggcacagctggcagg

SEQ ID NO: 113002 - DNA, 304 bp, Homo sapiens
ctaatttctagacacagagtcatgaggaaccttgaattaatattttctagaattcctataatcttgcattgtatttttgtactaaaaaagtgataattcaaaaaaatgtatacataaagctcttcctcaatttatgtaatattgttgctattcactttctatctaagagccttaaaaaatgggaggtctgcatccctcttggcctgggcaaggctcccgtaggtaccaggcactctgctttctaacttccttgtatcatttcgtaatttctccaggcaacctaaaggcacagtattatctcaat

SEQ ID NO: 113003 - DNA, 321 bp, Homo sapiens
gaacagtgcctggcacatgggaatcactgtgtgggtatcagctgttgttactattgtcattgttgttattagtgatgaagaaggcagctctggagtcaggaggaaccaggcttcaggcccagctcagctatctactggctgggaggtgtggggcagcttgcctagcctcggtctcttcatctttgaaatgggctgagtagtccagcctaagactattgtgagggtcatgaggcggttggcagagcctggctttggaggaggtaatggcagtgcagggaactgcccaaggtctcagagcaaggtggcgggagcagcactggg

SEQ ID NO: 113004 - DNA, 883 bp, Homo sapiens
gataagaggattggttggttctgtgagctcacactgagagataagctggtacctagttaacaatgggcattaacaaatgccccagagcaagttgatagttaaggatgtagaaaagagttctgagagtatcctataaacctccactggcccatatgcacctttgtggagttagaaacaggtagccctccagaagggcacagagctgagggagacttcgtgaaaatgagaaaaatggagtggaagcagcccagagccaggtgcaggcataaaaccatggaaagcagaccagatgttggttcctacttccctccttgcccagggcacaacctgaacagctacctgtggcatccctgcttaggcagacctctgggataagagtaaatttacagaccaggatctaatcctattatagccgccaactgtgtgccctcagtttcttcatctgtaaaaagacagagtttgacttcatagcctttgaaatataactgcttgaatatacttgctattttaccgcagtttggctctgtctctctctctctctttgtgtgtgtgtgtatgtgtgaaagagaaagagagagagagaaagagagagaaagagaaagagatgccttgtagtacttgaaaattagaattcttgataaaataaagctctaatttgttctagtgtttcttttcaacaaaccaggggttgccaagttttaaaacattttaaaatgcattagaggaagtgagtcagttacgttcttcatacactacaatggaagtacacttagttccaagttatgaatgctgtgaaaaattaggttcttttaataaatacaagatgaaactttcaggctttcaaaattcatgttctttctttccctccttattcatattagat

SEQ ID NO: 113005 - DNA, 240 bp, Homo sapiens
aggtatacatgtgccatggtggtttgctgaaaaaaaatagaatgttttataatttttttattgagaatgcccagttatgccaagcataataaataaaggtcagtagcatttataaaagaaatgcaatgtgggatattggaaaatacctgatagctgatatctggaatcaggcagatgtgaggttagacaccagctctgaggctcactggctacttgaccctggaggaagcatttaggtgc

SEQ ID NO: 113006 - DNA, 210 bp, Homo sapiens
ggataacttgaaacagggataacagagatatcagggagggataacagaggcagttaagttactctttcacgttatcactctgtttaactatttattttaaacacattttaaaaaccagatcaggaacaacacaagtttcaaaaaattcttcagtattagaagtaaagttatcatgaagaatatgttaaaattctcacaaagaatatatta

SEQ ID NO: 113007 - DNA, 433 bp, Homo sapiens
ggagcctggctgggggagaagtgtggtctgaagggtactgggaccctgactgtgccgtgtggcttcattccttcctaagctggttggggcacatggatgcctattacagcattctgtactgtgacttatagctttcaatatgtcttaaaatatttgaaaataaaatgcagtaagtatgcatatgggttaggactgacaataaacaataaaaagtatcttttcagggcaatgaggacatgaacacttttaacccttacccccaatattttctttaacattgtgattagcaaacacacacacacacaaacacacacacacaaacacacgaacacacacgcaaacacacacacacgttctggaccaagcatgccatttcgctgcttagaagagtgtaaatcccgcatgctagctttggcatttgtgcatcctctac

SEQ ID NO: 113008 - DNA, 777 bp, Homo sapiens
ggttgaatgcctgaatgattttggaaaagggagtcaaacaacatttttaagcacctatgatatgccgtatgctcatctatgtactgatagtttggactcttactccatgtgacttacactgtaatgggggcaatgtccagggaactctgccataggtgaggtgcagggctctaaggaaatacagtagaagctccttgggtggtcagagaaaaattcctgggaaaatcatgtttaagctgtgacctaaaggatggaaaaatgatttccagatgaagaaagggcaaagcatcttccacacaacaggaattctcccggataaccatttaaacctggagcatggaatttctattcacctttgtgaatatgcagaaaatatgagagcatattctgtgtatgtcataatgtttagttttgtgtaatttagcgttaggcatcagttagatattcagttggaagttgggtggatctgcaacttaggagagaagtttgaattggatgtgtagatttgaggagttgtcaaagtacaagaggggatgtgtgaggcatgtgtaaggatgagagggatgcataaggcatgtgtaaggatgagatctcccagaaacagtgtgcagactgagggaaaatagaggcaagatgtaaagaaatgccagcaaagagtgaggaaaagagaaaccaagaaagcagtgttgcttgagctgagattgcgaggaagttccaaggcaagtgattggtgagccatgccaccccaacttaggaccaggggtcacatgtttggga

SEQ ID NO: 113009 - DNA, 537 bp, Homo sapiens
aatatataaaaatgataatgcatcataaataaatgggctttatccctgaaatgcaagattgttttaacattcaaaaataaattgaggggacttttattttcacctttgacacataaagaggttggaaacttttattcctgacctttcaacaagaaaaagctgaacaaaccgaaaatcaatgaattttcttggacctgtgagataattgagggctcagggtaaactgccaccagaaatctggaggtgaatacaggtaaacacaaggagtcccagcctaaatggaacagaagctactggagccctaaactgatagggacactaaaaatactaactttgatgaatccctggaggctgaatatggcctagtctgagagtgagaaacagctggagagcctgcatttttgtggattttacttggagttactcataatgaagagctgtgaaaaaccttgatgtttctggcaggggaggaaataagtaaaactttggaaatatggccagaatactctgttataaatgtctgctcagcaagagaaa

SEQ ID NO: 113010 - DNA, 703 bp, Homo sapiens
aagaaagagtgatgtatgttcaagtgttagtgtgcagttgagttgagttgcattaataattagtggcgaccaggcatggtggctcatgcctgtaatcccagcactttgggaggccagggcaggtggatcacctgaggtcgacaccagcctgaccaacatggagaaaccccatctctactaaaaataaagaattagccgggtgtggtggcgcatgcctgtaatcctagctactcgggaggctgaggcaggagaatcgcttgaacctgggaggcagaggttgcggtgagccgaggtcgcaccattgcactccagcctgagcaacaagagtgaaactccgtctcaaaaaataaataaataaataaataaattagtggctactgatcatgtgtttttagaagtcctatggagtactgtttttgtgccagtgaccatgtcagcaacatactattggcagaacttaacatttacttaagatattaaaaaatcagaaatttcagtgactagtaattagcttaagcatggtcttcttccaactcagcatttatatattttttcagctccttggtagtttgatgagctttcttgattttagctcatatttgatatactacttaagaacataaaggttcattgctcagagttcttttggtttgttgagcattctgaatcaaagcaaattagtcaccagttaatataaatggat

SEQ ID NO: 113011 - DNA, 381 bp, Homo sapiens
agcattcctttggacacaaagtagactataaagaaaatttctaaattctgaatgcagtttctcattgattttaattattgctatgttccttttgaaaattttttggctggctctggcaacttatgcctgcagtcccacccagcacattttgaggccaaggcaagtggtttgcttgagcccagcagttcaagaccagcctgggtaacatggcgaaaccatgtctctacaaaaaatacaaaagatagggcttggtggcatgcatttgtagtcccagctactcaagaggctgaggctggagggatcgcttgagcccaggaagttgagactgtaatgagctatgattgtgccactgcaatccttggctgcaaagtgagatcctat

SEQ ID NO: 113012 - DNA, 305 bp, Homo sapiens
attccacttaacatcacataccagaggtttctacaaggtttcaacttttaccatagctctcaaagaaagttattattaagcagacaatgccaatacatagacaaatctatttctcagcaaatcatgaaaagctcctaaatttttcctaagagaatataggaggaggaagatgccactatccacacctattttctttttcaacagagtatttattacccagttcctatctcaagtcccaagcagccttgccagaaacagcaaagtttctagtctgtagggacagtctatgtctcatcacacagtat

SEQ ID NO: 113013 - DNA, 475 bp, Homo sapiens
ccccaggaagtcactcacaggaatacacagttgcccagttgtgctcaccaacctcctccttcagtatccctggccctgtggatttaaatacccttcagccctgtgcatgtgtcccgtgtacttagagctagcctcccagcgagatgtaggcaaattttccctcagttcaactgatttaggagattaagtgcgtccatttaatttccctgttaatgtgaaggcttattgcacgaagaattgcaaacacccactgcctggggctctgcacccataggctgtgctgttgtgtgagtgcagcttccttgccctgatctgccacaagtgcagcttcagtggaaagctgtaggggctgctgtgggcagtgagggaggagggcataagagggctcccgagccaccacaccttcccatgggaatgggccagatcatccttgctaatgactggctttgggctgaccttttgtcattaagaaact

SEQ ID NO: 113014 - DNA, 230 bp, Homo sapiens
ccaaggacagccaagcactgctgaagaacaacaacctgataaacttaaacttccaaatatcaagaataattaaaataaaaattagcacagtgtggtactactgcaggatacaaaaatgacaattagaatagagagtgtggaaacagacccacaaatatctgccttatgagaaaggtaacacttatggtacagtaggaaagaatgacctttttttttttttttttgagata

SEQ ID NO: 113015 - DNA, 247 bp, Homo sapiens
aggtggcagggatggaactcctgcctaggtggagcccagagaatttggtgtgggaacagctgcagtggagcatggccagggacgccccaatgctcgccacactcctgagtgggctttgccctttattggatgttggacctggacagagcagggctatcttgcccatggaactgggccagtcttgtcttagcacccccctgtctacttgcctctcctgggatccctacatggccatgcccgcttgcag

SEQ ID NO: 113016 - DNA, 615 bp, Homo sapiens
gacggagtttcgccatgttggccaggctggtctcgaactcctgacctcatgtgattcacctgtctcagcctcccaaagtgctgggattacaggcatgagccactgcacccggcctattcaataaacatgtattcagtctgtacctactgttctagggactgtggacagagcactgagcaagataggaaaaaaccagcacgtactctgggtgagtgtcagcagagccggtctcagggggcatgagccatgcaattacacactcggtttcatgctgtacggtggccattttgaaatccttaataatttttcaacaagagccctcaagtttcattttggaacgggccctgcaaattacgtagccggtcctgtgtgtcaggccaaactagcagataaggaaatgaggcacagagagggaaacaactccaccaaggttcacacaggatgcaagccacacagctgggattgaaacccaggttagactgggtgcagtggctcatgcctgtaatcccagtactttgggaggccaaggcggatggatcatctaaagtcaggagttcaagaccagcctgaccaacatggtaaaactccatctctactaaaaatacaaaaattagc

SEQ ID NO: 113017 - DNA, 360 bp, Homo sapiens
ggtgtgcagagaaagatgtttccagggaagctgagagaaggaagctcattagccagtgcagagctgggcttggaggcctttcctctagtcctgcaaggagctgggagctgtcacactgctcaccatgtccctttctgctcaaattccccaggatggattctgccccctgcactcaagaaaacacagggggccgggcgcggtggctcacgcctgttatcccagcactttgggaggccaagaaaggcggatcacgaggtcaggagatagagaccatcctggctaacacggtgaaaccccgtctctactaaaaatacaaaaaaattagccgggcgtggtggtgggtgcctgtggttccggcta

SEQ ID NO: 113018 - DNA, 1837 bp, Homo sapiens
aaaaaaaaaaaaacagtgggttggaataatcttataatctccctcagcattctcctgctttaaaggcactactcattagaaggaagagctgaaggagaagacggactcctctccatcatgggaaaggaaggaggctaagtgacttccaggaacagctgctaacttccctgatttcacagccctcattttcatgctcatcttttccctaccaccgtctggctcctcagagtgtgtgagctccctagtaggtgcagtagtaatagtaggcaccctttgctgttattgttatgaaaactgtcagctccaggatggtgctggaggtgacgatgatgttgatgacagggttgttaggaatggagttagtggcaagtggagctacagatgggcccacgggtatgagagctactaacaggaactttgactcaatttggcaaaatcgtatttcaaatctaaattctctttccaccagctccttttgctataagggaaagccaagtggaaacgtagaggcatgtgcacccagatctcctgaaaagggcaataggagagggtagcagggaggagacaatcctctactgagctgaactggaaacgcctgattgtcatttcttccctgctttgccactgacgcccgcagcagctgatcaggaaggtatcagatgccttcactagctgtcactaacacctgcctcctgaatcctgatcggggagatggtgtcatcgggccctccacataaaatatttagtggcacttgcttcccaaagaggcaagcgtggcctctccttggcatcaggaacgctccgagttacatgtgctgggagactctcttgttcaggcgagagtcctggagcagcatacctggtttgagacttggagtaggagagagggaaactggtagaacagagactaggcaagttttggctcttgagaatgcatgtgacaagtgacttcatgcactaaacagagagggatgtgacagaaagaagaaagcatcattattaagagaaaactcctgaggttgacactagcagaaaattggggataggaggaagtcacactgggtatgcaaagtcaaatgcatgtttgtttaccagtgtctaccaaactgaggatgggaaattcattctaagacagatgatgggatggatggaggtgaggagctggaaataatgacaaataaattgctaataacaaaggctaatgtatcttaaacacttaagatggccatgaactgttctaagtgcttttatatgtattaactgatttcattgtaataatcctatgacgtagctactagtactaaacctattttatatagatagttagataacatcatagaatggctaagtaccttgaccaagtgtacacagctataggctccatttgcgtccaggcacctaagttcagagctcatgcatttaattgttatatcgcactgcctctcaccagaggcacaaaggtgggctccatcctcccttactcagaatgtggataggagtcctgatctttgcccactgggctctgcttggaacagccacttagtcacatcaatttggcatagaaagatgaaggctctcaacgtgcccttgaagtcagctgtcttcatgaaggccacactcccaaggtggggtgcaaacctcccctcactgcaggagactgtgcctcctcttgactccagtgtccaatgacagctgctcccaggcgggcagtccctgagtcctgtgagatgaattcacttggctggttatcaggagtggcctgtcccaaagcaaatgctgcatgagggtgagaggaaaacagcccagctggagtggtctgtttagaactactggcctg

SEQ ID NO: 113019 - DNA, 805 bp, Homo sapiens
gagcacagggtgccagtttatcccatcattggtgttgcttttttaagttcataattaacctaaatttcagaggctggtaatttctggctttaccccaaattcatggactgtaccctatttagagcctactatatctcttatttttcactacacaatctattttttattgtatctttatagcatatttagaggtagatatgggactatgtaagtttagtacggtttgctgaactttggaatgtttttataatcataatattttgatcaagatggaaccttagaattttcctctcatttggattagaatgttaattctatactaggtagttcttgtggctagactgttgcacttttgaaggcagatttaagagttccactttcatgtggtccagccagctttcttctgtgtctcagaggtctccttactctgctagctgcctttacttttagggattaatggtatggaatagtggctataattgcaagcatattaattaccacaagtggaaaataagttctaattatgtattctatattaacttcatataggaaaaaacaatttttaccttctgactgtagatgttataatgataattttaaaaggcaccacagaagagggagtgggaaattgtttagctacatgaggatcatcctttacaaagggccattgtgaggtttcttttggtaattataaattgtagctatgtgtttaggtggagaggctttttttcttgataagaaacatttggggttatttaacttaggaacttaaaatactttgaattttgcaacttaagtgacatgg

SEQ ID NO: 113020 - DNA, 281 bp, Homo sapiens
cacttatccccattcatatcccctttggacctagggagaaggtactatttataggtgatcacctgagtttattgtcccttgtgctgtgccagaaataaaggtccccacctgctcttattagctctactaacaggataaggaaagtggccctcagagagctactgcttttgtgacaaacaaatgatacaagaaaaaaaaagtggctttttaattttagtgacctggggcaggacttccaaatgaaagtttatttctaaaaactaaaaggtaaatttaatata

SEQ ID NO: 113021 - DNA, 1703 bp, Homo sapiens
cagtctcggttagcttcacttcagcgggaacctgcccactaaggaggccgattctttccggctcgagcaggtccggacccgcccctctggcgtctagcagtctcggaggcctgcccgtatagttcagggccggacagcgagcggcggcgacttgccagtaagggtttggagtcatcagcaggtttaattttggaggaactttacaggtttggctccagcagctgctgttgccaccaccactagttcaagcaccatgcagtttacctcaatatcaaattctttgacctccactgctgctattgggctctcatttacaacttcaacgactaccaccgccactttcaccaccaacactactaccacaatcaccagtggctttactgtgaaccaaaaccaactgttatcaagagggtttgaaaaccttgtaccttatacttcaactgttagtgtagtagcaactcctgtgatgacatatggtcatctggagggtcttataaatgagtggaaccttgagctggaagatcaagagaagtactttcttctccaggccactcaggtcaatgcttgggaccatacattgattgagaatggtgagatgattcgtattttacatggagaagtgaacaaagtgaaactggatcagaaaagattggaacaagaattggattttatcctgtcacagcagcaggaactagaatttctgttgacttatttagaggagtctacgcgcgaccagagtggacttcattatctgcaggatgcagatgaggagcatgtggagacctccaccagatctgcagaattctgaatgcccatatggactccctgcagtggattgatcggaattcaggcatgctgcgaaggaaggtagaagtggtaacacgggttttcgaggattatcgtcacgaggagcatgcacacaatgtcaacactgctttttagtgaatgaccatatcttcagcatgtcgtttctggattattacctacaaattctgatgttaaatagagtagtatttatacttaatatttcatcttgatcataatgaattgtgcatcctttttttcatttaagtattgtactgttgagaattataccttagttttgtttttagtattagaaaatcaaaattatactagcccctttgtccagacagcaacctcttagatgctgactctatatgtgtaatttatgtcttactctccctggcatcagtacacatcatcctcctcactccagttgaatcatagggtgatgtctgccaaaagtacatgccaacctatatagtgctagatactgtaaagtctcttcttctcaaaggaacctactgtctagtttgagatataattaatgcttgtctgcataaaaacaatatagataatataaagaagtgcagtatgaattatagaaagtgtgttatagagattcagagcagggaggaaaagttagggtagattattattaaagggttaaggaaaggtaagtttcaaggaatttggttatttttaatgtatggatatactggcattttatttggttttagcatatgatttatagttggtgatttccgtatatttgtttgtttttctttttttttgtttgtttgttttgttttgttttaaataagccttgttcttaggtttggaacagtctggtctcctgtgtttcatgtttcacctaagtcataaataaaggtaatgtccta

SEQ ID NO: 113022 - DNA, 1875 bp, Homo sapiens
cagtctcggttagcttcacttcagcgggaacctgcccactaaggaggccgattctttccggctcgagcaggtccggacccgcccctctggcgtctagcagtctcggaggcctgcccgtatagttcagggccggacagcgagcggcggcgacttgccagtaaggtttggctccagcagctgctgttgccaccaccactagttcaagcaccatgcagtttacctcaatatcaaattctttgacctccactgctgctattgggctctcatttacaacttcaacgactaccaccgccactttcaccaccaacactactaccacaatcaccagtggctttactgtgaaccaaaaccaactgttatcaagagggtttgaaaaccttgtaccttatacttcaactgttagattcgtattttacatggagaagtgaacaaagtgaaactggatcagaaaagattggaacaagaattggattttatcctgtcacagcagcaggaactagaatttctgttgacttatttagaggagtctacgcgcgaccagagtggacttcattatctgcaggatgcagatgaggagcatgtggagacctccaccagatctgcagaattctgaatgcccatatggactccctgcagtggattgatcggaattcaggcatgctgcgaaggaaggtagaagtggtaacacgggttttcgaggattatcgtcacgaggagcatgcacacaatgtcaacactgctttttagtgaatgaccatatcttcagcatgtcgtttctggattattacctacaaattctgatgttaaatagagtagtatttatacttaatatttcatcttgatcataatgaattgtgcatcctttttttcatttaagtattgtactgttgagaattataccttagttttgtttttagtattagaaaatcaaaattatactagcccctttgtccagacagcaacctcttagatgctgactctatatgtgtaatttatgtcttactctccctggcatcagtacacatcatcctcctcactccagttgaatcatagggtgatgtctgccaaaagtacatgccaacctatatagtgctagatactgtaaagtctcttcttctcaaaggaacctactgtctagtttgagatataattaatgcttgtctgcataaaaacaatatagataatataaagaagtgcagtatgaattatagaaagtgtgttatagagattcagagcagggaggaaaagttagggtagattattattaaagggttaaggaaaggtaagtttcaaggaatttggttatttttaatgtatggatatactggcattttatttggttttagcatatgatttatagttggtgatttccgtatatttgtttgtttttctttttttttgtttgtttgttttgttttgttttaaataagccttgttcttaggtttggaacagtctggtctcctgtgtttcatgtttcacctaagtcataaataaaggtaatgtcctaaaaaaaaacatgtaatactgaaattaactattaaaagtttttaagtgactagagctcagtaacctataatttattgagctaaattttctgttgtactgattgcacacgaccatcgtggcgggtacacattacacgaagaaatatttttgaaatgaatattagcaacgattagtcttatgagcagactaaatgccaaaattgacatggactcttttttttctactcaaacttttccaagcagcagcttcttatccagtaagtttttgtaaccacgcagaattatagaatgtgaaaataatccagaactcatataatcttgtgaattatttctgtagatacacaacttttaagtataatctttagtaat

SEQ ID NO: 113023 - DNA, 150 bp, Homo sapiens
tgctgggccctgccagactcggagcccctgccagtgtgtgtatatcaaggcagggcggggggttgtcttgctctccagaggcaatggaacctgcctctaggcctcccttttcccttctcatctcctcacccctccttttttatgttagat

SEQ ID NO: 113024 - DNA, 260 bp, Homo sapiens
cggagctgttcatgttcggccatcttgccagccacctgtttcttgttcttgaagttcattgagattcttcaatctgtaagtacataatttttttcagatttggaaacttttcatgatttaaaaaaatctattaaagacatgctttattaatacaaacacaaactataaaggactaagaaatataaatatctgtgtcataagcaaacattcaggatcgacagaatgatcaaaggagactgcatcaaattggattcctatgg

SEQ ID NO: 113025 - DNA, 274 bp, Homo sapiens
ctggatgtgctccccaagaaccagagtccacagctgagctgagagcaggcaaatgatcacaacttgattttttttaaatcctgcaatagcatgaataaagtggcacaaatccaagtcctaaagtctatttttgaacctgcaaagctagagggtcttgtcttgagatccttggtgaccctaccacagtactcacattccaatgaggccctgtcaaaaaccagccttaggctgtgcacggtggctcaaacctgtaatcccagcactttgggggtgg

SEQ ID NO: 113026 - DNA, 150 bp, Homo sapiens
agtttctggtgtgtgtgtgtgtgtgtgtgtgtgtgtatttatttatgcaatggtagcattatttgtaattgtaaaataccagaaactatattgattgtatacacacacacatacacaatggagtagtctacagcttagaataagggagat

SEQ ID NO: 113027 - DNA, 591 bp, Homo sapiens
ttttgtctgtactgcaagttaaaccaattctattattatccttaccttgcctccttctcttagatgcttattattaaaaccataaaactaccttatttacactgatacttcaaaacttgattcaaccacatatgaaaaagaggctaaagggactttcagttgggtgtatcagcccaattctctatcacagcctcctcccctctggttattttgcaagtccattccaggcatagcgatacgtggaacagtcactgtgagaaatgtggcaggggcggcaacagatcctagatctagatgtcatggttcttctgagaagtcagagtagaatcaaacagaaaactatcactacattaaaaatatcctggacgtattagcaaacaaatgcatgcatttattcacggaataaaaatcaaaggtgccacatttgtaaccttatgcttctagcttagctacatgaaataaaaagctatttgaaatcaactacaaatgcaataaagcatagattttccaaataaatcttatttgctgtcaaaccataactcactcataaatcatacaatattttcactttgtaatacaataaaaatgatt

SEQ ID NO: 113028 - DNA, 213 bp, Homo sapiens
acatatggaatgcttcaatgctggcttaaccagcccttcttctctgaaataatagtgcaaatttatttagcttctttcctccttgaagattctcaaacattctataagttatgagtagagatgttccctagagagatagaaaaagaacatagcagaaaggggcagtaaacatttccagcccttcaatgatgttagaaactatttgaattcagg

SEQ ID NO: 113029 - DNA, 324 bp, Homo sapiens
ctcctaacaaatgggtttggagtaacactcccagctctcctggctcagagaagtagaaagaaacacactagacttcatttgaagggcatgctttagagtaggctccccctacacaagtctttataacataccactgacttgtaaacccctaaatgaaggactgcttatacacaatcattttccttttaacatttctgcacatttctcacaatgtacaagtctatgtttgactcagtgtgcatctggaggcaatgtttcacagcagttgagcagaagctatgaagtttggggacagaaaaggtcccagtgatgctgctgttattc

SEQ ID NO: 113030 - DNA, 644 bp, Homo sapiens
aaaagaacctaggtgaatattggggcaggctccctgatgaaatgatatatattcttaaaataaacttttcatctttgcatatacgtttatatgccgagttttctccaaccttgtcttacagcactttgtatactacattctagccatactaaactcttgcagttcctgagacatgtgctgtatcctatttcttctggtccttttctcattgattaactacctggagcatacttttaattcagtgtcagtctgctttgcaatctttacttaagtcctaggtaaccattttgtcatctagcaagcttgccttgacatcttacctctgttcccctaggaatattcacaccattggctctcaaatctacatgtgctgtgaatttcttctattctagaggttgatacgcttttctgcacaaggccagctaatttaggctttgtgggccagatagtctcttgttgctcgcttttgctgttgtagtgtgaaatcagccatagacagtttataagcaagtgagtgtggccgtgttccaattaacctttatttacaaaaacataaaatgggccgagcgcggtggctcacgcctgtaatcccagcactttgggaggcagaggcgggcggatcatgaggttaggagatcgagacc

SEQ ID NO: 113031 - DNA, 764 bp, Homo sapiens
cgctgtggctcatgcctgtaatcccagcactttgggaggccaaggcgggtggatcacaaggtcaggaactcaagaccagcctggccagcatggtgaaaccctgtctctactaaaaatacaaaaattagctggccatggtggcacgtgcctgtaatcccagctactcaggaggctgaagcagaaaaactgtttgaaccgggacccgggaggcgaaggttgcagtgagctgagatcgtgccactgcactgcagcctgggctacagagcgagactccgtctcaaaaaagaaaaaaaaaagaataccacagaagtgatgttggttctcctcatggtgtcctattgggggcagtgtcctatcaggaggcactgtcctatcacggtgttagggtgcctcattcctgggggcaaacttctatcacttggtttgggtggattctgccaggtttctccattgtgaagttactattccacctttgtaactaataaatatcttgtagggaaatacttcgagactatgtaaatatttgtttcccaaacatttagccactagctttaacaaccattaatgattcctgcttgagataattattattgtgatggttgccaaacagtgttttttctatttccatcattccatatatattaattggaattctgtaagacctttcttttctcacttttaattcaattacagtgaaaggatacaaagaaagtcagcaaacgggctcatgggtatttgtcttattctatgggtactacaggttg

SEQ ID NO: 113032 - DNA, 314 bp, Homo sapiens
ctatttttctggcattttaggctggaactgttagagtaagaagccccaccctgtgactgggtatttctgtattgaactcggtgtgtttgtttccagtcttcccgtgcacatctctacctctctgtctgaggtcacagtagaaagagaaaccaagtcagcagggactcagctgactcctcctttcaggatttccttggtagtttccaaattctttcctctacaccaggagcgtgtgttctctcgcccctctaccccctattctctcccatcctccctgtttctctttctttctcaaccaggtctggtctaacaaa

SEQ ID NO: 113033 - DNA, 335 bp, Homo sapiens
ggaaaggaccaggagactgggttggtactggttcctgcgggctggagggggtggagtagggagtgttgtgaaagtttcaagcacagaggactgaatggaagcctcacaatgcaacctaaggactttggattcttgcttttgagtacatgcactgtgtgtgtgtgtgtgtgtgtgtgtgtgtgtgtgtgtgtgtgtgtgtgtaaatggtgtagtttgttggctgtcagccttactaggaggctggtttggagcctgttgccttagctctgtggggtgatgatgggaatagtgaaaaagagggtgacaaaagcagagagtctcaaagaggggacaga

SEQ ID NO: 113034 - DNA, 321 bp, Homo sapiens
gcccgcctcggcctcccaaagtgctgggattacaggtgtgagccacgacgcctggctgatatgtatttttataattattttaggtgatatataaataaaaagattacacagaaagtcactgtgtttagttgtcttagtgtatattttgcagctagtttttcttggagtgctcactgctccaagctgggtattctgtgggtgctttattaagatttatttatatggcagttagttgcacctgcactaaaattttttctaggttaggctgcaaaataaatatacaaagaagtagcttttttaaatgctaggaataaccagttt

SEQ ID NO: 113035 - DNA, 452 bp, Homo sapiens
tattactagtttcgtacctggaaaacccctggtccttttaaccaggaaactcatcattgtctgtcctttgagggaaaaagccgcagcgtattacacaaagagatcatgcctcagactgtgcggaatgccactctgttaaaagatgagatcctggcttcacacttgaatcagtcctgtgaaaactgtgtgaatattgagaaggaggggcaaagaaatataaaaaatggagcttacagggtaacagtaagctacctgcacatcacagaaattctgctctttagagagcttcagtccaagactatcaacccagtaactcctctgatccaatcctagttgggctgaagaatgtaccactgcagtgtagcatttttcaggtggtcataatgtggagacagttagtaaagggaaggttacaagctcagaaaaatgcagcattcactgacagccacaca

SEQ ID NO: 113036 - DNA, 388 bp, Homo sapiens
tgtgtggaaaggcagtgagtcagccaggaacatgctgggggctggggagggtcccaccagcaaggcggacaagcccaggaggcggttctgggccttggagaaaagctggggtaggggagagatattaggtgtccttccattttcatgttacttaacagctactggagtggaggagactgccctagtggtatgcagaatgataagaaaggaggtataagaaaggagggataagaaaggagggaatgggagggacagaggaagagggggtcctggagatgggcagtcagagctaagtagtgggggcttcaaggagggatggtcgtgggtgctggtatttattgagtgtttgctgtgtgccgggtaccctctgtgtggattcacttacccc

SEQ ID NO: 113037 - DNA, 426 bp, Homo sapiens
gtcttagtgctctgcagtgctcgccctcactgggaagcttcaacctcgggagggtggttcagtgggaacagtaggagcctgagaccaaaaaaacactcagcattttgaagaaataatttgattcattaatttctgcattcatttagcaatatttatggagtttctgccacatggcaggcactggggtggatataaaggaaatagggacaaaaccgcactgaaccagtctctcggccaaacagttaccaaggaattatgatgaagtgaatggcagggtccccggccagggtgtgtgtgtgcatgggaagggtcccctaaaccagctggggaggccaggaagacctctctgtcaggaagtggcgtctcaacaggttaatccagaggggtcggtggcgattagccaggaagagtctggccgccctgtaa

SEQ ID NO: 113038 - DNA, 513 bp, Homo sapiens
agagtttgaacagggtgtcatgactctggagggaggaaaaaggagacatcatggaaaaaaatagatcccgagtattcatttgcgagtagaaaagagagcagttcaagtgaattatataatgcactgccaagactgaaatgaaaatgcataggtcttgagtatttccattggtcatgagataaggggacatttaatgacaggcaacccattttctttactgtgtcctatatattccaactaaagtgtccacatctttggattttctatcagaattcagtaatttcaataaaatggctcaaattatccttatttagaaaatatatttacagttaaaaaattctcatttcaaattcttgcaccaaaagagaaaacctacttgaattactcaagctgatcaggtatgctgaaatgtttctccaggaagtgctattgaaaatatggtcacaactgattctacttactggtctacttagtgttaagtataactgaaatgttctggactctcctccctgg

SEQ ID NO: 113039 - DNA, 124 bp, Homo sapiens
atttaagtatccgataagtggtaactatggtgacagttgtctgcctgtgtttgctaatgatgaacgtattcattccctcactcattgattcactgagcaaatatatactaaggatgctctaagg

SEQ ID NO: 113040 - DNA, 302 bp, Homo sapiens
agattggagcagtctagaaccacggagagctcagggatcatcttatgcaacacccctccctgttcatggaagaggaagctggagcatggggacagcggtgtcccctgggtggtggttggctggaaccagaaccctggcccagggctgctccattcatgtgggccagccttgatggctacgtccacaaactcactcctgggcctctcccaccaccacggggcctcaccttgatcttccaggtcgatccttcaccccagatgctctgggccattagaggaggggtcaggctgtcctctgagtcc

SEQ ID NO: 113041 - DNA, 336 bp, Homo sapiens
gcccacgccccattcaggtcctggcacagtgaggccaaccccacggctctaaaattataaacccaccatgagcagaagcccctatgcctccctgtttcccccacggcacatcctgccttcctacaaaccatcagacggacttattactttctttgcattctgcatcccctatagaatgccgcctccacgaggccaggggacttgcatatttcgttcaccgattgatccccactcaccagaacggagcctggcacctagcaggctctcagtgagatttgcaaaataaagaaggggttagagaaatgctgggctggaaaatgtcagcttgggacttgc

SEQ ID NO: 113042 - DNA, 1679 bp, Homo sapiens
accgggaactcggaggcggggagcggctgggaagtggccgtggtggttggccgcggtggagctagcaggcgggcgggcgggagcgggcgccggagtggagaaaggagccagcggtgggcagcgctgctgggatggcgcgggccgggccggcgtggctgctgctggcaatctgggtggtcctgccatcatggctgtcctctgcaaaggtctcctcgctcattgagagaatctctgaccccaaggacttgaaaaaactgctcagaacccggaataatgtactggtgctttactccaaatctgaggtggcagctgaaaatcatctcaggttactgtccacagtggcccaggcggtgaaaggacaagggaccatctgctgggtggactgtggtgatgcagagagtagaaaattgtgcaagaagatgaaagttgacctgagcccgaaggacaaaaaggttgaattattccattaccaggatggtgcatttcatactgaatataaccgagctgtgacatttaagtccatagtggcctttttgaaggatccaaaagggcccccactgtgggaggaagatcctggagccaaagatgttgtccaccttgacagtgaaaaggacttcagacggctcctgaagaaggaagagaagccgctcctgatcatgttttatgccccctggtgcagcatgtgcaagaggatgatgccgcatttccagaaggctgcgactcagctgcgaggccacgccgtgctggccgggatgaatgtctactcctctgaatttgaaaacatcaaggaggagtacagcgtgcgcggcttccccaccatctgctattttgagaaaggacggttcttgttccagtatgacaactatgggtccacagctgaggacattgtggagtggctgaagaaggtgtggccactgtaagaaaatgaagccggagtttgagaaggcagcagaagccctccatggagaagcggatctgtcgatgccactgtcaacaaggccctggcagaaagattccacatctcagagtttcctacgttgaagtattttaagaatggagagaaatacgcagtgcctgtgctcaggacaaagaagaagtttctcgagtggatgcaaaaccctgaggcccccccgcccccagagcccacgtgggaagagcagcagacaagcgtgttgcacctggtgggggacaacttccgggagaccctgaagaagaagaaacacaccttggtcatgttctacgccccttggtgcccacactgtaagaaggtcattccgcactttactgctactgctgatgccttcaaagatgaccgaaagattgcctgtgccgctgttgactgtgtcaaagacaagaaccaagacctgtgccagcaggaggcggtcaagggctaccccactttccactactaccactatgggaagttcgcagaaaagtatgacagcgaccgcacagaattgggatttaccaattatattcgagccctccgggagggagaccatgaaagactagggaaaaagaaggaagagttataattcctgcctcagaaaaagcttttccattacactgtgaatgatacctgttttgttgtttctgaatttccacatgttctgaagacaaattttttatagccgcttatggccattttgtacaattttgaaataaaattaaaccattta

SEQ ID NO: 113043 - DNA, 608 bp, Homo sapiens
accgggaactcggaggcggggagcggctgggaagtggccgtggtggttggccgcggtggagctagcaggcgggcgggcgggagcgggcgccggagtggagaaaggagccagcggtgggcagcgctgctgggatggcgcgggccgggccggcgtggctgctgctggcaatctgggtggtcctgccatcatggctgtcctctgcaaaggtctcctcgctcattgagagaatctctgaccccaaggacttgaaaaaactgctcagaacccggaataatgtactggtgctttactccaaatctgaggtggcagctgaaaatcatctcaggttactgtccacagtggcccaggcggtgaaaggacaagggaccatctgctgggtggactgtggtgatgcagagagtagaaaattgtgcaagaagatgaaagttgacctgagcccgaaggacaaaaaggttgaattattccattaccagtaagtacacatgggcatttccaatttccaagtaagtgccaaacgctttcattggtattttcagcgaacagcaatttttagttagattaattttatttcagaatggttttcttcctgtgtttacaattatttcttt

SEQ ID NO: 113044 - DNA, 1835 bp, Homo sapiens
accgggaactcggaggcggggagcggctgggaagtggccgtggtggttggccgcggtggagctagcaggcgggcgggcgggagcgggcgccggagtggagaaaggagccagcggtgggcagcgctgctgggatggcgcgggccgggccggcgtggctgctgctggcaatctgggtggtcctgccatcatggctgtcctctgcaaaggtctcctcgctcattgagagaatctctgaccccaaggacttgaaaaaactgctcagaacccggaataatgtactggtgctttactccaaatctgaggtggcagctgaaaatcatctcaggttactgtccacagtggcccaggcggtgaaaggacaagggaccatctgctgggtggactgtggtgatgcagagagtagaaaattgtgcaagaagatgaaagttgacctgagcccgaaggacaaaaaggttgaattattccattaccaggatggtgcatttcatactgaatataaccgagctgtgacatttaagtccatagtggcctttttgaaggatccaaaagggcccccactgtgggaggaagatcctggagccaaagatgttgtccaccttgacagtgaaaaggacttcagacggctcctgaagaaggaagagaagccgctcctgatcatgttttatgccccctggtgcagcatgtgcaagaggatgatgccgcatttccagaaggctgcgactcagctgcgaggccacgccgtgctggccgggatgaatgtctactcctctgaatttgaaaacatcaaggaggagtacagcgtgcgcggcttccccaccatctgctattttgagaaaggacggttcttgttccagtatgacaactatgggtccacagctgaggacattgtggagtggctgaagaatccgcagccgccacagccccaggtccctgagactccctgggcagatgagggcggctccgtttatcacctgaccgatgaagactttgaccagtttgtgaaggaacactcctctgtcctcgtcatgttccacgccccatggtgtggccactgtaagaaaatgaagccggagtttgagaaggcagcagaagccctccatggagaagcggatagctctggtgtccttgcagctgtcgatgccactgtcaacaaggccctggcagaaagattccacatctcagagtttcctacgttgaagtattttaagaatggagagaaatacgcagtgcctgtgctcaggacaaagaagaagtttctcgagtggatgcaaaaccctgaggcccccccgcccccagagcccacgtgggaagagcagcagacaagcgtgttgcacctggtgggggacaacttccgggagaccctgaagaagaagaaacacaccttggtcatgttctacgccccttggtgcccacactgtaagaaggtcattccgcactttactgctactgctgatgccttcaaagatgaccgaaagattgcctgtgccgctgttgactgtgtcaaagacaagaaccaagacctgtgccagcaggaggcggtcaagggctaccccactttccactactaccactatgggaagttcgcagaaaagtatgacagcgaccgcacagaattgggatttaccaattatattcgagccctccgggagggagaccatgaaagactagggaaaaagaaggaagagttataattcctgcctcagaaaaagcttttccattacactgtgaatgatacctgttttgttgtttctgaatttccacatgttctgaagacaaattttttatagccgcttatggccattttgtacaattttgaaataaaattaaaccattta

SEQ ID NO: 113045 - DNA, 1913 bp, Homo sapiens
accgggaactcggaggcggggagcggctgggaagtggccgtggtggttggccgcggtggagctagcaggcgggcgggcgggagcgggcgccggagtggagaaaggagccagcggtgggcagcgctgctgggatggcgcgggccgggccggcgtggctgctgctggcaatctgggtggtcctgccatcatggctgtcctctgcaaaggtctcctcgctcattgagagaatctctgaccccaaggacttgaaaaaactgctcagaacccggaataatgtactggtgctttactccaaatctgaggtggcagctgaaaatcatctcaggttactgtccacagtggcccaggcggtgaaaggacaagggaccatctgctgggtggactgtggtgatgcagagagtagaaaattgtgcaagaagatgaaagttgacctgagcccgaaggacaaaaaggttgaattattccattaccaggatggtgcatttcatactgaatataaccgagctgtgacatttaagtccatagtggcctttttgaaggatccaaaagggcccccactgtgggaggaagatcctggagccaaagatgttgtccaccttgacagtgaaaaggacttcagacggctcctgaagaaggaagagaagccgctcctgatcatgttttatgccccctggtgcagcatgtgcaagaggatgatgccgcatttccagaaggctgcgactcagctgcgaggccacgccgtgctggccgggatgaatgtctactcctctgaatttgaaaacatcaaggaggagtacagcgtgcgcggcttccccaccatctgctattttgagaaaggacggttcttgttccagtatgacaactatgggtccacagctgaggacattgtggagtggctgaagaatccgcagccgccacagccccaggtccctgagactccctgggcagatgagggcggctccgtttatcacctgaccgatgaagactttgaccagtttgtgaaggaacactcctctgtcctcgtcatgttccacgccccatggtgtggccactgtaagaaaatgaagccggagtttgagaaggcagcagaagccctccatggagaagcggatagctctggtgtccttgcagctgtcgatgccactgtcaacaaggccctggcagaaagattccacatctcagagtttcctacgttgaagtattttaagaatggagagaaatacgcagtgcctgtgctcaggacaaagaagaagtttctcgagtggatgcaaaaccctgaggcccccccgcccccagagcccacgtgggaagagcagcagacaagcgtgttgcacctggtgggggacaacttccgggagaccctgaagaagaagaaacacaccttggtcatgttctacgccccttggtgcccacactgtaagaaggtcattccgcactttactgctactgctgatgccttcaaagatgaccgaaagattgcctgtgccgctgttgactgtgtcaaagacaagaaccaagacctgtgccagcaggaggcggtcaagggctaccccactttccactactaccactatgggaagttcgcagaaaagtatgacagcgaccgcacagaattgggatttaccaattatattcgagccctccgggagggagaccatgaaagactagggaaaaagaaggaagagttataattcctgcctcagaaaaagcttttccattacactgtgaatgatacctgttttgttgtttctgaatttccacatgttctgaagacaaattttttatagccgcttatggccattttgtacaattttgaaataaaattaaaccatttattcgtcttttagccttggcactccagtatactttctcttgcgcttgcagggaagccacattgccacaggtcatcttca

SEQ ID NO: 113046 - DNA, 1893 bp, Homo sapiens
ggcgggcactgggtgctacgcgggagacagcgggcgtcccggtgccctcgccgccaagcgctcccggacgcaggggcaggaggcagctgtggggcgccgggagatccctggcagggtgcttacgccacggccacaactttgcggggatgcaggtcggggcacagccggtcgggcaggacgccggcgggctgcggggtgagctccgctccagactccgagccctgcacctgtgtggtcctgccatcatggctgtcctctgcaaaggtctcctcgctcattgagagaatctctgaccccaaggacttgaaaaaactgctcagaacccggaataatgtactggtgctttactccaaatctgaggtggcagctgaaaatcatctcaggttactgtccacagtggcccaggcggtgaaaggacaagggaccatctgctgggtggactgtggtgatgcagagagtagaaaattgtgcaagaagatgaaagttgacctgagcccgaaggacaaaaaggttgaattattccattaccaggatggtgcatttcatactgaatataaccgagctgtgacatttaagtccatagtggcctttttgaaggatccaaaagggcccccactgtgggaggaagatcctggagccaaagatgttgtccaccttgacagtgaaaaggacttcagacggctcctgaagaaggaagagaagccgctcctgatcatgttttatgccccctggtgcagcatgtgcaagaggatgatgccgcatttccagaaggctgcgactcagctgcgaggccacgccgtgctggccgggatgaatgtctactcctctgaatttgaaaacatcaaggaggagtacagcgtgcgcggcttccccaccatctgctattttgagaaaggacggttcttgttccagtatgacaactatgggtccacagctgaggacattgtggagtggctgaagaatccgcagccgccacagccccaggtccctgagactccctgggcagatgagggcggctccgtttatcacctgaccgatgaagactttgaccagtttgtgaaggaacactcctctgtcctcgtcatgttccacgccccatggtgtggccactgtaagaaaatgaagccggagtttgagaaggcagcagaagccctccatggagaagcggatagctctggtgtccttgcagctgtcgatgccactgtcaacaaggccctggcagaaagattccacatctcagagtttcctacgttgaagtattttaagaatggagagaaatacgcagtgcctgtgctcaggacaaagaagaagtttctcgagtggatgcaaaaccctgaggcccccccgcccccagagcccacgtgggaagagcagcagacaagcgtgttgcacctggtgggggacaacttccgggagaccctgaagaagaagaaacacaccttggtcatgttctacgccccttggtgcccacactgtaagaaggtcattccgcactttactgctactgctgatgccttcaaagatgaccgaaagattgcctgtgccgctgttgactgtgtcaaagacaagaaccaagacctgtgccagcaggaggcggtcaagggctaccccactttccactactaccactatgggaagttcgcagaaaagtatgacagcgaccgcacagaattgggatttaccaattatattcgagccctccgggagggagaccatgaaagactagggaaaaagaaggaagagttataattcctgcctcagaaaaagcttttccattacactgtgaatgatacctgttttgttgtttctgaatttccacatgttctgaagacaaattttttatagccgcttatggccattttgtacaattttgaaataaaattaaaccattta

SEQ ID NO: 113047 - DNA, 1723 bp, Homo sapiens
cgattcttctggggcccagccagaagctggaactcacagtcattggctccttgatccccaggtggtcctgccatcatggctgtcctctgcaaaggtctcctcgctcattgagagaatctctgaccccaaggacttgaaaaaactgctcagaacccggaataatgtactggtgctttactccaaatctgaggtggcagctgaaaatcatctcaggttactgtccacagtggcccaggcggtgaaaggacaagggaccatctgctgggtggactgtggtgatgcagagagtagaaaattgtgcaagaagatgaaagttgacctgagcccgaaggacaaaaaggttgaattattccattaccaggatggtgcatttcatactgaatataaccgagctgtgacatttaagtccatagtggcctttttgaaggatccaaaagggcccccactgtgggaggaagatcctggagccaaagatgttgtccaccttgacagtgaaaaggacttcagacggctcctgaagaaggaagagaagccgctcctgatcatgttttatgccccctggtgcagcatgtgcaagaggatgatgccgcatttccagaaggctgcgactcagctgcgaggccacgccgtgctggccgggatgaatgtctactcctctgaatttgaaaacatcaaggaggagtacagcgtgcgcggcttccccaccatctgctattttgagaaaggacggttcttgttccagtatgacaactatgggtccacagctgaggacattgtggagtggctgaagaatccgcagccgccacagccccaggtccctgagactccctgggcagatgagggcggctccgtttatcacctgaccgatgaagactttgaccagtttgtgaaggaacactcctctgtcctcgtcatgttccacgccccatggtgtggccactgtaagaaaatgaagccggagtttgagaaggcagcagaagccctccatggagaagcggatagctctggtgtccttgcagctgtcgatgccactgtcaacaaggccctggcagaaagattccacatctcagagtttcctacgttgaagtattttaagaatggagagaaatacgcagtgcctgtgctcaggacaaagaagaagtttctcgagtggatgcaaaaccctgaggcccccccgcccccagagcccacgtgggaagagcagcagacaagcgtgttgcacctggtgggggacaacttccgggagaccctgaagaagaagaaacacaccttggtcatgttctacgccccttggtgcccacactgtaagaaggtcattccgcactttactgctactgctgatgccttcaaagatgaccgaaagattgcctgtgccgctgttgactgtgtcaaagacaagaaccaagacctgtgccagcaggaggcggtcaagggctaccccactttccactactaccactatgggaagttcgcagaaaagtatgacagcgaccgcacagaattgggatttaccaattatattcgagccctccgggagggagaccatgaaagactagggaaaaagaaggaagagttataattcctgcctcagaaaaagcttttccattacactgtgaatgatacctgttttgttgtttctgaatttccacatgttctgaagacaaattttttatagccgcttatggccattttgtacaattttgaaataaaattaaaccattta

SEQ ID NO: 113048 - DNA, 1606 bp, Homo sapiens
accgggaactcggaggcggggagcggctgggaagtggccgtggtggttggccgcggtggagctagcaggcgggcgggcgggagcgggcgccggagtggagaaaggagccagcggtgggcagcgctgctgggatggcgcgggccgggccggcgtggctgctgctggcaatctgggtggtcctgccatcatggctgtcctctgcaaaggtctcctcgctcattgagagaatctctgaccccaaggacttgaaaaaactgctcagaacccggaataatgtactggtgctttactccaaatctgaggtggcagctgaaaatcatctcaggttactgtccacagtggcccaggcggtgaaaggacaagggaccatctgctgggtggactgtggtgatgcagagagtagaaaattgtgcaagaagatgaaagttgacctgagcccgaaggacaaaaaggttgaattattccattaccaggatggtgcatttcatactgaatataaccgagctgtgacatttaagtccatagtggcctttttgaaggatccaaaagggcccccactgtgggaggaagatcctggagccaaagatgttgtccaccttgacagtgaaaaggacttcagacggctcctgaagaaggaagagaagccgctcctgatcatgttttatgccccctggtgcagcatgtgcaagaggatgatgccgcatttccagaaggctgcgactcagctgcgaggccacgccgaaaggacggttcttgttccagtatgacaactatgggtccacagctgaggacattgtggagtggctgaagaaggtgtggccactgtaagaaaatgaagccggagtttgagaaggcagcagaagccctccatggagaagcggatagctctggtgtccttgcagctgtcgatgccactgtcaacaaggccctggcagaaagattccacatctcagagtttcctacgttgaagtattttaagaatggagagaaatacgcagtgcctgtgctcaggacaaagaagaagtttctcgagtggatgcaaaaccctgaggcccccccgcccccagagcccacgtgggaagagcagcagacaagcgtgttgcacctggtgggggacaacttccgggagaccctgaagaagaagaaacacaccttggtcatgttctacgccccttggtgcccacactgtaagaaggtcattccgcactttactgctactgctgatgccttcaaagatgaccgaaagattgcctgtgccgctgttgactgtgtcaaagacaagaaccaagacctgtgccagcaggaggcggtcaagggctaccccactttccactactaccactatgggaagttcgcagaaaagtatgacagcgaccgcacagaattgggatttaccaattatattcgagccctccgggagggagaccatgaaagactagggaaaaagaaggaagagttataattcctgcctcagaaaaagcttttccattacactgtgaatgatacctgttttgttgtttctgaatttccacatgttctgaagacaaattttttatagccgcttatggccattttgtacaattttgaaataaaattaaaccattta

SEQ ID NO: 113049 - DNA, 1780 bp, Homo sapiens
accgggaactcggaggcggggagcggctgggaagtggccgtggtggttggccgcggtggagctagcaggcgggcgggcgggagcgggcgccggagtggagaaaggagccagcggtgggcagcgctgctgggatggcgcgggccgggccggcgtggctgctgctggcaatctgggtggtcctgccatcatggctgtcctctgcaaaggtctcctcgctcattgagagaatctctgaccccaaggacttgaaaaaactgctcagaacccggaataatgtactggtgctttactccaaatctgaggtggcagctgaaaatcatctcaggttactgtccacagtggcccaggcggtgaaaggacaagggaccatctgctgggtggactgtggtgatgcagagagtagaaaattgtgcaagaagatgaaagttgacctgagcccgaaggacaaaaaggttgaattattccattaccaggatggtgcatttcatactgaatataaccgagctgtgacatttaagtccatagtggcctttttgaaggatccaaaagggcccccactgtgggaggaagatcctggagccaaagatgttgtccaccttgacagtgaaaaggacttcagacggctcctgaagaaggaagagaagccgctcctgatcatgttttatgccccctggtgcagcatgtgcaagaggatgatgccgcatttccagaaggctgcgactcagctgcgaggccacgccgtgctggccgggatgaatgtctactcctctgaatttgaaaacatcaaggaggagtacagcgtgcgcggcttccccaccatctgctattttgagaaaggacggttcttgttccagtatgacaactatgggtccacagctgaggacattgtggagtggctgaagaatccgcagccgccacagccccaggtccctgagactccctgggcagatgagggcggctccgtttatcacctgaccgatgaagactttgaccagtttgtgaaggaacactcctctgtcctcgtcatgttccacgccccatggtgtggccactgtaagaaaatgaagccggagtttgagaaggcagcagaagccctccatggagaagcggatagctctggtgtccttgcagctgtcgatgccactgtcaacaaggccctggcagaaagattccacatctcagagtttcctacgttgaagtattttaagaatggagagaaatacgcagtgcctgtgctcaggacaaagaagaagtttctcgagtggatgcaaaaccctgaggcccccccgcccccagagcccacgtgggaagagcagcagacaagcgtgttgcacctggtgggggacaacttccgggagaccctgaagaagaagaaacacaccttggtcatgttctacgccccttggtgcccacactgtaagaaggtcattccgcactttactgctactgctgatgccttcaaagatgaccgaaagattgcctgtgccgctgttgactgtgtcaaagacaagaaccaagacctgtgccagcaggaggcggtcaagggctaccccactttccactactaccactatgggaagttcgcagaaaagtatgacagcgaccgcacagaattgggatttaccaattatattcgagccctccgggagggagaccatgaaagactagggaaaaagaaggaagagttataattcctgcatttccacatgttctgaagacaaattttttatagccgcttatggccattttgtacaattttgaaataaaattaaaccattta

SEQ ID NO: 113050 - DNA, 2259 bp, Homo sapiens
accgggaactcggaggcggggagcggctgggaagtggccgtggtggttggccgcggtggagctagcaggcgggcgggcgggagcgggcgccggagtggagaaaggagccagcggtgggcagcgctgctgggatggcgcgggccgggccggcgtggctgctgctggcaatctgggtggtcctgccatcatggctgtcctctgcaaaggtctcctcgctcattgagagaatctctgaccccaaggacttgaaaaaactgctcagaacccggaataatgtactggtgctttactccaaatctgaggtggcagctgaaaatcatctcaggttactgtccacagtggcccaggcggtgaaaggacaagggaccatctgctgggtggactgtggtgatgcagagagtagaaaattgtgcaagaagatgaaagttgacctgagcccgaaggacaaaaaggttgaattattccattaccaggatggtgcatttcatactgaatataaccgagctgtgacatttaagtccatagtggcctttttgaaggatccaaaagggcccccactgtgggaggaagatcctggagccaaagatgttgtccaccttgacagtgaaaaggacttcagacggctcctgaagaaggaagagaagccgctcctgatcatgttttatgccccctggtgcagcatgtgcaagaggatgatgccgcatttccagaaggctgcgactcagctgcgaggccacgccgtgctggccgggatgaatgtctactcctctgaatttgaaaacatcaaggaggagtacagcgtgcgcggcttccccaccatctgctattttgagaaaggacggttcttgttccagtatgacaactatgggtccacagctgaggacattgtggagtggctgaagaatccgcagccgccacagccccaggtccctgagactccctgggcagatgagggcggctccgtttatcacctgaccgatgaagactttgaccagtttgtgaaggaacactcctctgtcctcgtcatgttccacgccccatggtgtggccactgtaagaaaatgaagccggagtttgagaaggcagcagaagccctccatggagaagcggatagctctggtgtccttgcagctgtcgatgccactgtcaacaaggccctggcagaaagattccacatctcagagtttcctacgttgaagtattttaagaatggagagaaatacgcagtgcctgtgctcaggacaaagaagaagtttctcgagtggatgcaaaaccctgaggcccccccgcccccagagcccacgtgggaagagcagcagacaagcgtgttgcacctggtgggggacaacttccgggagaccctgaagaagaagaaacacaccttggtcatgttctacgccccttggtgcccacactgtaagaaggtcattccgcactttactgctactgctgatgccttcaaagatgaccgaaagattgcctgtgccgctgttgactgtgtcaaagacaagaaccaagacctgtgccagcaggaggcggtcaagggctaccccactttccactactaccactatgggaagttcgcagaaaagtatgacagcgaccgcacagtaagtgggggagaggcgtctgcccagagctctctctctgctgatgggcagggaaacttccactgaggaggggcagcactgggcagcatcccagaaactgcagaagtcagctggaacactgcaccgagaggcccaggccctgggcctggctgaggcttgacattgttggaggagagtcccaaggggttgccacagatgtcctgtccccagaggcaggctggactccagatgccgagggttttctcacttgctggtcggggctggtgcaagccacgcagaccctctccaccttgcagaagtctgcccacctctccctgtcataggagtgaccccctggaggggctgggggtgtggggagagagagtgcacagccagctcagggattaaagctctttctctctctctctctcccacttccctgcaggaattgggatttaccaattatattcgagccctccgggagggagaccatgaaagactagggaaaaagaaggaagagttataattcctgcctcagaaaaagcttttccattacactgtgaatgatacctgttttgttgtttctgaatttccacatgttctgaagacaaattttttatagccgcttatggccattttgtacaattttgaaataaaattaaaccattta

SEQ ID NO: 113051 - DNA, 1197 bp, Homo sapiens
accgggaactcggaggcggggagcggctgggaagtggccgtggtggttggccgcggtggagctagcaggcgggcgggcgggagcgggcgccggagtggagaaaggagccagcggtgggcagcgctgctgggatggcgcgggccgggccggcgtggctgctgctggcaatctgggtggtcctgccatcatggctgtcctctgcaaaggtctcctcgctcattgagagaatctctgaccccaaggacttgaaaaaactgctcagaacccggaataatgtactggtgctttactccaaatctgaggtggcagctgaaaatcatctcaggttactgtccacagtggcccaggcggtgaaaggacaagggaccatctgctgggtggactgtggtgatgcagagagtagaaaattgtgcaagaagatgaaagttgacctgagcccgaaggacaaaaaggttgaattattccattaccaggatggtgcatttcatactgaatataaccgagctgtgacatttaagtccatagtggcctttttgaaggatccaaaagggcccccactgtgggaggaagatcctggagccaaagatgttgtccaccttgacagtgaaaaggacttcagacggctcctgaagaaggaagagaagccgctcctgatcatgttttatgccccctggtgcagcatgtgcaagaggatgatgccgcatttccagaaggctgcgactcagctgcgaggccacgccgtgctggccgggatgaatgtctactcctctgaatttgaaaacatcaaggaggagtacagcgtgcgcggcttccccaccatctgctattttgagaaaggacggttcttgttccagtatgacaactatgggtccacagctgaggacattgtggagtggctgaagaatccgcagccgccacagccccaggtccctgagactccctgggcagatgagggcggctccgtttatcacctgaccgatgaagactttgaccagtttgtgaaggaacactcctctgtcctcgtcatgttccacgccccatgtgagtggaactttgctcctccccctccacaccctcccctctctcagagtaggatgagtgtggcgctttgcaatgtgaacccaggaagcacttattttttggatgccaggacccatgctaagccaggggatgcagtggtgacaggcgaggtcccca

SEQ ID NO: 113052 - DNA, 1546 bp, Homo sapiens
accgggaactcggaggcggggagcggctgggaagtggccgtggtggttggccgcggtggagctagcaggcgggcgggcgggagcgggcgccggagtggagaaaggagccagcggtgggcagcgctgctgggatggcgcgggccgggccggcgtggctgctgctggcaatctgggtggtcctgccatcatggctgtcctctgcaaaggtctcctcgctcattgagagaatctctgaccccaaggacttgaaaaaactgctcagaacccggaataatgtactggtgctttactccaaatctgaggtggcagctgaaaatcatctcaggttactgtccacagtggcccaggcggtgaaaggacaagggaccatctgctgggtggactgtggtgatgcagagagtagaaaattgtgcaagaagatgaaagttgacctgagcccgaaggacaaaaaggttgaattattccattaccaggatggtgcatttcatactgaatataaccgagctgtgacatttaagtccatagtggcctttttgaaggatccaaaagggcccccactgtgggaggaagatcctggagccaaagatgttgtccaccttgacagtgaaaaggacttcagacggctcctgaagaaggaagagaagccgctcctgatcatgttttatgccccctggtgcagcatgtgcaagaggatgatgccgcatttccagaaggctgcgactcagctgcgaggccacgccgtgctggccgggatgaatgtctactcctctgaatttgaaaacatcaaggaggagtacagcgtgcgcggcttccccaccatctgctattttgagaaaggacggttcttgttccagtatgacaaaaggccctggcagaaagattccacatctcagagtttcctacgttgaagtattttaagaatggagagaaatacgcagtgcctgtgctcaggacaaagaagaagtttctcgagtggatgcaaaaccctgaggcccccccgcccccagagcccacgtgggaagagcagcagacaagcgtgttgcacctggtgggggacaacttccgggagaccctgaagaagaagaaacacaccttggtcatgttctacgccccttggtgcccacactgtaagaaggtcattccgcactttactgctactgctgatgccttcaaagatgaccgaaagattgcctgtgccgctgttgactgtgtcaaagacaagaaccaagacctgtgccagcaggaggcggtcaagggctaccccactttccactactaccactatgggaagttcgcagaaaagtatgacagcgaccgcacagaattgggatttaccaattatattcgagccctccgggagggagaccatgaaagactagggaaaaagaaggaagagttataattcctgcctcagaaaaagcttttccattacactgtgaatgatacctgttttgttgtttctgaatttccacatgttctgaagacaaattttttatagccgcttatggccattttgtacaattttgaaataaaattaaaccattta

SEQ ID NO: 113053 - DNA, 929 bp, Homo sapiens
agatcgagaccatcctggctaacacagtgaaaccccatctctattgaaaaagtacaaaaaaaattagccgggcgtggtggcgggtgcctgtagtcccagctacgtgggaggctgaagcaggagaatggcatgaacccaggaggcggagcttgcgggtgtggccactgtaagaaaatgaagccggagtttgagaaggcagcagaagccctccatggagaagcggatctgtcgatgccactgtcaacaaggccctggcagaaagattccacatctcagagtttcctacgttgaagtattttaagaatggagagaaatacgcagtgcctgtgctcaggacaaagaagaagtttctcgagtggatgcaaaaccctgaggcccccccgcccccagagcccacgtgggaagagcagcagacaagcgtgttgcacctggtgggggacaacttccgggagaccctgaagaagaagaaacacaccttggtcatgttctacgccccttggtgcccacactgtaagaaggtcattccgcactttactgctactgctgatgccttcaaagatgaccgaaagattgcctgtgccgctgttgactgtgtcaaagacaagaaccaagacctgtgccagcaggaggcggtcaagggctaccccactttccactactaccactatgggaagttcgcagaaaagtatgacagcgaccgcacagaattgggatttaccaattatattcgagccctccgggagggagaccatgaaagactagggaaaaagaaggaagagttataattcctgcctcagaaaaagcttttccattacactgtgaatgatacctgttttgttgtttctgaatttccacatgttctgaagacaaattttttatagccgcttatggccattttgtacaattttgaaataaaattaaaccattta

SEQ ID NO: 113054 - DNA, 1019 bp, Homo sapiens
accgggaactcggaggcggggagcggctgggaagtggccgtggtggttggccgcggtggagctagcaggcgggcgggcgggagcgggcgccggagtggagaaaggagccagcggtgggcagcgctgctgggatggcgcgggccgggccggcgtggctgctgctggcaatctgggtggtcctgccatcatggctgtcctctgcaaaggtctcctcgctcattgagagaatctctgaccccaaggacttgaaaaaactgctcagaacccggaataatgtactggtgctttactccaaatctgaggtggcagctgaaaatcatctcaggttactgtccacagtggcccaggcggtgaaaggacaagggaccatctgctgggtggactgtggtgatgcagagagtagaaaattgtgcaagaagatgaaagttgacctgagcccgaaggacaaaaaggttgaattattccattaccaggatggtgcatttcatactgaatataaccgagctgtgacatttaagtccatagtggcctttttgaaggatccaaaagggcccccactgtgggaggaagatcctggagccaaagatgttgtccaccttgacagtgaaaaggacttcagacggctcctgaagaaggaagagaagccgctcctgatcatgttttatgccccctggtgcagcatgtgcaagaggatgatgccgcatttccagaaggctgcgactcagctgcgaggccacgccgtgctggccgggatgaatgtctactcctctgaatttgaaaacatcaaggaggagtacagcgtgcgcggcttccccaccatctgctattttgagaaaggacggttcttgttccagtatgacaactatgggtccacagctgaggacattgtggagtggctgaagaatccgcagccgccacagccccaggtccctgagactccctgggcagatgagggcggctccgtttatcacctgaccgatgaagactttgaccttcagcctcgaggatcctctagagca

SEQ ID NO: 113055 - DNA, 542 bp, Homo sapiens
gcggccgcccgccttataaagcagtttgggaggctcgcgccggagatcgcgccaggcgaggaggagagctcgggcgagcggcgagcacaggccacgggagctgagcgcagcagagagcagccggagtccgcgcctgactccgcgcgggtcctgagccggccgcagcttgccaggatccccggcgtccttctcgcgccgcttcacgaagagggcgccttcgccgctcgcccagccggagtgcgcacgggcccgctggaaaccgcactcgccgctccctgggcaggccggggcacccgggcacgcagggcgcgcctggcgagcgccccgggaggtgagcagtggtcgcgggcagcgggcagccgctcagcggggacccgccagggctgggggcgcccgagtccgagggggacgacgcttctcgcacccgccacgacccccttgggcacccactcccgggtaagcaaaccaagcgctcctccatacctttcccccgcagcactccgaagagttcccctttgcggagcgaagcctcgggagcctgg

SEQ ID NO: 113056 - DNA, 2358 bp, Homo sapiens
gcggccgcccgccttataaagcagtttgggaggctcgcgccggagatcgcgccaggcgaggaggagagctcgggcgagcggcgagcacaggccacgggagctgagcgcagcagagagcagccggagtccgcgcctgactccgcgcgggtcctgagccggccgcagcttgccaggatccccggcgtccttctcgcgccgcttcacgaagagggcgccttcgccgctcgcccagccggagtgcgcacgggcccgctggaaaccgcactcgccgctccctgggcaggccggggcacccgggcacgcagggcgcgcctggcgagcgccccgggaggtgagcagtggtcgcgggcagcgggcagccgctcagcggggacccgccagggctgggggcgcccgagtccgagggggacgacgcttctcgcacccgccacgacccccttgggcacccactcccgggcggcgtgcaggaccagcggcggccgtgcaggcggaggacttcggcgcggctcctcctgggtgtgaccccgggcgcgcccgccgcgcgacgatgagggcgcggccgcaggtctgcgaggcgctgctcttcgccctggcgctccagaccggcgtgtgctatggcatcaagtggctggcgctgtccaagacaccatcggccctggcactgaaccagacgcaacactgcaagcagctggagggtctggtgtctgcacaggtgcagctgtgccgcagcaacctggagctcatgcacacggtggtgcacgccgcccgcgaggtcatgaaggcctgtcgccgggcctttgccgacatgcgctggaactgctcctccattgagctcgcccccaactatttgcttgacctggagagagggacccgggagtcggccttcgtgtatgcgctgtcggccgccgccatcagccacgccatcgcccgggcctgcacctccggcgacctgcccggctgctcctgcggccccgtcccaggtgagccacccgggcccgggaaccgctggggaggatgtgcggacaacctcagctacgggctcctcatgggggccaagttttccgatgctcctatgaaggtgaaaaaaacaggatcccaagccaataaactgatgcgtctacacaacagtgaagtggggagacaggctctgcgcgcctctctggaaatgaagtgtaagtgccatggggtgtctggctcctgctccatccgcacctgctggaaggggctgcaggagctgcaggatgtggctgctgacctcaagacccgatacctgtcggccaccaaggtagtgcaccgacccatgggcacccgcaagcacctggtgcccaaggacctggatatccggcctgtgaaggactcggaactcgtctatctgcagagctcacctgacttctgcatgaagaatgagaaggtgggctcccacgggacacaagacaggcagtgcaacaagacttccaacggaagcgacagctgcgaccttatgtgctgcgggcgtggctacaacccctacacagaccgcgtggtcgagcggtgccactgtaagtaccactggtgctgctacgtcacctgccgcaggtgtgagcgtaccgtggagcgctatgtctgcaagtgaggccctgccctccgccccacgcaggagcgaggactctgctcaaggaccctcagcaactggggccaggggcctggagacactccatggagctctgcttgtgaattccagatgccaggcatgggaggcggcttgtgctttgccttcacttggaagccaccaggaacagaaggtctggccaccctggaaggagggcaggacatcaaaggaaaccgacaagattaaaaataacttggcagcctgaggctctggagtgcccacaggctggtgtaaggagcggggcttgggatcggtgagactgatacagacttgacctttcagggccacagagaccagcctccgggaaggggtctgcccgccttcttcagaatgttctgcgggaccccctggcccaccctggggtctgagcctgctgggcccaccacatggaatcactagcttgggttgtaaatgttttcttttgttttttgctttttcttcctttgggatgtggaagctacagaaatatttataaaacatagctttttctttggggtggcacttctcaattcctctttatatattttatatatataaatatatatgtatatatataatgatctctattttaaaactagctttttaagcagctgtatgaaataaatgctgagtgagccccagcccgcccctgcagttcccggcctcgtcaagtgaactcggcagaccctggggctggcagagggagctctccagtttccgggcaaaaaaaa

SEQ ID NO: 113057 - DNA, 2233 bp, Homo sapiens
gcggccgcccgccttataaagcagtttgggaggctcgcgccggagatcgcgccaggcgaggaggagagctcgggcgagcggcgagcacaggccacgggagctgagcgcagcagagagcagccggagtccgcgcctgactccgcgcgggtcctgagccggccgcagcttgccaggatccccggcgtccttctcgcgccgcttcacgaagagggcgccttcgccgctcgcccagccggagtgcgcacgggcccgctggaaaccgcactcgccgctccctgggcaggccggggcacccgggcacgcagggcgcgcctggcgagcgccccgggaggcggcgtgcaggaccagcggcggccgtgcaggcggaggacttcggcgcggctcctcctgggtgtgaccccgggcgcgcccgccgcgcgacgatgagggcgcggccgcaggtctgcgaggcgctgctcttcgccctggcgctccagaccggcgtgtgctatggcatcaagtggctggcgctgtccaagacaccatcggccctggcactgaaccagacgcaacactgcaagcagctggagggtctggtgtctgcacaggtgcagctgtgccgcagcaacctggagctcatgcacacggtggtgcacgccgcccgcgaggtcatgaaggcctgtcgccgggcctttgccgacatgcgctggaactgctcctccattgagctcgcccccaactatttgcttgacctggagagagggacccgggagtcggccttcgtgtatgcgctgtcggccgccgccatcagccacgccatcgcccgggcctgcacctccggcgacctgcccggctgctcctgcggccccgtcccaggtgagccacccgggcccgggaaccgctggggaggatgtgcggacaacctcagctacgggctcctcatgggggccaagttttccgatgctcctatgaaggtgaaaaaaacaggatcccaagccaataaactgatgcgtctacacaacagtgaagtggggagacaggctctgcgcgcctctctggaaatgaagtgtaagtgccatggggtgtctggctcctgctccatccgcacctgctggaaggggctgcaggagctgcaggatgtggctgctgacctcaagacccgatacctgtcggccaccaaggtagtgcaccgacccatgggcacccgcaagcacctggtgcccaaggacctggatatccggcctgtgaaggactcggaactcgtctatctgcagagctcacctgacttctgcatgaagaatgagaaggtgggctcccacgggacacaagacaggcagtgcaacaagacttccaacggaagcgacagctgcgaccttatgtgctgcgggcgtggctacaacccctacacagaccgcgtggtcgagcggtgccactgtaagtaccactggtgctgctacgtcacctgccgcaggtgtgagcgtaccgtggagcgctatgtctgcaagtgaggccctgccctccgccccacgcaggagcgaggactctgctcaaggaccctcagcaactggggccaggggcctggagacactccatggagctctgcttgtgaattccagatgccaggcatgggaggcggcttgtgctttgccttcacttggaagccaccaggaacagaaggtctggccaccctggaaggagggcaggacatcaaaggaaaccgacaagattaaaaataacttggcagcctgaggctctggagtgcccacaggctggtgtaaggagcggggcttgggatcggtgagactgatacagacttgacctttcagggccacagagaccagcctccgggaaggggtctgcccgccttcttcagaatgttctgcgggaccccctggcccaccctggggtctgagcctgctgggcccaccacatggaatcactagcttgggttgtaaatgttttcttttgttttttgctttttcttcctttgggatgtggaagctacagaaatatttataaaacatagctttttctttggggtggcacttctcaattcctctttatatattttatatatataaatatatatgtatatatataatgatctctattttaaaactagctttttaagcagctgtatgaaataaatgctgagtgagccccagcccgcccctgcagttcccggcctcgtcaagtgaactcggcagaccctggggctggcagagggagctctccagtttccgggcaaaaaaaa

SEQ ID NO: 113058 - DNA, 2005 bp, Homo sapiens
gcggccgcccgccttataaagcagtttgggaggctcgcgccggagatcgcgccaggcgaggaggagagctcgggcgagcggcgagcacaggccacgggagctgagcgcagcagagagcagccggagtccgcgcctgactccgcgcgggtcctgagccggccgcagcttgccaggatccccggcgtccttctcgcgccgcttcacgaagagggcgccttcgccgctcgcccagccggagtgcgcacgggcccgctggaaaccgcactcgccgctccctgggcaggccggggcacccgggcacgcagggcgcgcctggcgagcgccccgggaggtgagcagtggtcgcgggcagcgggcagccgctcagcggggacccgccagggctgggggcgcccgagtccgagggggacgacgcttctcgcacccgccacgacccccttgggcacccactcccgggcggcgtgcaggaccagcggcggccgtgcaggcggaggacttcggcgcggctcctcctgggtgtgaccccgggcgcgcccgccgcgcgacgatgagggcgcggccgcaggtctgcgaggcgctgctcttcgccctggcgctccagaccggcgtgtgctatggcatcaagtggctggcgctgtccaagacaccatcggccctggcactgaaccagacgcaacactgcaagcagctggagggtctggtgtctgcacaggtgcagctgtgccgcagcaacctggagctcatgcacacggtggtgcacgccgcccgcgaggtcatgaaggcctgtcgccgggcctttgccgacatgcgctggaactgctcctccattgagctcgcccccaactatttgcttgacctggagagagggacccgggagtcggccttcgtgtatgcgtgctgacctcaagacccgatacctgtcggccaccaaggtagtgcaccgacccatgggcacccgcaagcacctggtgcccaaggacctggatatccggcctgtgaaggactcggaactcgtctatctgcagagctcacctgacttctgcatgaagaatgagaaggtgggctcccacgggacacaagacaggcagtgcaacaagacttccaacggaagcgacagctgcgaccttatgtgctgcgggcgtggctacaacccctacacagaccgcgtggtcgagcggtgccactgtaagtaccactggtgctgctacgtcacctgccgcaggtgtgagcgtaccgtggagcgctatgtctgcaagtgaggccctgccctccgccccacgcaggagcgaggactctgctcaaggaccctcagcaactggggccaggggcctggagacactccatggagctctgcttgtgaattccagatgccaggcatgggaggcggcttgtgctttgccttcacttggaagccaccaggaacagaaggtctggccaccctggaaggagggcaggacatcaaaggaaaccgacaagattaaaaataacttggcagcctgaggctctggagtgcccacaggctggtgtaaggagcggggcttgggatcggtgagactgatacagacttgacctttcagggccacagagaccagcctccgggaaggggtctgcccgccttcttcagaatgttctgcgggaccccctggcccaccctggggtctgagcctgctgggcccaccacatggaatcactagcttgggttgtaaatgttttcttttgttttttgctttttcttcctttgggatgtggaagctacagaaatatttataaaacatagctttttctttggggtggcacttctcaattcctctttatatattttatatatataaatatatatgtatatatataatgatctctattttaaaactagctttttaagcagctgtatgaaataaatgctgagtgagccccagcccgcccctgcagttcccggcctcgtcaagtgaactcggcagaccctggggctggcagagggagctctccagtttccgggcaaaaaaaa

SEQ ID NO: 113059 - DNA, 2205 bp, Homo sapiens
cgctgtgtctgcccggtctctcctgggtctccggttctgccgcctcctgtccctccttccggctgccccggccagaggggctcgaaggcgcgttggggcccggggccacgctgggagacacgccttcggccgcgcctaattcgagccaggcgcgggacgcgtcccccggccgggcggagcgggaggggacgcccgccgcgctcggcctccccgggccccgacccctcctttgtaatttgaataaaacgcctcccccgcccgcgcgccgccttaacccgccgcctccgctctccccggctgcaggcggcgtgcaggaccagcggcggccgtgcaggcggaggacttcggcgcggctcctcctgggtgtgaccccgggcgcgcccgccgcgcgacgatgagggcgcggccgcaggtctgcgaggcgctgctcttcgccctggcgctccagaccggcgtgtgctatggcatcaagtggctggcgctgtccaagacaccatcggccctggcactgaaccagacgcaacactgcaagcagctggagggtctggtgtctgcacaggtgcagctgtgccgcagcaacctggagctcatgcacacggtggtgcacgccgcccgcgaggtcatgaaggcctgtcgccgggcctttgccgacatgcgctggaactgctcctccattgagctcgcccccaactatttgcttgacctggagagagggacccgggagtcggccttcgtgtatgcgctgtcggccgccgccatcagccacgccatcgcccgggcctgcacctccggcgacctgcccggctgctcctgcggccccgtcccaggtgagccacccgggcccgggaaccgctggggaggatgtgcggacaacctcagctacgggctcctcatgggggccaagttttccgatgctcctatgaaggtgaaaaaaacaggatcccaagccaataaactgatgcgtctacacaacagtgaagtggggagacaggctctgcgcgcctctctggaaatgaagtgtaagtgccatggggtgtctggctcctgctccatccgcacctgctggaaggggctgcaggagctgcaggatgtggctgctgacctcaagacccgatacctgtcggccaccaaggtagtgcaccgacccatgggcacccgcaagcacctggtgcccaaggacctggatatccggcctgtgaaggactcggaactcgtctatctgcagagctcacctgacttctgcatgaagaatgagaaggtgggctcccacgggacacaagacaggcagtgcaacaagacttccaacggaagcgacagctgcgaccttatgtgctgcgggcgtggctacaacccctacacagaccgcgtggtcgagcggtgccactgtaagtaccactggtgctgctacgtcacctgccgcaggtgtgagcgtaccgtggagcgctatgtctgcaagtgaggccctgccctccgccccacgcaggagcgaggactctgctcaaggaccctcagcaactggggccaggggcctggagacactccatggagctctgcttgtgaattccagatgccaggcatgggaggcggcttgtgctttgccttcacttggaagccaccaggaacagaaggtctggccaccctggaaggagggcaggacatcaaaggaaaccgacaagattaaaaataacttggcagcctgaggctctggagtgcccacaggctggtgtaaggagcggggcttgggatcggtgagactgatacagacttgacctttcagggccacagagaccagcctccgggaaggggtctgcccgccttcttcagaatgttctgcgggaccccctggcccaccctggggtctgagcctgctgggcccaccacatggaatcactagcttgggttgtaaatgttttcttttgttttttgctttttcttcctttgggatgtggaagctacagaaatatttataaaacatagctttttctttggggtggcacttctcaattcctctttatatattttatatatataaatatatatgtatatatataatgatctctattttaaaactagctttttaagcagctgtatgaaataaatgctgagtgagccccagcccgcccctgcagttcccggcctcgtcaagtgaactcggcagaccctggggctggcagagggagctctccagtttccgggcaaaaaaaa

SEQ ID NO: 113060 - DNA, 2314 bp, Homo sapiens
gcggccgcccgccttataaagcagtttgggaggctcgcgccggagatcgcgccaggcgaggaggagagctcgggcgagcggcgagcacaggccacgggagctgagcgcagcagagagcagccggagtccgcgcctgactccgcgcgggtcctgagccggccgcagcttgccaggatccccggcgtccttctcgcgccgcttcacgaagagggcgccttcgccgctcgcccagccggagtgcgcacgggcccgctggaaaccgcactcgccgctccctgggcaggccggggcacccgggcacgcagggcgcgcctggcgagcgccccgggagggataagccccagctccgggtcctcgactctgctgcctcgcctggactcctgattcctcattcctctcctttccgtcccaggcggcgtgcaggaccagcggcggccgtgcaggcggaggacttcggcgcggctcctcctgggtgtgaccccgggcgcgcccgccgcgcgacgatgagggcgcggccgcaggtctgcgaggcgctgctcttcgccctggcgctccagaccggcgtgtgctatggcatcaagtggctggcgctgtccaagacaccatcggccctggcactgaaccagacgcaacactgcaagcagctggagggtctggtgtctgcacaggtgcagctgtgccgcagcaacctggagctcatgcacacggtggtgcacgccgcccgcgaggtcatgaaggcctgtcgccgggcctttgccgacatgcgctggaactgctcctccattgagctcgcccccaactatttgcttgacctggagagagggacccgggagtcggccttcgtgtatgcgctgtcggccgccgccatcagccacgccatcgcccgggcctgcacctccggcgacctgcccggctgctcctgcggccccgtcccaggtgagccacccgggcccgggaaccgctggggaggatgtgcggacaacctcagctacgggctcctcatgggggccaagttttccgatgctcctatgaaggtgaaaaaaacaggatcccaagccaataaactgatgcgtctacacaacagtgaagtggggagacaggctctgcgcgcctctctggaaatgaagtgtaagtgccatggggtgtctggctcctgctccatccgcacctgctggaaggggctgcaggagctgcaggatgtggctgctgacctcaagacccgatacctgtcggccaccaaggtagtgcaccgacccatgggcacccgcaagcacctggtgcccaaggacctggatatccggcctgtgaaggactcggaactcgtctatctgcagagctcacctgacttctgcatgaagaatgagaaggtgggctcccacgggacacaagacaggcagtgcaacaagacttccaacggaagcgacagctgcgaccttatgtgctgcgggcgtggctacaacccctacacagaccgcgtggtcgagcggtgccactgtaagtaccactggtgctgctacgtcacctgccgcaggtgtgagcgtaccgtggagcgctatgtctgcaagtgaggccctgccctccgccccacgcaggagcgaggactctgctcaaggaccctcagcaactggggccaggggcctggagacactccatggagctctgcttgtgaattccagatgccaggcatgggaggcggcttgtgctttgccttcacttggaagccaccaggaacagaaggtctggccaccctggaaggagggcaggacatcaaaggaaaccgacaagattaaaaataacttggcagcctgaggctctggagtgcccacaggctggtgtaaggagcggggcttgggatcggtgagactgatacagacttgacctttcagggccacagagaccagcctccgggaaggggtctgcccgccttcttcagaatgttctgcgggaccccctggcccaccctggggtctgagcctgctgggcccaccacatggaatcactagcttgggttgtaaatgttttcttttgttttttgctttttcttcctttgggatgtggaagctacagaaatatttataaaacatagctttttctttggggtggcacttctcaattcctctttatatattttatatatataaatatatatgtatatatataatgatctctattttaaaactagctttttaagcagctgtatgaaataaatgctgagtgagccccagcccgcccctgcagttcccggcctcgtcaagtgaactcggcagaccctggggctggcagagggagctctccagtttccgggcaaaaaaaa

SEQ ID NO: 113061 - DNA, 2437 bp, Homo sapiens
gcggccgcccgccttataaagcagtttgggaggctcgcgccggagatcgcgccaggcgaggaggagagctcgggcgagcggcgagcacaggccacgggagctgagcgcagcagagagcagccggagtccgcgcctgactccgcgcgggtcctgagccggccgcagcttgccaggatccccggcgtccttctcgcgccgcttcacgaagagggcgccttcgccgctcgcccagccggagtgcgcacgggcccgctggaaaccgcactcgccgctccctgggcaggccggggcacccgggcacgcagggcgcgcctggcgagcgccccgggaggtgagcagtggtcgcgggcagcgggcagccgctcagcggggacccgccagggctgggggcgcccgagtccgagggggacgacgcttctcgcacccgccacgacccccttgggcacccactcccgggcggcgtgcaggaccagcggcggccgtgcaggcggaggacttcggcgcggctcctcctgggtgtgaccccgggcgcgcccgccgcgcgacgatgagggcgcggccgcaggtctgcgaggcgctgctcttcgccctggcgctccagaccggcgtgtgctatggcatcaagtggctggcgctgtccaagacaccatcggccctggcactgaaccagacgcaacactgcaagcagctggagggtctggtgtctgcacaggtgcagctgtgccgcagcaacctggagctcatgcacacggtggtgcacgccgcccgcgaggtcatgaaggcctgtcgccgggcctttgccgacatgcgctggaactgctcctccattgagctcgcccccaactatttgcttgacctggagagagggacccgggagtcggccttcgtgtatgcgctgtcggccgccgccatcagccacgccatcgcccgggcctgcacctccggcgacctgcccggctgctcctgcggccccgtcccaggtgagccacccgggcccgggaaccgctggggaggatgtgcggacaacctcagctacgggctcctcatgggggccaagttttccgatgctcctatgaaggtgaaaaaaacaggatcccaagccaataaactgatgcgtctacacaacagtgaagtggggagacaggctctgcgcgcctctctggaaatgaagtgtaagtgccatggggtgtctggctcctgctccatccgcacctgctggaaggggctgcaggagctgcaggatgtggctgctgacctcaagacccgatacctgtcggccaccaaggtagtgcaccgacccatgggcacccgcaagcacctggtgcccaaggacctggatatccggcctgtgaaggactcggaactcgtctatctgcagagctcacctgacttctgcatgaagaatgagaaggtgggctcccacgggacacaagacaggcagtgcaacaagacttccaacggaagcgacagctgcgaccttatgtgctgcgggcgtggctacaacccctacacagaccgcgtggtcgagcggtgccactgtaagtaccactggtgctgctacgtcacctgccgcaggtgtgagcgtaccgtggagcgctatgtctgcaagtgaggccctgccctccgccccacgcaggagcgaggactctgctcaaggaccctcagcaactggggccaggggcctggagacactccatggagctctgcttgtgaattccagatgccaggcatgggaggcggcttgtgctttgccttcacttggaagccaccaggaacagaaggtctggccaccctggaaggagggcaggacatcaaaggaaaccgacaagattaaaaataacttggcagcctgaggctctggagtgcccacaggctggtgtaaggagcggggcttgggatcggtgagactgatacagacttgacctttcagggccacagagaccagcctccgggaaggggtctgcccgccttcttcagaatgttctgcgggaccccctggcccaccctggggtctgagcctgctgggcccaccacatggaatcactagcttgggttgtaaatgttttcttttgttttttgctttttcttcctttgggatgtggaagctacagaaatatttataaaacatagctttttctttggggtggcacttctcaattcctctttatatattttatatatataaatatatatgtatatatataatgatctctattttaaaactagctttttaagcagctgtatgaaataaatgctgagtgagccccagcccgcccctgcaaaaaaaaaaaaaaaatataaatctcttggggggggcccgggcccaatttcccttataggagccgttacaaatcacttggccgcgttttacaacgtcggactggaaaaacctggcgttcccaaattaatcgctttggagaaaacccctttttccaat

SEQ ID NO: 113062 - DNA, 676 bp, Homo sapiens
tccgggttcaagcgattctgcctcatcctcccgagtagctaggattataggggcacgccaccactcctggctagtttttgtatttttagtagagacgaggtttcactggtcttgaactgatcacccgaggtcaggcctcccaaaatgctggaattacaggaatgagcaaccacacccagccctgttttcaaaatcttaagtgaaactcaaagctgatgtagacccactctttctttcgagtgagcccccagtgagactttctctggcaaacagtagactgtgtgctggcagtgggcacaggctgatttcccagctcactcctggaagccacctcactcctccctctttccaccgctggaaaccacctcactcctcctttccacggctggtccctctccatgttcctgtacccagtccatcacctctctattaacttttgaacctctcgtctctgtttctaacatcatctactcctagctcaatctactcctatctctctgagaccctacagccgcctcccacagatctgcatccattcacccaacctcccctcctcctggctgtcagaatgaccttttttgttctttttaagggttttacttaattagcttgatttaatcattccacattgtgtgaaaacatcatatcatactccataaatatatacgattataat

SEQ ID NO: 113063 - DNA, 242 bp, Homo sapiens
ttttcattaaaaaattagaagattaaaatggagcagagaaattaaaatctgaaaacaacttctctagtagaatcctaacaaacagtctggagacaaagtaaagaatctcaaagacagctcaaaagataaaagatgttacactgatactgtggaatttaagaaagatttctggatagaaggtaagaaaaagggtagtggtactcagtttccaattcatttctcttctactcatatcttcccca

SEQ ID NO: 113064 - DNA, 410 bp, Homo sapiens
tcggtctacatgtctgcttgaggacgccagtccggcggctgcggtcttccagcctcggtgacagagcgagactccatctcaaaaaaaacagaaaaaccaaaaaaaacatactgttgaatgaaaagcaagttacagattatgtactgcttatgtaacgtttttatttatttgttttgtttttctccttggtgggcattggaaaatggaacattcttaaatggacacattcatactaatagcatcttcatgttctgtctttttaaatgcacacacacagacacacacatatgcggaagaaagggacacactggaaggatacactctaaattcctgaaagtggttacctctgaagagactgggagagtaattgatttggactggggttgaggggagtgcaagggggcttcaat

SEQ ID NO: 113065 - DNA, 725 bp, Homo sapiens
tgggaggccacataaaacccagtcctactccgaacttcagtttccgtattttaataacctggtcatcctttctgggaaatacctagcacaaagactggctcatgaggaagtgctcagtaaatcttaagaacatgaatagcccagtctgcaatcttcactggggtccttcacaccctagtcccagtcagctgagactgcccccgcccaagcaccaccatacaaccaggtctcccaagtccaccaagctctatcatgccccaggaatttgcacacactgtttactcttcctagaatgtctgtcctccctatctctacccagtcagtgcctacttctcctattataatccagctcaggcattccagcccatggaaagcagagggttcccacagaacccacccactccaccatctatatttatcatattgtagattgttgcaccttgctatgggtctgtgtcctggagcagactgtgagctcttccaggtcgcaaaccttgcagccccaccacctgcaagaggcctggcctcaggaaggtttattgaatgaagaaaaggactgagtgacccaaaaactcagaaaccaaaagggatcattccaaactgtcaaaaggaaaaagcaaccccgccacctgctggactgactgcttggtcttcattgagtgttcttgatgggaatgtgaacttcaaagtcaaagagtgctcggggcctataatcccagcacttt

SEQ ID NO: 113066 - DNA, 258 bp, Homo sapiens
aacggggttgattacctgctaaaacaaaacaaaactcaacatgctttatgattttaacaggacccagagtctcatagtatactatatgaaatgtccaggaaacaatttaaaactacccaaagtgataaggaccaggaaaacatgaccagttctcaagggaaaagataagacaatgttggaactggaaaaaaaaaactccgaagcatctattataatcatcctgcgtgacataaaggtgaatgctcttacaatgaatgg

SEQ ID NO: 113067 - DNA, 156 bp, Homo sapiens
tgcttctcagctggccagtggtcacacctgattggaaggtgaaaagactttgcgttctacttccaaaagttttcacatttgtcacactgtcctaaccctatcagctttgttgctatcattgtagtgaggcctgcctagggatgataagtgaaggat

SEQ ID NO: 113068 - DNA, 268 bp, Homo sapiens
tgtcaggcagcatcaagctctctaattcacctaattggtgtccaaatttaacagcattattcacaacataacttgaacaaggagattaaaactgaatttttgataggaaatttgtataacaagtgctgtgcccctcaaggagcatgttcttcctctcagttcttattgctcattagaaagagacaaggctgggccaggtgtggtggttcatgcctgtaatcccagcacttggggaggtggaagcaggaggatcgcttgagcccaggag

SEQ ID NO: 113069 - DNA, 772 bp, Homo sapiens
caggaatcctttttcctagtcagctttcttttagttctccacagtgacttcctcaaaaccttctccttacactagttcattttaaagaaaaggatacctatgttcattttaatatcataatggatagaaaatcttatttacttccaggagatagattatcatatgagaactcccttgaaattccaatactcaactacatgtttaactctatccatatttgtccttttatcctgtcctcctgtcctgtctgaagctaatgcctatacttgggctcttagtctcacccctgccaccttctcagggactaatggttagcagcgatcctctaactcagtcctttatttccgattccacttgctctttcccagtcacattaaaatgtgctcaaatctccttatctttgaaagaaatactctggacccctttagctgccaccttaccgcactgtgtccattcacagccaagcctcttgaaagcattaactgccctcagtgtctacttccctactcattttccagccctctgcccccaccacagctgctttcaccaaattaccaacaacctcctggttgctgaaaatcagaggatgttcttagttcttcacttgaccaccccctttttgaaaaaaagaatttgcttgacgtctgtagtttcgcattcctggtttttcccttgcctctctggctcctccttgtcagtccctgttcaaagaggcagtgctgtctggattagtggtcagccatggtacttaagaacctgggcttgggagaca

SEQ ID NO: 113070 - DNA, 635 bp, Homo sapiens
gggtcccatcatttacatgacttgaatggagcaatttctgtattcagtgtccctcttgttaaacttcagattatgaggtgatggaatttggcccccttggatcaggattaatcatttatatccatgacggcaagtggcaatgcccagatctggctaccggggaaatcactgtgagcagggctccaatttctgcctgctgctggggcagtgtggtatgggagaaagagaacaaagatgctgggtgtgagctggatttcactgcttagtaggcatcttaatagtcagattttagtgccttttaaagtaaattgcgataaaatatacataaaatttatcattttgaccgtttaaaaagatataattcagtgatattaaggacattcacaatgttgagcaaccatcactgctctgcatttccagaacttttttttactatcccagacagaaactctgtatcctttagaaaataaattcccattctctccttaccccagcccctggtaacctctagtctactttctgtctctatgaatttgcctattctaggtaccatgtataagtgaaaacatgcaatattcatctgtccttttgtgtgtctggcttgttttacttaatgttttcaaggttcatccatg

SEQ ID NO: 113071 - DNA, 345 bp, Homo sapiens
tgacatatttaaagtgctgaaagaaaaaaacttttatcctagaatagtatatccagcaaatatatccttcaagatgaacttttcactagactaagaaaaaaaacagggaagattcaaataaaattgcaaataaaaaaggagacattacaatggatacaacagaaatacaaaggattataagagactattatgaaaaagtataaaccaacaagctgaacaatctaaaatcaataaacaaatctcttgattcatacagcctagcaagactgtattataaaaaaatagaaaattttggccaggcacgacggctcatgcccgtaatctcagcactttgggaggccgaga

SEQ ID NO: 113072 - DNA, 1146 bp, Homo sapiens
ggcatcccatttagagaattcgggaaggttccctgcaagcttctgtgggaccactagcaccagtgggcacatcgagagcaaacacatcggagacaaatttttctttctttgtgaactctgccttaactcaaagattcctgtcatgacttaaagagaaactttcacaatgtctggagcccttgatgtcctgcaaatgaaggaggaggatgtccttaagctccttgcagtgggaatccaattaggtggcaccaaattgacttccaaatggaacagtacatctataaaaggaaagtgatggcatctacagcataaatctgaagaggacctgggagaagcttctgctggcaggtcatgccattgttgtcattgaaaactctgctgatgtcagtgtcatatcctccaggaatactggccagaaggctatgctgaagtttgctgctgccactggagccactccaattgctggccacttcactcctggaaccttcctaaccagatccaggcagcctactgggagccacggcttcttgtggtttctgaccccagggctgaccaccagtctctcacagaggcatcttgtgttaacccacctgccattgctttatgcaacacagattctcctctgtgccattggacattgccatcacatgcaacaacaagggagctccctcagtgggtcagatgtggtagatgctggcctgggaagttctgcacatgcgtggcaccatttcctgcaacacccatgggaggtaatgtctaatctctacttctacagagatcctgaagagactgaaaaagaagagcaggctgctgctgaaaaggctgtgaccaagaaggaatttcagggtaaatggactgtttcagctcctgagttcactgttactcagcctgaagttgcagactggtctgaaggcatgcaggtgccctctgtgcctattcagcagtttctactgaagactggaaggctcagcctgccatggaagactggtccacagctccactgctcaggccactgaatgggtaggagcaaccactgaatggtcttaagctgttcttgcacggactcttaagcaacatgaaaataaggttgacagaaaataaacatcagtttctaaaaaataaaaaataaaattctgtgatgcaaag

SEQ ID NO: 113073 - DNA, 1035 bp, Homo sapiens
tctctaataaccaccgctacagattcctgtcatgacttaaagagaaactttcacaatgtctggagcccttgatgtcctgcaaatgaaggaggaggatgtccttaagctccttgcagtgggaatccaattaggtggcaccaaattgacttccaaatggaacagtacatctataaaaggaaagtgatggcatctacagcataaatctgaagaggacctgggagaagcttctgctggcaggtcatgccattgttgtcattgaaaactctgctgatgtcagtgtcatatcctccaggaatactggccagaaggctatgctgaagtttgctgctgccactggagccactccaattgctggccacttcactcctggaaccttcctaaccagatccaggcagcctactgggagccacggcttcttgtggtttctgaccccagggctgaccaccagtctctcacagaggcatcttgtgttaacccacctgccattgctttatgcaacacagattctcctctgtgccattggacattgccatcacatgcaacaacaagggagctccctcagtgggtcagatgtggtagatgctggcctgggaagttctgcacatgcgtggcaccatttcctgcaacacccatgggaggtaatgtctaatctctacttctacagagatcctgaagagactgaaaaagaagagcaggctgctgctgaaaaggctgtgaccaagaaggaatttcagggtaaatggactgtttcagctcctgagttcactgttactcagcctgaagttgcagactggtctgaaggcatgcaggtgccctctgtgcctattcagcagtttctactgaagactggaaggctcagcctgccatggaagactggtccacagctccactgctcaggccactgaatgggtaggagcaaccactgaatggtcttaagctgttcttgcacggactcttaagcaacatgaaaataaggttgacagaaaataaacatcagtttctaaaaaataaaaaataaaattctgtgatgcaaag

SEQ ID NO: 113074 - DNA, 823 bp, Homo sapiens
cacaaacacacaaaattaagattaaaaaatattggaaacgacatatccccaaatgatagccaagcacttcgtttgcagatgcggtctttggcgcttcctacagatgtgccagcttgattcctaccaagccctaccaagcaggagttaatactctccccatttcacaaagggggaaattgaggcacagagggcagcacgtgggatgcaggaacccagaacccctagtcctttcttgggctcgacgggatggaccagcccctggagggggtccaacccctcccaacggcctgggaagccacggccaggctgggcggaaccgtgggtgtccctggcgccccaaggtgccaattaaatattcgtggccgtctggggccagagctgtggaccgcggcatggccgagccggggccggagcccgggcgtgcctggcgggtgctcgccctgtgcggggtggccgtgttcctggctgcggcagcagccggcggggccctggtagcctggaatctggccgcctcggctgctcggggacctcgctgcccggagccaggggccaatgccacggcgccgcccggggacccgccgcctggggtcgacgacctgcggcgccggctggcagaggctgccgagcgggaggaggccctagccaggcagctggaccaggcggaaagtatccggcacgagttggagaaggcattaaaggcctgtgaaggccgccaggtaggtgggccgggtagagggggagctcgggaatccagaatgttgagataagagacggcctgcccacacaactccagggttccctccctgtgcctcggtttccccag

SEQ ID NO: 113075 - DNA, 225 bp, Homo sapiens
ctgcacgccccctctcctgtgtccctccctgcactaacacacatctaatttattttacttattacaccttttatttattggggtgtccttgcactagaatgagaattctatgaaggcagagagctttgtctagtttgttcattgtgcattccaatgaaattgttgagtgaatgaatccatgaggacacatttgagcagggatctgaaagttgaaatgttacctgg

SEQ ID NO: 113076 - DNA, 311 bp, Homo sapiens
tgcaaaggaaatggtcacactcttggttgaccttagcttagtgggtaagcccaatgagcaaagagaacaaaaacctgaggagtgttggaaaaggggaaactcatcttccaaagtattttgcttctatgagaaagggaatccattacataacattcttggtttctctctgctccctctttcacttctaccagacagaaggagtgaattttctgactagaaatttaaaggacaggaactagcatctgtgctttggtcccttcctcctttttttctttgggatttgcctgtctgcagagagaacacagcctgtt

SEQ ID NO: 113077 - DNA, 341 bp, Homo sapiens
tttaagtaaattgacaatttataattgtatatatttatagtgtacaacgtgatgttataatttatgcatacaatgtggaataattaaatgaagctaattagcatatccatcatctcaatagttaacatttttttgtggtgagaatatttgaaatttactctcagcaatttgaaatgctctattattaagtatattgaccatttcttaacttggggtctaattaatttgtgagccacctaaaatcctactaagtttcctttgcttaagttagttggtgttattttctcttctatggaattaagacttaaagctgaaatattacataactatacatttaagtt

SEQ ID NO: 113078 - DNA, 403 bp, Homo sapiens
caaatccacttgacagaaataccaaggaaaagtagctgagtctggtggaaaaaccagaatcttaggaattgagcaggagtctggggaaaagcgtgaacaggcacgcaggcctcagagatagcttcacccattagcccagggtttctggcaggtctctgctgttagactttggttgtccccttgctcagagatactaaacagctgagctgctagtagactatattttcaagttttgagaacactgccgcctctcttgtaagcaccatccagctggaatgttgagacttgggccagttttcagaggtgccaatggcagaatcaaagccacacaccaggaatttttgttttgttttctacttgatctctgtccctagcagattattggtggtgactgtttatgcaa

SEQ ID NO: 113079 - DNA, 342 bp, Homo sapiens
acggtgggagagggatgcctgtatgctgatatggttgacgcctgtatggttgaattgggtctaccattcctcatctaattagctatggtctattaaggtgcatagctacacacaaatattggtactacgttcaattcagaggaagaagatattgcattcttgagagtagacaagaacaccctgaatttggggtcactgtatcataagtcatattatcaggtctctctaggaaggcttagaggaagatttccaggatacacttgtgacaacattgaaggcttccttcttccccaaagggacccgatctcccctcagtcaagaagctccaagtctctgaactgg

SEQ ID NO: 113080 - DNA, 238 bp, Homo sapiens
taggagttcaggaccagtctgggcaacatagtgagaccccacctctacaaaaaaagaaaaatcagccaggtgtggtggcacatgcctgcgaccccagcatcttgggacgctgaggcagggggttgcttgagcccaggagtttgaggctatgattgttctactgcactccagcctgggagacagtaagttcttttctcaaaaaaaaaaaaaaaaaaaagccaggcgcagtggctcatgc

SEQ ID NO: 113081 - DNA, 2874 bp, Homo sapiens
cggaaatggagggggtcgctttcctcaccttcctcgctgcgcgggcggcggttggtaaccggtcagaccagcccgagagggacctggtgcctgtacccaggcttctgtcgctctgtcgcctgcgctatgccctgctgtagtcacaggagctgtagagaggaccccggtacatctgaaagccgggaaatggacccagtggcctttgaggatgtggctgtgaacttcacccaggaagagtggacattgctggatatttcccagaagaatctcttcagggaagtgatgctggaaactttcaggaacctgacctctataggaaaaaaatggagtgaccagaacattgaatatgagtaccaaaaccccagaagaagcttcaggagtctcatagaagagaaagtcaatgaaattaaagaagacagtcattgtggagaaacttttacccaggttccagatgacagactgaacttccaggagaagaaagcttctcctgaagtaaaatcatgtgacagctttgtgtgtgcagaagttggcataggtaactcatcttttaatatgagcatcagaggtgacactggacacaaggcatatgagtatcaggaatatggaccaaagccatataagtgtcaacaacctaaaaataagaaagccttcaggtatcgcccatccattagaacacaagaaagggatcacactggagagaaaccctatgcttgtaaagtctgtggaaaaacctttattttccattcaagcattcgaagacacatggtaatgcacagtggggatggaacttataaatgtaaattttgtgggaaagccttccattctttcagtttatatcttatccatgaaagaactcacactggagagaaaccatatgaatgtaaacaatgtggtaaatcctttacttattctgctacccttcaaatacatgaaagaactcacactggggagaagccctatgaatgtagcaaatgtgataaagcatttcatagttctagttcctatcatagacatgaaagaagtcacatgggagagaagccttatcaatgcaaagaatgtggaaaagcatttgcatataccagttctcttcgtagacatgaaaggacccactctgggaaaaaaccgtatgaatgtaagcaatatggggaaggcttatcctatcttataagttttcaaacacacataagaatgaactctggagaaagaccttataaatgtaagatatgtgggaaaggcttttattctgccaagtcatttcaaacacatgaaaaaactcacactggagagaaacgctataaatgcaagcaatgtggtaaagccttcaatctttccagttcctttcgatatcatgaaaggattcacactggagagaaaccctatgagtgtaagcagtgtgggaaagccttcagatctgcctcacagcttcgagtgcacggtgggactcacactggagagaaaccctatgaatgtaaggaatgtgggaaagccttcagatctacctcacaccttcgagtgcatggtaggactcatactggagagaaaccctatgaatgtaaggaatgtgggaaagccttcagatatgtgaagcaccttcaaattcatgaaaggacagaaaaacacataagaatgccctctggagaaagaccttataaatgtagtatatgtgagaaaggcttttattctgccaagtcatttcaaacacatgaaaaaactcacactggagagaaaccctatgaatgcaaccaatgtggtaaagccttcagatgttgcaattcccttcgatatcatgaaaggactcacactggagagaaaccctatgagtgtaagcaatgtgggaaagccttcagatctgcctcacaccttcgaatgcatgaaaggactcacactggagagaaaccctatgagtgtaagcaatgtgggaaagccttcagttgtgcctcaaaccttcgaaagcatggtaggactcacactggagagaaaccctatgagtgtaagcaatgtgggaaagccttcagatctgcctcaaaccttcagatgcatgaaaggactcacactggagagaaaccctatgaatgtaaggaatgcgaaaaagcattctgtaaattctcttcttttcaaatacatgaaaggaagcacagaggagagaagccctatgaatgtaagcattgtgggaatggattcacatctgccaagattcttcaaatacatgcaagaacacacattggagagaaacactatgaatgtaaggaatgcggaaaagcattcaattatttttcttccttgcatatacacgcaaggactcatatgggagagaagccatatgaatgtaaggattgtgggaaagcattcagctagcctggttccttttatggacatgaatagactcacactggaaggaagcactatgaatgcaagcaatgtggcaaaactttcacattttccagttcttttcgatatcatgaaaggactcacactggggagaaaccctatcaatgtaagcagtgtgggaaagccttcattccttttacttcttttcaatgtcatgaaaggactcacacgggagagaaaccctatgagtgtattctagttccgtttgatatcatgaaaggacttacactggagtgaaaccctatgaatgtaagcaatgtgggaaagccttcagatgtgcctcgcaccttcaacggcatggaagggttcacacttgggagaaactctatgaatgtaagcagtatgggaaagccttcagatctgccaagattctttgaatacagataattaatgtaaacaattatcataagtatactaacatgttattctttttaaataagaaggtataataaaatatcccattggttttatgtattagatcaaaaa

SEQ ID NO: 113082 - DNA, 919 bp, Homo sapiens
cggaaatggagggggtcgctttcctcaccttcctcgctgcgcgggcggcggttggtaaccggtcagaccagcccgagagggacctggtgcctgtacccaggcttctgtcgctctgtcgcctgcgctatgccctgctgtagtcacaggagctgtagagaggaccccggtacatctgaaagccgggaaatggtgcgtgtgcgggaccagatgtcgtgagacgggggaggggctgcctggaacaggcgggaaccggctgtggcgggacccgggcctccctgtgggcgactccggggtctgggaccgagtcctccttgagcagttcggccctcggtccccttggccgctggacggggctgggccagcagccaggacccgggcgtcctgtcccgtccctgcgcggcgactgcggccgcggcccctgccccggagccctctctgggcagttccgctcccgcagccccgcgtctccccagattgtgcggaagcaacgggagggtcatggaggcatcctgactcgggtgtggggttcgtgcgtgggaggagcagtggtctgtggggcccccagtccccactttctcctgttaaaaattaaactgaggtacgttaacaattaaagagttcatttgagcaaacagcgattcacgaatgagaaacaccccgtcctgggttgtggtttgtcaacggaaaaagccaaactatgtaaaataaagaagtttattcagagccgaataggagagaccttggccgagggaaacacaaccccaagcagcctggagtaagtggtcccgaggcggctcaagacagtttggttttattcatttcagagagacaggaattgcagggaaaatgatgaatcagtgcctgaaaggtgtaagttccattggcagaaagggtgggacctgtggaaggggggttagaa

SEQ ID NO: 113083 - DNA, 389 bp, Homo sapiens
cggaaatggagggggtcgctttcctcaccttcctcgctgcgcgggcggcggttggtaaccggtcagaccagcccgagagggacctggtgcctgtacccaggcttctgtcgctctgtcgcctgcgctatgccctgctgtagtcacaggagctgtagagaggaccccggtacatctgaaagccgggaaatggacccagtggcctttgaggatgtggctgtgaacttcacccaggaagagtggacattgctggatatttcccagaagaatctcttcagggaagtgatgctggaaactttcaggaacctgacctctataggaaatggagtgaccagaacattgaatatgagtaccaaggacagtcattgtggagcttttacccaggttccagt

SEQ ID NO: 113084 - DNA, 2820 bp, Homo sapiens
cggaaatggagggggtcgctttcctcaccttcctcgctgcgcgggcggcggttggtaaccggtcagaccagcccgagagggacctggtgcctgtacccaggcttctgtcgctctgtcgcctgcgctatgccctgctgtagtcacaggagctgtagagaggaccccggtacatctgaaagccgggaaatggacccagtggcctttgaggatgtggctgtgaacttcacccaggaagagtggacattgctggatatttcccagaagaatctcttcagggaagtgatgctggaaactttcaggaacctgacctctataggaaaaaaatggagtgaccagaacattgaatatgagtaccaaaaccccagaagaagcttcaggagtctcatagaagagaaagtcaatgaaattaaagaagacagtcattgtggagaaacttttacccaggttccagatgacagactgaacttccaggagaagaaagcttctcctgaatttaatatgagcatcagaggtgacactggacacaaggcatatgagtatcaggaatatggaccaaagccatataagtgtcaacaacctaaaaataagaaagccttcaggtatcgcccatccattagaacacaagaaagggatcacactggagagaaaccctatgcttgtaaagtctgtggaaaaacctttattttccattcaagcattcgaagacacatggtaatgcacagtggggatggaacttataaatgtaaattttgtgggaaagccttccattctttcagtttatatcttatccatgaaagaactcacactggagagaaaccatatgaatgtaaacaatgtggtaaatcctttacttattctgctacccttcaaatacatgaaagaactcacactggggagaagccctatgaatgtagcaaatgtgataaagcatttcatagttctagttcctatcatagacatgaaagaagtcacatgggagagaagccttatcaatgcaaagaatgtggaaaagcatttgcatataccagttctcttcgtagacatgaaaggacccactctgggaaaaaaccgtatgaatgtaagcaatatggggaaggcttatcctatcttataagttttcaaacacacataagaatgaactctggagaaagaccttataaatgtaagatatgtgggaaaggcttttattctgccaagtcatttcaaacacatgaaaaaactcacactggagagaaacgctataaatgcaagcaatgtggtaaagccttcaatctttccagttcctttcgatatcatgaaaggattcacactggagagaaaccctatgagtgtaagcagtgtgggaaagccttcagatctgcctcacagcttcgagtgcacggtgggactcacactggagagaaaccctatgaatgtaaggaatgtgggaaagccttcagatctacctcacaccttcgagtgcatggtaggactcatactggagagaaaccctatgaatgtaaggaatgtgggaaagccttcagatatgtgaagcaccttcaaattcatgaaaggacagaaaaacacataagaatgccctctggagaaagaccttataaatgtagtatatgtgagaaaggcttttattctgccaagtcatttcaaacacatgaaaaaactcacactggagagaaaccctatgaatgcaaccaatgtggtaaagccttcagatgttgcaattcccttcgatatcatgaaaggactcacactggagagaaaccctatgagtgtaagcaatgtgggaaagccttcagatctgcctcacaccttcgaatgcatgaaaggactcacactggagagaaaccctatgagtgtaagcaatgtgggaaagccttcagttgtgcctcaaaccttcgaaagcatggtaggactcacactggagagaaaccctatgagtgtaagcaatgtgggaaagccttcagatctgcctcaaaccttcagatgcatgaaaggactcacactggagagaaaccctatgaatgtaaggaatgcgaaaaagcattctgtaaattctcttcttttcaaatacatgaaaggaagcacagaggagagaagccctatgaatgtaagcattgtgggaatggattcacatctgccaagattcttcaaatacatgcaagaacacacattggagagaaacactatgaatgtaaggaatgcggaaaagcattcaattatttttcttccttgcatatacacgcaaggactcatatgggagagaagccatatgaatgtaaggattgtgggaaagcattcagctagcctggttccttttatggacatgaatagactcacactggaaggaagcactatgaatgcaagcaatgtggcaaaactttcacattttccagttcttttcgatatcatgaaaggactcacactggggagaaaccctatcaatgtaagcagtgtgggaaagccttcattccttttacttcttttcaatgtcatgaaaggactcacacgggagagaaaccctatgagtgtattctagttccgtttgatatcatgaaaggacttacactggagtgaaaccctatgaatgtaagcaatgtgggaaagccttcagatgtgcctcgcaccttcaacggcatggaagggttcacacttgggagaaactctatgaatgtaagcagtatgggaaagccttcagatctgccaagattctttgaatacagataattaatgtaaacaattatcataagtatactaacatgttattctttttaaataagaaggtataataaaatatcccattggttttatgtattagatcaaaaa

SEQ ID NO: 113085 - DNA, 2784 bp, Homo sapiens
tggagtccacagcatcctgagaacttcttgggaatagagtctaggcctccagtgctgtcactctcacccatcttcctctacacatgtgagatgtttcaggacccagtggcctttgaggatgtggctgtgaacttcacccaggaagagtggacattgctggatatttcccagaagaatctcttcagggaagtgatgctggaaactttcaggaacctgacctctataggaaaaaaatggagtgaccagaacattgaatatgagtaccaaaaccccagaagaagcttcaggagtctcatagaagagaaagtcaatgaaattaaagaagacagtcattgtggagaaacttttacccaggttccagatgacagactgaacttccaggagaagaaagcttctcctgaagtaaaatcatgtgacagctttgtgtgtgcagaagttggcataggtaactcatcttttaatatgagcatcagaggtgacactggacacaaggcatatgagtatcaggaatatggaccaaagccatataagtgtcaacaacctaaaaataagaaagccttcaggtatcgcccatccattagaacacaagaaagggatcacactggagagaaaccctatgcttgtaaagtctgtggaaaaacctttattttccattcaagcattcgaagacacatggtaatgcacagtggggatggaacttataaatgtaaattttgtgggaaagccttccattctttcagtttatatcttatccatgaaagaactcacactggagagaaaccatatgaatgtaaacaatgtggtaaatcctttacttattctgctacccttcaaatacatgaaagaactcacactggggagaagccctatgaatgtagcaaatgtgataaagcatttcatagttctagttcctatcatagacatgaaagaagtcacatgggagagaagccttatcaatgcaaagaatgtggaaaagcatttgcatataccagttctcttcgtagacatgaaaggacccactctgggaaaaaaccgtatgaatgtaagcaatatggggaaggcttatcctatcttataagttttcaaacacacataagaatgaactctggagaaagaccttataaatgtaagatatgtgggaaaggcttttattctgccaagtcatttcaaacacatgaaaaaactcacactggagagaaacgctataaatgcaagcaatgtggtaaagccttcaatctttccagttcctttcgatatcatgaaaggattcacactggagagaaaccctatgagtgtaagcagtgtgggaaagccttcagatctgcctcacagcttcgagtgcacggtgggactcacactggagagaaaccctatgaatgtaaggaatgtgggaaagccttcagatctacctcacaccttcgagtgcatggtaggactcatactggagagaaaccctatgaatgtaaggaatgtgggaaagccttcagatatgtgaagcaccttcaaattcatgaaaggacagaaaaacacataagaatgccctctggagaaagaccttataaatgtagtatatgtgagaaaggcttttattctgccaagtcatttcaaacacatgaaaaaactcacactggagagaaaccctatgaatgcaaccaatgtggtaaagccttcagatgttgcaattcccttcgatatcatgaaaggactcacactggagagaaaccctatgagtgtaagcaatgtgggaaagccttcagatctgcctcacaccttcgaatgcatgaaaggactcacactggagagaaaccctatgagtgtaagcaatgtgggaaagccttcagttgtgcctcaaaccttcgaaagcatggtaggactcacactggagagaaaccctatgagtgtaagcaatgtgggaaagccttcagatctgcctcaaaccttcagatgcatgaaaggactcacactggagagaaaccctatgaatgtaaggaatgcgaaaaagcattctgtaaattctcttcttttcaaatacatgaaaggaagcacagaggagagaagccctatgaatgtaagcattgtgggaatggattcacatctgccaagattcttcaaatacatgcaagaacacacattggagagaaacactatgaatgtaaggaatgcggaaaagcattcaattatttttcttccttgcatatacacgcaaggactcatatgggagagaagccatatgaatgtaaggattgtgggaaagcattcagctagcctggttccttttatggacatgaatagactcacactggaaggaagcactatgaatgcaagcaatgtggcaaaactttcacattttccagttcttttcgatatcatgaaaggactcacactggggagaaaccctatcaatgtaagcagtgtgggaaagccttcattccttttacttcttttcaatgtcatgaaaggactcacacgggagagaaaccctatgagtgtattctagttccgtttgatatcatgaaaggacttacactggagtgaaaccctatgaatgtaagcaatgtgggaaagccttcagatgtgcctcgcaccttcaacggcatggaagggttcacacttgggagaaactctatgaatgtaagcagtatgggaaagccttcagatctgccaagattctttgaatacagataattaatgtaaacaattatcataagtatactaacatgttattctttttaaataagaaggtataataaaatatcccattggttttatgtattagatcaaaaa

SEQ ID NO: 113086 - DNA, 237 bp, Homo sapiens
cctccaaaagtgctgggattacaggcatgagccactgcacccggccacactttttttttttccttgttgtaccagctaattctctggcacattgaattatagtgatggaagcagtcatctttatcttgtaactgatttttaaaggaatcctttttgtttgtttgtttgttttgtttgtttgttttgagatggagtctcacagtgtagcctgggctggagtgcagtggtgcaatctca

SEQ ID NO: 113087 - DNA, 4638 bp, Homo sapiens
ggtggagccgagcggtgcggagcagatctggtggttctccggagagcagcttccttgggtgttacatgagccaagccctcactgtacagaagagtgagagctgaaacctgttccctgagctgatcagaaggacatcccttggcccctccatctgggctcctgtggataggaggggctgggtgagcaggccagctgggctatggtgtggtgcctcggcctggccgtcctcagcctggtcatcagccagggggctgacggtcgagggaagcctgaggtggtatcggtggtgggccgggctggggagagtgtggtgctgggctgtgacctgctgcccccggccggccggccccccctgcatgtcatcgagtggctgcgctttggattcctgcttcccatcttcatccagttcggcctctactctccccgaattgaccctgattacgtgggacgagtccggctgcagaagggggcctctctccagattgagggtctccgggtggaagaccagggctggtacgagtgccgcgtgttcttcctggaccagcacatccctgaagacgattttgctaacggctcctgggtgcatctgacagtcaattcaccccctcaattccaggagacacctcctgctgtgttggaagtgcaggaactggagcctgtgaccctgcgttgtgtggcccgtggcagccccctgcctcatgtgacgtggaagctccgaggaaaggaccttggccagggccagggccaggtgcaagtgcagaacgggacgctgcggatccgccgggtagagcgaggcagctctggggtctacacctgccaagcctccagcactgagggcagcgccacccacgccacccagctgctagtgctaggacccccagtcatcgtggtgccccccaagaacagcacagtcaatgcctcccaggatgtttcattggcctgccatgctgaggcataccctgctaacctcacctacagctggttccaggacaacatcaatgtcttccacattagccgcctgcagccccgggtgcggatcctggtggacgggagcctgcggctgctggccacccagcctgatgatgccggctgctacacctgtgtgcccagcaatggcctcctgcatccaccctcagcctctgcctacctcactgtgctctacccagcccaggtgacagctatgcctcctgagacacccctgcccataggcatgccgggggtgatccgctgcccggttcgtgccaaccccccactgctctttgtcagctggaccaaggatggaaaggccctgcagctggacaagttccctggctggtcccagggcacagaaggctcactgatcatcgccctggggaacgaggatgccctgggagaatactcctgcaccccctacaacagtcttggtaccgccgggccctctcctgtgacccgcgtgctgctcaaggctcccccagcttttatagagcggcccaaggaagaatatttccaagaagtagggcgggagctgctcatcccctgctccgcccaaggggaccctcctcctgttgtctcttggaccaagggctcaccagtggttctgtaggtgggccgggggctgcaaggccaggcccaggtggacagcaacagcagcctcatcctgcgaccattgaccaaggaggcccacgggcactgggaatgcagtgccagcaatgctgtggcccgagtggccacctccacgaacgtctacgtgctgggcactagccctcatgttgtcaccaatgtgtccgtggtggctttgcccaagggtgccaatgtctcctgggagcctggctttgatggtggttatctgcagagattcagtgtctggtacaccccactggccaagcgtcctgaccgaatgcaccatgactgggtgtccttggcagtgcctgtgggggctgctcacctcctagtgccagggctgcagccccacacccagtaccagttcagcgtgctagctcagaacaagctggggagtggtcccttcagcgaaatcgtcttgtctgctccggaagggcttcctaccacgccagctgcacccgggcttcccccaacagagataccgcctcccctgtcccctccgcggggtctggtggcagtgaggacaccccggggggtactcctgcattgggatcccccagagctggtccctaagagactggatggctacgtcttggaaggccggcaaggctcccagggctgggaggtgctggacccggctgtggcaggcacagaaacagagctgctggtgccaggcctcatcaaggatgttctctacgagttccgcctcgtggccttcgcgggcagcttcgtcagcgaccccagcaacacggccaacgtctccacttccggtctggaggtctacccttcgcgcacgcagctgccgggcctcctgcctcagcccgtgctggccggcgtggtgggcggagtctgctttctgggagtggccgtccttgtgagcatcctggccggctgcctcctgaaccggcgcagggctgcccgccgccgccgcaagcgcctccgccaagatccacctcttatcttctctccgaccgggaagtcagctgcaccctctgctctgggctcaggcagtcctgacagcgtggcgaagctgaagctccagggatccccagtccccagcctgcgccagagtctgctctggggggatcctgccggaactcccagcccccacccggatcctccatctagccggggacccttacctctggagcccatttgccggggcccagacgggcgctttgtgatggggcccactgtggcggccccccaggaaaggtcaggccgggagcaggcagaacctcggactccagcccagcgtctggcccggtcctttgactgtagcagcagcagccccagtggggcaccccagcccctctgcattgaagacatcagccctgtggcaccccctccagcagccccacccagtcccttgccaggtcctggacccctgctccagtacctgagcctgcccttcttccgagagatgaatgtggatggggactggcccccgcttgaggagcccagccctgctgcacccccagattacatggatacccggcgctgtcccacctcatctttccttcgttctccagaaacccctcctgtatcccccagggaatcacttcctggggctgtggtaggggctggggccactgcagagcccccttacacagccctggctgactggacactgagggagcggctgctgccaggccttctccctgctgcccctcgaggcagcctcaccagccagagcagtgggcgaggcagcgcttcgttcctgcggcccccctccacagccccctctgcaggaggcagctacctcagccctgctccaggagacaccagcagctgggccagtggccctgagagatggccccgaagggagcatgtggtgacagtcagcaagaggaggaacacatctgtggacgagaactatgagtgggactcagaattccctggggacatggaattgctggagactttgcacctgggcttggccagctcccggctcagacctgaagctgagccagagctaggtgtgaagactccagaggagggctgcctcctgaacactgcccatgttactggccctgaggcccgctgtgctgcccttcgggaggaattcctggccttccgccgccgccgagatgctactagggctcggctaccagcctatcgacagccagtcccccaccccgaacaggccactctgctgtgaacatccctaatgtgaggctgtgaaaaggcatatggacctgcaaaggaggcccccaaccagacagacctagtttcaaacgagggcactgcccctgcctgcccctttggtgcccaggcacagaccctgatagtgggtttgggtcaccttggtatggaatgtatgtgctgaccccctaggtgagtctggggattggaacagggatcttaggtctgcctctctctctctctctctctctctctctctctctgtgtgtgtgtgtgtgtgtgtgaagttttttacaggtgaataaacaaagtttgaaagatgtttctgtgtgttatctgtctttgagagagtgccaggaaaatccctggacccttaaagaagaggagaatcttcttgaataaatggaggtgcattcagcattcattcaagaaacatttattgagtgcttacggaggccagctactaaaggccagccactgaagtagatactgagaaaatacaaagctctggaagcacgcctttgcccttgaggagttctttctagtcagtgaggcggacaaagaaatagttaccgtatgataagttccgtgataaagctatgtgttggttattgtagcacaaaggaagatgttgcattcaaggccacctttagtgaacgctaatatcgtgtgctgggacaaatgccacatattgggggggagtcctcaggaccctcacagatagatggtggtaataatagtattcactatgtgccaggcactgctctaagccctataggtggactgtttagttctctacaattctatgaattaggtagtactattagctctgttctatagaccagggaactcaagcatagaatgcacaacagtcacacagcaggtaaagggtag

SEQ ID NO: 113088 - DNA, 3579 bp, Homo sapiens
ggacatcagtcacacacatccagaagtaagatatcctgttgcccaactctcactaaccttgaccgtgctgcctccctctctggggctctgggaggaagaatgttctgcagaggtttgtacatctctgagagtcctgcctaagcctgccagcccttactacaccaccattttcctccagcccctacccactggggaacagaaacagagccagagaggaattgagagatggagagagaatgaggtagagacaggcttggtgagtgtttagctagggggagtgagggagagtgaggtgagacatggcatgacagggagcacagagagagggagtagccagccttagatgtaagagagggcccctcccaatgccagatctggcttgcaggctcccccagcttttatagagcggcccaaggaagaatatttccaagaagtagggcgggagctgctcatcccctgctccgcccaaggggaccctcctcctgttgtctcttggaccaagggctcaccagtggttctgtaggtgggccgggggctgcaaggccaggcccaggtggacagcaacagcagcctcatcctgcgaccattgaccaaggaggcccacgggcactgggaatgcagtgccagcaatgctgtggcccgagtggccacctccacgaacgtctacgtgctgggcactagccctcatgttgtcaccaatgtgtccgtggtggctttgcccaagggtgccaatgtctcctgggagcctggctttgatggtggttatctgcagagattcagtgtctggtacaccccactggccaagcgtcctgaccgaatgcaccatgactgggtgtccttggcagtgcctgtgggggctgctcacctcctagtgccagggctgcagccccacacccagtaccagttcagcgtgctagctcagaacaagctggggagtggtcccttcagcgaaatcgtcttgtctgctccggaagggcttcctaccacgccagctgcacccgggcttcccccaacagagataccgcctcccctgtcccctccgcggggtctggtggcagtgaggacaccccggggggtactcctgcattgggatcccccagagctggtccctaagagactggatggctacgtcttggaaggccggcaaggctcccagggctgggaggtgctggacccggctgtggcaggcacagaaacagagctgctggtgccaggcctcatcaaggatgttctctacgagttccgcctcgtggccttcgcgggcagcttcgtcagcgaccccagcaacacggccaacgtctccacttccggtctggaggtctacccttcgcgcacgcagctgccgggcctcctgcctcagcccgtgctggccggcgtggtgggcggagtctgctttctgggagtggccgtccttgtgagcatcctggccggctgcctcctgaaccggcgcagggctgcccgccgccgccgcaagcgcctccgccaagatccacctcttatcttctctccgaccgggaagtcagctgcaccctctgctctgggctcaggcagtcctgacagcgtggcgaagctgaagctccagggatccccagtccccagcctgcgccagagtctgctctggggggatcctgccggaactcccagcccccacccggatcctccatctagccggggacccttacctctggagcccatttgccggggcccagacgggcgctttgtgatggggcccactgtggcggccccccaggaaaggtcaggccgggagcaggcagaacctcggactccagcccagcgtctggcccggtcctttgactgtagcagcagcagccccagtggggcaccccagcccctctgcattgaagacatcagccctgtggcaccccctccagcagccccacccagtcccttgccaggtcctggacccctgctccagtacctgagcctgcccttcttccgagagatgaatgtggatggggactggcccccgcttgaggagcccagccctgctgcacccccagattacatggatacccggcgctgtcccacctcatctttccttcgttctccagaaacccctcctgtatcccccagggaatcacttcctggggctgtggtaggggctggggccactgcagagcccccttacacagccctggctgactggacactgagggagcggctgctgccaggccttctccctgctgcccctcgaggcagcctcaccagccagagcagtgggcgaggcagcgcttcgttcctgcggcccccctccacagccccctctgcaggaggcagctacctcagccctgctccaggagacaccagcagctgggccagtggccctgagagatggccccgaagggagcatgtggtgacagtcagcaagaggaggaacacatctgtggacgagaactatgagtgggactcagaattccctggggacatggaattgctggagactttgcacctgggcttggccagctcccggctcagacctgaagctgagccagagctaggtgtgaagactccagaggagggctgcctcctgaacactgcccatgttactggccctgaggcccgctgtgctgcccttcgggaggaattcctggccttccgccgccgccgagatgctactagggctcggctaccagcctatcgacagccagtcccccaccccgaacaggccactctgctgtgaacatccctaatgtgaggctgtgaaaaggcatatggacctgcaaaggaggcccccaaccagacagacctagtttcaaacgagggcactgcccctgcctgcccctttggtgcccaggcacagaccctgatagtgggtttgggtcaccttggtatggaatgtatgtgctgaccccctaggtgagtctggggattggaacagggatcttaggtctgcctctctctctctctctctctctctctctctctctgtgtgtgtgtgtgtgtgtgtgaagttttttacaggtgaataaacaaagtttgaaagatgtttctgtgtgttatctgtctttgagagagtgccaggaaaatccctggacccttaaagaagaggagaatcttcttgaataaatggaggtgcattcagcattcattcaagaaacatttattgagtgcttacggaggccagctactaaaggccagccactgaagtagatactgagaaaatacaaagctctggaagcacgcctttgcccttgaggagttctttctagtcagtgaggcggacaaagaaatagttaccgtatgataagttccgtgataaagctatgtgttggttattgtagcacaaaggaagatgttgcattcaaggccacctttagtgaacgctaatatcgtgtgctgggacaaatgccacatattgggggggagtcctcaggaccctcacagatagatggtggtaataatagtattcactatgtgccaggcactgctctaagccctataggtggactgtttagttctctacaattctatgaattaggtagtactattagctctgttctatagaccagggaactcaagcatagaatgcacaacagtcacacagcaggtaaagggtag

SEQ ID NO: 113089 - DNA, 4617 bp, Homo sapiens
ggtggagccgagcggtgcggagcagatctggtggttctccggagagcagcttccttgggtgttacatgagccaagccctcactgtacagaagagtgagagctgaaacctgttccctgagctgatcagaaggacatcccttggcccctccatctgggctcctgtggataggaggggctgggtgagcaggccagctgggctatggtgtggtgcctcggcctggccgtcctcagcctggtcatcagccagggggctgacggtcgagggaagcctgaggtggtatcggtggtgggccgggctggggagagtgtggtgctgggctgtgacctgctgcccccggccggccggccccccctgcatgtcatcgagtggctgcgctttggattcctgcttcccatcttcatccagttcggcctctactctccccgaattgaccctgattacgtgggacgagtccggctgcagaagggggcctctctccagattgagggtctccgggtggaagaccagggctggtacgagtgccgcgtgttcttcctggaccagcacatccctgaagacgattttgctaacggctcctgggtgcatctgacagtcaattcaccccctcaattccaggagacacctcctgctgtgttggaagtgcaggaactggagcctgtgaccctgcgttgtgtggcccgtggcagccccctgcctcatgtgacgtggaagctccgaggaaaggaccttggccagggccagggccaggtgcaagtgcagaacgggacgctgcggatccgccgggtagagcgaggcagctctggggtctacacctgccaagcctccagcactgagggcagcgccacccacgccacccagctgctagtgctaggacccccagtcatcgtggtgccccccaagaacagcacagtcaatgcctcccaggatgtttcattggcctgccatgctgaggcataccctgctaacctcacctacagctggttccaggacaacatcaatgtcttccacattagccgcctgcagccccgggtgcggatcctggtggacgggagcctgcggctgctggccacccagcctgatgatgccggctgctacacctgtgtgcccagcaatggcctcctgcatccaccctcagcctctgcctacctcactgtgctctacccagcccaggtgacagctatgcctcctgagacacccctgcccataggcatgccgggggtgatccgctgcccggttcgtgccaaccccccactgctctttgtcagctggaccaaggatggaaaggccctgcagctggacaagttccctggctggtcccagggcacagaaggctcactgatcatcgccctggggaacgaggatgccctgggagaatactcctgcaccccctacaacagtcttggtaccgccgggccctctcctgtgacccgcgtgctgctcaaggctcccccagcttttatagagcggcccaaggaagaatatttccaagaagtagggcgggagctgctcatcccctgctccgcccaaggggaccctcctcctgttgtctcttggaccaaggtgggccgggggctgcaaggccaggcccaggtggacagcaacagcagcctcatcctgcgaccattgaccaaggaggcccacgggcactgggaatgcagtgccagcaatgctgtggcccgagtggccacctccacgaacgtctacgtgctgggcactagccctcatgttgtcaccaatgtgtccgtggtggctttgcccaagggtgccaatgtctcctgggagcctggctttgatggtggttatctgcagagattcagtgtctggtacaccccactggccaagcgtcctgaccgaatgcaccatgactgggtgtccttggcagtgcctgtgggggctgctcacctcctagtgccagggctgcagccccacacccagtaccagttcagcgtgctagctcagaacaagctggggagtggtcccttcagcgaaatcgtcttgtctgctccggaagggcttcctaccacgccagctgcacccgggcttcccccaacagagataccgcctcccctgtcccctccgcggggtctggtggcagtgaggacaccccggggggtactcctgcattgggatcccccagagctggtccctaagagactggatggctacgtcttggaaggccggcaaggctcccagggctgggaggtgctggacccggctgtggcaggcacagaaacagagctgctggtgccaggcctcatcaaggatgttctctacgagttccgcctcgtggccttcgcgggcagcttcgtcagcgaccccagcaacacggccaacgtctccacttccggtctggaggtctacccttcgcgcacgcagctgccgggcctcctgcctcagcccgtgctggccggcgtggtgggcggagtctgctttctgggagtggccgtccttgtgagcatcctggccggctgcctcctgaaccggcgcagggctgcccgccgccgccgcaagcgcctccgccaagatccacctcttatcttctctccgaccgggaagtcagctgcaccctctgctctgggctcaggcagtcctgacagcgtggcgaagctgaagctccagggatccccagtccccagcctgcgccagagtctgctctggggggatcctgccggaactcccagcccccacccggatcctccatctagccggggacccttacctctggagcccatttgccggggcccagacgggcgctttgtgatggggcccactgtggcggccccccaggaaaggtcaggccgggagcaggcagaacctcggactccagcccagcgtctggcccggtcctttgactgtagcagcagcagccccagtggggcaccccagcccctctgcattgaagacatcagccctgtggcaccccctccagcagccccacccagtcccttgccaggtcctggacccctgctccagtacctgagcctgcccttcttccgagagatgaatgtggatggggactggcccccgcttgaggagcccagccctgctgcacccccagattacatggatacccggcgctgtcccacctcatctttccttcgttctccagaaacccctcctgtatcccccagggaatcacttcctggggctgtggtaggggctggggccactgcagagcccccttacacagccctggctgactggacactgagggagcggctgctgccaggccttctccctgctgcccctcgaggcagcctcaccagccagagcagtgggcgaggcagcgcttcgttcctgcggcccccctccacagccccctctgcaggaggcagctacctcagccctgctccaggagacaccagcagctgggccagtggccctgagagatggccccgaagggagcatgtggtgacagtcagcaagaggaggaacacatctgtggacgagaactatgagtgggactcagaattccctggggacatggaattgctggagactttgcacctgggcttggccagctcccggctcagacctgaagctgagccagagctaggtgtgaagactccagaggagggctgcctcctgaacactgcccatgttactggccctgaggcccgctgtgctgcccttcgggaggaattcctggccttccgccgccgccgagatgctactagggctcggctaccagcctatcgacagccagtcccccaccccgaacaggccactctgctgtgaacatccctaatgtgaggctgtgaaaaggcatatggacctgcaaaggaggcccccaaccagacagacctagtttcaaacgagggcactgcccctgcctgcccctttggtgcccaggcacagaccctgatagtgggtttgggtcaccttggtatggaatgtatgtgctgaccccctaggtgagtctggggattggaacagggatcttaggtctgcctctctctctctctctctctctctctctctctctgtgtgtgtgtgtgtgtgtgtgaagttttttacaggtgaataaacaaagtttgaaagatgtttctgtgtgttatctgtctttgagagagtgccaggaaaatccctggacccttaaagaagaggagaatcttcttgaataaatggaggtgcattcagcattcattcaagaaacatttattgagtgcttacggaggccagctactaaaggccagccactgaagtagatactgagaaaatacaaagctctggaagcacgcctttgcccttgaggagttctttctagtcagtgaggcggacaaagaaatagttaccgtatgataagttccgtgataaagctatgtgttggttattgtagcacaaaggaagatgttgcattcaaggccacctttagtgaacgctaatatcgtgtgctgggacaaatgccacatattgggggggagtcctcaggaccctcacagatagatggtggtaataatagtattcactatgtgccaggcactgctctaagccctataggtggactgtttagttctctacaattctatgaattaggtagtactattagctctgttctatagaccagggaactcaagcatagaatgcacaacagtcacacagcaggtaaagggtag

SEQ ID NO: 113090 - DNA, 3627 bp, Homo sapiens
caggcaggaagccccacgcggcccaactacaggggtggccattcacagtgtattttctgtgagtggcaccccctggagttgtgcagtcacagcctcacactattgggaggggtccctctgcaggaaggaaaggaagcactggaaatcagagaggggtcaggcctagacatggagctgctggagtcttctgcacagctgtgggtttctcatcctgccccctctcttgtactgccatcccgggcttgtctctgctgagctcctctctctagctgtcatcttctcttccttccagttccctggctggtcccagggcacagaaggctcactgatcatcgccctggggaacgaggatgccctgggagaatactcctgcaccccctacaacagtcttggtaccgccgggccctctcctgtgacccgcgtgctgctcaaggctcccccagcttttatagagcggcccaaggaagaatatttccaagaagtagggcgggagctgctcatcccctgctccgcccaaggggaccctcctcctgttgtctcttggaccaagggctcaccagtggttctgtaggtgggccgggggctgcaaggccaggcccaggtggacagcaacagcagcctcatcctgcgaccattgaccaaggaggcccacgggcactgggaatgcagtgccagcaatgctgtggcccgagtggccacctccacgaacgtctacgtgctgggcactagccctcatgttgtcaccaatgtgtccgtggtggctttgcccaagggtgccaatgtctcctgggagcctggctttgatggtggttatctgcagagattcagtgtctggtacaccccactggccaagcgtcctgaccgaatgcaccatgactgggtgtccttggcagtgcctgtgggggctgctcacctcctagtgccagggctgcagccccacacccagtaccagttcagcgtgctagctcagaacaagctggggagtggtcccttcagcgaaatcgtcttgtctgctccggaagggcttcctaccacgccagctgcacccgggcttcccccaacagagataccgcctcccctgtcccctccgcggggtctggtggcagtgaggacaccccggggggtactcctgcattgggatcccccagagctggtccctaagagactggatggctacgtcttggaaggccggcaaggctcccagggctgggaggtgctggacccggctgtggcaggcacagaaacagagctgctggtgccaggcctcatcaaggatgttctctacgagttccgcctcgtggccttcgcgggcagcttcgtcagcgaccccagcaacacggccaacgtctccacttccggtctggaggtctacccttcgcgcacgcagctgccgggcctcctgcctcagcccgtgctggccggcgtggtgggcggagtctgctttctgggagtggccgtccttgtgagcatcctggccggctgcctcctgaaccggcgcagggctgcccgccgccgccgcaagcgcctccgccaagatccacctcttatcttctctccgaccgggaagtcagctgcaccctctgctctgggctcaggcagtcctgacagcgtggcgaagctgaagctccagggatccccagtccccagcctgcgccagagtctgctctggggggatcctgccggaactcccagcccccacccggatcctccatctagccggggacccttacctctggagcccatttgccggggcccagacgggcgctttgtgatggggcccactgtggcggccccccaggaaaggtcaggccgggagcaggcagaacctcggactccagcccagcgtctggcccggtcctttgactgtagcagcagcagccccagtggggcaccccagcccctctgcattgaagacatcagccctgtggcaccccctccagcagccccacccagtcccttgccaggtcctggacccctgctccagtacctgagcctgcccttcttccgagagatgaatgtggatggggactggcccccgcttgaggagcccagccctgctgcacccccagattacatggatacccggcgctgtcccacctcatctttccttcgttctccagaaacccctcctgtatcccccagggaatcacttcctggggctgtggtaggggctggggccactgcagagcccccttacacagccctggctgactggacactgagggagcggctgctgccaggccttctccctgctgcccctcgaggcagcctcaccagccagagcagtgggcgaggcagcgcttcgttcctgcggcccccctccacagccccctctgcaggaggcagctacctcagccctgctccaggagacaccagcagctgggccagtggccctgagagatggccccgaagggagcatgtggtgacagtcagcaagaggaggaacacatctgtggacgagaactatgagtgggactcagaattccctggggacatggaattgctggagactttgcacctgggcttggccagctcccggctcagacctgaagctgagccagagctaggtgtgaagactccagaggagggctgcctcctgaacactgcccatgttactggccctgaggcccgctgtgctgcccttcgggaggaattcctggccttccgccgccgccgagatgctactagggctcggctaccagcctatcgacagccagtcccccaccccgaacaggccactctgctgtgaacatccctaatgtgaggctgtgaaaaggcatatggacctgcaaaggaggcccccaaccagacagacctagtttcaaacgagggcactgcccctgcctgcccctttggtgcccaggcacagaccctgatagtgggtttgggtcaccttggtatggaatgtatgtgctgaccccctaggtgagtctggggattggaacagggatcttaggtctgcctctctctctctctctctctctctctctctctctgtgtgtgtgtgtgtgtgtgtgaagttttttacaggtgaataaacaaagtttgaaagatgtttctgtgtgttatctgtctttgagagagtgccaggaaaatccctggacccttaaagaagaggagaatcttcttgaataaatggaggtgcattcagcattcattcaagaaacatttattgagtgcttacggaggccagctactaaaggccagccactgaagtagatactgagaaaatacaaagctctggaagcacgcctttgcccttgaggagttctttctagtcagtgaggcggacaaagaaatagttaccgtatgataagttccgtgataaagctatgtgttggttattgtagcacaaaggaagatgttgcattcaaggccacctttagtgaacgctaatatcgtgtgctgggacaaatgccacatattgggggggagtcctcaggaccctcacagatagatggtggtaataatagtattcactatgtgccaggcactgctctaagccctataggtggactgtttagttctctacaattctatgaattaggtagtactattagctctgttctatagaccagggaactcaagcatagaatgcacaacagtcacacagcaggtaaagggtag

SEQ ID NO: 113091 - DNA, 4062 bp, Homo sapiens
ggtggagccgagcggtgcggagcagatctggtggttctccggagagcagcttccttgggtgttacatgagccaagccctcactgtacagaagagtgagagctgaaacctgttccctgagctgatcagaaggacatcccttggcccctccatctgggctcctgtggataggaggggctgggtgagcaggccagctgggctatggtgtggtgcctcggcctggccgtcctcagcctggtcatcagccagggggctgacggtcgagggaagcctgaggtggtatcggtggtgggccgggctggggagagtgtggtgctgggctgtgacctgctgcccccggccggccggccccccctgcatgtcatcgagtggctgcgctttggattcctgcttcccatcttcatccagttcggcctctactctccccgaattgaccctgattacgtgggacgagtccggctgcagaagggggcctctctccagattgagggtctccgggtggaagaccagggctggtacgagtgccgcgtgttcttcctggaccagcacatccctgaagacgattttgctaacggctcctgggtgcatctgacagtcaattcaccccctcaattccaggagacacctcctgctgtgttggaagtgcaggaactggagcctgtgaccctgcgttgtgtggcccgtggcagccccctgcctcatgtgacgtggaagctccgaggaaaggaccttggccagggccagggccaggtgcaagtgcagaacgggacgctgcggatccgccgggtagagcgaggcagctctggggtctacacctgccaagcctccagcactgagggcagcgccacccacgccacccagctgctagtgctaggacccccagtcatcgtggtgccccccaagaacagcacagtcaatgcctcccaggatgtttcattggcctgccatgctgaggcataccctgctaacctcacctacagctggttccaggacaacatcaatgtcttccacattagccgcctgcagccccgggtgcggatcctggtggacgggagcctgcggctgctggccacccagcctgatgatgccggctgctacacctgtgtgcccagcaatggcctcctgcatccaccctcagcctctgcctacctcactgtgctctacccagcccaggtgacagctatgcctcctgagacacccctgcccataggcatgccgggggtgatccgctgcccggttcgtgccaaccccccactgctctttgtcagctggaccaaggatggaaaggccctgcagctggacaagttccctggctggtcccagggcacagaaggctcactgatcatcgccctggggaacgaggatgccctgggagaatactcctgcaccccctacaacagtcttggtaccgccgggccctctcctgtgacccgcgtgctgctcaaggctcccccagcttttatagagcggcccaaggaagaatatttccaagaagtagggcgggagctgctcatcccctgctccgcccaaggggaccctcctcctgttgtctcttggaccaaggtgggccgggggctgcaaggccaggcccaggtggacagcaacagcagcctcatcctgcgaccattgaccaaggaggcccacgggcactgggaatgcagtgccagcaatgctgtggcccgagtggccacctccacgaacgtctacgtgctgggcactagccctcatgttgtcaccaatgtgtccgtggtggctttgcccaagggtgccaatgtctcctgggagcctggctttgatggtggttatctgcagagattcagtgtctggtacaccccactggccaagcgtcctgaccgaatgcaccatgactgggtgtccttggcagtgcctgtgggggctgctcacctcctagtgccagggctgcagccccacacccagtaccagttcagcgtgctagctcagaacaagctggggagtggtcccttcagcgaaatcgtcttgtctgctccggaagggcttcctaccacgccagctgcacccgggcttcccccaacagagataccgcctcccctgtcccctccgcggggtctggtggcagtgaggacaccccggggggtactcctgcattgggatcccccagagctggtccctaagagactggatggctacgtcttggaaggccggcaaggctcccagggctgggaggtgctggacccggctgtggcaggcacagaaacagagctgctggtgccaggcctcatcaaggatgttctctacgagttccgcctcgtggccttcgcgggcagcttcgtcagcgaccccagcaacacggccaacgtctccacttccggtctggaggtctacccttcgcgcacgcagctgccgggcctcctgcctcagcccgtgctggccggcgtggtgggcggagtctgctttctgggagtggccgtccttgtgagcatcctggccggctgcctcctgaaccggcgcagggctgcccgccgccgccgcaagcgcctccgccaagatccacctcttatcttctctccgaccgggaagtcagctgcaccctctgctctgggctcaggcagtcctgacagcgtggcgaagctgaagctccagggatccccagtccccagcctgcgccagagtctgctctggggggatcctgccggaactcccagcccccacccggatcctccatctagccggggacccttacctctggagcccatttgccggggcccagacgggcgctttgtgatggggcccactgtggcggccccccaggaaaggtcaggccgggagcaggcagaacctcggactccagcccagcgtctggcccggtcctttgactgtagcagcagcagccccagtggggcaccccagcccctctgcattgaagacatcagccctgtggcaccccctccagcagccccacccagtcccttgccaggtcctggacccctgctccagtacctgagcctgcccttcttccgagagatgaatgtggatggggactggcccccgcttgaggagcccagccctgctgcacccccagattacatggatacccggcgctgtcccacctcatctttccttcgttctccagaaacccctcctgtatcccccagggaatcacttcctggggctgtggtaggggctggggccactgcagagcccccttacacagccctggctgactggacactgagggagcggctgctgccaggccttctccctgctgcccctcgaggcagcctcaccagccagagcagtgggcgaggcagcgcttcgttcctgcggcccccctccacagccccctctgcaggaggcagctacctcagccctgctccaggagacaccagcagctgggccagtggccctgagagatggccccgaagggagcatgtggtgacagtcagcaagaggaggaacacatctgtggacgagaactatgagtgggactcagaattccctggggacatggaattgctggagactttgcacctgggcttggccagctcccggctcagacctgaagctgagccagagctaggtgtgaagactccagaggagggctgcctcctgaacactgcccatgttactggccctgaggcccgctgtgctgcccttcgggaggaattcctggccttccgccgccgccgagatgctactagggctcggctaccagcctatcgacagccagtcccccaccccgaacaggccactctgctgtgaacatccctaatgtgaggctgtgaaaaggcatatggacctgcaaaggaggcccccaaccagacagacctagtttcaaacgagggcactgcccctgcctgcccctttggtgcccaggcacagaccctgatagtgggtttgggtcaccttggtatggaatgtatgtgctgaccccctaggtgagtctggggatgttcacagcagagtggcctgttcggggtgggggactggctgtcgataggctggtagccgagccctagtagcatctcggcggcggcggaaggccaggaattcctcccgaagggcagcacagcgggcctcgtgcc

SEQ ID NO: 113092 - DNA, 449 bp, Homo sapiens
acagtgaggaggtggggaaggcatcttggaattttagagcttctcatgcagcttttactgaccttattttaacctgtcacccttttaccctcagtctttgagcagactggagtgagtacttctcggcttttctcactgttggtatagcattccctctctcaagttggctgagacagttgccacttgtccatctgttttccactttcatgatttgtagtttccattacagttctttaagtccttgggtctctatgtcttctagaaagatctcttactgtcacttaagtggggtttagggaaagggtgtaattggatatgtgtgttaaatttaccgtcttaatctggaaggctcggaagatgaatccttagaactaaaaaaataccggatcatgttacattttgtttcgttggcaaggactgccatctgtaatcagtgtttcttttaaggg

SEQ ID NO: 113093 - DNA, 578 bp, Homo sapiens
ctaatgcttagctagttttagtattcttgacaaattccatttacctaatagatcagtcgtttaatgtagctttttgtttgtttgtttgtttgttttgagacagagtctggctctgtcacccaggttggagtgcagtggtgagatctcggctcattgaaacctctgcctcctgggttcatgcgattctcctgcctcagtctcttgagtagctgggattataggcgcccaccatcatgcccggctaattttggggtttttagtagagacggggtttcaccatgttggccaggctggtctcgaactcctgacctcgagtgatcctcccgcctccgcctcccaaagtgctgggattacaggcccgaccctcatgtagcttttgaaatgtatgtggtacaacgttatacaataattcattcaaatttttaaatgttactgtctgttgctacatcttctttctcttttctaatgttaattttgtcttctcactatttatcttggccagagtagccgagctttttgtctatttattattcttctcaaatgatccatttttaactttattgaataaatttgcctta

SEQ ID NO: 113094 - DNA, 377 bp, Homo sapiens
ccacggtgaacactgatgaactggcttctgtcatcccagggaagagacgggcttcaagcaggctgcaaaaccaggccggcgggctccgacaacaactctcatccaaagttccctcgttgccatctgctgaccagctggacccactgacctcagaccagaaccttccccaagcttgatctgcagcctgccacctggggaacccacttcgctgaataggagctggaaatctgggctctttttcaggcctctgccatgaggcactgtatccttgttccaactcaattattactgattcattatttgtctttcctctaaaaagaaccagccataacaaaaagcccctctcatggtctgtagaaaataaatacaaccaaaag

SEQ ID NO: 113095 - DNA, 514 bp, Homo sapiens
gttcaattattgtgtcttattgtttcctgtgaacataaaggaatgtccacagaatattagagaatattggaatgcaggaagagaggcaagtctgagaggtggggatgagttcagagaaatccccaggggcctccttattgtgcagtagttttccctccatgtgccccctgggctgatattaatgtgttctaggaaatgcttaatgcttatgggcctgactcttggttttgccttttaagaggcatcatcattactaacaaacacgttcctgaacaggccttagtgctaagctaggctcgatctcttctttctggccaaattgggattaatgccactctttgatttcctcatgttggcaatcacacagtgccatgattaactggtgccacacattgccaaggccctatggtttacttcaagggtcagtaaactgtaactccaaggccaaatctggcccactgtgtttttatagagtccttctgctaagaattgtttttacatttttaaatgattg

SEQ ID NO: 113096 - DNA, 488 bp, Homo sapiens
actgtgttatgtgttgccataggaaggaggaaacagagctgtcgctgaaaactgaatcatatatgctaatacaactgacttaatatatttaatgcatatattaactcatagctttcaaaatatgtcatcccaacactccccactttctcaaatcccattcccttgaatcaaagagtacacatagataatcttcagaaaacacaatcactgagatcaactctttgaaacactgagcacttgcttttcaaagtcaggaagggtacaagcagtagatataaatggctcactgcattccttctggtacttttaaagtgtgataacgctcactttaaaacattcagatcataattatcaacagcaaaaattggaggcttgtcacttctaatttcattgattctcttgcaattcttccattacttcccaagataattttctatttaaaatctttgtcctttattactttaggcaactaccttttttgttctcac

SEQ ID NO: 113097 - DNA, 289 bp, Homo sapiens
attggaaaaaattattctagttaagaaaccaagtattttccttaaattacaaatcactactgtaaaagtgaagtcttacggcttctcagcctcttggctaagagcaagtgtacaagtgaagttttaattggtaaaacaaaaaattagatttacatcaaagtagaatcacactttaaaaattattgtagattatctttaacctcatactaagaaaccattctcatgcagtatatatgtacttatgccacactgtctcccatattaataaaaattctgcatttttacttct

SEQ ID NO: 113098 - DNA, 752 bp, Homo sapiens
ccccttcatctccccgtggaggctccatgcctagaggtggtcttcaaacagaagaatggcaaagataattgtctcgtgttttaccctgaccccattcctttaagagggtcacttcttggcccattcatttaaaaaccaatgtcatagttctgtgattccacctatcagacagtgccacgtccaaggcggggctctcacctccctgggaagagagactgttgctgtctgtgcttcctgtgttctccagtcccacgctcccacggacccacgcccttggagactccctcagtgtcccagggcttctggtgtgttcagagacctccacactcaacgaccactggtgctgcagaagggccggtgcttacattccaattaacagacgcttttcccatctaatgcctcttgccttctcctaacaccacctcgggagtgtttatgtctattctaagtgaatttcactgtgtgaaaaaattcacacctgttatcccagcaatttgggaggccaaggcaggtgtatcatttgagcccaggagtttgaaactagcctgggcaagatggtgaaaccccgtctctataaagaaattttaaaaattagctgggcatagtggcacgtgcctgtagttccatctactagggaggctaaggtgggaggatcacatgagcccaggagtttgaggctgcagtgagctgtgatcgcagcactgcactccagtctgggcaacaaagcaaaaccctgtctcttaaaaaaaaaa

SEQ ID NO: 113099 - DNA, 460 bp, Homo sapiens
ttctatcaggggtgctggggtggatcagaaggttgagactccaactgggagagatgtgtttctgctgctcaaatatttcccaagtttgcaagacatctccagcctttggagtgccttctggtttgaggagcagggatggccatccaggtctcaatgagactcagttaactcctctcatgacaaggcagccatatttcaccatccagtagagctgcctgtgatttttttgtgtgtgcatttattcaatttgaagcaatactcctttggtgaaagaatgccccctgggttgaggtacgtaaagtaaatatgcggaaaaaatcagaaagttccttaaaagaggtttattatatcactcaacccgtatctccccacgatgctacgatgactattttctttgcctgtgtcagggttgaaagctttgtcctgaggtcaggcctgtcctccttccctgtgctctgcc

SEQ ID NO: 113100 - DNA, 402 bp, Homo sapiens
tacataatgctagagaatattggagttatcacggaagaacatttaatttaaacagttatctttaacttatagagctgacatttaagagaaaatgttcaggttgttaggtgctcaaagtcacccccactcttcaaaatgtcaaatagaactttaaacagctgaagaccaagataaaaatagaacacagcatttgtttttaagagctgaattctaacccttctgtctcaaagtaaataactgtagaatatccattgctcttattacttcataatcaatgcatctttctttaataaatttctcctccttatgtttggagggcggtcataggaaactggtcttggggtgaaaggagaagtgaactattccaacctaatttctcacaaagtgaaccagagtcccagt

SEQ ID NO: 113101 - DNA, 297 bp, Homo sapiens
atgtgtcagtcttccgcagtttccttttctcacttctaatttattctctcttttttttttctgaggttagggattctacagaaggacgattattaaaattatgccatgaatttttgaaaaatttaaaatgctctcctacaaataaaatacatggagtttctgatactaatttcagtttgtcagtagatggctaaatttgttgaataattgactacttggtaaatgagctgttagctgtaattagttctttagtactaatattaaggaaattttgttattttcggatgaggactctcc

SEQ ID NO: 113102 - DNA, 365 bp, Homo sapiens
agccagaggaagggagtgttgagatgatgagtaagaagaggactgataattggccattatatttgacaagacaaaggtcatgactatgtttgacaatagcacttcctgttaagaggttaataaaagttctgaagcgatgcatgtaaaccgatctttgaagtgttcctgtagaggactggaggttaatcagagataatttgcagggtgggtttttatcccagttttgcttttaaggtggcagttacagcataattctatgctgttgagaatgatatgggggaaaatcgagatgcaaagaaagagagcagggatactttcaagagcaaagtccttgagtaaatgagagaagatggaactcagggcac

SEQ ID NO: 113103 - DNA, 1028 bp, Homo sapiens
taaatgccctgcaccaataggtctccccaccttggtcaagaggttcagtgtatgtgctggcggcacactttcaatgttgtggcaagtagtttaaaatattttctaaaccttcacgccttctgtttgtacagaacctcagtgtcagctacaggtgaaatataagaactttctaacgtctttcttgggcatgcacaccattttgcaatatgcgtgtttttccagattcccaggaatatgtcaaagctcttgaaagccctttacaggctactcatttcccagatttttcttttatggtttttggtcttattctttgccccaaccattatcactttctcagccctcttcaatttaaacaattgctgctgattgttttggaaaatgcctcaggaaaagattattcacactgagtgaactctgagtcaggtcaaattaaaaaaaaaaaaagtcctttccaggtaactgacagacaagtcaaatagtaacaattttctgaaggtggaattcttgagaaactctaaatcaaatccattccgttttctctgggaatggctatgctgataatttttacagcgtgatttcaaggttgtcggtttccagtgctactgcaaagctgtgcagaaaggaatatgaatacagggcaagaaatatttccacagaagattaatcggttaatctcctcaagtccatggggacttcggctcaaaatattccaaattcacttttcctatgcattattttatttcttaatgactcaagagatgtgctggtgttcctcttgggaaacggctcatcgttttcttactctgatttctttctcccctcggggggtggccaaggataaagacttctttttcaaaagacggtcaacaagaaaaaacgacaacacgacaagagacaaacagacaggagagcaccgacaagacgacgaaacacagcaaaaagagaccacaaaagagagaaaagagacgcagcagacgacgaacagcagacaccaagaagagcaacaagaaaacagaaaaactaaccga

SEQ ID NO: 113104 - DNA, 1269 bp, Homo sapiens
taaatgccctgcaccaataggtctccccaccttggtcaagaggttcagtgtatgtgctggcggcacactttcaatgttgtggcaagtagtttaaaatattttctaaaccttcacgccttctgtttgtacagaacctcagtgtcagctacaggtgaaatataagaactttctaacgtctttcttgggcatgcacaccattttgcaatatgcgtgtttttccagattcccaggaatatgtcaaagctcttgaaagccctttacaggctactcatttcccagatttttcttttatggtttttggtcttattctttgccccaaccattatcactttctcagccctcttcaatttaaacaattgctgctgattgttttggaaaatgcctcaggaaaagattattcacactgagtgaactctgagtcaggtcaaattaaaaaaaaaaaaagtcctttccaggtaactgacagacaagtcaaatagtaacaattttctgaaggtggaattcttgagaaactctaaatcaaatccattccgttttctctgggaatggctatgctgataatttttacagcgtgatttcaaggttgtcggtttccagtgctactgcaaagctgtgcagaaaggaatatgaatacagtaagttaaaattctgtaaattgtgatgttcatactaatatccaagtgtttttcttgactaaatgctcctcatattgttgtgtcctatttgttaattgccaaatttctttaaaatctgattttcataatttttgctaatgttcttactgcttttcttgaggaccaaattttcagatattcttacccatgcattctggaaactagaactgtctactctccattttgttgattatatttgtctttttgttaccgctctcctcctctcaactgtaaatctatctgccctctcctaattatgacccttctgcagatgacaagcctgagaatccttgtttttctttccttttttttctgtacaggtctttaaatttctctgtagagctggaaccagattggcagcaaacactaagttgaaccaacttagttgttccaataaacttggaatcagcatctgagggattatagtgaaatctgaggggccttctgttcctagttcagttgtcctgtgcactacaatgtctttgtgaaaatatatatgcgttgagacccttgattctaaggtttccttgaattctatttggttgaatatcttgctgacagacaggtcatagatttgtgacaaggcttccctttc

SEQ ID NO: 113105 - DNA, 800 bp, Homo sapiens
gtagagaaatagggccattttgtaatcaatctaccatctcttaagaggactattttaaaacagtggttcatctaagatgggagaaaatgaaatgcacaaaggataaaaactatactttataaatcctataaggcagggtttctcaatcttggcactactgacattttgggccaggtaattctttattgtgaagaggttgtcctgcacattgtaggatgtgcagcaatacccatggcacctccccactagatactagcaatactcctcaagcttaacaaccaaaaacatctccagacattgccaaatgtctcttaaggaacaaaatcacccctagttgagaaccactgttataaagggatgaataaagggatgaattaagggaaagacaactcggtcttacaaactggctttatattggcaagaatataattgctttaaaaggctgttaaaatgattctaaagtgcaaactttatttacaggcatgtatgatatataccaaattttcaatagctgacatattaaaaattcaaagttttattgacaattcctaggccactctcaattcatataatttaataaaaaacattaccatactcttgaagtcaatataaaagaagataatggtgtcagatgttaaactaaattaatactactggctctagattttgatatgtggtgtatatataagccccagattgcaataaacagagttgtttctctccaactgccaaatataaaattctgtcttacaactctatctcatctccaacccttctcttcccacttcatgcatgaccct

SEQ ID NO: 113106 - DNA, 459 bp, Homo sapiens
acaaatgctaatcctctctgaatctcagtgtcttatcttacaaagcagagcaggagatggaagacaatgaattccaaggtctctctcggctctcagcttccataattcattcatttactcattcgttcattggtccataaatttactgaggaacaaacagggaccaaaccctgcgctatgagctggggatgctgtgagcaaagagacagacagaatttctcttctcacgtaggtaaagtccagtgggagctggtgtgtgcaacattaaagaaatcacaaagaattgtgagttctaactacagtgagaatgctaagtacagttttccttacataatagagaaagggcttcctaaggcatctgctgaagatcaaaagagatgttcagtgattaacatggaaactcaggcagtatacggtggctcatgcccgtaatcccagctctttgggaggccgagacag

SEQ ID NO: 113107 - DNA, 435 bp, Homo sapiens
ttggcttcacatgccttctaagaaagactgataaaggctaaaggcgagtggggcagaaactagggtgcctcattcctgtgtttccctccatctcctcctcccatcaggtcctcaataaagcctggcagcctggatttgtgctgaaagcccctggagcaggcagaggtacctgctattcagcatgctttgggccttcctctcccttccctatctgctcattcctcagtttccacaccagtaaaatgggaatcatcagagtaagtgcctcatagggttgttgtgaggattccagagggtaaaccaaggagtgctctcagcactatggctggcacagatagtgcttaacaaagttgttattattattattattttgagacggtgtctcgctctgttgcccaggctggagtgcagtggcacaatctcctctcactgcaa

SEQ ID NO: 113108 - DNA, 836 bp, Homo sapiens
tagaaaaatgaagatgaaagcaactgactgtgacaatctgctgtgtacacaatctaagtgtatttttctttcttttctcttttcctcctggggtctccagtttaccgtggtttctgggcagtcctgatgctcctgggggtagttgctgtagtcatcgcaagctttttgatcatctgtgcagcccccttcgccagccattttctctacaaagctgggggaggctcatatattgctgcaggcatcctattttcattggtggtgatgctgtatgtcatctgggtccaggcagtggctgacatggaaagctaccgaaacatgaaaatgaaggactgcctggatttcaccccttctgttctgtatggctggtcatttttcctggccccagctgggatatttttttctttgctagctggattactatttctggttgttggacggcatattcagatacatcactaaatcaactgttgccacaagtattttcttgagagattttaaaacaaggaatactttttttccattttgtttcattgatcccagcataaagttagtagatataactttttagttgctattcaaattaatcattttactaaaattttcttcagtaagaaggtcctagaatctctccagacaccagcaagcctctatcttgtctaagtgctgtcaaggacctagttctttagggaataggtaaacaggtctccctttcattgaacatgttagagttcatgcaggtcgcaaaggcctgataatagcttaataccatgacatggggaaaatctcgatagatttggcttaaagtctccttggcattcacttctgctaattaaaaa

SEQ ID NO: 113109 - DNA, 995 bp, Homo sapiens
cggtgctggctgggagttctggtctcaggcaaggtggggactgggcacatcatcaatacgatagagaacgtcacttttcaccatgaagggttcttctggaggtgttggtttaatgggattgtggaagagaatgactccaatatttggaagttctggtacaccaatcagccaccgtccaagaactgcacacatgcttacctgtctccgtaccccttcatgagaggcgagcacaactcgacctcctatgactctgcagttatttaccgtggtttctgggcagtcctgatgctcctgggggtagttgctgtagtcatcgcaagctttttgatcatctgtgcagcccccttcgccagccattttctctacaaagctgggggaggctcatatattgctgcaggcatcctattttcattggtggtgatgctgtatgtcatctgggtccaggcagtggctgacatggaaagctaccgaaacatgaaaatgaaggactgcctggatttcaccccttctgttctgtatggctggtcatttttcctggccccagctgggatatttttttctttgctagctggattactatttctggttgttggacggcatattcagatacatcactaaatcaactgttgccacaagtattttcttgagagattttaaaacaaggaatactttttttccattttgtttcattgatcccagcataaagttagtagatataactttttagttgctattcaaattaatcattttactaaaattttcttcagtaagaaggtcctagaatctctccagacaccagcaagcctctatcttgtctaagtgctgtcaaggacctagttctttagggaataggtaaacaggtctccctttcattgaacatgttagagttcatgcaggtcgcaaaggcctgataatagcttaataccatgacatggggaaaatctcgatagatttggcttaaagtctccttggcattcacttctgctaattaaaaa

SEQ ID NO: 113110 - DNA, 298 bp, Homo sapiens
cctcccttggttggaaactaagtcccagctgctgatttttgcttccttttctctacatttccaaatacctgtgttagaactgtggggctctatacatagaaaatgtcttaaaataacagtctgtgtttttaaacttgggactgtaaggggctcctcctaaacatgtttggagtattttattttgctgatactagaagctgaccatttacctaaatagtaatatacacctttccagaatcagctctctggacaacccagctgtctgctgcaaaagagcaaaaaaccctaaagtagacca

SEQ ID NO: 113111 - DNA, 273 bp, Homo sapiens
ccgggcccagctccgtcctctcggcggcctctccaggtgcaaaacttcctcgagtcagcctctccaggcccagctcctcctgcctcccagtggcctctttcagcccagcccagctcatggctctcagcggccttcccaggtcccgcttttgacttttggcagcctcttcaggcccagaacttgacctccagtcggcctttgcagtcccggcctcctgcctcccgaaggcctgcacgggcccggcctcggcctcggcctcacagcggactctcc

SEQ ID NO: 113112 - DNA, 622 bp, Homo sapiens
cctttacactgaagacagcccctagactttagtttgtagggtagcactgacaagggaatagactgtttagagtggggtatgtgctgttgacagggataagcacatacttatgggaagcacatagcacacaccccagtgtggactttatccagaggcaatgaggagttagtggatagtcttaagtaggagactaacatgctctgacttgtgtttggagactatagaaaagcaaggattataaacaagagtccagctagcagacttttttcttttcttcttcttactctctttcgctataactgcatctctccaaaggtggggatctgaggcatgtatccactgatccccgctccaattggttgaaggttgccattgaaagcagtccctcctgtgcattttgagattgctgttaggagccagctgtgattgcgggacagaaaaactgagtctccaaagtgtgcttgaagtgggaacaatggcagtgtaaatggagctgtccaccacagctgtgctgaaatctggcaggctgacaggacttagcacagagtttttgctataggaggcctttgcagtaatcttaatgagaaatcatggtggcttggaccactgtggaggtagcatt

SEQ ID NO: 113113 - DNA, 394 bp, Homo sapiens
gtctctgcttgggctatgatcacggtgactctagcaacccttcatggacattatagtactctctgccattcacttttggtctaatctgacttcaacccccacttacttggtctctccttttacaaccaacacaaccgaaatccgagggcttctttttttttgagacagagtctcattccattctgtcacccaggctggagtggaatggcacgatctcggctcactgcaacctccacctcctgggttcaagggattgtcctgcctcagtctcctgagtagctgggagtacaggcgggtgccaccgtgcctggctaatttttgtatttttagtagagacggggtttcaccatgttggtcaggctggtctcgaactcctaacctcgtgatgcgcctg

SEQ ID NO: 113114 - DNA, 387 bp, Homo sapiens
atgccttctgactggataaaccctcccggacccaggagacatcctcacctgcccggaccccgggaggcatcctgacccttgcggaccccaggaggcatcctcaccctcctggaccccaggaggcatccttaccctcggggaccccgggaggcatcctcaccggagcaatctttggtatagaacttttaactaaattacacagtgtggagagacaagcttcagtcatttctccactacccactcagtgcctggcggaaggcaggcagcacagaccttcatcccaacgcacgaggggaatattcaaatcatgccttaggggcacagggaagggagtcagagactgccccgcctgtgattttgatacaagtagacagatgatctgagaga

SEQ ID NO: 113115 - DNA, 704 bp, Homo sapiens
ggtataacatatattgcaaacagcattattcttaattgtacagcctgattaattttatgaatgtatgcactcatacaattaccacccagattcagagcatttcagcacctagaagtctccctcatgttccctcctagtcaattcttgtttaccaagggtaatcactgctatgacatatcacacagataatatttgcctggttttggacatcataaaaatagaatcatacaatgtaaactcttgggtgtctgacttcttttactcaacattctgtgagacattcagattttgtgactaaggcttttacagaaaacattttacaagtatttctcaatatcttttctccaatatagaaattaaaaaagagctttacaccttgtatcatttagtaacaagttaaaattttactttcttggggtgatgtgtgtcagtcatagttagcatttttataagaaatgtatactattttaaaaaaattgaatagtttaccattcaaataatcttccttcctccttttctttttgagaaggaaaatgtctttacaaggtaagtggcaaggcagagaggggtgagggagttatgtcaatagcagcagagaatggcattagtgatcagaaaaatatttttcatgagttcctacagatcatgtttacatggaaccatgtcatcacaagtcaaagccagttccgctctgcaaagatata

SEQ ID NO: 113116 - DNA, 405 bp, Homo sapiens
tgaccttaggatcaaatattctctaatctagcatctgattttgctcccctccatcctgccctctctctctctcactttattactaatctagcttgctcctccctatgaaagaaaactttacctaacctttgagatgctttcaaatattatacttggtgctttcctcctatcactacaatacttcattcaaataaggtcactacttacctaaatctggattttacttgagggtgtctagaaacagccccagggcaataacaactacaaccacagaaggggcaacagatcccacccccaaccgcatctgcctatggatcccctaggaaacctgcagcatagtctcgccaggaagaactaaatgggccttcggtgacctccccttacaggctcaagattggccttagc

SEQ ID NO: 113117 - DNA, 383 bp, Homo sapiens
actggtggtgaggaggagcccagggtccaggtcttcggatgatctcctgaccatgggcccagtgtgtagagatgagtccagggaggctagagccaagggacagcattccctccttcccacagggcttggggatagctctggcctgggcagggcttcggggagcttgtgggtagactcactggatttcaccacgtgtctgtttggcctcccagggtttgggctgggctcttccagtttcagcacttggcatttttagcacttggctttctgccttttccgctgggagctccccaagtttgcccaagtagggcctgcttccctgagagctgagctcaggggtccttgggaagaatcactagagttaggggtggccttcttgggcc

SEQ ID NO: 113118 - DNA, 316 bp, Homo sapiens
agtatgtgtactctgaaaaattatatgtaaatcagattttttaaaacctgaattatatctttttttgctatttaaagggatcatattataaaagtaaatccttttgtaaattatttcttcatcttttaaaaaataatatagactttgttgtatctcttcttaaaccatatttgattttgtaaatgaagagctaaacttccttttcacctgtaccattgattgtatatttaaaaaggctggaaaccaaaaaaaacagcctttctagttagtgtggccctgcagctgtttataattgtccttgctcaaaaggttattt

SEQ ID NO: 113119 - DNA, 722 bp, Homo sapiens
cattgttaagtgacacatgactgtattttgttctgtaactttcttggccaaatgtactattttgagtcaaattccatagacctttttgtttcctcttgaagtataatgaaccttttccttttaacttataaaaagatgagtgtattcaagattgattgttcagaaactttgtctgggcagatttgactttttattttaaattagctttgtcacaaggatattatcaccttatgtcttgaaaccctgacccagccctcattgcactctcccaatttccctgctggattttgtttgattatttgttgttttgctgcctcaccgatttacacatatcaccctgtagtttcaatatgtaaattcaaaacttacctgttttgctatctaggataatatttagataatcagttatgttgatgagaaagagatagatttgttctgagatacttaaatttattttaactgttctctccccagatatacagatactcctcaacttacaatggagttccttcctgttaaaggtatcttaagttgaaaatatcataagtcaaaaatggatttaaaacacctaacctaccaaacatcacaatttagcgtagcttaccttatatgtgctcaacacttacattagccttcagttgggcaaaatcgcctaacataaaacctgttttataataaactattgaatatattatgtaattaattgaatactgtactgaaag

SEQ ID NO: 113120 - DNA, 1220 bp, Homo sapiens
cctcagcctcccgagtagctgagattataggcgcccaccaccaagcctggctaattttttctatttttagtagagccggggtttcaccgtgttagccaggctggtctcgaactcctgacctcaggtaatccacctgcctcgcctcccaaagtgctgggattacaggcgtgagccactgtgcccagctcttctagttcatttttaagtgttgagtccctgctgttttaagagatgttttggtgaaaatctacattcagagagaaacaggttaatcttccacattttttataaaatacataaaatatagtacttggcattttaagaaaagaatgccatgtattaaaaggtgctattttcaactatttattattttaaaacaggaatgcttatcaatactttcgaatttaagataaatgtcttcgttaaattttctaggcagttcaaagatggccatttgctggtgaattttccaaaatagataacagataaaatgattatgtaagaacttggcacaacagatcattttgcctttagtcgttcaagaaatgatactaaactcaaagtcattcacttgaaacaactgagaagaccattcttaggtgtttagatccttgcttttagaaacattcttagttatatttgtgttttcaaaagttattgagtagatagatattttttcatgaatttttaaacattagacttagctgaattgattaaaattaggtgattatgaaaaaaatattgccctgctcgagggcatctggagccctacagttaccattactaaagtctgtgagtatgtctattttgaaaagtgtcataaaaatatctagtccataaatcattataggttcagtaatacatcattttgaactgattctatcttctgtgaaattctagagatatgttatctttaggtagcatgagtaagattcaggtatgctgtgaattttgttaacgtttatgttttccattaatggatagtcaggaatcttttgaactgcgtctatgtatttaaatgatttggaaagatagcatctctcagtttaaacttagcatctcattttggcaagataaattattttagctgtctggccttttctttgtcttcttagagttatttctgaaatgtgcatagccagtcataaaataacttgtgtaaatagcctaatgtaatttatttctaataaatacgtagcttaatgaaatgtatttctagt

SEQ ID NO: 113121 - DNA, 367 bp, Homo sapiens
gtagtaggcaatcttgggtcctagagctaaactgtcagagctcatgccccagacttgtcatttactagatgtgcaaccatagacaagttactccacgtctctgtgcctctgtcacctcatcagtgaaatggaaataataatacaacctactttctcatattgatttgagaacggtgctagataatgcatatatagcactttattcaggcatgtcaaaagtactgtaattatgattcagcatcactgaataaaataatgatatggtttggctgggttcccacccaaatctcatcttgaattgtagctcccacaatcaccatatgttgtgggagggactattctcatgacagtgactaagtctcacaat

SEQ ID NO: 113122 - DNA, 786 bp, Homo sapiens
agcatgaatcgcttttgccatatataatatcatgtagtacctgaaaaaaaaaaatgatgccaaagactagagatttggtcgaggacattggtttttctggctctttttgcctccggaactcttcttcagtttatatcagatgtggaagggaagcctaatctataaaacaaagatgggggtttgagtccccggggtttcccctcaccactgtgctaaccctaaatcagctttcaccacttacttgaaaaacccagggcccagagaaaccaaggtgtgagagtgtgaaaggtaagtgcaggacagatagacgataacgagggtgatataaataataatagcttacatttttttaggtcttcttgtgttccaagcactgtgctaaacacagactgtccccccaaaatatggcaaattgtgatgcctgaggcagagtatggtatggctgtctgggaactcttgaaaaggatattggattgcttgcaggcaagaaacaggccagattatcttggcagatctcgctctcactgtggttcttagcctttattacactgttggaatgggtttctcacaagtgatatcaagggaaaaaactagacggatatgtccagtgtatgtgtacgtgtgtgtgcacatgcacttaggacaactttgagccaggagtgtgagccggattagcacactgagttgtactttattctaacacatgcagctcagtagaagtctcatcttaagggacatatagaatgttgaggtagaaatagctcagaagaaagttgataaagtaat

SEQ ID NO: 113123 - DNA, 731 bp, Homo sapiens
gagaaatgttagtgcttactgtctgatgtacattaatgacaaactaccctacttcaatgcagaggcagccccaactgaatcagatcaaatgtcagaagtggaagccctatctgtggaactcaagcattacattcaggaggataactggcggtttgagcaggaagtagaggagtgggaagaagagcagtcttgcaaaatccctcaaatggagtcctccaccaactcctcatcacaggactactctacatcacaagagccttcagtagcctcttctcatggggttcgctgcttgtcgtctgagcatgctgtgattgtaaaggagcaaactgcccaggctattgcaaacacagcccgtgcctatgagaagagcggtgtagaagcggcactgagtgaggcattccatgaagaatactccaggctctatcagcttgccaaagagacccccacctctcacagtgatcctcgacttcagcatgtccttgtctactttttccaaaatgaagcacccaaaagggtagtagaacgaacccttctggaacagtttgcagataaaaatcttagctatgatgaaagatcaatcagcattatgaaggtggctcaagcgaaactgaaggaaattggtccagatgacatgaatatggaagagtacaagaagtggcatgaagattatagtttgttccgaaaagtgtctgtgtatctcctaacaggcctagaactctatcaaaaaggaa

SEQ ID NO: 113124 - DNA, 168 bp, Homo sapiens
ggagagggaacaggattaagaatgggtttaaggagcaagactgagactctgattcagcgagaaacaaccataggggcagatcccttcatctgtcctgggaatgtcctcccaagactggagtcctcagctcagaacaaagggaaaggggtgcagcttccaccctggcag

SEQ ID NO: 113125 - DNA, 783 bp, Homo sapiens
gtgcggtgcggtgcatatgggtaggaagggaaaaggagaagagaacagcaagtatatcccaagaggtgccttgtggtcaggcctcctggaaagggtatggtgtgccgagtcaatgcagaaggaaggacagacaggctgcccaagccctgcgcagctcatgtagcgccaggtggcctggagtggcttaaaggtacagcctccgcagccctccagagcagctggatcaggaagcccagtgtcggtggggtctttacttaagcagacagaatagttatcctcaacacgtgacatgtgtctagcccccactgtgtctgctcgctccagccaagtgcttgcaaagtaattttattccaggtttgggtccttttatgaatgagtaaacgagcttggcaaggttgaatgacctgcccacgggcacttagccaagacgcaagccccatctgcttgcttccacaccgtctggaagcctcactggctgggttcaaaaagggaggggccaggcacagtggctcacgcctgtaatcccggcactttgggaggccgaggcaggcagatcacctgaggtcaggattttgaaaccagcctggccaacgtggtgaaacgctatctctactaaaaatacaagaattaggtgggcgtggtggcgtgcacctgtaatcccagctactcaggaggctgaggcaggagaatcacttgagcctgggagtgggaggttgcagtgagctgagattgcgtcactgtgcgcttgggtgacagaacaagactccgtctcaaaaaaaaaaa

SEQ ID NO: 113126 - DNA, 285 bp, Homo sapiens
actgcgtgtcctcttttgtgacctgttgcttttgcttaataccgtctttgaagttcatctctgtttttgttagtaactatagtttattcattttcattgttgtatttttttttttttttttttgaggcggagtcttctctgttgcccaggcttgagtgcagtggcgcaatcttggcttactgcaaccctcgcctcccgggttcaagcaattctcctgcctcagcctcctgagtagctgggattacaagcgcccacgtcgacgcccggctaatttttttgtatttt

SEQ ID NO: 113127 - DNA, 160 bp, Homo sapiens
caacccagccaaggctgtcctgaattagcaaccctgacacgtgtgagcaagtccaacggacaccggaagatccacctagtcaagcccaaccaagactggcagagctgccaagctgaccacttaaggcgcatgaggaataaacactcgttgctgcatgcca

SEQ ID NO: 113128 - DNA, 243 bp, Homo sapiens
ttattgtgagtttttatcatgaaattgtgttgaatattttcaaatgcttttcctgcatcaatcgaaatgaccatgtgatttttgtcctttgttctgtcaatttggtgtacagtattacattaattagtttctgtgtgtcaaaccatccttgcattgcaagcataaatccctcttgctcatgatgagtggtccttttaatgtgctgctgaattcagtttggtaggttttttttttttttttttt

SEQ ID NO: 113129 - DNA, 509 bp, Homo sapiens
agctttggtaaatttattctgattttcaacatctgtagcagttcttaaaaaaattataaaattctttcatgactgtaaattttaatttttacctaagtaaaatatgcatgtgcttatttttgttttctagttatatgaaaaggtgatatgtttattttacttgtaccaggaggcatttatggtgactaggattcagataggatgatttgtttattttggctcaagtgttgacaagctggttgcatgccacattagcatccgtgcactgctaagcctcccagatgatggcaggtgctcactgggaacaaggctggtggactccttggcccttggaacagaagggcatacgtaagttcatgtggattcattttagaagtcatatagggacgacaggaaaagcactgtaccaagaaactgagaagatgtgagagttcagttacaggccaatggagtttgggggtgtggacaacagtgtgaaagccaaaaggagttgagtcatgccttctgaa

SEQ ID NO: 113130 - DNA, 309 bp, Homo sapiens
caacagtcctagccagctgttgctgaagggcccaacaccaaatcccagctgaagaacagcttctcatcttttgagacacagcacagggtgatgggcatggagctcttccacactccccacagtctgacttagctctctccgttgtgccctcctggcaccctgctcgtattttattgtggcacctatatcgctggatctcactcactggtttgcactcctgtatcccctttgagggaacaaatcccatgcctctgcaatcccaggatctgatactgagatagacactaaacagatatttaaaaatttttg

SEQ ID NO: 113131 - DNA, 359 bp, Homo sapiens
agagcatagggctttaagatgaatttgcagggttacaggattacaactgcaatgtgggctaataatagtgccccctgcattaagctgcagagattgagcgagtaagtgggaagctgagaaaatgcccccatggggtagacactcaataagcatctgctgttattaccaggactcgtatggtcatgggtgacagcttcagaccacaggcagtccacctacaacctgtgcccctatccaccatgccatcctgcccacccacccacgccagctcccccaacccccaacacttttggggatcctaaacacttcctgggcctcagtaatgctccccaaagcctcaggctttcttcccgcaaaaa

SEQ ID NO: 113132 - DNA, 678 bp, Homo sapiens
cggtctgctggcatctgagggctcaccctagagaagagtggttgtactccagggcacatgggtctggtgaggacagagaagcatgggtggatgggtgggtggagatgagggtggatgttttctctgtaatcgtctccggccaggctggagccagaaccagactacccactttattagtccattgagaatatctaaagtcaggcttctcagcacagctgccatttcccctgcttgggaccagattttcctgttttctgagggcttccaagtaagttggaagttccttgggtttccacaactttgacttaatgaagaaacaaggtcaagaatcagaggaaaggtttttggatgggcctcagaggtctgaaatggttaggtgggagtctaaaggtataggagagaaactaaatcagttgtagccccagctgtttggagatgatgccagcagatgggattgagtaagcgaccacaggttgcagagggtggcagatgggaggcggatgtggaaatggggtcccagtcagaaatgaacaccactagaggagcaggaagaagggccaagcaagagcagtggttctcattgtggtttctggactagcggcggcagcagcacccacgatgtagatgtcaactcttaactccactcggaaacccactgaatcagaaactcaggtggtg

SEQ ID NO: 113133 - DNA, 433 bp, Homo sapiens
gagccacaaaaaggtttggctgagcatcccaggggtcagagacagggagtggcagaccaggcttctgatacaaatgggctcaaggtcagtccccacccccactccccagtgcccctcacccctagccaccccctccatcccctgggtgaccagagcagtactgtataaacctaaactgagtcctccccgctcccgcggtgaaaagccctgtgcagttttctacagccccgcctctagagtctgattcaaaaccagctgcaatttcttggccaatgcctgtcttctcatcagactgaactttgtgagggcaggcgacacacatgtcctggtcccggccaggcctggagcagcccagggttcggcctggaggagatgttcagtgacatgcagaggcccaggcctggcctttggtcccgggcacctgcagcagagg

SEQ ID NO: 113134 - DNA, 254 bp, Homo sapiens
cacatatgctcccatttgccttctgccatgattgtaaacttcctgaggcctccccagaagccaagcagatgttagtgctatgcttgtacagcccgcagaactttgagccaaaataaacctcttttccttataaatgacccagtctcaggtattcctttatagcaatttgcatggactaacacagtcctccaatgggtgcagtagtatcccattaagaacttgctctttacttgggtcaggggagtcacaacatg

SEQ ID NO: 113135 - DNA, 353 bp, Homo sapiens
cggcctcccaaagtgctgggattataggcgtgagccactgcgcctggccaggatattttgaaaagatgaaattacaggatttattagttcaagtttcaatattatttaatttttatagttttgattaaatgttattgtaactcctctttgtcaaagtgagtctactcttcaattaaatgtaagaaattgttatgtagttttacacagagtttattaatctagagcgagaggtttttatgttttaaataatattctaagttaaagacttcatggtgatacaactaaatttttaaatttaaagtttgtcaaaatattagtaataataattatgtttactgtagtatctcggattt

SEQ ID NO: 113136 - DNA, 152 bp, Homo sapiens
tgtcttttactgtgccatcgatctttgatattgcattgaaagacaatataccacagtagcaccttgaactcagtgaaaattgttcaggatcaaaataccaagtgttcttttagagggaaggaaaaagtacacacactctcctctcacaatga

SEQ ID NO: 113137 - DNA, 622 bp, Homo sapiens
gtgctcagaccagtatctggcacaaagaaagcaatcagaaaatatttttaaagtaataaataaatgcagtggatgaagaagaaaaactagccaaatataaataaacttgcatgacaatgtttgatataggttatgaggtgttttgaaaacatatttttatcatttcatgttttggtatcagtaatatttctctcatcattccggttcgctggttagcttttcaaatgctttgcatctttctgggtatatatgactctgccaacaatagaaaatggagaatggcaaatattcatctgttgttttttgtagtttttacataattacataaaatatttcattaccgttaagagcagattagcacagtggattttttaaataacgtttgtgtatgcctgtggctttcacaagttgtgaaaaacacatgatttttgcatgtcctttcctaaggatagaaaatagcagactaaaaaaataagtattttccaataagtaggaactgagcatcttccacttgagtaccactttgattaaactacactgttgcttttttctgggtgtgtgtgtgttcttatagaaaatgcatattttcctacatgaagtaattaattattcgaatctccca

SEQ ID NO: 113138 - DNA, 1074 bp, Homo sapiens
ggaagatgaaatgtataactgattacttttgtaagctaaatacatattaaagagagctttttattttagttaaagccatttgaaaaacagccaactccagataattcacaatgaaattgtagggccccatcggtgttttattaggtgttttggccatatcaatacatacttgtgagcatttctaattagagtcaaaatattactagattagaaaaagttgaatcagtcggtttgttatttattagtgattttggaaagtgatgtagagactggaagagcctgcagctgttgtccaaaatgaatcctgtggatttcagctctctttggtattcaattttgataaagaaagattgtttaaataactaagttattttttccgtttatcagagattagttccggagtgtcccaaatagaaaattttataaatactgaagtatcattaattacttgtttatcctcaaccagattcccaagatatttgagatggcttacaaaaatacatttgtttatgatgaaggtggaaaaacagagaggatagaccttagggtcctcatatgaataggtaccacaggaaatcgctgttgggaacagaaagcaaaagccagtgcatggcctaaagggtttgaggcaaattgtttcttcttgtttgacctgccccatcatcttcccagctcattgctttccttactccttcaccagtcagatatcatcaccatttaaaataactgctctcacctgcctcctgaagaagccatagaaagttcctgtggcaggcacattcagcttatttagtgaacaagaacatggacacaaaccatcatcgcactgtattgcaggagcatgtgctgctctgagcacgcctctgatctgtgaaactgaaaccatgaataaggaagcttttctttgcttcaacagatttcatttttaggaaaacatcagtatctagtgtatttgcctttgtcttctttgtgtcatatattttgcttgatctcccataagtttatggcagtatccaaaccaatcttaaagtatcttttaagtgaaagcaaaataaaattcagccttaaaattgt

SEQ ID NO: 113139 - DNA, 343 bp, Homo sapiens
cttgcggtatcaccttcatataacttcaaagaatttaaaatggcttaagcagaaagcgattcaacaatgagcgagatgagagatccctgtggccaggtcataaaggtccttaaataccatgttgctgaattctgattttatcctacagaaaatgtattcatttactctaccgagcctggtgctacatgtcaaagatagagcaataagtttgacagagctgcagtctggcagacctgctaaaatgtggtggatactgctgattctcacccaatatccatttctccttcttccttactaacagaccctgagtttatttcagctggcagtgtgtctagatcaaagg

SEQ ID NO: 113140 - DNA, 279 bp, Homo sapiens
gctgaccgcccacgggtgaggctggaagtcagttaacattttactgggtttgcttctgccctttgcatgtggaatgggtgtgccccaccgctgcccgtcccaccccaaccctgaacatcaggcttcccgtggggcccagccacggaacattccaggcctggagcggccatctcatttgcatgccgcaaggttgtggctcaggcggcttctcctgggggcctggtggtcccaggcagggggccgggctggggactgctccgccgaaccacgtcccagatc

SEQ ID NO: 113141 - DNA, 458 bp, Homo sapiens
atccccttctcacaattggaaaaataaaatacctatagtacttcaaaggaaggcaataattatattaaacgtttttgaaatatttaagaagacaggctgggcatggtagctcacacctataatcccagcactttgggaggccgaggcaggcagatcacttgaagtcaggagttcaagaccagcctggataacatgacgaaaccccatctctactaaaaatataaaaatcagctgggcgtggtggtgcatgcctgtaatcccagctatttgggaggctgaggcaggagaatcacttgaacctggaagccaaaatcgtgccactgcactctggcctgggtgacagagcgagactcccatctcaacaagaaaaaaaaaaacccaaaaaccaaaatgagtcccagaagcccctgcttggtgccaggctggaatgtgcaaggctgaggatccagtcattgagc

SEQ ID NO: 113142 - DNA, 407 bp, Homo sapiens
gtaaaggtagagacaaagattgacacagacagaaaaaaaaaaaaaaggttaagacataggcaacaccaaccaactacctactctgtgccagggactgtgccaggcactgtcacaaccatgcccagagactcagtattttagtgtccccattttcactggaaaaactgagaaggattaccccattacccataaaacagcgctggctttaaaagttctccagtttcacagagcctggagacaggcggccctgaagccccagccagctgcagggctaaatgccggctgcagagagagccactgggtttaagcatggatctgcaagctctcttattctgagctctgtcctggtgttcttaaggtgggaggtggggtatggcagaagagctccagggtgaccagcttgtatc

SEQ ID NO: 113143 - DNA, 341 bp, Homo sapiens
gcctggaggaggccctggggacatggaactggcctctgtctgcaattatgaaccttcggaaaggcgtgagatggagttacctgcaaaaggtccgcatggggacccccacgccctgtggactgcctgaataatcaagttcttaactcattccaatcaacaatttttgcctcttgatatcaaaacaagcccactggctaaggttctcatctggacgggttgtttctatgcaggatttccactgcccaggccccaagccaggaggcccatcatgctcggcaagcacaggctaggcagagtgtgtgaatccatccaggcacacctggccaaggccccatacccct

SEQ ID NO: 113144 - DNA, 1099 bp, Homo sapiens
tttctaattctgtgaagaatgtcaatggtagtttaatgggaataacactgaatctataaattactttgggcagtatggccattttcatgatattaattcttcctatccataagcatggaatgtttctccatttgtttgtgtcctctctgatttccttgagcagtggtttgtagttctccttgaagaggcccttcacctcccttgttagctgtattcctaggtattttattctctttgtagcaattgtgaatgggagttaatcatgtttggctctctggttgtctattgttgttcaggtgtgcagtacagacacagagatataggaatctctgtatataggaatgcttatgatttttgcacattaattttgtatcctgagactttgctgtagttgcttcttggcttaagaagctttggggctgagacgatagggttttctagacatgggatcatattatctgcaaatagagacagcttgatttccttgagatgaattttcaaaacccgttttaatgtagcacctgcttggtgcagaagatacttaagagggcctgcttggctaatggtagtatcagggtatgatgcctggggaaggttgggaagcagtttcccagaagaattcagtggatggatggtatggattcctttggtgaactgccgaggtccagggtctggcctttgggcttaggtcctcatatacctaattttatcatcatacaaaaaatagatttatctcttggggtagactcttaataactaagcccgtgaaactcagtaataaaaacagaatgagaattaatgagtaatgtaaccatcacatggaccagactgaacaaatgcaattttcttattacagctaagcttcataggaagttaataagattgcttggtgaagacaaaatcagaagggtagtcagatttaacaaaagattaatgagaacaagctggtatacctgatatatctgctgcccataaggatgattttgccaataacataatcaaagtcctttcagttctaatccctggcatctgtgacagctatcaatttattgcctcagtttcaaatctacgcttcattgccctgtctgtgatactggac

SEQ ID NO: 113145 - DNA, 610 bp, Homo sapiens
tttctaattctgtgaagaatgtcaatggtagtttaatgggaataacactgaatctataaattactttgggcagtatggccattttcatgatattaattcttcctatccataagcatggaatgtttctccatttgtttgtgtcctctctgatttccttgagcagtggtttgtagttctccttgaagaggcccttcacctcccttgttagctgtattcctaggtattttattctctttgtagcaattgtgaatgggagttaatcatgtttggctctctggttgtctattgttgttcaggtgtgcagtacagacacagagatataggaatctctgtatataggaatgcttatgatttttgcacattaattttgtatcctgagactttgctgtagttgcttcttggcttaagaagctttggggctgagacgatagggttttctagacatgggatcatattatctgcaaatagagacagcttgatttccttgagatgaattttcaaaacccgttttaatgtagcacctgcttggtgttgatgctgtggggaaaaccaccctgtctctctcagtctctcagtctctctgcctctgtttccggtctctctgtctctg

SEQ ID NO: 113146 - DNA, 122 bp, Homo sapiens
aaagcaagtctgttagcaacgcattctctgtctttttttcatctgggaatttctcaatttcaccttcagttcggaaggatagttttgctggatattgaattcttggtttacagttttttttt

SEQ ID NO: 113147 - DNA, 689 bp, Homo sapiens
aaccattcaggcttcggttggaatcctaaagtgctatgtcttagaaataaatcccaactttgaaatatctcactcaccgaatacattaatgtgatctgtgactcatgtttcttgccacctgcaggacagagatgttactcatcccttaagtttgctagctgcaaacagagccctgggacatgtcctaggcagagagtagtcagggctttgtattcttgagacatcagtaagaatgtgtagggacactcggggcctcggaggaggattacctctcccagtaacaaatgaccccaaaacttattggcataaaataaccactatttttaatgctcatgattccgagaatcaggaattcagtcagggtatatatcaagtttggcttgcttgtgctctacagtgtcttggtctttgattggaatggttcagacagcttaaaaatggctgggatggtgacactggagccttatgtccagggccttggtccatctcatgtcatcttccagggctggaacctccaagatggcttctgcactcttaggtgtggtgccaacatttttctctctccataaatggcagtctcagggaagtcttagggtagttggactaattacatggcagctactttctcccagagcaagcatttcaagaaagaggaagtgtgaggactcatagtgtctgaagatctgggc

SEQ ID NO: 113148 - DNA, 302 bp, Homo sapiens
cttatccaaggcagggagctgagcacagccttgagtgccaggcaaaggggttggggaatggagagtccttcccatgaacacttgttagctggactttagaatgaggactcagtttctgtgatgagggcaaggagagcaacaaatttgtgttaggtaggctctgtctgtgtgcccagcctctgagcccccagtggctgtgagcagataggactgtggtagtttagcccagagatggcagatggattccacaaataaagagtctctctccgtgatgagtgctgaaggccgggcgtgggtggggg

SEQ ID NO: 113149 - DNA, 396 bp, Homo sapiens
gcataaatgctgtttttatttatttttatttttttggagacacggtctgactccatcacccaggcgcgatctcagctcactgcaacctctacctcctgggttcaagcgattctcctgcctcagcctactgagtagctgggattacaggcgcccgccaccacgacctgctaatttttgtatttttagtagagatggggtttcgccatgttggccaggctggtctcgaactcctgacctcgtgatccacccacctcggcctcccaaggtgctgggattacaggcgtgagccaccgcacccagaagcataaatacccttaacccgaggtgcagcctctactaacacccagagtccccacccgaagccacagactcccaacgcagctgagtaaggtccgg

SEQ ID NO: 113150 - DNA, 377 bp, Homo sapiens
tgggtgctgtctgaggccatctgtggaggtgagagattggagagatgagacaggtaagtatggttttgaagaaccttgtatgctatcttactgaaggagtttggacttcaataacaactttgaactttccccccccccgctctgaaatcttttcatttagtctcagtggctgtctgtgatgattattctgatggacaacatctcaccaaggctttgagcacttacaatgcatgaagtgctgttgcagatagaaaaaaaaaaaggaattagctttcaaggagcttaatgtccagttgggaaaataattcataagtatttggagagtttggaaatgtaaaataatagactgttccaatctattctacagcaatgcaaga

SEQ ID NO: 113151 - DNA, 817 bp, Homo sapiens
gcatctcagcaggaagtcctatgacccttatcaatctgcaccccttatgtgaagacgatgtgccttaggaactctgctgtccctggctgaacacagattcctttaacttcacatgtgactcatgtttacaaaggcatcgctggacagtccgtttggactgtgatgcaatgactgtgtgtaccatggaaaaaatgagaaagacatcctagcaggacgccagggcgcagttgaggaaatcctgtggtgtgtcatccgtgcaacactagaagcaccagatcactgggcaggctgaatagcatcccccgttcttaaaatgtcaccaggaattcggagcacagtgttctcctgggcccaggacaggtttccagtttctcggcaatgaaatggtaagccaagcaagaataggttttcagataactgtcttttcatggatgtgacttccagcagagggctgaccagttggaattctccatctcacttctctggccattctgttaccacctgtatcagggaggcatcattcctgatccctgggtcaccaaaaccatttttccttttcttttatccttatccaaaagctctcttctgttccatccctcagccacatgaatttccagtagtagtgagagttcttgacctccagctgtttccttcaagcaaggtatggattgttgtgccctggtcgtagagccttggcttgttaagaaacctgggctttgcacttggtcagcaaaatttggaggcagccaagatggaaaacaaaacaattctgaaaaaatattaggcatgcttcattacttttttccaaatgagaatg

SEQ ID NO: 113152 - DNA, 1813 bp, Homo sapiens
ctgtcttgctaaccttccttgtacactgtattctggagaaccttggctgttgaaagcataaaggaagaagaatgcagtttttgccttggggagcttacatcttatctggtataccagataaacacaatgaaggacaacacaacggtaaacaaggtatggctatcagaagaatcaagatgaatgagcgtccagaccattgaagggaaagaagtctggctgatgaaaatgagctctgcactgaatccaggccatgttttgaggtttccattgtttttggctcagcctagaaattggattattgctcttcataccactggaggcctgcagcccaacctctgacccaagctatcacagaaaacagggaaacacaaactgaaaattataacaatgctcttcaagctcaacagagagatagtcagacacgtaatcaccacggagagattacagttttctagtctacacttttgaagggaaagagactgcaaaaaaaaaaaaaaaaaaaaaaaaaagagagagagagagagcattaacctttatcagctttcagcatttcatgctttcaatttagaactggatgctattggctctggaaggccatagaagatgtgggaagagcatgcactgttgcttccattattttgtagtgagaaggatggctttggcgagactctaaacgctcttcctttaaaaatcttaacctctgcctcactgatcagaaggctttgtggagacccagcaaagcctgatactctgtgacagaaaccatgcccactattgatgctcatctctgtcatcttaatggcctctagcaagaaagtctttaggcaagctagtgcttgaagcttacctaaaatataaaggtatccctggtggggaaaaactatgaagttttgccaaaaaaaaaaaaaaaaaaattcactctcaaccaagatgccatctttaaaatttggtgagagattgttcttatagatgggtatgattcttagacattcatttcttcatcattctttgggaaaaataacaacatctaacatcaataatttgaagtctaaggatacagctttccccactgaagaggaaatggattcactttattgcaagaggaagcaactctaactttaaacccagcaataacacattccttattccctatttttagttttttctttggactttaccccattaaattagataacttaagggcaaggtctgaacagtgaagacaattcaaacatgtaatcaaaaggctgtctctctgatcgcaaaaagggtgtttagagtttaatattgacactatgtcgcttccacataaattaaaattttaaatcctgtttaaaattcagttgaatatatgttacctaacattgatcaaatatgagccagttggcaatactcacataactggcactggttttcatatcatgatgtctcatctaactgaatagctgttgttagtgttaagtcctgctggcaatatggtatccatttgacaaaatgatagcctatgtttgtgctgacccattttaccctaaggcttatactgcttctctagaacatttcttttggatgataaacacaaataaataaacactagattgaaaaaaggtgtggccatactggctaaaagatttctactcaagaaagaccgtgattttataactttaccttggaacagctgcttgagaaagaaacaaggcaagagaatccaaataaattattctattacattataaagtcattttgatattatagtttaaaatttttctaaaaggataaatagcatgaataagaaacaaatattctttacttattt

SEQ ID NO: 113153 - DNA, 1648 bp, Homo sapiens
ctgtcttgctaaccttccttgtacactgtattctggagaaccttggctgttgaaagcataaaggaagaagaatgcagtttttgccttggggagcttacatcttatctggtataccagataaacacaatgaaggacaacacaacggtaaacaaggtatggctatcagaagaatcaagatgaatgagcgtccagaccattgaagggaaagaagtctggctgatgaaaatgagctctgcactgaatccaggccatgttttgaggtttccattgtttttggctcagcctagaaattggattattgctcttcataccactggaggcctgcagcccaacctctgacccaagctatcacagaaaacagggaaacacaaactgaaaattataacaatgctcttcaagctcaacagagagatagtcagacacgtaatcaccacggagagattacagttttctagtctacacttttgaagggaaagagactgcaaaaaaaaaaaaaaaaaaaaaaaaaagagagagagagagagcattaacctttatcagctttcagcatttcatgctttcaatttagaactggatgctattggctctggaaggccatagaagatgtgggaagagcatgcactgttgcttccattattttgtagtgagaaggatggctttggcgagactctaaacgctcttcctttaaaaatcttaacctctgcctcactgatcagaaggctttgtggagacccagcaaagcctgatactctgtgacagaaaccatgcccactattgatgctcatctctgtcatcttaatggcctctagcaagaaagtctttaggcaagctagtgcttgaagcttacctaaaatataaaggtatccctggtggggaaaaactatgaagttttgccaaaaaaaaaaaaaaaaaaattcactctcaaccaagatgccatctttaaaatttggtgagagattgttcttatagatgggtatgattcttagacattcatttcttcatcattctttgggaaaaataacaacatctaacatcaataatttgaagtctaaggatacagctttccccactgaagaggaaatggattcactttattgcaagaggaagcaactctaactttaaacccagcaataacacattccttattccctatttttagttttttctttggactttaccccattaaattagataacttaagggcaaggtctgaacagtgaagacaattcaaacatgtaatcaaaaggctgtctctctgatcgcaaaaagggtgtttagagtttaatattgacactatgtcgcttccacataaattaaaattttaaatcctgtttaaaattcagttgaatatatgttacctaacattgatcaaatatgagccagttggcaatactcacataactggcactggttttcatatcatgatgtctcatctaactgaatagctgttgttagtgttaagtcctgctggcaatatggtatccatttgacaaaatgatagcctatgtttgtgctgacccattttaccctaaggcttatactgcttctctagaacatttcttttggatgataaacacaaataaataaacactagatgcggcaggtgatcttttgtttgctcgggtttctgttaatatggacaaataaa

SEQ ID NO: 113154 - DNA, 533 bp, Homo sapiens
ttagggccctgcaggatgccagctgcattcccagtgcacccacacttccaatcactggctaccaagatagaggctcccactcagggcttcaagttgaataaataattcattagaatgactcaccaacctctgcacttacaattccagttttattgattggtacaaatcaggacaagctaaatgaaaagatgcacagggagaggtttggggagattcccaaatgtgaagcctcccagaacacggttatacgattaccaaccagggtggctgcactgagctacaatgtccagagtttttattggggtttgttacctaggcatgattgatgaaatcattgcttacacctttgtactcaattccaatacccactctctccccagaggtcaggctgatatcatgtggctcaaagtcctgaccctttattcacatggctggtcttgccatggttggccagcctgcatcctgaagctatggagtcccaccttgaagcacctggtcagcataaactccggtgtggccccagggacccacga

SEQ ID NO: 113155 - DNA, 357 bp, Homo sapiens
tggaaggaaataaaatacgagcagtagtattatctttgggttatgaaataatagttaagttttattttcttctttatgttaaacaaaaattcaacatgatcacataggaaacagatgacatattacttgaggccgtgagttttggactcagactgcctggttacaaaacctggtgctgctactttctaactctgttatttacacctgtttcctcatttatcataagaaatagtgcagacatttcattaaagtaatacaagtaattctgatgaagcaacatggaattctgaaatatcacatcatcaaaaatgtatatgatataatattaaataaagatggaaagttctaatggtagaa

SEQ ID NO: 113156 - DNA, 360 bp, Homo sapiens
tcttgacactgaattctagaacaggatctttggtatttgcccagaaatgtacatttgggtttactgtacccatgtgcattagtcagcttgggctgccatagcaaaacaccatacactgggtggttaaatcacagatatttacttctcacagttctggaggctggaagtccaagatgaagatgctgacgtctttggttcctggtgagggctctctttctggcttgcagagggctgccttctggctatgtcctgctatggctgagagacagagagagagcaagctctctggcatctctttttttttttttttttttagatgcagtctcactcttattgcccaggctggagtgcagtggcacg

SEQ ID NO: 113157 - DNA, 85 bp, Homo sapiens
aataagttttgagattttaatgagtcattcatattattgtcctttagctgtggtccttgtcaatgcagaaaaaggattccagatc

SEQ ID NO: 113158 - DNA, 183 bp, Homo sapiens
  misc_feature (180)..(180): n is a, c, g, or t
aacatagaaaccagtaagtatatgacaggtagtgatgagtactatagaaaaatatagagcagagtcaggggaaagggaagtgacagtgcagagtgggagctgataaggaaagaggggtggctggcctgggagtgggggttgtgatgtctccatcttccccatcagtatctgtgtcctcangat

SEQ ID NO: 113159 - DNA, 158 bp, Homo sapiens
actattttaatttttaaaaaattattttaagtcaaggtcctactctgtcactcaggctgaggtggaaggatcacctgagcctaggaggaagaggctgtggtgagctgtgactgtgccactgcacaatctgcctggatgacagagtgagatgcttatca

SEQ ID NO: 113160 - DNA, 568 bp, Homo sapiens
tatgtacacatgctatttgtcccacagaatttaaaagctgaatttttaaaattcagaatatgtttcgtgatggcacacatatccagttctagagttccctctgttgtcttctatccaggtggtctcactctttacattacttgcctagttcctgtatggacccttgagctcatggaagaagttctgagcatggcataggaagtcttgcataacctgacctgcctgcctttctgtctcatttcatgcttttaactcaaatttgctgatgccaaggctcatgtttatctactacaccgcactaattaatgttacttcttttcttccttgggcttatgaaatgtgagaagccaatgcaaataagacatggaacaacaaactcaaattacaaggtaggagtgtatgtggggtgggtgtgaatgaaagggactgggacacaggtgagtaaaagtagtactgtggaaatcccatccagatgggataatttattaccccatttatttcagtgtcagggttaaggcagtaaaacaattgatttttctaatccctgtgtatcattcatttttgtagc

SEQ ID NO: 113161 - DNA, 436 bp, Homo sapiens
atatcaatttgaagtggcagttccatccagttaaaaaataaaaagtatggacaaatcattacaaagtaaacctgaacaaaggaaaaaagaagaaaagaaagaggtaagaaaggaaagtgaaccctgacggatgaaaacaaccaatcctacgaagtttaaattcagaattataataggcaatacttagagttataaaatcaaatctaaaagagctggggtctttcagagtctagcattattaaaggatgaatattttagcacctccgagcagtttgcagtcagtatctgccatgctggagtttcactcttagtttgtaaatacaagcgtcactttctacaaagttttccttgtgggagagcacctgaataaaaaccctgggttttctagataattttaaagcttcctggtctaacgaagctgctgaaggtctccagg

SEQ ID NO: 113162 - DNA, 270 bp, Homo sapiens
tgttatcaaaatctccttccttccttccttccttccttccttccttccttccttccttccctccctccctccctccctccctcccttcctcccttccttccatcgttccttccttttcttatttccttccttttttcagacagagtctcaccctttcacccaggctggaatgcagtggagttattatagctcactgcaggcttgaactcctggcctcaagccgtcagggtagttaggactacaggcatgtgccaccatgcctcgctattt

SEQ ID NO: 113163 - DNA, 311 bp, Homo sapiens
gtagggagatcacgtctctacaaaaaataaaaaattagctggatgtggtggcatgtgcctgtggtcccagctgcttgggaggctgaagtgggaggatcgcttgagcacaggaggttgaggctgtactccagcttgggtgacagaacaagaccctgtctttaaaaaaaaaaaaaatgaaaaagaaagtaagcatttaattcaggggttgggaatggaaaggaggtgagaggcccagcaaaacgaggcatacaaggccacagaaaagtaatgtttgagctgggatggggtaagtaggctctggagtccaccta

SEQ ID NO: 113164 - DNA, 296 bp, Homo sapiens
gcaatctgcccgtctcagcctcccaaagtactgggatttcaggtgtgagctactgcacctggcctcataattcactttatattttgcattaaaactagtttgtctatcaagacagatagaaagtgtccttgttctaaataggtttatttgttctccttattaccctcatctgaatctgtaggccactgacaaagagttttttcaggtctccaaatgactccatgttttcttgaaaccagtctttaaacagtactttttctttcttttctttccttttttttttttttttttttttt

SEQ ID NO: 113165 - DNA, 153 bp, Homo sapiens
tctcataatcctacttcattccttcattcacttatttttaaaagggtcatgtgtacaaatacatagttcagaaaaattttaaatataactataaaagtatacagcaaaatcccattcacagtcttattctccttccacagccaaacactttta

SEQ ID NO: 113166 - DNA, 103 bp, Homo sapiens
gtgctgagcaacgcccctggcttctgcccactccatgccaggagcacctgccagttgtgacagccacaagtgacccagacaccgttcagtgtcccctgggggc

SEQ ID NO: 113167 - DNA, 504 bp, Homo sapiens
acgaatcgagccggtaccgagcggaacaagcaagacagtaaaagatgagtcaggcggggagcgggggctcacgcctgtaatggcagcatttgggaggccgatgctgggaatacaggcgtgaaccaccgtgcccagccccgtgttgtgacatttctatacacctgtgaaatcaccacaatcaagacaatgatcaaatccactgccccagagattccccatgtcctcatgccttttgcaatccctccccgcttcctcttcctctccccaggcaaccactgatctgctttctgtcatcacagattagcttgtcttttctagtttatataaatggaatctggagtatgtactttatctggtttatgtactttatctggtttctttcactcaatataaattgagattcacgcatgctgttacatgcagcaggagctcattcctctttactgccatgtggtattccaccatatgaatgtattagtttgtttatccatttgcttgttgatg

SEQ ID NO: 113168 - DNA, 427 bp, Homo sapiens
agtgagccacaggctgaaactctagcaagctagaagcttaccacaatcctgctggaaactcaaagaacatctgacttgccttccatgaaaagtcaattctactctaggtctggacctcgctttcataacactgagcatgttaaacacgcttgtgttgccagcacccgactcctcacactaaggaaccaaaaccgacagcgtggtcaggccctggcccggctgctccatctttctgcttaaggaatgatgggggccaggcatggtgcctcatgcctgtaatcacagcattttgggaggccgaggaagtcagatcacttgagcttgggagtttgtgaccagcccgggcaacatggtgaaaccccatctctactaaaaatacaaaaatcagccgggtgtggttacatgggcctataatcccagctaccgg

SEQ ID NO: 113169 - DNA, 347 bp, Homo sapiens
attttttaaagggaaatgaacattttaacctttttcttttgagactcttaataaaatcagcttcataaatcagagttactaataattttatctattctgtacttcttaattttttcctaaattaccaaccaccatatctattttatttgaatattcttggtttgcttatgatatcctgtgaaattgcatttgaactttatagataaaactatttaagtctcccacaacggaattccatggaactttaagtactataaactttcaataaggcaaaagcctataaaattattgttacttgatccctctgtgtctccattttcttatccaatgtggtaggtaaattttaa

SEQ ID NO: 113170 - DNA, 326 bp, Homo sapiens
agccaactgaagagacacatagggtgaggtctagaagagtcccaaatacagaactttgtaccctctcccagtggaatcaaggcctgtcaccctcctaccatatcgaacagttcatcagctgggaaactccactggtgttcagtacaatgtttttattggggaatcattatgaaggcataattggttgaatctttgacctcatgattcaactcagtctccagccccctgtgcttccccacccaggtcagggtggctcagagccccaaccctctaatcacatggtggttggtcttttctggtgaccagccgctgtcctgagtcttctc

SEQ ID NO: 113171 - DNA, 396 bp, Homo sapiens
agcgaggccaggtgtaggtggcatctccagcccaggtggccatgcagctgccctgctgtcagggaggaggcgcgtctgcaagctgccttccttccggtgcagatgggctcccttgtggcctttaaagatcgaaaacaccactttgaaatgggattagatatgaatgggggggaaacaggcaaaagggaaaaaattctggcttcagaatagaagaaatggatcaaaaacacaaacagcttaacaaaataattgagaattggggctctgcagtcagaccattctgggttcaagttctaactctgccacttacttgccctgtgatctcagttgagcaacttttttttttttttttttttgagaaggagtctcgctctgttgccaggctggagtgcagtg

SEQ ID NO: 113172 - DNA, 158 bp, Homo sapiens
agacaagaaagcaggtttggacactgcagagaggctgacaaaacttgaagcccagtgggttcctattagttggaaaattcaactgattaaagaaaaaagctcattacaaaagtaaatttttggccaggcgcggtggctcacgcctgtaatcccagcac

SEQ ID NO: 113173 - DNA, 383 bp, Homo sapiens
taactgaatcagcatctgtgaggggcagagcctgtatgtctgccttctactttggatcatactacgatttgagaactgttggtgcagtataactcatctgtgttttctgttcaatctctagtagtcacaatttcacaataaattatttccctacagtgttctaagtagttgctgttttgtttgtgcatggatttttgccagaactcctcaccatcaccaccacaggcactctacatctattttttcattattcttcatagcatctttaagaggcagttaggtggcagattttgctatgtgacaagctgtggtgacagctctgtcttctcctctgctaagcagaatactatatgtgatttatcatttccccagggttgctcaga

SEQ ID NO: 113174 - DNA, 403 bp, Homo sapiens
agggtaatgtgaagtagtgtcacatggacagtaacggagaggtatctgctgctgccatttatataataaatctgaatttggaggcagagaaaggaggcagaaagtttggtaaggacgttattgcaacctgaataagccacttagggcctagatcagtgtttgggaatgtgggagaagacagccatagtcaagaagcgtgaagtagttaatgttgagttatttttaggtggtttttctgttctttttactccagacactgactttcgtaataagataaataatctggtgagtcgcatgctcatggtgtgctgaggcatttagccaagcagcttatgcatgtattatctcatttaattctgtcactatgaggtagagattatctttaaccattggttccaaatga

SEQ ID NO: 113175 - DNA, 826 bp, Homo sapiens
gaatattctccttggtaagtcagttagaaaaactcactcttttgaacaataatgctctgtttttctccagttggggaactgaaataatggagaaagtctctgctcttaatttctctaaccagatggaatttaaaaagcatgtggttcgagtcatcattgggaaaacatgacaaagattatggaacacacatgaattccaacttgctgggcacccacacattttccttcattctttgaagaattgctaaaatcagccatcaagaacagtaaacaccaatactttgccttgagaggaattaggggtttgagctaaaatatctaaaagacttgaaatctgtaattaaacatagacttggttttaagtttcctaatcctctctttatcatcaacattctgcaataaattctttctaaacttccccacctcagtttactagtttagctctctgatgcaataatctccacaaacaatcgtttttgctcagttacttttcattaatttatggtttttccagttttagtcttaactggaataaatgaacatatgactttaatttaacctatatttccttgcacttagaaacaaaagtgaataatattatgtatgcatgtatgtatgcatttatttattctcaatcccaaagacctcaccaatttgatgagggaggttaagcaaaatgaaacaaaaacattctcacccttttactgtacctaaactcaatagtccaacaaaataaaatgaagaaatgatattttagatagtattgtctttactgaaaagccagttgtagtcatattttgcagaaagagagtttaaaatatataaa

SEQ ID NO: 113176 - DNA, 2444 bp, Homo sapiens
tgggcatggtggcatgtgtctggaatccctgctactcaggaggctgaggcaagaggatcacttggaacttgggaggcagaggttgctgtgagctgagatcacaccactgtactccagcctgggcaacagagtgatactctatctcaaaaaaaaaagaaagaaagaaagaaaagaaaaagaagcttacaatcatggtggaaggcgaagaggaggagcaggcatatcacatggccaaaaagggagcaagagaaaggtgagaaagacactagactctttttaaaaccagctctcacatgagctaatggaataagaactcactcattaccacaaggacagaacccagccattcatgagggacctgccaccatgacccaaaaacctcctacttgacccaacctccaacactggggataacatttcaacatgagatttgaagaggacaaatactcaaactatatcacttgttgtccatttttaatctttctctaacataccctaacttcttcttgaaaatgcttaattttctctgttttgagatgtaaatttgctatcctgtttttcttaaaacttggtaagatcttcagccatgaaggacagacaaactgtaacctttccatttacaaagctgcatttgaattcaactgtccttttaaactaaggagttttactggtctcgtggctaaaattttaaagatgtaggccaggtgcagtggctcatgcctgtaatcctatcacttttggagaccaaggcggggatggatcacctgaggtcaggagttcaagaccagcctggccaacatgatgaaactccatctctactaaaaatacaaaaattagtcaggcatggtggcacacacctgtaatcccagctactcgggaggctgaggcaagagaatggcttgaacccgggcgacggaagttgcagtgaggcgagattgcaccattgcactccagcctgggcaataagagtgaaactctgtctcaaaaaaagaaaaaatgatataaagtatttatttgtgtttatattttatggatacgtgtctatgtttatagattgcctgtatggtaccaacttgacataaataaattagtactcataaattaagtaaataagcccaaacgcttttcaagttcacagggcattagtaatctgtggtaaatgaagatagtttaaaatttggggtaaaataaaatagaaacattttctgaatttaatttagatatttttctgggtctatttgttagacaggtttacactatctctgctatttttttaaggacctaaaactgaatggacatagaaaattgaggaaagaaataaaaccgtaacaattataagaggttataaaaggttcatggaacctttttatgttttttcttgtgcagtcaaaaccaattgcaggctggatgcagtagctcacacttgtaatcccagcactttgggaggctgagatgggcagatcacttgagctcaggagtttgagaccatcctgggcaacatagtgaaactctctcactaccaaagtacaaaaggaattagctgggcatgatggtacacacttgtagtcccagctacttgggggactgagatgggaaaattgcttgagcccgggagtcaaaggttgcagtaagccaagattgcaccactacactccagcctgggtgacaaagtgagaccctgtctcaaaaaaaaacaaaaaaaggaaaagaaaacaattgcaattggattgatctgtttataaggctttattaaaattagctttagcatttataatacactggcacaaagttagaatttggatttctcttttgaacaagatttttgtatacattaataagaaatagtaaaagatttttgtttaccttttgagtaaactgcaaaaaatattagtaataagaggagagaatttccctaatgctgtttttattatgtcttttgattgtttggaaaactgaatctcccctctgtcaaagagtaaaatttttgctttttgaaatttttgaattatcagtttggctaaatgaataactattatcttacagtgacctgtaatcttattttgatcaagtgttttaaacctttgatatttgacaaactttccaaaatcaaatgtaaaattctaacttaaatgttttcgacctcaagctaacttttgggcattaaagcccttggaagtccaaatagggcccctggaagtccaaaagaaacatattaggctaatttggtatattaaaatcatacaggaagctgatcaaataaaaaatgttgtttaattttctttgagttgtatttgtataaatctgttattaatatgcatcccaaaattgtatcatattgctaaaatgttgatagatcttgttatatgttattggtaataattgttatcctgttaaattattgtataccacagaaataatgaaatttctttgtcaattgcatcagt

SEQ ID NO: 113177 - DNA, 2742 bp, Homo sapiens
tgggcatggtggcatgtgtctggaatccctgctactcaggaggctgaggcaagaggatcacttggaacttgggaggcagaggttgctgtgagctgagatcacaccactgtactccagcctgggcaacagagtgatactctatctcaaaaaaaaaagaaagaaagaaagaaaagaaaaagaagcttacaatcatggtggaaggcgaagaggaggagcaggcatatcacatggccaaaaagggagcaagagaaaggtgagaaagacactagactctttttaaaaccagctctcacatgagctaatggaataagaactcactcattaccacaaggacagaacccagccattcatgagggacctgccaccatgacccaaaaacctcctacttgacccaacctccaacactggggataacatttcaacatgagatttgaagaggacaaatactcaaactatatcacttgttgtccatttttaatctttctctaacataccctaacttcttcttgaaaatgcttaattttctctgttttgagatgtaaatttgctatcctgtttttcttaaaacttggtaagatcttcagccatgaaggacagacaaactgtaacctttccatttacaaagctgcatttgaattcaactgtccttttaaactaaggagttttactggtctcgtggctaaaattttaaagatgtaggccaggtgcagtggctcatgcctgtaatcctatcacttttggagaccaaggcggggatggatcacctgaggtcaggagttcaagaccagcctggccaacatgatgaaactccatctctactaaaaatacaaaaattagtcaggcatggtggcacacacctgtaatcccagctactcgggaggctgaggcaagagaatggcttgaacccgggcgacggaagttgcagtgaggcgagattgcaccattgcactccagcctgggcaataagagtgaaactctgtctcaaaaaaagaaaaaatgatataaagtatttatttgtgtttatattttatggatacgtgtctatgtttatagattgcctgtatggtaccaacttgacataaataaattagtactcataaattaagtaaataagcccaaacgcttttcaagttcacagggcattagtaatctgtggtaaatgaagatagtttaaaatttggggtaaaataaaatagaaacattttctgaatttaatttagatatttttctgggtctatttgttagacaggtttacactatctctgctatttttttaaggacctaaaactgaatggacatagaaaattgaggaaagaaataaaaccgtaacaattataagaggttataaaaggttcatggaacctttttatgttttttcttgtgcagtcaaaaccaattgcaggctggatgcagtagctcacacttgtaatcccagcactttgggaggctgagatgggcagatcacttgagctcaggagtttgagaccatcctgggcaacatagtgaaactctctcactaccaaagtacaaaaggaattagctgggcatgatggtacacacttgtagtcccagctacttgggggactgagatgggaaaattgcttgagcccgggagtcaaaggttgcagtaagccaagattgcaccactacactccagcctgggtgacaaagtgagaccctgtctcaaaaaaaaacaaaaaaaggaaaagaaaacaattgcaattggattgatctgtttataaggctttattaaaattagctttagcatttataatacactggcacaaagttagaatttggatttctcttttgaacaagatttttgtatacattaataagaaatagtaaaagatttttgtttaccttttgagtaaactgcaaaaaatattagtaataagaggagagaatttccctaatgctgtttttattatgtcttttgattgtttggaaaactgaatctcccctctgtcaaagagtaaaatttttgctttttgaaatttttgaattatcagtttggctaaatgaataactattatcttacagtgacctgtaatcttattttgatcaagtgttttaaacctttgatatttgacaaactttccaaaatcaaatgtaaaattctaacttaaatgttttcgacctcaagctaacttttgggcattaaagcccttggaagtccaaatagggcccctggaagtccaaaagaaacatattaggctaatttggtatattaaaatcatacaggaagctgatcaaataaaaaatgttgtttaattttctttgagttgtatttgtataaatctgttattaatatgcatcccaaaattgtatcatattgctaaaatgttgatagatcttgttatatgttattggtaataattgttatcctgttaaattattgtataccacagaaataatgaaatttctttgtcaattgcatcagtaatcatggctcttctaagtcttttgtcattcacagatgattattgttttacttggattcttttcaaaagtggtttgtaattggctacagcctaaaatctgcttgttcaaaaaaaaaaaaaaaaaatccatggaaagggccctgacagcacacacacttaaacacagttttctgataactttggaattcacaccgttggactagttaaaaacttctaaaataattttttaaaatctaataaattaatgaagattgctaatccaacatcaagcagaataagttaattacatggggctgaa

SEQ ID NO: 113178 - DNA, 106 bp, Homo sapiens
acacaggcagctgcagcactgaggatgaagaagtcctgacttggcctcaaagccagcattgacttcctagaagaggtaccagctaaatggtggtgagaaggctggg

SEQ ID NO: 113179 - DNA, 274 bp, Homo sapiens
tgactacaaatttgttggcttaagacaatagagatttatcgtcttacagttcaggagagaataaatccaggtgttacagcgctgtgttccttctgaaagcactggggaaaatcttttgcctcttttggcttccggtggctccagatgttccttggttcatggttgcatcactccaatctctgcccatggtcacactgtctcttcctcctctctcttctgtccctctgtctgttcttcctctatctctgtcttatatggatacatatgattacat

SEQ ID NO: 113180 - DNA, 294 bp, Homo sapiens
aaactctggaactttgttccttctcactttcctgctaacatccagttggctttctcagccaactgaatcaactcctggaaagtctctctggttgcttccattctaatccccaaagggccccaattcagccttcatcagcttgtctgattataactgcccttctctctctctctgtggttctttttcatgcctcatagtgccacctgtgttatctttacaaaacagacctgtcccggtaacctgatgaggaaattaagtatcatgtgtcttctagcttgtagacagaaagggaac

SEQ ID NO: 113181 - DNA, 253 bp, Homo sapiens
gcacacccaggagtgagagtgaggagcagctgagagagttggaaaagggagcccttatgtggccaccaagggcttccctgctagcagccacacggtggctatccagctcattatgcgagttctagttcttcaaacaagaggccacgggaggagcaacggccacccaccatcccggggatcctcattcatgatttgaaaccactctaagcaggttctggggtgttcggcagaagctggcaaccattcttgtggg

SEQ ID NO: 113182 - DNA, 455 bp, Homo sapiens
taggactgagtctcgctctgtcactctcaccgaggctggagtgcagtggcatgatcttggttcactacctccaaggttcatgcaatgctccttcctcagcctcctgcgtagctgggattagaggctcccaccaccatgtccagctaattattgtatttttagtagagatgaggtttcaccatgttgaccaggctggtctcaaactcctgacgtcaggtgatctgcccatcttggcctcccacagtgctgggattacaggcgtgagccacagtgcccggcctccactcctttctcttaattcccccggacactgcctaggttaagcactcatttcttattgggatgaccacaagaacttcccagactggtctctctgcttccagactgtctcactgcattttccttgaggttgactgtaggaagctctaaaggcagatctgatgcattactcctct

SEQ ID NO: 113183 - DNA, 1272 bp, Homo sapiens
gttagattgtgtgtgcctttagttaccttacctctgaatattaattctattttgactcgatcgtagcgttactcacgttcaaggtaaacacgttccacactggccccaagccaggcacactgtgttttactgattgatttgaagatgatagagagcctagggggatgagtctattggactcaaaggttacattttgtttttccatttaatttaataatcaacaaaacgacaaagtcagtttaatatctttcttctgctgagtcttcaggatgttagctagtctttcaaaagccattgctacaaaagtgcaaatttctcatttcctgtgggtctctagaaactctctcaatatttaaagccaaacaaatccatcttttctgagagacagaaactaaaaaattcagagttaattcactattaaaaacagcaaggccctgctatttcccaagaataaagaaatttaaaattctcattgtaagaagtatgaacttgaagctagaattggtttatttctggcagctacttacaatattaagaactttactttttaaatttgagacaatttcacaggaaagcaagaaattagtctattgtgaaatgtttttacaactaacttggaatatactgcaaatcactagtaagtagagacacatttaagataaaatgattaataaaacaattggtaattctgaataaggatctgaataaatccagatcacagactgttcctttaccaatatgtaaaagaatgtgcaaaattagtaaaaatatacccaaaaatttaccagcaacagagaagcaaagaatggagttcaaccttacactataaacatctaatagatatgtatgaaaatttaaaaactagaaaaggttgggcatggtggctcatgcttgtgatcccaggactttaggaggccaaggtgggaggattgtttgagcccaggagttcaagaccagcttgagcaatatagtgagaccctgtctctacaaaaacaaacaaacaaacaaacaaataaataaataaataaaattagctgggaatggtgatgcacacctggagtcctagctactcagaaggctgaggcaggacgatcacttgacctcagaagtctgaggttacagtgagctatgatcataccagtgcactccagtctgggtgacagaacaagaccctgtctccaaaaattaaataaataaaacaaaaaaaaagaatttaaaagttttatataaaggcatagctactatctcatctgcccagtgtagtcatgaata

SEQ ID NO: 113184 - DNA, 2303 bp, Homo sapiens
ggaggagatactgatctatgtagcgaataaatgccgttttctcttgcggaatggttattctccgaaggatattgctgtgcttttcaccaaagcaagtgaagtggaaaaatataaagacaggcttctaacagcaatgaggaagagaaaactgtctcagctccatgaggagtctgatctgttactacagatcggtgatgcgtcggatgttctaaccgatcacattgtgttggacagtgtctgtcgattttcaggcctggaaagaaatatcgtgtttggaatcaatccaggagtagccccaccggctggggcctacaatcttctgctctgtttggcttctagggcaaaaagacatctgtatattctgaaggcttctgtgtgacaggaaacccaagcctaagaaacaattaagtggttctcatctctaattaactgtgaaaccatttaatccaaacatgtaagcacacactcacttattaagtcacatacttttctaggtgctggggattgagaacgaatcgatgtaagattcctcctttagggcagagacagaccactgacaaatacacagatagacaaggaatttcccatggtaaaaagggatatcagtaattagaggaccgtgagactcagagatgtgtgtgtgtgtgtgtgtgtgtgtgtgtgtgtgtgcgcgcgcgcacgtgcacatgtgtgtaggtagatggagggggtgattattttgggtggtcagggaagtgctcagtgagggaagaacttgtcatgagaatctctgagcgtgccaggcagactcggatatttttataaatttttaacatggccacttgcagaagagcttgaatgggacgtgcagcgagaatgtgaaggatggagcaggtagctcatctggccttgtaggtgccgggaacgggcaagacatgttttgaaatgtaagatcacagactgttttttgcaagaccacattatattactttattattttctgctttttcttttaacgacattagtgtttttgagcactatattttaaaatgctttttgtgagccttttggttatgtggaatctgttccttagctctgattttttattcttatggagcgtcttaggttactacatgaaggtaagactgccacagtcccccagggaggcacactgtgttttactgattgatttgaagatgatagagagcctagggggatgagtctattggactcaaaggttacattttgtttttccatttaatttaataatcaacaaaacgacaaagtcagtttaatatctttcttctgctgagtcttcaggatgttagctagtctttcaaaagccattgctacaaaagtgcaaatttctcatttcctgtgggtctctagaaactctctcaatatttaaagccaaacaaatccatcttttctgagagacagaaactaaaaaattcagagttaattcactattaaaaacagcaaggccctgctatttcccaagaataaagaaatttaaaattctcattgtaagaagtatgaacttgaagctagaattggtttatttctggcagctacttacaatattaagaactttactttttaaatttgagacaatttcacaggaaagcaagaaattagtctattgtgaaatgtttttacaactaacttggaatatactgcaaatcactagtaagtagagacacatttaagataaaatgattaataaaacaattggtaattctgaataaggatctgaataaatccagatcacagactgttcctttaccaatatgtaaaagaatgtgcaaaattagtaaaaatatacccaaaaatttaccagcaacagagaagcaaagaatggagttcaaccttacactataaacatctaatagatatgtatgaaaatttaaaaactagaaaaggttgggcatggtggctcatgcttgtgatcccaggactttaggaggccaaggtgggaggattgtttgagcccaggagttcaagaccagcttgagcaatatagtgagaccctgtctctacaaaaacaaacaaacaaacaaacaaataaataaataaataaaattagctgggaatggtgatgcacacctggagtcctagctactcagaaggctgaggcaggacgatcacttgacctcagaagtctgaggttacagtgagctatgatcataccagtgcactccagtctgggtgacagaacaagaccctgtctccaaaaattaaataaataaaacaaaaaaaaagaatttaaaagttttatataaaggcatagctactatctcatctgcccagtgtagtcatgaata

SEQ ID NO: 113185 - DNA, 2249 bp, Homo sapiens
ggaggagatactgatctatgtagcgaataaatgccgttttctcttgcggaatggttattctccgaaggatattgctgtgcttttcaccaaagcaagtgaagtggaaaaatataaagacaggcttctaacagcaatgaggaagagaaaactgtctcagctccatgaggagtctgatctgttactacagatcggtgatgcgtcggatgttctaaccgatcacattgtgttggacagtgtctgtcgattttcaggcctggaaagaaatatcgtgtttggaatcaatccaggagtagccccaccggctggggcctacaatcttctgctctgtttggcttctagggcaaaaacaattaagtggttctcatctctaattaactgtgaaaccatttaatccaaacatgtaagcacacactcacttattaagtcacatacttttctaggtgctggggattgagaacgaatcgatgtaagattcctcctttagggcagagacagaccactgacaaatacacagatagacaaggaatttcccatggtaaaaagggatatcagtaattagaggaccgtgagactcagagatgtgtgtgtgtgtgtgtgtgtgtgtgtgtgtgtgtgcgcgcgcgcacgtgcacatgtgtgtaggtagatggagggggtgattattttgggtggtcagggaagtgctcagtgagggaagaacttgtcatgagaatctctgagcgtgccaggcagactcggatatttttataaatttttaacatggccacttgcagaagagcttgaatgggacgtgcagcgagaatgtgaaggatggagcaggtagctcatctggccttgtaggtgccgggaacgggcaagacatgttttgaaatgtaagatcacagactgttttttgcaagaccacattatattactttattattttctgctttttcttttaacgacattagtgtttttgagcactatattttaaaatgctttttgtgagccttttggttatgtggaatctgttccttagctctgattttttattcttatggagcgtcttaggttactacatgaaggtaagactgccacagtcccccagggaggcacactgtgttttactgattgatttgaagatgatagagagcctagggggatgagtctattggactcaaaggttacattttgtttttccatttaatttaataatcaacaaaacgacaaagtcagtttaatatctttcttctgctgagtcttcaggatgttagctagtctttcaaaagccattgctacaaaagtgcaaatttctcatttcctgtgggtctctagaaactctctcaatatttaaagccaaacaaatccatcttttctgagagacagaaactaaaaaattcagagttaattcactattaaaaacagcaaggccctgctatttcccaagaataaagaaatttaaaattctcattgtaagaagtatgaacttgaagctagaattggtttatttctggcagctacttacaatattaagaactttactttttaaatttgagacaatttcacaggaaagcaagaaattagtctattgtgaaatgtttttacaactaacttggaatatactgcaaatcactagtaagtagagacacatttaagataaaatgattaataaaacaattggtaattctgaataaggatctgaataaatccagatcacagactgttcctttaccaatatgtaaaagaatgtgcaaaattagtaaaaatatacccaaaaatttaccagcaacagagaagcaaagaatggagttcaaccttacactataaacatctaatagatatgtatgaaaatttaaaaactagaaaaggttgggcatggtggctcatgcttgtgatcccaggactttaggaggccaaggtgggaggattgtttgagcccaggagttcaagaccagcttgagcaatatagtgagaccctgtctctacaaaaacaaacaaacaaacaaacaaataaataaataaataaaattagctgggaatggtgatgcacacctggagtcctagctactcagaaggctgaggcaggacgatcacttgacctcagaagtctgaggttacagtgagctatgatcataccagtgcactccagtctgggtgacagaacaagaccctgtctccaaaaattaaataaataaaacaaaaaaaaagaatttaaaagttttatataaaggcatagctactatctcatctgcccagtgtagtcatgaata

SEQ ID NO: 113186 - DNA, 557 bp, Homo sapiens
cctcctgggttcaagcaattctcctgcctcagcctcccaagtagctataggtgcccacaaccacgcccggctaattttttgtatttttagtagaggcggggtttcaccatgttggccaggatggtcttgatctcttgacctcatggtctgcccgccgtggcctcccaaagtgcagggattacaggtgcgagccactgcacctggcctaccggtagatttttgaaaaataattttttagtcagaatccaaacacagttagacaatattgtgaaatgtgtggtactctgggattgtttctctctttccaccagattccgagtccctgagggaagagacttgcgtctctgaccccctttgaaccatagcaggggtttaagacccacgtgcctatgagtacctggcaggcgatctgcctcacaggctcttcttgtggtcactgaatacttgcctgagatgattttggagtgacctgaattatttcctcactgtttcagtgaagagagtttaaaatagactttaagcagaacaataatttcaagttgaaataaaaagggtta

SEQ ID NO: 113187 - DNA, 260 bp, Homo sapiens
atgaaattatacaccatgtactctttcgtacgtggctcctttcactcaatcttttgcttttggagttctatactgttatatggtactgtagtccatttattcttgcttttaaataggcttctatagtgtataaatatatcaaatttatttgtccattctattcttaataggcacttgggcaatttccagtttggagctattataaacagtgttgctatgaacatttctgtacaggtcttttgatgaacatatgtacacat

SEQ ID NO: 113188 - DNA, 319 bp, Homo sapiens
ctgtcggtggcaataccaagtctatttttgatgaagaatcaacatgagatttcaacagaagcaaaaaaggtaatctttatttgaaaagcccatcaactctttgttttatatccattttttggtcactttagaaatatttttgcagaatttttcgttgttaattttataacctccacaaaaatattgtagaagtgctgaggttagtccaggaagtattttatttcaaaaatgaaatgacagaatgccagggctcaatccccacctctctccatgttctcccaataaaaaatacaagaaagaatttttattaacttttaga

SEQ ID NO: 113189 - DNA, 173 bp, Homo sapiens
tatttagaagataagtgtaaaaagaaccagactattatagattgagaacttggaatgaataagcacaactgacacctgcttatacatgtcttctaaactggctcacgtagggctcctttgatttgtcatcataatttgttattgtagagctagaaaagttgtctaaccttttg

SEQ ID NO: 113190 - DNA, 579 bp, Homo sapiens
tgtcttggggacagttccccgcaaaggtcattcctagcttttgaggtcaatgttgggtcataaggtactgcattgtgcaaagaagtcagtctgctaactttatgcaaagatagaaactgcacggtattttttaaaattagtttttaaaataaatgccaagagtagatcttatatatatatatatgtatacatattttatatatatatatatttccatactcaaccacaacttcctctgtactcattgtttactacagtgggggacatcaagggttggaaggattataaagctttaaggctgggcgtggtggctcacgcctgtaatcccagcactttgggaggcgaggtgggcggatcacctgaggtcaggagttcaagaccagcctagccaacatagtgaaactctgtctctactaaaaaatacaaaaattagctgggcgtggtggcgggcgcctgtaatcccagatactcgggaggctaaggcaggagaatcacttgaacccgggaggtgaaggttgcagagagccaagatcacaccactgcactccagcctgggtgaccgagcgagactccgtctca

SEQ ID NO: 113191 - DNA, 996 bp, Homo sapiens
tttagtagagatggggtttcatcatgttggccaggctggtctcgaactcctgacctcaggtgatctacctgcctcggcctcccaaagtgcagggattacaggtgtgagtgagccaccgcggccggcctctatcattttctgactcagcagctccaccaaaattgacatcctagcaaacactgtgaaggaattaacctaagtgcttccagagcatctcatgtaacctctatggagtaagtcactttttctgtaacatgtggcttttgaccttgatgaagactttgacttctcatccctgtctacatggaggaagatgattcagtggtggggaaaatgaacctcggtaacatttccaatgtccttcaagagggaaacaagttcagtgttatcatcgtggcattcgttagtttttttttttttaaatcacttgtttagatacaactttatttttttatacctacatagcacatgactggggggataaagcatgtataagttgggagagggtaaagaatgtgtgactatgtatacagaaaatagactaaaatgtgcagcaaaatgatatatactgtaatctggtttttgaagtatctactattctggaatattgttaaacaactttttgcttttgaaaaaaaaaggtgccttgattcagttgcgtgacttagaacattcatcctattttattgtgatttttaatgtcttctgaccccaaactgtgtttttggttgcagtctggcggctgcaggcatagcgtcggttttgttccaataacagagaccaaagagttaatcagatatggttcagctgctacaattgtatgattcaaaggcaatttaatcaccccaaatttccatggcccccacagtcaagacctgccattcgttttctcttgcaggttggagtaaatttgcactttgaatcatgtgggtcatttggggaccttgttcttttctattttgctttattaataaaggaacttgtagaaaaaaaaaa

SEQ ID NO: 113192 - DNA, 1241 bp, Homo sapiens
tgtcttggggacagttccccgcaaaggtcattcctagcttttgaggtcaatgttgggtcataaggtactgcattgtgcaaagaagtcagtctgctaactttatgcaaagatagaaactgcacggtattttttaaaattagtttttaaaataaatgccaagagtagatcttatatatatatatatgtatacatattttatatatatatatatttccatactcaaccacaacttcctctgtactcattgtttactacagtgggggacatcaagggttggaaggattataaagctttaaggctgggcgtggtggctcacgcctgtaatcccaaagtgcagggattacaggtgtgagtgagccaccgcggccggcctctatcattttctgactcagcagctccaccaaaattgacatcctagcaaacactgtgaaggaattaacctaagtgcttccagagcatctcatgtaacctctatggagtaagtcactttttctgtaacatgtggcttttgaccttgatgaagactttgacttctcatccctgtctacatggaggaagatgattcagtggtggggaaaatgaacctcggtaacatttccaatgtccttcaagagggaaacaagttcagtgttatcatcgtggcattcgttagtttttttttttttaaatcacttgtttagatacaactttatttttttatacctacatagcacatgactggggggataaagcatgtataagttgggagagggtaaagaatgtgtgactatgtatacagaaaatagactaaaatgtgcagcaaaatgatatatactgtaatctggtttttgaagtatctactattctggaatattgttaaacaactttttgcttttgaaaaaaaaaggtgccttgattcagttgcgtgacttagaacattcatcctattttattgtgatttttaatgtcttctgaccccaaactgtgtttttggttgcagtctggcggctgcaggcatagcgtcggttttgttccaataacagagaccaaagagttaatcagatatggttcagctgctacaattgtatgattcaaaggcaatttaatcaccccaaatttccatggcccccacagtcaagacctgccattcgttttctcttgcaggttggagtaaatttgcactttgaatcatgtgggtcatttggggaccttgttcttttctattttgctttattaataaaggaacttgtagaaaaaaaaaa

SEQ ID NO: 113193 - DNA, 330 bp, Homo sapiens
ccatagcgttgtttgcaggaattgctttctgggaggatacaccagggtttggatccaggctgtgccccttgctagtgatgtggctttgggtagaggccctccgtgagtcttagtttccccctctgcaaaatgggagtgcagtactgcgtgcccagaaaggattgttgtgagggtcatgtatttggaaaggactggtgtgcggtcaggagtatagcttggtggtgtgctcccttcccccacttgagtgtgtcctggtgagcccttggctcttggtttccaggcttatcacctggcacctctgctcccagtcagcccagacaggtgcctaaa

SEQ ID NO: 113194 - DNA, 817 bp, Homo sapiens
aaaataaaatttgcatacatattaaaaatccaatccctggatttttatttatcctattataaggaaccaaattgctagttattaaattatggttacaaatattctcattttcaatcactcatgcaaacagctctagaattgataaaaaggcattaactctcagacataaaaacaaaattaaagttattaaatacaatagacatgaatgtgcagctcataatatacagagttggcacgtgaacaacataggcttgaactgtatgggtttacttatatttaaattttttccaataaatatactggaaaaaattctggagatcagcaacaatttcaaaaaacctcacagacaaaccatatagcctagacatattgaaaattttaagaaaaagttgggtttgttctgaatgcataaaatatatgtagatactagtagtctattttatcatttcctaccgtaaagtatacacaaaactattataaaaagttaagttttattaaaaacgtatatatactttcagactatacatggtaccatttgaagttgagagaaatatgaacaaacataaagacgcagtattaaatcacaactgcataaaattaactgtagcacatactatattactgtaacaattttgtagccacctcctcttgctattgaattcacagtgaattcaagtgctgtgagtatctgcttgaaaccctgggtgatgctaatcatctccatgtgagcagttccacaggcctgtaaattgtgtattgcagtaaaaagtgatctctcgcagtctcacatttttttattgtgttgagcacaatattg

SEQ ID NO: 113195 - DNA, 698 bp, Homo sapiens
gagcccgtggttgcccaggcgactgttaggtggcttacgcggcccggatgcagcagaaacaccagcgttgctgcgaccgcgttggcgatggcgcacgaaggctcggtgagcttcagttcagctggggatgcgccagagccagggtcggccgttaaggtcggtgtcgggaacagtgggctggctctgggccgcccagtgcccctacttgctcccgcccaccgcgcgggagtttagatgaccaaggaagccacgtcggtactcgggcagaaaacctacacctgcacggtgcccactcaaacgctttgttacactcaagccatgagggaaagggtcagtgggtggtgtagagcccgagaacaggaagtggattttgaaacagctaatgaatgtagtaagtctcttacatggtggtgcgtatttaaatggatgagcatttagagagggaagataacagaaaaaatctatttcgagaatttcaagaggaagaaatatattaaataattcagagactgcacttgaaagtcaaattgtttaagagccaatcaattttaaaataaagaaaacggggccggtctcaatggctcatgcctgtaatcccagcactttgagaggctgaggcgggaggattgcctgagctcaggagttcaagaccagccaggccaacatggcgagaccccgtctcgactaaaatacaaaaa

SEQ ID NO: 113196 - DNA, 308 bp, Homo sapiens
gtttgagcagaacatgacatttgtgttatttgtgcactgtcaggcttgagccagtgtgtgcacgtgtgtgtacatgtgctgccaagagggagagcccattaggatggcagctccactggggccaggatcctagtcgattttgtttgctgcagaatccccaacatctagaacagtgctggatgcctaataggcccttgggaagtatatcgtgtgggtgagtaaatgattgccaacgtgagcttgtgtactggcacgtgctgagcttggggtgcatgtgggtaaacacgcatgtgactcagcacccagtg

SEQ ID NO: 113197 - DNA, 167 bp, Homo sapiens
tgctgggattacaggtatgagccaccgcacctggccacattaacttttattctgaaacactttaaatttctttgtagcacactttatagattgctatgcttatttatttagggaaatacgttttttttaaaacctagccgcattttttttttttttttgagatggag

SEQ ID NO: 113198 - DNA, 504 bp, Homo sapiens
gcagccttcaaattagttaccctgtctctaggactgtctacagttcctttcttccacaatgcccccagaaaactaaaacacaaacccaaccatgccactcacctgtttcaaaccctccaggagcttccatgccctccaaataaagtccaactcctgaagcagggtgctttacatgccagtggttcctgctgattgccccagccatctttctcatccccagacctcctcccaactctcacaagctttcctcagctgtttgcatgcaccatgctctttctcacctgcaggtcttcagacatgccattccctttgtctagaatccatccctcattcaccctctctaccctgctggtccagtttaaacattacttcctctagatagcctttctagatgaccttctcccacccaaagcctctccccttctccagtctgggttaaatacactcatggcactttccccttaccacagtacttatcatgctttattttaacagttttaactg

SEQ ID NO: 113199 - DNA, 626 bp, Homo sapiens
gacagaagtagtcattaaaatcagaaccagaaaaggcaagttttacttgtttatgtgactgtatgtgtaacaaaattcaagcagttcatctaaaaacctcttagagacgatatatcaaagggagacaggagccaacttgaaagagctcccaatggctaaaacagaacaattcaagcaacaaaataagtagcatagcattgtattacaaccaagtcttaaatatccatgagtacttatataaggaaatgattaattgaataactacaatcaaatagaagagggcagtattccttatagaacaattccaaaagtgactcgtagatattctctctgttaagagttggagcttattctcttcccccactttgagtgggggctgaacttagtgacccccttctgagtaatagagtatagaaagaaagaaaaaagtcactgtacaatggagaagccccgcaaacactaccttggccagatgattgaggttaacatcagtaataaatcatgttaatggcatgcacttcctgatataaggcactaaaaagaacactaaccacaaccttatggggaaaacactggacaaatagaaactgaagaatattctataaaatatctaatcatagactcct

SEQ ID NO: 113200 - DNA, 827 bp, Homo sapiens
gtttctagaaccttgtgcgatagctccccactattgtaaaggggtgaaatattttacctaagtaaacatacccggtaagtgagttctaaatgtcagtatttgaatggaggttttctcagccttttctccctctgtcttctgagtataaatggagtgactgccctcctgagtctcctttcttatggcttgagcgatctttctacgatacagatcggatcctgtcattccccagcttgaaattctttctgattttcttttttcctttttttcaaatttaagtttaatttttattttttgtagagatacggtcttgctctgttgcccaggctggagtgtagtggcatgatcatagctcactgcagccccaaatacctggcctcaagtgatcctcctgccgcagcctcctgtgtagctgggattacaggtggcttggctaacccagcctgaaattcttaaaagtgctcctcctgctttcagaatcaagttcaaactccttcaccaaacatattaaaggcctctttatctggttcctgtccagctttgcagcctcatttcctcctgcttttccaaaggcactcactctgtgcttttgccattctgaactgtttcttacctctaaactaaacacacaattccctataatggtccctcagtgacccacagggaaacctgatccccttccctgataccatgcacacaccataggcaaagtccttaaaacttgcaccttagaattacctgaatatgatgcctagtcctcacagttactctctggttgggaatgttgtgcaaagaccacgattgcatgagctcacttctatgagatg

SEQ ID NO: 113201 - DNA, 279 bp, Homo sapiens
aaaaattgtggtgaagtatacataacataaaatttaccatttttaagtgtacagttgagtggcgtgaagcactttcacagtgttgtgcagccatcaccaccatccatctccagaacgttctcatcttcccaaactgaaactctgttcccattagatgccaactcccctcccccatccagtggcggcggccaccattcttaccattctttctccttttttttttttttttgagatagggtctcactgtcgcccaggctggagtgcagtggcacgatcttg

SEQ ID NO: 113202 - DNA, 338 bp, Homo sapiens
atcccactttcgctgttctaagccatcctgtttgtggtaatttgttacagaagccacaggaaaccaacacaacaggcaaacctagcagttgtactcgccaactccagagtggagcctctgttcccctggtacactcgccaactccagagtggggtctctgttcccctggtacactcgccaactccggagtggggcctctgtttccctcgtacactcgccaactccggagtggggcctctgtttccctcgtacactcgccaactccagagtggggcctctgttcccctggtacacttgccaactccagagtggggcctctattcccctcgtacactcgc

SEQ ID NO: 113203 - DNA, 156 bp, Homo sapiens
agcataaggtttctgagatccatccatgttgttgcgtggatttgtggcacatttccttctattgctgagtagatttcaattgtgctgtttgtttatccattctttttaaaatggacacttgtggcttgtttccagtatggatctattatgaataaa

SEQ ID NO: 113204 - DNA, 221 bp, Homo sapiens
agcagtttagtgttgactacatcactgtcattctgcagcagagctgttggaggtatctgaatactttattttttaaattgttgaaaaatagaaatgaagattcagtaatgcgccgttaagattggaaatctttaggtatcctgagttaatcttactcatttggagaatcattggtttttaagtttagttagcctcatattcattcatgaaggaaaaaaatt

SEQ ID NO: 113205 - DNA, 274 bp, Homo sapiens
aatttcaatgtcataacttaagaatctgttaaaaaaaaaaaaaaaaggccagtgagaagtctttggatgatgcctgcctcttaaaagtgactatacaacctggaaaaatggccagtactatttcctcaaatgttagtctcactaaagcaaacagttttaaaaaatgattttccttgtgctagaaaacctcacccataattatgatagttcttgaatatggcaatcttttattgaggaggagctctttaatatatactaacctcaaaaggttcaa

SEQ ID NO: 113206 - DNA, 493 bp, Homo sapiens
tcaattaagtcccaagctaaacatggccctttgtcttctgaagaatatagtaataatagtgtgtatggttatttatggagagctcaccataggccaaacattgagataagcactttatggagtcagctccttcagcactctcaattacctagttttggggtaagttatcactactctcaccattagatgaagaaattgagggtcttcaggtttaaataacttgcctgaggaagtagagctagcaaaggacagtcaaaatctcccagtcctgtcctgttctgaagctcacattcaaaacaagactgcaccacggcttcctccccaggttaaagctacgactacagcactgatgtcaaaacaactgagtgattcaatggaggaaaagccaatcagttccattagctgagatcatttcaaaacaaagatataactgtccttgattttccactttgttcctcacttttttggtgttatagagatccagtcaaaaaaa

SEQ ID NO: 113207 - DNA, 111 bp, Homo sapiens
aagctctgcccaaataacctgtggatggaaaagcgccacttgctactggagaggatgatgataatgaagttccagatcttgtggagaattttgatgaggcttccaagaatg

SEQ ID NO: 113208 - DNA, 312 bp, Homo sapiens
aaaaaatatttttacattttcatgtatcaccataagtacataatattttgtatgatttgtttacacacagaatatgtcgtcgtacacatcatctctaatttgcttaagaccaacctgtgttgattcataatgatctagtttcttcctttttacctgcaaaataggatgacagcatgtggccacaccacattccattttcccactcctctgttcgtggacggggcctagtgtctctgagtcatgtttactgaggcagcgctgagtgcatccttccggaacaggcaagcccgtttgcctgccaccttgttgact

SEQ ID NO: 113209 - DNA, 280 bp, Homo sapiens
ggagagagaaagggacacagagccaatgggaaaagagaaatgtctgtcagtcagtttggtctgccataacaaaaatcccataaacttggtggcttaaacaacaacagtttatttatttattatattaattttttttttgagacagagtcttgctctgttgcccaagctggagtgcagtggtgtaatctcagctcactgcaacctcctactcctgggttcaggcgattttcctgcctcagcctcccaagtagctgggactacaggtgcatgccaccacgcc

SEQ ID NO: 113210 - DNA, 750 bp, Homo sapiens
gagtcttatagaaaccaaaaggatagttagaacagaagacaggaaaatgggacagaacgctgccaagaccacaactgaaaaaacatgcgggtgcccctgtatgcatctgccgatgtccacgcactgaatatcaggggtggtacgtgccacgtaaccacgcgcactgcagacacctgccctcctcaccagggcgtgcagctggggagaaagcaccctgtggttggttcatccatcccatgttctccactcagaccatttgtgattgatttgtgaaatttctaatgctggcattaatgcatctttgctttgtgaaaaagcgaagtctactgaagatgtgcatcacagggagagccccttctcagacatgctcagaagaggtgggatggtcattttgctggattcggggaagagtttcggtggccaggtctgcagcgggacacggggtacagagctcagatgatagtgccatgaccagctccaacggcaggtggacaaggaggttccaaggggccaagtgactggcctggggagctcacctcagattcggatgtgggacttactgtccccagagccatggtccttaaccaaaagtctggcagcctccctgggggtgaagccacgtgtccttgggagccagtttcgaccctcagatcacagagtgttaaagttagaagccattttcaagcgggtattattttgcgtctggatttcctccgtagagaggcgctgggcctgagccaagcgggcact

SEQ ID NO: 113211 - DNA, 381 bp, Homo sapiens
tggtgcccatttacagggtgccagtcacagatggaggccgggccgagtggcggagggtccagccaggttcaagcccagcttcttgccccttttcctctttttttttgtttgagacagagtctctctctgtcacccaggctggagtgcagtggcgcgatctcggctcactgcaagctcctgcctcagcctcccaagtagctgggactacaggcgcccgtcaccacgcccggctaattttttgtatttttagtagagacggggtttcagcgtgttagccaggatggtctcgatctcctgacctcgtgatccatctgcctcggcctcccaaagtgcagggattacaggcgtgagccaccgcggccggccttttttttttttttt

SEQ ID NO: 113212 - DNA, 371 bp, Homo sapiens
aggaacttttgaggttgatgacaatgtttagaatcatgacttcagtggttgttacctgatacacttaaaagtggcgaattttagtgtataaaaattttatccccagctactcaggaggctgaggcaggaggattacttgagcccagaagttagagaccaggctggacagtatagtgagaccctgtctcaaaaaaaggaaaaaaatgaataaaggcaattttaaaaattacacacaggctgggcatggtggctgatgcctgtaatcccagcactttgggaggccgaggtgggtggatcacttgaggttaggagttcgagaccagcctggccaacatggcaaaaccccatctctattaaaaatacaaagaatt

SEQ ID NO: 113213 - DNA, 407 bp, Homo sapiens
gagctgagcaggctgtggggacatcccgggcggaggcttgctggaggccagggtggctggaacacagggagccaaggggcaagaggtctgggatgtggctggatgggcatgaagagccttctgggtacctagaggtgctgggaaggagtttggatttaatcttggctgtcctgtgacagggattcggaggccatgggggagggctgagcagggagacaggagacaggcaagaggcgctgtgagaagcgtgggctgagtgacctgctccttggtgagtgagaagtcctagaactgagcaccatggcatgcacctgtagttccagcaacttgggatgctgaggtaggaggatcacttgagcccaggaggttgaaactagcctgggcaacatagcaagacctcatctcaa

SEQ ID NO: 113214 - DNA, 266 bp, Homo sapiens
tggctgacagagcgagatcctgtcaagggagactacggtgtgtgagcctggccaagtcaggcaatcctttgggagagagggcttagggcttcctgggatcagagattctccctgctggcctcagaagcagcagccaccgtgatctccacaggtgcaagactacaacttctgccaccaaccacgtgagcatagaggagggaccgcccccagccttccataagacgctagccctgggcaaccccttgaatgcaggctcaagacagacc

SEQ ID NO: 113215 - DNA, 249 bp, Homo sapiens
cacaatgaacgctatgtgagctcattgacacagctcaactcagggtgcaccaaagcttgtgaactccttcagtgaaaaacctgaaagcatttcacaaacccttaagctagagactcagacctggcgctattgtcacagagtggaagcagagtgcctttgaaagggcttgtcaacaaagcttttatcagcattagcaaatcacaaagatgtgggtcactaggtaaccactatcgccccaagattttaggt

SEQ ID NO: 113216 - DNA, 203 bp, Homo sapiens
ctccccggcagtcatcatttgagcccctttcttactgttaaggctgcagcggctatcttcagagcctgtcaggctatgagtaacttgagctatgcaacgtgaaaccagaaagcactagtaaagtacttgtgagttctagaaatttgactttttttttttttttttttttttttttttttttttttttttttatattttttttt

SEQ ID NO: 113217 - DNA, 237 bp, Homo sapiens
ctgctggatttcttacctattatgtttccttaccaattcatctacaatccttgaattggcctttccattgtgggagacagtaatagaggacacacttctcaacagctgagtgaattcacattagctacctgtgctgatcaaactagttcttcacttttaaatatgaatggaaaataaagatttactagatatttgaggaaaagcaacagcataaagcatactcaccaagatgactag

SEQ ID NO: 113218 - DNA, 434 bp, Homo sapiens
ggtggaggaaggagagaccagaccaggctgcagcgacagagtagagcaataacacagcatgccccagcacacaatgacatatctcctacaaggtccaacatgttctgcaacacctgagcatagctcaacactctacagaatgcctttacagggacctaggacactctgtctactcccagcactctctgctatcttctgacatggatctgggacctggaatattgccccgacagttgttaacattccctgacatggccaaaacacatatgacaaaccctaaatgacacaacatgctctgccatggacctgagatggtctgatatgacttctgtgtatcccagtgaagggtcctagataacatttaaatatgatgtcactaatgtcctaaacatggcccgggtataaccaagcctattcttcggcataattcaaat

SEQ ID NO: 113219 - DNA, 416 bp, Homo sapiens
tagacagagtttcattcttgttgcccaggctggagtgcaatggcttgattttggctcgctgcaacttctgcctcccaggttcaagtgattctcctacctcagcctgctgagtagctgggattacaggtgcccgccaccacactcagctaattttttttgtatttttagtaaagacagggtttcaccatgttagccaggcttgtctcgaactcctgatgtcaggtgatgcactcactttagcctcccaaagtgctgggatgacaggtgtggccatcactaaatgaacacttaccctgtccagggaggtttattgaggcagaatgctgggcagctcagtcacaaaggaccacaagtttcgactatgacatcatgttcaaacaatttataaataaaatcacaaagatttcctgagaaga

SEQ ID NO: 113220 - DNA, 610 bp, Homo sapiens
cagtgaaaatacaatgagaaggcagctgtctgcaagccaggaagaacccttaccaagaattgaatctgctggcacctttaacttggacttgccagcctgcagaactgtgaaaaacaaatgtcttttgtgatcaagtgccaagatgacttactagaagcagctagtatgctccactctcgtgaaaaggaaatagactggccagtaaacactagcacttcaactggatcttccaagaggacatgttgggattcagcaaggaagcaacagaagccatggagaacaaaaacagcaagacacaacagccacccacccaggattgagtggagtcaggggaggatccttaccacaaagaaatagtgactgagagagagccccatggccccatacttctgtcatggacctttgtaatcataggcacagcctgctgccatccatgtaagatgtgacttgctcctacttacctttcaccatgattttgaggcctccccagccacgtggaactccatatcaagaaggacatgtttgctgccccttccaccataagtgtatgtttcctggagcctccccagccatgcagaactgtcagtcaattaaaactattttgattcta

SEQ ID NO: 113221 - DNA, 510 bp, Homo sapiens
cagtgaaaatacaatgagaaggcagctgtctgcaagccaggaagaacccttaccaagaattgaatctgctggcacctttaacttggacttgccagcctgcagaactgtgaaaaacaaatgtcttttgtgatcaagtgccaagatgacttactagaagcagctagtatgctccactctcgtgaaaaggaaatagactggccagtaaacactagcacttcaactggatcttccaagaggacatgttgggattcagcaaggaagcaacagaagccatggagaacaaaaacagcaagacacaacagccacccacccaggattgagtggagtcaggggaggatccttaccacaaagaaatagtgactgagagagagccccatggccccatacttctgtcatggacctttgtaatcataggcacaggtgatccaccctgagtccctccccctggggccttcagactaacaaggagagctgcatagaatctgggcagagctccagatcaggcacatg

SEQ ID NO: 113222 - DNA, 367 bp, Homo sapiens
catgttgaccctgatgcactgcaaggtctttgatacaagggagagattatattttacccagtattctaactatatccagaaaatatgtagagacatagtcaagaaatttttcgcaactaattatttaaagaaaagcatttttgcccttaaaaaggttaaatcttcataatccaatgaacaaggacagcctataaccagctgtccggttgtaggttttgtttgcgagttcaaccgtcacttggttatttatttctatttaagaattatgcatgcgtttagaaattgctactatcagatggtacagtaatgatattttcctgggccaaaccaatagattttcacaatatatagttaattcagagagaca

SEQ ID NO: 113223 - DNA, 382 bp, Homo sapiens
taaaatatacttccctgcctttaatacacttttaaaagaacatgagactaaacataatattttcttgaaatcaattatagcaaaatcaacttgatttactaagctgtggagaaacactgcagatagccccaaatcaaaactaatgcaagggtcaactagccaggagtggtgaactttttggttttgtttttaaatatctattttaaagcaatgttagatttatagaacattgcaaagctagtacagagttcccatatactcctccatccttgttactaacattttacatagtatggtacatttgtttcaataaaccaatgttgaagcgctgttattaaccaaagtccacacctgagatttccttagttttattcaatgttct

SEQ ID NO: 113224 - DNA, 300 bp, Homo sapiens
gagctctgcccactgtcaaatcagcagtggcattagattctcttacattctcttaggagcgtgaagcctatttttaacggcgcaggtgaggaatctgttttacatgctccttttgagaatctaatgcctgatgatctaaggtggaacagtttcatcctgaaaccatccttgacccattgaaaaattgtcttccgtgaaaccagtccctggtgctaaaaaggttggggactactgctgtagttaacatgagtgcaaatatttcctcaaaaatccatggtggtggctcacgcctgttatccc

SEQ ID NO: 113225 - DNA, 116 bp, Homo sapiens
agtcatggctcactgtagcctcgacatcctacctcaacttccgcagtagctgagactacaggcacgcaccaccactaactaacgcacctggctaacttttgaaaattttgtgtaga

SEQ ID NO: 113226 - DNA, 469 bp, Homo sapiens
atcacgccattgcactccagcttgggtgacgagagcaacactccatttcaaaaaagtgtacttgattttgaacaaactgtacataaagtgtacaatatgataaatattgccacgtttcaccaccacaatcatgataacatatccaccacccgccgaagtgtcctgtttcctcctgaccctccctcacaccatcccaggcagccattgatctctctgtcactataagtttgcattttctaaaatgttatataaatggaatcctacagtatgtgctcttttattggttggaggggctggcttctttcactcagatcaattactttgacattcatctgtgttgtcacatgtatgaatggttcattcctttgtgttgctgagtagtggtgtatggatataccacagttcatctgttgatggacacgagttatttctagtcgttcatcattacaaataaagctgctttgcacaa

SEQ ID NO: 113227 - DNA, 726 bp, Homo sapiens
gtttatcattaaattttttaatgtaattttagtgtattttagttttaaaatgtccagattttgatgtttaactttgcctttaatcaggtaagatttttttatgttattacttataaaagaattaggcttaataagtttatccagtattaaatgaatttaatatgtgtgtatatgactcttttaaaattatttcgtgaaatgtgaagttggatggttattagtttattagatgtgtcagtttttgaattagttcttatatttatgccaaatgatccaagggaaagatttttagtactattttagtttttcttgtctaaactatgttacacatgttaaagtagagaaaattctccatttgcaattttattgaatagttttttacataaggttttcatgttaagttgattttggtctgagatttcatcctaattaatactaatagttcaagaaaatatttattttttaatttgagacagggtcttgctctgccgcctaggctggagtgaagtggcgtgatcatagctcactgcagccttgagctcctggggccaagtgatcctcttgccttaggttcctgagtaggtaggaatacaggagcttgtcaccatgcctagttcttttaaaattttttgtagagacagggtctcactatattacccaggctggtctccaactcctcacctagttatcctcccaccctcgcctcccaaagtgctgagattacag

SEQ ID NO: 113228 - DNA, 599 bp, Homo sapiens
aacattttcccacaaagagagtgtgatggttaattttatgcatcaacttcactgggtcacagggtgcccaggcatttggtcgaacattcttctggatgtgctggtgaggatgtttctaggtgacaggaatatttgaatcagtagactgaggaaagcagatggcccctctatgtgactggccctcatccaatcaactgaagacttgaataggaccaaaagactaagagggaattcctcctgcctgtcggtctgagctgagacatcagtcttgttctgcctttggactaaaaagttggctcttcttgggtctcaaacctgcaggctttcagactggaactctgattggatcttctggtactcagaccttcagactcaaactagaactacaccattgactctcttaggtttctagcttgccagccacagatcctaggacttctcagcctctataattgtgtgagtcatttccttataagaaatctcttcccaaatagatagatacctcgatatctcaatatctagatagatagatagatagatagttagatagatagatagatagatagatagatagatagatagatagatagatagataga

SEQ ID NO: 113229 - DNA, 610 bp, Homo sapiens
tggcccgttaaggagtgggagaaggtgaggttggagtgttgggtggtaggacagtgaggaaagtcttcttggtttgaatcatgatatatgtattaggtttaatcaagatctttttcactttcgagtgtttttcttcattttcaatatagaaatatttgtgaattgtaaatgctgtatgtattcgcatcttggaaactttcagaaaaatctgaagatacaggacagtaaaagggcaagtaaatattttttcagtaaatatttctcagaacttactgtgtgcctagtgatgttttaggtgctggggcctgagtagtgaataagtcagaagatccttgttcacgtggaccttacattctgtgactgcagtagagaccacatctgacatttaagtaccgtagaaggagaaatgatatctttttgccattaaaagtaatggcaaaaactgcagttacttttgcaccaacctaatcattttttgagcaggaaaataaagtgacaagagattaatatgctgcattatttggaggaaatagaacccacaaatttgaaggccactttcagaaatctaggtttgaggtaaataagtgccttgctgagagtgtaagcagta

SEQ ID NO: 113230 - DNA, 723 bp, Homo sapiens
tggattgggactccaaagacctaggtttgagtcctgtctgtcctatcactagccattggacacagatgcttctggctcccatcccttcctggttgctctctgagaggtctggtacctggctggaactgggccacttaggtcaaggacccatggtaggttctgctcctcactgtcaggggcattagccttttgatactaattttcttttctgcaaagtaggcataatcatattacaaaaggatattgtgagaattaagtatgaattaatatactcaacaaatatttgtcaggcacctactccatgccagccacagttctgggccctggggatatcgcagcaaagataacagcaaagatgacatgtgcttgcagggtcctagcggaacatcaggcatatagcctgtgcttgggaggtagtcagagtcactggctttagacagacatttaaggccctcatgctgaggccctgtttcttcctctaagtctctgtgctttcgccatccctcttcctgctgctgcctggcgcaggcagcctcctgcaccttcccccatgcccaagagcagacatctcccctttctcactgggaggatactgctgcctcccctgagctcaggtgggcaaagtgatggcagcatcggtgtcttcgccatcagctccatccaagtattcagggaatttgtccttagatgtctcctgggacatttaaagcaattaagggatga

SEQ ID NO: 113231 - DNA, 544 bp, Homo sapiens
gaagggttttttaaaaatctttgggccactactcctaactcgtaacataaggagaccagactatatcatctcagaggtccttccagctccactattctgtctctggacctgataaattctcttaaaatatttcagaatttatcatcactgcttttttcattgatgtaaccataaatacaaaacaaaaatgctataaataaaaatagtttaaccaatttaaagtgattatagctaaaatcactatctaagaaggaaagttgatcatttctcttgttaatcacatcaaacccagtagtcccattgacaattacaaatttttcaaagattacttcccagcattctcacagtaggtgtaaagccaacatgctgctgtgaagccattatctgtgaagattttgatcttagcattctgagatatttactaaattaatgggaagttggttaaaattccctccttttcagattatatatgggacttctaaaatgaaacatgtcttttagggagaaaattatccctttaattttagcatattttaaaaatagg

SEQ ID NO: 113232 - DNA, 345 bp, Homo sapiens
gttagccaagatggtctcgatctcctgacctcatgatccacccacttcggcctcccaaagtgttgggattacaggcctgagccaacactcctggcctccttcttttttataaggatgtgtgcctcttcacatagagtgctgtgtaggacttgaacttctatctcatgaatgtctcatgttggcggaggtcatgcagcatgattctcattgcttttaagtgatggataattgagtgattaataattgatttcactgcattctgtgttttttgcaccttttaaaaaaaatcgcttaagctagggtttttgtttctgttttttaaatgctaccccaagtttggttgtg

SEQ ID NO: 113233 - DNA, 449 bp, Homo sapiens
caaaagatacctccccaccacaataaaaagcactgatttgtatcatttgccaatttgtatcaattgtatcggttcccaccaatgaacatggagttgggacaaaatgcatacaattggctcttgagagccagtgcaattgagacccaggacaccactggaatttacccagttactgaaaccagaaccctgggaaacatccttgattcttaaacctttcctacccctcgctatagacagacccacatcctcacacctctaccagttcctacttactcatacatggagagacccagatcctaacacctgtaccacagcctaccttctaagacactgacagactcagatcctcataatcctaatgggtcagatcctaccttctcagacaaggacagacccagatacccataccagggcaagatcctatctcctcagggtgggagcatctggtg

SEQ ID NO: 113234 - DNA, 633 bp, Homo sapiens
aaaagcctcagggtccaggcacaggcagggctatcacagaaagcccctagtagggtaacacccagcagatccatggggtcaggctcagggtcactgcagagtccccattggggcaatgctcaggggagctatagggttggggatgccgaaaagaacttccactagggcaaatatccagtaaagctgtgtgggcaggactacttccaagaccctggaccagcagagccaccagcatgtaatttcagcccaggagagctgcaggagtaccactgcaatgccatgaaagctgctgtgtgggctgtgcccagcaaagctagggggcaggactgttctgagctttgcggacccaacttccaccccagtatatccagaaagcagacatagagtcaaagatcattctcaagcctcaagatttaatgttctttgccttggtgagatttgtacttacttgccacctgtttccatttcttccttcctatttcccccttttgaaatgggaacatctattctatgcctgtcctaccgttgcattttggaagcaaaaacttgtttgatttcacagattcacaggtggaaagcaatttgtctcaggataaatcataccttgagtctcatccatatctgatttaaatg

SEQ ID NO: 113235 - DNA, 526 bp, Homo sapiens
aaaagaaaaaaagaataatcatacatcagtgcaaaaaaacacagcagaggtgaagaatattgttggtcatagccagagtatatcagtagtcattaaaaaaccaaaaaggtaaattgagacaaagaaagaaaaacaaaacttgaagctttagaactgcatgtcctttctctttcagaaaagggagaaaggggctggaatacaaggaagggagtctatgcgtgtcagaaatgctttggcctggccgggtgcagtggctcacgtctgtaatcccagcattttgggaggccgaggaaggccgatcacgaggtcaggagattgagaccatcctggctaacatggtgaaaccccatatctacttaaaaaaaaaaaaaaaaaattagcctgcgtggtggtgggcgcctgtagtcccagctactcgggaggctgagtcaggagaatggtgtgaacccaggaggcggagcttgcagtgagcggagatcatgccactgcactccagcctgggcgacagagcaagactctgtctcaa

SEQ ID NO: 113236 - DNA, 406 bp, Homo sapiens
ttggatggttactccactccacccgacggggtgggactcgggagaagagtacagaacataaaaggccctcttcctctctcaggaaaggacaccaagtcatctagtgcaagttcactttacacttcagatataatctcttggccaggagcggtggctcatgcccgtaatccctgtaatcccagcactttgggaggccgaggtggacagatcacgaggtcaagagatcgagaccatcccggccaacatagtgaaaccctgtctctactaaaaacacaaaaattagctgggtgtggtggcacgtgcctgtagtctcagctacttgggaggctgaggcaggagaatcgcttggacctgggaggcggaggttgcagtgagctgagatacgtgccactgcattgtagcctgg

SEQ ID NO: 113237 - DNA, 319 bp, Homo sapiens
gatgtggaaatattactgcatatacaccacatatgtgcagaatttaaaggttaaacatttctatctcctattaaaatgttatgtaattaaatgctgaaatttaaaaagctgatttttgtttaaaatacacatgttctaaatttagaaattctaaaataaaatgttactacctcattagtatttttcaatttaaattaattttttggtgctttttagcttttaggttcagggatacatgtttaagtttgttacatatgtgactttcaaactctaacttcaggaagtcattacttccagtaggttatgttctggtcattca

SEQ ID NO: 113238 - DNA, 465 bp, Homo sapiens
gctctctcctttcagtacagggctccagtgccctccacagaactccacacccagcccagcaagcccctccataatgggtgctgagagtggcaggcatggggctcttgttacatcagagccccaggaaacaggcggtcacagactattctgagtgggcagaggaggtccacctatggacacacgtttagagaagctgaggagttcatccctgaagacatccagcccgtgagtagtagaggtgggtttggagctaggagttgaacccagacctaaccgcagagaccacagtctcagctgtcaggttctactgcctgacgatcatacaacctgctgctgggttgatggtgctgaccctttaggtagcccttccaggccatgccaggcatcattgtgccttgtcacaatcattgagaccctgtatggtggctccgagacctccctgtcacatgggaaaaagtgctgatg

SEQ ID NO: 113239 - DNA, 614 bp, Homo sapiens
gagaagagttacgcagtattcagtgatggtctgtaagtatgtgtgtattagctatagtcatttagctgacatagttggaactagaactcaggtttctagattccttatattgtttttcctgaccaaataatacctacttttttctgggaaccttcgcataggaaagcactgaggattttttcctagacctgtggttcttaaaagtgtagtatccagacaggcagcatcagcatcacctgggaacttgctagaaatgcaaattattgggtccaaccctagacctgtggaatctaaggtggtgggacctttggtgatagggctagatgcatattgaagtttaggagccactgctgtagattgtaacttcaggcctcctcccagcgtcacggaatgctgtcctgatccctagcatttactcacatgctgtgcttagtgcttgaccatgtggtggcagattctgtgatgtgtaagacgtggttgccacccttagagattctggagtctagaagccaaggaggcattattctctgactctgataaagctttattgacttgagtcattttacctttccatttcttgttcctttgtaatggggaatcaaattatatatgtt

SEQ ID NO: 113240 - DNA, 676 bp, Homo sapiens
atcaggctgcactctggcccacatcctggctgctgtgtatcacgtggctctagacactgcacttttgcctcctcatcattgctgtagataggatttctgacagcagggtcattagacgaatttttttttttttttgagacggagtctcgctctgtcgcccaggctggagggcagtggcgcaatctctgctcactgcaagctccgcctcccgggttcacacaattctcctgcctcagcctcccgaatagctgggactacaggtgcctgcaaccatgcctggctaattttttttgtatttttagtagagacgcggtttcaccatgttagccaggatggtctcgatctcctgacctcgtgatcctcccgcctaggcctcccaaagtgctgggattacaggcgtgagccaccgcgcccggccccattagacaaatttgtatctgcacggttcctacagataaactctgggacattagaattataaggcttttgtttaaggatggtttcagatgtttttcagaccttgaattccagccaaatagctgacactaaccagtttgaagaccccagtgaggaatgggatcagcatgagaacactgcgtcttcatgcccctgtctccgccagcagtcagcatggccacactctggcccacaccaaaacacttaaaaaccctagccc

SEQ ID NO: 113241 - DNA, 563 bp, Homo sapiens
aaaaaaatccacaaaggtgcccactacatattatacataatagtaaaaatgggaacaaactcaatgcccctaaataaggaagctgataagtaaatctattaattcatattttcaacaaatatttataaattgctccatttctgagttctctgctatatcagctcaataaaatatcttgtagtcagtaaaatcatcaataataaaatatgtaacataagaagtgaaatgaaattcataaaaatacacttttgccatgattataatgatgccaaaattaaatatttttatttgcagtgtttgggaacatggacaaatcaaaattgctcatttattaagatggtgaattctagattattttcttctccactacttgttattcattattacattatttgaaatgaagaaaaatcttattaaacatgtaaaaacgccaggcatggttgctcacgcctgtaatcccagcactttcggaggccaaggcgggtggatcatctgaagtcaggagtttgagaccagcctggaagacgtggtgaaaccccgtctctactaaaaatacaaaaatt

SEQ ID NO: 113242 - DNA, 392 bp, Homo sapiens
actggaaaggcaaagtgaaatatcccatattcctgcaatgtttaggaaagacctattagagggagacctacctagtatatcaaacatgactggttttccattcaagataaatgtcagattttgatactgtatagggtaagaagttaactgctgaggagatggagaactttcatattttctatctgaatatagagagacacactcaaggaactgggaaaaccaaaccagttagttgtgaacttaaaattgcaactaggtctcaatccattttttttttttttcaagacagagtctcgctctgtcgcccagtctggagtgcagtggcacagtcttggctcactacaagctccacctcccaggttcacaccattcttctgcctcagcctcccaag

SEQ ID NO: 113243 - DNA, 299 bp, Homo sapiens
aattactgagtcatacccattctcccacaacagcatctcctgaagctgttctcttttgtccccaatgccactaccctcactcaggccaacatcaactctttgatgagccaccatgcagcttcgtgatcattttcctgttttaattcctgtgcctctttccagtacattcttcacatttcagccagagtgatttgagcaattatgtcaatctctctgaaccaggagcccccgtcccttaggataaagtcccaactccttagggtgacatttaagacccttcccccatgccaataagatgg

SEQ ID NO: 113244 - DNA, 248 bp, Homo sapiens
caaaagtatgtgtgccggggaatgactgagtccccctggaattttcaactcaagacttgtccacactgtgcagttaagttaattacagttcaggtttccctagcctgtcagttttccctggaggcctctgtctgagggtctcggctccagttacttgtgcttctctgcctttgcctgccggtcactccaatttcaggggccatgatagtttgccctgtggcttcactgttcttaactaagaattgatt

SEQ ID NO: 113245 - DNA, 439 bp, Homo sapiens
atcagaagttggcatttaagacactcctggttgctcaagtaaatgatttgattttagtttggaacgaggctgaccctgaaaggcacctggaagcccaggttaattttatggcccttctagttcccttctctttgcttatgccattctgtaatgtgagatgggtgatagtttaaagttagctctggatcaaaccatgctctttgggagcaaggccagaaagggacatttaggccaagcacctgcataattagcttactattggactgtgtgttttctcttctccagcagctacttttgctccagatgacacactacctcattcttaaggtgacgaagcctggctagggacagctgtatagttctctcaaaacctcactgtggtatcattcctcatcactaacctcttcctccaccttttaaagtagacctttatgtttag

SEQ ID NO: 113246 - DNA, 473 bp, Homo sapiens
aggtctcacttccttgctcgctgtctccacccgctcaacgcctcctgcatgcttcatcacatagccaccttctccatcaaacaagcttctgatctctctgacttcctgtctgccccatttcctctgcctccagcaggagaaagttctctgcttctgaaggttcatgtaattagattgggcccacctggttaatccaggttactctctctgtacagtcccttttgctgtgaaaagttacctgttcaccagcttcaggggttaacaggtggacatctttgggggccattttgcttatcagaagtgggtactagagtttcccattcaatccggagtcatggagtgaagcagagcacaggggagcaaatccagtcctagccaggtcagacaccgtctattttgcctggtctctgacccatcaggtaacaggcataggcttctgacttcaagttgcctggttcacaactggtatcttt

SEQ ID NO: 113247 - DNA, 120 bp, Homo sapiens
tgtgtgcacgccagtgtgtgtgtgtctaagtgtgaatgtgtgtgcctgagggtgtgtataagggtgagtgagtgtatgtgaatgtgtgtgacagtgtgtgggtatgtaggtgattgtggg

SEQ ID NO: 113248 - DNA, 199 bp, Homo sapiens
gaacaaaatgaaagaactagaacttttatgttcaatgaaggaagtctcctttgatgggaatgatcttgaaaacatggtcctatcactgagggagaagttcctacaagaagtgaattctcttattcagaaaccctcacacccactggctaaaacaaagacgttagtgaagagtttaatgaaccgagccgagctgttgctg

SEQ ID NO: 113249 - DNA, 380 bp, Homo sapiens
gagaaaattcttatgtggaaaaaaaatctctataggttaatttttgagataaatatctagtaaataccaaacggtaatcaaaagaaaaaaatttctcaacctccaagttgtaatccactttcttccctgctctgtcctctaaacccctagttggtttgtcatattttctctttcacactgctttcttctctggagtggtatagctaataataaatctgggaggggatttcagccttctaaaactagatccctacaaaaataacttatgctatcttacgtaaataacttatgaatatctataatttgtgagaaacaataagcaaatagttttaagttttacagttataaaattctacctacaaacttattcaaaaaaaaaa

SEQ ID NO: 113250 - DNA, 513 bp, Homo sapiens
aagtgctaaggatttttaaagctatttcttcagaaagaatcaaagtgaaaaccaccacaaagaccctactaaaataaaaataacagataacacttctccaagccataccatgatttcaagatactattaatcaaaatcaacatttctatgactcagtattctcaactataaatgacaaccttttacaaattatttctagccctaaaattctatgacttaattctgtgtcttttttagggtttcaatatgtgtaaaatactgttacatagaagtagacactgtaggaatgaattcaacatagactcagaagtataagatgcaggcctctgctctcagtaaatttccaaatgaagactaggaaatgagagaaataacttaagagtttagaaatcttagaagacaatgcaaagtataacagcttttatactcaaagctgcaacaatttcaaaacctgacatacaagtgtgctggcttggtctggaaagttaaatgtggcttattcttctatgctgt

SEQ ID NO: 113251 - DNA, 363 bp, Homo sapiens
tattattaatcaatttcactttctctgctgaaaacaagtcagggaagcccatagataaacttttacagtgtggtgaacataaacaacacaacacaggagacctggattatcagccaggtgctgtgtgacctcaacctctctgtttctcagctttctgttctttgaacaaagagttttcaactagatgttctcagatgtcaaatctacccttaacagttgtgtggtttgctatccaggcataaattctcttcatttttaagggcaatttcgcagtttctctaattgcataagtattgatgaaagcatgcaagtttttatcactttttatcatttgtggaggattgaaaaagaaaataaactccc

SEQ ID NO: 113252 - DNA, 132 bp, Homo sapiens
agcattccttctaaccaactcaagtgtgggccagacaatcccacctatggctatttcctcagggccaactgtatttttcctactgaatggcaacaacttttcttatgttaaagagtgactaaggcagtccta

SEQ ID NO: 113253 - DNA, 160 bp, Homo sapiens
cttaaataccaggtttttaaaatttagcttacttttaacatatatgtacctgatcattgtattcagagagcttctcataaatcttacggtataaaaagtaatacatttcttttcaaaatagaaataaattttataataaattaactttttgcataattct

SEQ ID NO: 113254 - DNA, 297 bp, Homo sapiens
gctttagtgtaggcagtgtgaagacctcacctgggtgtgccaccaatggaggctgcaggccccggctccagtgaaggctggtgctgctgctgccctgtccaggacggctctgcatcttcctcccagaagcccagactcccctgtgggctgcccacctggctgcagctcctgaatgtctggtaggcatcacacccttcatggatgcacctgcaaagaaactgcactgtgcttgcccgggggtcccccgtctgactggtgactgcaccatttgctcaaataaaatcctcagggtcacct

SEQ ID NO: 113255 - DNA, 328 bp, Homo sapiens
ggaataacggggagccccccctacacgcggcacacccgccccgccccccgagaacactcacctgggtgtgccaccaatggaggctgcaggccccggctccagtgaaggctggtgctgctgctgccctgtccaggacggctctgcatcttcctcccagaagcccagactcccctgtgggctgcccacctggctgcagctcctgaatgtctggtaggcatcacacccttcatggatgcacctgcaaagaaactgcactgtgcttgcccgggggtcccccgtctgactggtgactgcaccatttgctcaaataaaatcctcagggtcacct

SEQ ID NO: 113256 - DNA, 285 bp, Homo sapiens
cactgatcttcctcaggtgggtaggtttgtgagctagaggaggcttgggtcctgaatccactctcctatcacctttgggcagcctggataaagaggaaagaagtcttggctgctgggcagagccgggtttctctcccattcccgaggaggcctgagcagctggacacgcagagagcggaagatgggcagtgatgacaccaaatataagcataaaaagacgttttaaaactacagatcctgaaacccagcacggcaggcacctgcagcttccagtgctgtaacagg

SEQ ID NO: 113257 - DNA, 190 bp, Homo sapiens
caactgattctggactgggtgcattatgttaatgacaagtttaaggagggtgattaattaaagcaaccctccacaaacccgtctgatgtctggtggtgtggctcccactgatggccactgggacccctgtcacatttgcaataggccacatgtgaactattaatctggagggataggctcacaatactca

SEQ ID NO: 113258 - DNA, 599 bp, Homo sapiens
ggaaatagttacacagtaaaatatttgtaaataccacctcttggtgttttgaattctctcaaggatactcttttcccaaaaaatgatggcttcagccgctgattgacaagccttctcaaaatatttcctgaacacagctacattctttccatactttctttttgctctattttaatttttgctatctcagcagcttaacaaaagtttacctgcaaattgatcacaaaaatttaaaaattttaactattacactccaataagtgtaacaaatactctcttcacatccaggctcaacattaatgctctgtccaagtacattacatttacttcatctttagttttatctcactcactgtatttgtaggactcactcaaaagtcataaacaaatgtcaacataaataaaaataatgtgcagaatggtagagtatcccattattaaaatttctaggttgtttttgatataccaaagattaagactttagaagactgttggggaaaccacccccacaccacccagcaggtaccctgagtctagcggcgacaaagctgatagaaagagagagaccgaataagtgttgaaaaggcaggtccggggga

SEQ ID NO: 113259 - DNA, 326 bp, Homo sapiens
gatcatgcctttctagcacaaattgtatttgaagataatcaaatagttgatgagagaaagtcattaattatggagaaatcacaactaatacatgcaaaaggaatgaattagaaaatgagcgttataaaactcctgatgagacagcagagcaaaacagtcatcatcagtggtcgctaaatccatcaagtaacaggttgatggaaaactttctcatggacgaggctgacttgaatggaggaaatatggaaatgaatagagaaataaagcagtttgatacctttatcctattgagatgtgcctgagctggaaaatttgcaacaacaaaa

SEQ ID NO: 113260 - DNA, 647 bp, Homo sapiens
ccactgcctctatttgtgcctgcagttctaccattagtaaatacttctttccttttctttctgaagttctttaagaaattgagagctcatgggttgggtgcagtaagttcccagcattttgatgtgagcctgtttggcacactggagagagatcttaagctgaacaggcataggtaggagctaaggaactcagatagtctggggtcagtgtgctcattcctcacaatctgctcatttagtgaggcctccaaaagaataggggaggaggccaattagattcttcttcccctgaagtccttgggtaaagcctgtggttaaaagactttgtcctagtgaatgagcctagaaaattgacttagacaaagggaggtgcaggacagttctgaaagattctattctaccttacttacatcatagcccaaatcaattccagatggcattaatgtgaaaggcaaaaccttaaacattttagaagaaaatatagaagaataaccatatgacccagaggtaggaaatgatttattaaatgagactcataaagtacttgatgtaaaatagataaattcaaccacatcaaaattagaattaatttctgttctcaaaaggcacaattaaaaaaagatgaacctcaaattcctcaaattggg

SEQ ID NO: 113261 - DNA, 105 bp, Homo sapiens
ccagtcaagtgactctcacctgcagcctgtcttgaaaaatgcagtcacctccctccgaccttgaatctacatgaacgctttaaagtgtgttttcacctttcaatt

SEQ ID NO: 113262 - DNA, 345 bp, Homo sapiens
  misc_feature (276)..(276): n is a, c, g, or t
tccctcaaagaataatggaaattgggtgctggccacagctatcacttcttaagtgttcccttcccagaatgagtcatagcaagtgtgagtcccgtgaaaatctaattcttcctcaatattattgcttttatacacagaaaacaattcaacaggcccaagttagagattggacagataacacttgaccttgggatatgatgatggtctggatcgtgcagagggtaagactgagattgtcgaggtgagattactagaaggtttttagcaacatggggnaaagacaaagaaggagagagagaaagaaaagaaaggaataaagggggaaggaaggaaagaaaggaaagg

SEQ ID NO: 113263 - DNA, 346 bp, Homo sapiens
gagtacatttgggaggggatcccaggaagccccagctggggagtgggaagctgggcaggaaagggaaggcgcccttcagggagtgttaatgagcaggtggctgcctgggcactagagctcaaacccagtggaccttggagaaaccgtgtggaacactcctcactcgtgtcccaccaaagttgagaagccagctgggccatcgggctccagctccatttgctcctacaggtgttacctccccggcaccttggcctgactgtgtgtgggctgagcaggctcctgcagccagagaaagccttcaggccagcagacacagatgcttacggtacaaagatgaaggtgaagg

SEQ ID NO: 113264 - DNA, 281 bp, Homo sapiens
aggattacaggcgtgagccacggcgtctggcctcccctaggctctttacagaggctcctggcaggtctgaattcttcttaaactcaagctgggagcatcgctccatgtataacagtgataaagtggcaaatcaaaatgtctaacagtaagggattcgtgatatatcttatggtatatacatacagtggcgtaattggcagccattggtatttgaatactaaatgaaataggagaaaatgttcataataaatagttttgatttttttttttttttttttttt

SEQ ID NO: 113265 - DNA, 1003 bp, Homo sapiens
gagaaaggtatgttagaatctctcactgtgattgtggatttattattcttataattctgtcaaattttgctttatttattttgagaccatattgttagaagagtcaaacttttgaattagtatatctccctgtaggttgaatctattattatgatgaagtgatcatctttgacacagggtcttgctgtgttgcccaggctggggtgcagtggtgtgaccacggctcgctgcagcattgacctcctgggctcaggtgatcctcccacctcagcctccctaggagctgggactacaggcatgcatcaccatgctgggttaattcttttatgttttgtagagttctcactatgttgcccaggctggtctcaaactcccgggctcaagtgttcctcctgcctcagcctcccaaaggtttaggattgcaggcatgagccactaaaaaaatctcttgtcatgctttatgacccaaagtctaatttgtagatattaacaaggctacattagctttctgggattacaggagtcaagtcctgccttctaggcgaggatgcatgtcaagagccccagtggatgccccaaactgtggataagctccagtggatgcctgaaactgtggatagcatcaagccttatatatactaggtttaagtgacgagtgggtggacagtgtgtggagtatggagaagctggataaaggcacaattcacatctcaggcaggactaggcaggatgctgtgagatttcatctcaatacgcagaatggcatgtaatttaaaacttatgaattgttcatttctggaattttccatttattatttttggagtatggttgaccatgagtaactgaaactgtggaaagcaaaactgcagatacggaaggactccagtatttttcctgtgatgcgtctttctctgtaactttactttcaacctttctgtttcattatgttttagatatttcttcattttacattttttgtatttttttcatgacgcatcactc

SEQ ID NO: 113266 - DNA, 307 bp, Homo sapiens
caggggacaagtctgtacagcagccacacccctgccagagccaggagctcttccatttccacagcaggccaactctcacctggaagcacccacctaaccaaacccaatccctgccttcttttagtcacactgggaactgccacaggaaggctggggactccacatactccctcctcaccacaccccatgtgtgatcacccttaaacagaaaacatgcacctaagatcctacgatgcgctgcccacctcacaaaaaaccggtgcctctaggtaagaggcacctagctgacccatccctgttccctctc

SEQ ID NO: 113267 - DNA, 425 bp, Homo sapiens
gatgttcctggtccctggcagaggacaggcagagtgactgctggcagggccaggctggactgactgtgagccacaggttctaaggagatggctactaggttggtgactctcttacaggtgggccccagtcttaatactgggatctacagacattgggtacagagtttctagagtggtttctggccacagcctgtctggagcaaggaggcttcaaatggctcttgccaaagcttgaggagcagggatttctgctttaactagaagccatggtcctagacagttgagttgcagattggtgacaagggccaggtgctcaggtgtgagtgtttcctcacccagagcttttattcacctgccataggagcagatgtgatacacaagctttcccccaatgaatcctcatttgttctgccatcagaacaacc

SEQ ID NO: 113268 - DNA, 289 bp, Homo sapiens
cagcatggggcagggtcatggctgagggccagggaaggtctgggggagtgacagcttccagctttggcctggtctgccttgctgcaggacccaggatgcacacaggaactcctgggggtcttgtcaaaatgcaggctctggctcagctggtctgggggacccagcacctggggtggctgaggctctggtccttcccagaccatgctttgagatgtgaggagtgtgggaagggccttttgcacaagccaggagaggcttccccagagcaagacccccagtatccacatga

SEQ ID NO: 113269 - DNA, 375 bp, Homo sapiens
aacagaagacaaagcttgtccgagaagttctcgaaggctgtacttcaaagtgagagtgacctagaaataaacccccttggggactatgaggaaaattacctgtctgaaacgttggcacggagcagccctcagactggttttcagcctgactttaccctatctgggtagtccaaaagcccctaagtcaacctttagtttaaagtgatggaaactggaggttccctagtgcttcacagaagcaaacacgagccttttctgaggaagcccattttcaccacaagcttcagtgatatccacagataaagctccaagtgatatgagtagctcacagccaaaaatctctaaacacatgacacaagacaccatgagggagaa

SEQ ID NO: 113270 - DNA, 721 bp, Homo sapiens
  misc_feature (28)..(29): n is a, c, g, or t
  misc_feature (38)..(38): n is a, c, g, or t
agaacccaacaaactggtatctttcagnngatgctcanggaaacaagagaccagagcaggagtggttcatggggccattggagaagctggtgttacagccctgctcgctctttgtctctgcctcatcttcttcatagtgaagacccacaggaggaaagcagccaggacagcagtgggcaggaatgacacccaccctaccacagggtcagcctccccgaaacaccagaagaagtccaagttacatggccccactgaaacctcaagctgttcaggtgccgcccctactgtggagatggatgaggagctgcattatgcttccctcaactttcatgggatgaatccttccaaggacacctccaccgaatactcagaggtcaggacccagtgaggaacccacaagagcatcaggctcagctagaagatccacatcctctacaggtcggggaccaaaggctgattcttggagatttaacaccccacaggcaatgggtttatagacattatgtgagtttcctgctatattaacatcatcttagactttgcaagcagagagtcgtggaatcaaatctgtgctctttcatttgctaagtgtatgatgtcacacaagctccttaaccttccatgtctccattttcttctctgtgaagtaggtataagaagtcctatctcatagggatgctgtgagcattaaataaaggtacacatggaaaacaccaaaaat

SEQ ID NO: 113271 - DNA, 772 bp, Homo sapiens
ataatagatgccaaagatgatgtcagtgtagctgcccagaatttttccacattagtctctgtgagtattcaagagaattgcgaatcaatcaatacgtgctacatgtgttagataatgaataagtagagccttaattaattaacatttgatgaaagaatgaaagagtgaataaatgttctgtcagagtcaaatttacttcattgaccctctttgccttctcctggtccccctcctcactgccctgctctaacccccttctttcctctccataagaaacaccagaagaagtccaagttacatggccccactgaaacctcaagctgttcaggtgccgcccctactgtggagatggatgaggagctgcattatgcttccctcaactttcatgggatgaatccttccaaggacacctccaccgaatactcagaggtcaggacccagtgaggaacccacaagagcatcaggctcagctagaagatccacatcctctacaggtcggggaccaaaggctgattcttggagatttaacaccccacaggcaatgggtttatagacattatgtgagtttcctgctatattaacatcatcttagactttgcaagcagagagtcgtggaatcaaatctgtgctctttcatttgctaagtgtatgatgtcacacaagctccttaaccttccatgtctccattttcttctctgtgaagtaggtataagaagtcctatctcatagggatgctgtgagcattaaataaaggtacacatggaaaacacca

SEQ ID NO: 113272 - DNA, 297 bp, Homo sapiens
aggagcgagccatggtgcccgacctcctcttttttcttttgagcacccttagcttctggtacaaagatgttttaggcttatcctgaaactttgactgcttcaggcctggaatcagccatttctctgaggactcctggttttggttccactattctcctgccttaacctcctgagtagctgggactataggcccatcatgcccagctaattttttttgtatttttagtagcaacagcctggtctcgaactgctgagctcaggcagtctgcccaccttggcctcccaaagtgctaggag

SEQ ID NO: 113273 - DNA, 615 bp, Homo sapiens
cacccaccctcccacacaatccttaggaaatggcatgggctcttttacagtcctcagctggaaggatctttgccaggccatcccgttcattcccctgtttcacaggcatccaagtaagataaaaattccacctatttcaaaacagcttaaacagaaacttttctgtcatttatctccttcactccttcatgtctttgtcccattctggtttcttccaggaattccttccttgagtggaaatgaagtcttccttgagtttcccagggcagttcaagccctttccctattaaaaatgaagcacggtggctcacagggacagacagctcttcctgggctgacgtgagaccgctgtgcattcatgtgggcccctgcaccccccacttccaaaagtcattccacagcttctcatcgtttcttagtaaggccttcctttggaacaagtcatctttctgctgttccaaatgcaatttggagtaaaactcccctggggaccactgaggtctgtgaagaatgagtggcagtcgcagttccagggtgttgcagctggcccagaggatggtgctcgggaggcaccagttctctgccattccaaacccaaagccctgccttgctctg

SEQ ID NO: 113274 - DNA, 342 bp, Homo sapiens
caggtaatcagcacagtacctgatgtttttcagtcttcaccctcctcccattctccaccctctacattttcctttaaaaaaaagttttcctcccagcactttgggaggctgaggcgggcagatcacgaggtcaggagttcgagatcaccctgactaacatggtgaaaccctgtctctactaaaaatacaaaaattagccaggtgtggtggcggacgccttaatcccagctactcaggaggctgaggcaggagaatcgcttgaacccagggagcagaggttgcagtgagccgagatcgcgccattgcactccagcctgggcgacagagcaagactccctctca

SEQ ID NO: 113275 - DNA, 477 bp, Homo sapiens
aggacattttcctcccccaagctgcttgtcctcgcttttaaatagtagctcctccgtgaataaaggcagaaacatgtggttatagggaagaacaaaggaagataacatctctcacattataatggcaaacaatgatttgaaaatatcggtacaccagctttatccgtaaagcagtttatgtgagtgataactggtagataaatatggaaaagtagccgaacacacttgacacctctctgagcttgctttgtgatatgtgggcagctagaaaaagcagctaattattaggtggctcctttaacatttcctgatggggagcctgtgagcagaaaagagcgggtgcagccctggacagtggtcatgcacggttagcgcgaaacccactgagctgcagacacccgggtcagctcggaggagggaaggagtcgccgtcctgggccacagtctaggggggtggaccgtggtgccgtccctttg

SEQ ID NO: 113276 - DNA, 577 bp, Homo sapiens
gaagcccattcataggatcaacagattttgatggttcaaggactataaggagtgagagatagcaggtttctggcttaggcaactgagaaaatagtgtcacagctcagactacaaataactgatcacgagccctgctcaattcagcctggtcagattttcacaggggcaaccaaggaaaatgatgatgtaaagcccctggatttggtggccactagagaatttcgagagtaatctcagtgagaaatgtaggccaaattagaaggactttaagaagcaagagtgaggaattgaaaaaattaggtttagaccagttttatttttagacttttgatagaggaaggtggaatatgatggctgatggaaaaaacaaacaacaaaacaaaaacaaacaacaaaaacatttgttgggcgcggcccctgggccctgtcgaaaaaggcttttttaacacccattggtgttgtgggcgccgcggaggccccagttgggttctaggtgaacattgtggccaaatccggggttcccaaggaaaaaacccggggccagaacatagggctggggtttccccccattaaaaag

SEQ ID NO: 113277 - DNA, 233 bp, Homo sapiens
ggttgcacagtgcttggcacatggttaagggctcataagtattagctctgtattggctgggtctgatccatgcattttctccctaagaatatattcctgatcatttcctgatgatgttccttaaatgagtattttttttaattccctgtcaaagaaaatcctgttttgttttttttaaaaaaacatccttgagctcatcaagaaaacttttgtctgtgcccagcatgattcca

SEQ ID NO: 113278 - DNA, 515 bp, Homo sapiens
gaaaaacaacatgggtactttaaacctctcagaagcagattcttgggtagaatacttaaaagcttatgagaacatgacgatgctgctctaaaatcaatgaagccaaagcaagagaagttatacaaaataatattatttctgataacacatactgtttccccagaaatgattattacctccttttagcatatcatgagaatggcacgtttattttgagtttagagttctaagaagacatttggtatccaaataaaaagtatcgtatggctgggtgtggtggctcatgcctgtaattccagcactttgggaggccaaggcacgagatgacttgagcccaggagttcagcctaggcaacatggcaagaacctgtctcaacaataaaataaattaattagccaggcatggtggtgcgcgcctgtgggacatacagactacccacagtagatgggactataggcatgtgttagcaaacccggataagtgaaaagaatataaagtacagatggagtaacac

SEQ ID NO: 113279 - DNA, 782 bp, Homo sapiens
gtaacattataagtggttcaaatcaataattttttatttaattgggaacatatatcctaaaatatgatgtaataaaggaaaatcctactgtaacttcatggatgctaattctgcccaattattagccataaaaaaaatccaattttaagaaaatgttttccacaaattaggtaatttggattctgggttttttgaatatcagcagaaggagccctaagaagtatctcctgtgtcctagttctgcacacacactcctacccccaagtggccaacagaaatggaaactcctgcttcctttttcctctctggaataataggtactttctcaggattagctgctgctggagaagaagcaatagataattgaaaacatcttaatttacatttatattttggttgaatttgtgagccaaaagagcaattgacaaatatcttggccaatgaataattattgcattgaacttgcttttggaaatacttgttgaattttatactttcttttcccattaaggccaaaattttgaattctctaatgggtaagggagaacaaaggcaaagagaaatctaagattctttccccaggaaaacatattaacatcatagtagaatatgctcaggaaactctgacctaagcttttacctttagaggtttagagtctgggaaatgttttacttacacatactggggaagatttatagagaagtgaaatgtactagtatactttcatagataaggcatctggagtgtgtgtatatagggtgtataacataatagcaacaaa

SEQ ID NO: 113280 - DNA, 343 bp, Homo sapiens
ccctgctcctgatggaacaccgacatcagcaggttaccatttcacatgagttgtcaaacactttgagtaacgactctgttcataaccccaagatcccctaacctagaggtggattaagtgtctctccagctcaccttccaatttctcttctatcctctttcaaaagtcttacctgtctgaagtttatgccattagactttaccacccattatcccttctcgctgtcatctacccaactactgctatttccccttatttgctgatgaccttcatacctatttccctttccagactcatctgtcttcatcattgcagttttcttttttgttttgttttttgtttt

SEQ ID NO: 113281 - DNA, 224 bp, Homo sapiens
actacccatttattttttaaagagagagagagggaaagtatttgtgtgcagagagaaagagaatgctaaagtaaaatataaaatgttgacaggtggagaatctaggtggagggtatgcagatttccattttactagcctttttattttctctttacttttccttataaaaatgagggtaggagtggttaaagccaggtctagaggactcagaaaatatcttgtg

SEQ ID NO: 113282 - DNA, 518 bp, Homo sapiens
caagcaacacatagatatctggtcagttttctttgtgatgtgcaccatgcacagaggcagtgttgcccgtgggggcaaataaactgggttccaatctcagcggcatcatatgagccaggcaaccttgggcaatttactgtctgagcctcgatttcctcgtgtttctatccaccttggactatcatgggaataatactagaccttagagctgtaaggatttgaaattacacacgcaaagtgcctaggtagggattggcaaataatgctccacaaaagtcacgccagttggtgacttgggttcatgtccttccttcattgcccacaaaccaccttttactgcaggttgtgcccagatggagggtggatcttggctaagaagaatattatggatttctggaaaggagaaatcattaaggggctctggggttttgctctgaagcgggcatgtcttccttaagaattgtggttttgttctggggctctgaaaagcctgagatgacaccatactgtacagtctg

SEQ ID NO: 113283 - DNA, 383 bp, Homo sapiens
cgcttcggctgctggatgtgtggaccctggagtgaaaggaggcgcttcggctgctggatgtgtggaccctggagtgaaaggaggcgcttcggctgctggatgcctggaccctggagtgaaaggaggcactttggctgtgcagacctgctccattctcctccgcgtccacagcgcagaagaacaccagcttccatttctaaaaccattatttaaaagtcaagttcttttggtataatgtgcctaatgtgtttggctttctctaggtcaccatttaacatcttactctgcaacactacggtcctagttaagaccaaattcacagccaccaggtatctttacaaattaaccaagattggccaggcgcagtggctcatgcctgtaat

SEQ ID NO: 113284 - DNA, 407 bp, Homo sapiens
tgctgaagtagagtcttagggtgaccccagggggacgtaatgtttccgagaagaaggacagaaagaagactgggagacaccggaactcgaaagaaaatcggtaacaaaatgtgggttcggccaacagtgccctgtaggcctgaaatttcggtctggccagagcaagcatacagaaaggctgtacctggaggaaggaagtgcggagccagcctgagttgggagaagagctccagagatgtgaaaacagactaatacatcgtctcaaaaaaagaaaaaagaagaagaaggaactaaagaagaatttctttggaagcaaaatatttggaagcaaaatatttggctcctgactgaaagggttttgatccatgcatacattaataaacccttcagaaccatgagttgggata

SEQ ID NO: 113285 - DNA, 470 bp, Homo sapiens
  misc_feature (2)..(2): n is a, c, g, or t
cnccggaactcgaaagaaaatcggtaacaaaatgtgggttcggccaacagtgccctgtaggcctgaaatttcggtctggccagagcaagcatacagaaaggctgtacctggaggaaggaagtgcggagccagcctgagttgggagacaccggaactcgaaagaaaatcggtaacaaaatgtgggttcggccaacagtgccctgtaggcctgaaatttcggtctggccagagcaagcatacagaaaggctgtacctggaggaaggaagtgcggagccagcctgagttgggagaagagctccagagatgtgaaaacagactaatacatcgtctcaaaaaaagaaaaaagaagaagaaggaactaaagaagaatttctttggaagcaaaatatttggaagcaaaatatttggctcctgactgaaagggttttgatccatgcattccagcctggaacacagagtgagactcctt

SEQ ID NO: 113286 - DNA, 476 bp, Homo sapiens
  misc_feature (2)..(2): n is a, c, g, or t
cnccggaactcgaaagaaaatcggtaacaaaatgtgggttcggccaacagtgccctgtaggcctgaaatttcggtctggccagagcaagcatacagaaaggctgtacctggaggaaggaagtgcggagccagcctgagttgggagacaccggaactcgaaagaaaatcggtaacaaaatgtgggttcggccaacagtgccctgtaggcctgaaatttcggtctggccagagcaagcatacagaaaggctgtacctggaggaaggaagtgcggagccagcctgagttgggagaagagctccagagatgtgaaaacagactaatacatcgtctcaaaaaaagaaaaaagaagaagaaggaactaaagaagaatttctttggaagcaaaatatttggaagcaaaatatttggctcctgactgaaagggttttgatccatgcatacattaataaacccttcagaaccatgagttgggata

SEQ ID NO: 113287 - DNA, 312 bp, Homo sapiens
tgctgaagtagagtcttagggtgaccccagggggacgtaatgtttccgagaagaaggacagaaagaagactgggagacaccggaactcgaaagaaaatcggtaaccatacagaaaggctgtacctggaggaaggaagtgcggagccagcctgagttgggagaagagctccagagagtgagtcaaagcgctctgtgtcctgctattaatgatgccctcatagtcagaggaagcctacttaagtgaaatccatttttgacctgtcaagtattaaatattctcttaatttttagtactgaatgatagaaggcgcc

SEQ ID NO: 113288 - DNA, 373 bp, Homo sapiens
tgctgaagtagagtcttagggtgaccccagggggacgtaatgtttccgagaagaaggacagaaagaagactgggagacaccggaactcgaaagaaaatcggtaacaaaatgtgggttcggccaacagtgccctgtaggcctgaaatttcggtctggccagagcaagcatacagaaaggctgtacctggaggaaggaagtgcggagccagcctgagttgggagaagagctccagagagtgagtcaaagcgctctgtgtcctgctattaatgatgccctcatagtcagaggaagcctacttaagtgaaatccatttttgacctgtcaagtattaaatattctcttaatttttagtactgaatgatagaaggcgcc

SEQ ID NO: 113289 - DNA, 1031 bp, Homo sapiens
  misc_feature (2)..(2): n is a, c, g, or t
cnccggaactcgaaagaaaatcggtaacaaaatgtgggttcggccaacagtgccctgtaggcctgaaatttcggtctggccagagcaagcatacagaaaggctgtacctggaggaaggaagtgcggagccagcctgagttgggagacaccggaactcgaaagaaaatcggtaacaaaatgtgggttcggccaacagtgccctgtaggcctgaaatttcggtctggccagagcaagatggtactgccttttaaggtctattacttaaacataagtatggctctggttcttaccgcctttaccgtatccttcatgggaagttgatactgatcggaaactgacacagagccttctcacctacactaagggggcctaggtaagcaagattatctttctcccaacttcagcaagaggttttcttactggtgttcagaatgcttgattgagcagttagaaaactgttgctacctagtctccagtcttataaggggacaatggctgcaagtcatgcctgcaagaacaagaggctcacacagttttgaaattagcacaacttctagctggataggagtctttttagtttcatttagccttgagttgaaactaataggagtcttttaattagaaaaaagctcagggctctaaacgtaccttcaacatgttaattctgttaccaaaaactggcttggtctgtgttaactcccaacagaattctttttcagtcactgaggcagaggtgcttccagagaaagattcttgacctactcatactgaataattatcgttactagaagctgcaaccaaagactcctggagggtagtaagaggtacagagaatgcaggttagatacagtgaggacagagaagaaaggatgggttggaggctgggcgtggtcactcacacctataattccagctactttagaggctgaagcaagagaatcacttgagtccaggagttcgaggctgcagtgagctagcattgtgccactgcactccagcttggatgacagagcaagaccttgtctcaaaa

SEQ ID NO: 113290 - DNA, 615 bp, Homo sapiens
  misc_feature (2)..(2): n is a, c, g, or t
cnccggaactcgaaagaaaatcggtaacaaaatgtgggttcggccaacagtgccctgtaggcctgaaatttcggtctggccagagcaagcatacagaaaggctgtacctggaggaaggaagtgcggagccagcctgagttgggagacaccggaactcgaaagaaaatcggtaacaaaatgtgggttcggccaacagtgccctgtaggcctgaaatttcggtctggccagagcaagatggtactgccttttaaggtctattacttaaacataagtatggctctggttcttaccgcctttaccgtatccttcatgggaagttgatactgatcggaaactgacacagagccttctcacctacactaagggggcctagcatacagaaaggctgtacctggaggaaggaagtgcggagccagcctgagttgggagaagagctccagagatgtgaaaacagactaatacatcgtctcaaaaaaagaaaaaagaagaagaaggaactaaagaagaatttctttggaagcaaaatatttggaagcaaaatatttggctcctgactgaaagggttttgatccatgcatacattaataaacccttcagaaccatgagttgggata

SEQ ID NO: 113291 - DNA, 370 bp, Homo sapiens
tgctgaagtagagtcttagggtgaccccagggggacgtaatgtttccgagaagaaggacagaaagaagactgggagacaccggaactcgaaagaaaatcggtaaccatacagaaaggctgtacctggaggaaggaagtgcggagccagcctgagttgggagaagagctccagagatctcaggtatgtctttatcagcagtgtgaaaacagactaatacatcgtctcaaaaaaagaaaaaagaagaagaaggaactaaagaagaatttctttggaagcaaaatatttggaagcaaaatatttggctcctgactgaaagggttttgatccatgcatacattaataaacccttcagaaccatgagttgggata

SEQ ID NO: 113292 - DNA, 823 bp, Homo sapiens
agcgcagcccgccagcggccgtgccccgagcctcccgctcgatcgccggccgccgggcaccgctgctcccggagtccggacgggcgcccgggtccgcggccttaaccccttcgggcctgcggacgccacgcggctgggcgaggctggctcccggcacctgccggctgggagaacgggcggcgccccgggctttcgggtgtcccgctggcccggggacgctggtgaagtcacaggctggacggccgaggcgctgcgcgggcaaagaaggcggtcgggttcgccccctggaggctcgcaaagtcggcccgtgggccgtgagtgtggcgcggcgggctgggaggggcgtggcagccgcaagcccgggagccctgcccgcacccccacctcgcgctggcccggggcacagggtggccagacggatttgtgtaagcactctttcgaatctaattcccgccgcgatgacttgcccgaaggccgccttagtgagttttgcagaggaggaaactgacgatcagagtgggacggacgtgggaagtgacttagaccacagcacaggacctgcctgcccgagccgttcctcccgctctttccactcggccgctagctccctaaggaacctcttgttatagaagctgccctgccctaggactgtctacactaccactgagtgccgctctactggtggagtgataacacaggtgcgtcctgtgtgttgatccaatcctgactcggggcacagtgtgtcctggagctgctgcggagatttgagggacagtcacctgaaggtgacctcgcaagtcttgagaaaggagtctccctccca

SEQ ID NO: 113293 - DNA, 403 bp, Homo sapiens
cccttccttcttcatatgtcagccaaacttggtaagatctttaaaaatggggctcttgcaagcctaatgaccagatcagggcaagatcaggctgaaacatcctttaggtgagccagatctagtgctttgcctcctgcatttggggaatgtgatgatgtatgtgagagcaccactaaactgcaacatgcaacctgtgtgaaagacacacagacaccatcccagactattagacagttttgtggttgttattgttttattctcatgttattgttttattacttagcagattaacaaattctcaaactaaattctatcctaatattcctcctaaacttatcctgtagacatgtgggaccactttctcacttatttcttaacagagaggaataagaaatggtcacaa

SEQ ID NO: 113294 - DNA, 657 bp, Homo sapiens
aggaatttgttcatttcatctattttatctaatttgttggcatccaattgttcacagtattcttctgtaatactttttatttctgtgaaattggtagtaatgtctcctctttctgattttataatttgaattggctgggcacagtggctcatgtctgtaatcccactttggaaggttgaggcaggaagaccacttgagcctaggagttcaagaccagcctgggcaacatagcaagacatcatctctaccaaaaaaaaaaaaaaaaaaaaaaaaaaaaactttgtgtggggccgcgcctgtgggcccctgcgaagaagaactttttaagaacctttgtgttgtggggcggcgggggccccaagtggggttaatgtgggagacatggggtccaaagctgtgtgtcatcccagagggagagagaccccggggggccatgagcaacaagggcgtggggagtatttctcatcaccacatataaaaaaaaccagcgccgcgggggggaaaacccaggaggctgttttctgagcaaaacacttcccacaaaaggggggcgtcttccagagaggggacactcacaagcggggggatccatctacacaacaggggggagtccccaaaaggaggagggccccgagatacatcaaatatttagggccg

SEQ ID NO: 113295 - DNA, 383 bp, Homo sapiens
ggattttccttcctgaagttcctgtaaagggggatgggaggcacttcctgaaggtgcccttgttctgcccccagccctgcccagctcttgcaaaacctgcagtctctaatctgctgtgtcatttctttcttttcttgtataaggactggtttctggaatctagggcagatcagaaacctgagtcgtctgtgttcttccattaaacttaaatatagtggcacctgcctccagcatttatggttctaatccgtatgtgcggccagtagcacaattattatcacagtcatttcattacaggccatattatatatgcacctctagaattttgatttagagcacagattctggaagtgatcgcttaatgatgtctaaatgtatctttt

SEQ ID NO: 113296 - DNA, 427 bp, Homo sapiens
acacccggctattttttgtatttttagtagaggtggggtttcaccatgttggcctggctggtcttgaactcctgacctcaggtgatctacccatctcggtctcccaaagtgctgggattacaggtgtgaaacaccatgcctggcccccagtgaagtcttgatgcctcagtttcccccttccataaaagagatgaacccataaaccctgccaaagcatcgtccctggagggaagtgaatgaaacttaatgagctggtggctgccacacattccacgctccccaaaataatggcacgaggctaatgttcagggctattattagaaaggcaaacaagaggtacttccatttctcagtccaaccaacctagttacccagacctctctctccagggccctgtgccacggggcttgggcagaacctgagtcag

SEQ ID NO: 113297 - DNA, 362 bp, Homo sapiens
gtaagagctaccctgtctctctcactaagcagtgaaaacgaaggtcaccttcaagtttacaacagaaacctactcattaagtagggtcagacaggcccatgttcacagtgggtgttgggtgttggtcagcagttgacagtggggacactgtgcctccaggactcaaacacctgcacaaggatagtgagaaggggcatttggggcagaggaagtttagaaatacgacagaattcttgacgtctcagtgactttctaactgaaacatctttgggttcctcagactactgggtggagcagtcgatgaagaccaatgtcacagaaacagtcttgtctggaggcatctcctccccttggaagcctgg

SEQ ID NO: 113298 - DNA, 998 bp, Homo sapiens
  misc_feature (992)..(992): n is a, c, g, or t
  misc_feature (994)..(998): n is a, c, g, or t
gacaaatgagggtttggcatgcagctcgtcatcttaagagttactatcttcttgccctggtgtttcgccgttccagtgccccctgctgcagaccataaaggatgggactttgttgagggctatttccatcaatttttcctgaccgagaaggagtcgccactccttacccaggagacacaaacacagctcctgcaacaattccatcggaatgggacagacctacttgacatgcagatgcatgctctgctacaccagccccactgtggggtgcctgatgggtccgacacctccatctcgccaggaagatgcaagtggaataagcacactctaacttacaggattatcaattacccacatgatatgaagccatccgcagtgaaagacagtatatataatgcagtttccatctggagcaatgtgacccctttgatattccagcaagtgcagaatggagatgcagacatcaaggtttctttctggcagtgggcccatgaagatggttggccctttgatgggccaggtggtatcttaggccatgcctttttaccaaattctggaaatcctggagttgtccattttgacaagaatgaacactggtcagcttcagacactggatataatctgttcctggttgcaactcatgagattgggcattctttgggcctgcagcactctgggaatcagagctccataatgtaccccacttactggtatcacgaccctagaaccttccagctcagtgccgatgatatccaaaggatccagcatttgtatggagaaaaatgttcatctgacataccttaatgttagcacagaggacttattcaacctgtcctttcagggagtttattggaggatcaaagaactgaaagcactagagcagccttggggactgctaggatgaagccctaaagaatgcaacctagtcaggttagctgaaccgacactcaaaacgctactgagtcacaataaagattgttttaaagagtaanannnnn

SEQ ID NO: 113299 - DNA, 276 bp, Homo sapiens
ctcataatgaaaaatatattttcatgtgcttatttaccacctatatatcctcttcagtgtcatgtcccttaatgacttttgcgtatatgctaattagattgatttttttttccttactgagggttttgagagttcttatgtattctagatactagccctacgttggatgtatggtttgcaaatactttctccaactgtgtagtatattttttcattcacttaacaactcttttgcagtgcaaacgttttcaattctgatgaagtacaatttatcct

SEQ ID NO: 113300 - DNA, 442 bp, Homo sapiens
atacagcctaagctaggtattgaaacagtaagagataccagatacaggtaagaatgatctaaccaaaagagacattatcactcagagattacaatgtgcggcactaccccactactcacatatgatacagagaaaagaatacacatacacacatatacacacacaagcacatttgaccaactgtaaaatatatcccatgtgagaaagtaaacttttttttatttgaaacagggtcttgctctgtcactcaggctgctgtgcagtggcacgatcacgactcacggcagcctcaacctcctgggctcaagcagatcttcccacctcagcctctcaagaaactgggactacaggtgctcaccaccatgcctggctaaattttaaaaatttttttagagaaggggtcttgccatgtttcccagactggtctcaaattcctggggtc

SEQ ID NO: 113301 - DNA, 452 bp, Homo sapiens
agacagggtccatcctgtcaaccctaacctctctggatgctcttttctcctgggacactgtctttaagctgttggccattgccatggtggcattaattcctggaaccctcattaaaaaatttagtcagaaacatctgcaattgaatgaaacaagtactgctaatcatatacacagtagaaaagacacatgatctggattttctgtttgccacatccctggactcagttgcttatttgtgtaatggatgtggtcctctaaagcccctcattgtttttgattgccttctataggtgatgtggacactgtgcatcaatgtgcagtgtcttttcagaaaggacactctgctcttgaaggtgtattacatcaggttttcaaaccagccctggtgtagcagacactgcaacagatgcctcctagaaaatgctgtttgtggccgggcgcggtggctcaa

SEQ ID NO: 113302 - DNA, 523 bp, Homo sapiens
tctgtggccagacacttcatcagccttgaaccttcactctctgtcagactcggcacaggtgcttacacacattatcccatttcatcctccgccaccgtgacgaaaccagggttcagagagatttcatagatcagccagggtcacactgctaggaatggcagagctgagatttgaatctgggcctttctgaatttgatgtctcttctatgcttttgcttgcatccctgtccccgatccccaccccatcagacacgtgcagcccaggatagcagcgtagttaagagcatggaccctggagctggacatcctggggttcgaaggcccctctgcctcctaaccagctgtgtggtcatggcagcagtctgccacagtaccctcttcctacagtggggtggggtaggtaatgagaccttccttctaaggctgctgtgacaattaaatgagctaatgcagatcactgtgaaagtacccacctgacacacatcactgggtaagaaaaatgattgttgctattgttcctccc

SEQ ID NO: 113303 - DNA, 618 bp, Homo sapiens
tggggtttcaccatgttggccaggatggtgtcaatctcctgaccacgtgatctgcctgcctcggcctccctaagtgctgggattacaggtgtgagccaccgcacccggcctctccttgattttctaagctcctctcatccaacctgaaaacatatttatctagtctttaggatagtcattctggcttttacagctttgtgtgttctcttggacttattatcttgatttaaaaccttcctatttaaagcagggccaaaattttaacaaaccaaagacctctctgtttttggcacagcctcctttagtacagaaaatcctaaaggtaaaggaagtcctgtgcgtacaaggaaatacagtggaaaaagccctcaaataatatttgaaaatgttattcacatattgtctttatttcaactcagattcctttctcattccatttttatctggctcctacactcattgcttcacagaattagtcacagaataggtcacaaatgacctaaatccagtgaatacttctcagccatcttacttgaccttgccaaacataaaccacgtgtattagtcagggttcccacaataggctgtctgcaggctgaggagcaaggagagccagtc

SEQ ID NO: 113304 - DNA, 450 bp, Homo sapiens
aatgtaatctattgccaattggggttttgtatttgaagtcctctgatttctaaaataagcacaaattgttttcttgtctttcatcttcacagcctttctatgcatagaaatcttgaatatggtctttttctggcaagtgtctgaataagggtttacaatgccttgtttatctgacaagcaaccatgttggcaaatatttcaaggctccagtaatactaatgtgagtctttaggtaaaggaagctggttatctgtctggcacatgggaagacttaagagcattgcagtaatgaactatttccttagaatgccaggtttaccagcaatcagatatggaggccgcaattaatacattaggatccaccaggaggtcctaaaattgggtcttgtagagtttcaaaagagatactgttactgtgcccctccttttcccactctgttggccaaagtt

SEQ ID NO: 113305 - DNA, 784 bp, Homo sapiens
ctgtatgttttagatcttttatcagcaagatctctgggacagctagtggagaaatcaaacagggaggcagcaggccagtgatcgccgtaatagtttaaacttagaccagtaaaacggagctattttacaaaaaactgtggcattctaaatcgttgaaagttacgtttcattatttgggagtggtaattagctagacaatgtatgattaaagtattatgaaactaacggatctgacagttctctttgcaaagaaggaggcaagagccatgcttttttgtgtgcagaggaagacttcatcgcatattctttacgtgttcaaaatgattccttgctattgatacttgttctaagttttccccacataaattacagtagcattgtgaggctagttgtgaaattaagccatactttatggagctgcccttagtggtgatgtaaaataatctttagagtctcttgtgttactgagtacagatcataggcagcttcaaataagtgggcagctacatcagaaagcatgacgctggagagaaaggtttccttccgaccaaggtagaacctgaaatgtccagatatattggaaacatgaaatgtatccagcgtaacttccactgctatctgccacacagaacaaccacactgtttatattgtcacttctgaagagtaatagtgaggagatcctgaggagagaggatatgataagccattgcccaaattacagagccccaggcctattccatctaatcaggagaaagagctttaggcgaggatgtcctcactctc

SEQ ID NO: 113306 - DNA, 168 bp, Homo sapiens
aaatggctctgttgtctggggtatatctctggttctttgtcttggttgagaaagatcaggacatggacacacacaaagagtgagtttaagagcagaaagtttaatagacaaagaacaagagagagagaaaatgcgtcctcatgctgagaaagccggttgcccgagagg

SEQ ID NO: 113307 - DNA, 235 bp, Homo sapiens
actgcactccagcctgggtggcagagcaagaccttatttctaaaataaataaataaacattaactctttatttgtcacatttttcaataacattttttccagttttgtctgtttaatttttaatgttatttattgtgggttttttgtgtttagaaataaccatgtattttaatttttaatgtagtcatatattttcatttttccagaaaagaatgagttgaggctgggcatggca

SEQ ID NO: 113308 - DNA, 265 bp, Homo sapiens
agggaggagcctctggaataggaagagaaggtccccaccggcagtgactggacagtgatgtcagggaccgaggggttgggcacggggaggagcgggcctgggagaaggtgggtctgtttctcctgccctgaccctcaggctcgtgtttgcttctgtgtacagtgttttagggccttgtctgttcctcccagataacactgagctgtttggttgacaaacagaaatctacacattcagtggataagtcactgaggaaccttctgga

SEQ ID NO: 113309 - DNA, 252 bp, Homo sapiens
tgagattgtgccactgtactccagcctgggtgacagagcaagactgtatctcaaaaaataaaaaaataaaggttgaattgaattgacctttaaaaagttctcttttgttatcagggtgagaaggtgggcgaaaaatccagactgagcttgggttggggtttccatgaagccttcctaggggaggagaagggatattggtatattggtctattggtctgctacggctgtcatagcaaaggaccacagactgcg

SEQ ID NO: 113310 - DNA, 515 bp, Homo sapiens
ggacagctggacctgtctctcaccacccacctcagaagcacaaaaggattcacacccagatctctagaaaaatgatcaaaagcaggttccttctcgcagccaagcttcctggacatggtagttcattgcatcttgggaaagagtaaatcattttttcagctgtcaatactgtgtccctcacatccttgaaccttgttcttgcaaaatcttggccttctttctgggttcactggccatactgtatggggtgttgtgaagtttcttggacaccacatagaggaacttggcctgatcttcattcccatagttgtaagaagagccattgctgaccagttgttcaaacttccagctgtcggacatggtggacaccacctgtgtgagttcctcctcctgacactgaagcacgtggtacacatgcttcatgggcacctgtgatgttttgctctcttgttctctaattttgtcctttacaagttttattaatgaagtgatactgtaaaattcactttttccaa

SEQ ID NO: 113311 - DNA, 459 bp, Homo sapiens
acccgaatcaaagggccttgatcctctgtacagcctgcattccaagaatgggccagaggttcagatgttcagatgtccttcctagaaaaggagcagatctctgagttggccactcccacatttcttagcttggaagtgtgaacccacattctacttggaccatagggtcattgttagggtatgcttgagttattgctgtcaggtgcatctgccatacgataccataaaccttaaaccactaaaataaaagagatgtagctagtcaataaaaggaaataaagtggaattataaaaaaagattaataaaaaataaggcagaaaaagaagaaaacatataggacaaatagaaaacagcaaaataatagacacaaatctaatcatactaataatcacattaactataaatggtctgcatgcgctaatcaaaaggcagaagttggttggattggctaaaaaaaa

SEQ ID NO: 113312 - DNA, 217 bp, Homo sapiens
ccactttatttccttttattgactagctacatctcttttattttagtggtttaaggtttatggtatcgtatggcagaaaaagaagaaaacatataggacaaatagaaaacagcaaaataatagacacaaatctaatcatactaataatcacattaactataaatggtctgcatgcgctaatcaaaaggcagaagttggttggattggctaaaaaaaa

SEQ ID NO: 113313 - DNA, 589 bp, Homo sapiens
cagcgcctgccccagagctcccaagcccctgcccgccacatctgcagtgccgcacacagacaggagaccagcattacagcaacaaccgaggggccactgcctgatgaattgccagaggggaaccaccagctcggctcttaataaccggatctgcatcctgctgctgcccagctgggctgagggccctgaccacagctaaggggagtcatcacagggcttcagggctggaattccagtgctgcaggatgagtggcgctggtctcgggatccgcagagtctacagggccctgggcttggacaccgtctcaggggtttgtgccttcagagcctggtggagcagccaagcaactgggcacatgaagacaaaggtcagacctccattccagaaagtcctgccccatacccacacccagaaggaagaaatgcatgctcagaggggccaggaagaaatccagagagacaggccttgctgggtgtccccactccgtctattcacattcgatcattgccctttttgtccagtcatatcgctacacagctgtccatgtgtccttgaaactcagcataaaagtggacaattttccctgta

SEQ ID NO: 113314 - DNA, 204 bp, Homo sapiens
cagaaatgcaaaattatgcatcttcccatagtcctgaggcttcctttgccaatggaagggctagcaatgcattctccctctcatgaaagttaaatttccagagacttccttagattgctcaaaatgttaaagatatgtccatgtctgcaattcgccagtttcaggtcaaggcctactttcatcaatattgctcccagaagtttt

SEQ ID NO: 113315 - DNA, 431 bp, Homo sapiens
cttggtgaggcagcccaggtcgctgcagcatttgagccgctgtgcgctccgctcccacctggagggcagcctgccccaagcgctgccccgcctccccctgccaccgcgcctgctccgctacctgcagctggattttgagggcgtgctctactagatgtccatggccttttgagagggcctgaaagcagatgccccagcctgcagagggcgcgcctctgcactaactcaggccaggtagccctggcagcaggaggcccagctccgcaggcaggtgtggatgctgcaattcccaatgcagagaagcggaccgacagcggcagccgggtgatgtctgatgaagacacactcctactggggctctcctgaggcccccttctagcctgtgcaaaccctgtatgtgcattaaaaatctccaggtctgtgtttggtgc

SEQ ID NO: 113316 - DNA, 272 bp, Homo sapiens
ctgagaccaggagctgcaggcgttagatagaatatggtgacgagagttacgaggatgacgagagtaaatacttcatactcagtacgtgccaagcactgctataagcgctctgtatgtgtgaagtcatttaatcctcacagcatcccacggtgtaattattttcattatccccatgagggaacagaaactcagaacggttcaacacatatgcgagaagtcgcagccggtcagtgagagagcaggttcccgtccaagcagtcagaccccgagtg

SEQ ID NO: 113317 - DNA, 498 bp, Homo sapiens
agcagctcactttctgcaccccagcttcagagccctcctgacaggagctcacagctcacatttttccatattataggaaatcatgctctttgcagaaaatagaaaaatacaggaaagtataagaaataagtaaatgatagttatgttacacattgtaaaaatcctttttaatcttagcatggagaataacactttggatctattctgtctcttatgcatatacgtatatactaaaaatgagattcactgaagaatgttttaaaatatgtgagatttgaatacatgtttcatagtttattttccatttgacctataagtatttttcctatgtctttgaagtattttgaaatacttttagtaaatacataattgttgagatggatagtgtctgacatatccctgtacagctctgtcaggagaaaatttatcctactctggtttccagcatggtctggtacatcttgaccacttttctaaggattccctagggggagagtg

SEQ ID NO: 113318 - DNA, 309 bp, Homo sapiens
caataattttaataatagctagttcttacaatagtgttatgtaccagggatgttctaagcatatggtagaaagcaaagagttttggtccatcctgtctccaccctgcatgtgtatccctggagacttatttgacttctctgagcctccttgtctataaaatgggaatcttgagtcaaagactctatctcatagtgtaatggaaagattaatttagaagcctataacatgccaacccttgtttatagcaaatactagatactccatatttgctcttcttcctacagactcacagtttaaacatataacaa

SEQ ID NO: 113319 - DNA, 1242 bp, Homo sapiens
ggaggttgattggtctcaagagaagaaagctgggaaaaaatggaatgcataagccaaatcttttatatttagtggaaggttatttcaaaatacttactctactaatgccatgttgcaattcacagaatatgccactaatgcattgccattagcaaaaataagataagccatgagagatacaccatgaagataaatcataaatgctagttagtactttggactaacatttgaaaatgttttcaaatgtaatacaatataaattgttcttggttgggttacagattctgtagttgctctaagccttatttcactatatgctaagaatcttttggtgattaagaattcataaatcaaagaatcatacctccacgactatgtcagcagaagtctgagtcgggaacagattctaataattattttaaatgtaattgaaatggctagaattccaagatataacacatgcctataaatgccaccttttataattcttgagctttatatgtcattatgaaaagatttaaataatttcacattttcttatacttccatagaggatatatgtgctaaatgaaaaaaaaaaagtattatttcttgaatgcctagagagtgttggaagatacagtaaagctagtttagttctactttttttttttctgtttttgtttttcagaaggaaaagccagttcagtgtagttaagtaatttccctaaaactacatagtggtagagcagtgattcttcattagctttacacattttataaaaaaagacttcttcctaagaaaggaacttagagaaggcagttatttatcatggataattaagtcagggagattcatttgcagggagtaaattgtgccatagctctagaattcccttttgtgaactatttctttgtctcgggatgtgtggggtagcagatggtagacttttctagactcatgacagaccttttaggtagaagggtgagggaacagagagacaggttaccgtataccctttgacatggttcctccttaaaaatctgctgtattttagggaagttaatgaaattgtccttcaagcttcaggctttgagtagtacagcaagtggacaggaagtggagggtgggcaagggagtggcatggactcttttccaagttccttcctgtgccttggaccagcactgccattggaaatataatgcaagccggccacacggtggctcatgcctgtaattccagcactttgggaggccaaggc

SEQ ID NO: 113320 - DNA, 369 bp, Homo sapiens
caagagtgtagaggacgacgctgagggccacctcatctaccacgtcggggactggctacaagagcgatgtacaagccaaatcgtaacaatcctatagcctgtaatggtcccatagccatcctaacgtcccaagccaacctgagtcacagcctcttgccttttctcagtggtgttgtttatctgggtggtttgagttgctgttgagaattgacctctgttgtccactcccagctctcacggcccctgggttaaaggtggtgggaatcacgcaggggttttcttcccctgtgaccatctgtatctgttccccttccttcatctccaccccaggttgctgtccccttttttcttccaactcagctcattccc

SEQ ID NO: 113321 - DNA, 361 bp, Homo sapiens
tgagcatcatacttgacagacaagtatttttttttaattcatttccaacatttaaaaggtagaagaatctcatggaagaatccagatttatgacttcttgtgaaaaatcagaaaatctggcaacactgggtccccattccatgcagccacaatggggcatgatcggagctgagtggtacctccattctgtggccaggatatgatctgcagtcaccatgtccccagcctgtgccattcacttgcctgtgtggtccctgatgtggctgaagagttagaataaaggagaaaaagaaagaaagagagagagaaagagagagacagaaagagaaaggaaggtaggaaggaaggaaggaagagaggg

SEQ ID NO: 113322 - DNA, 407 bp, Homo sapiens
cacgtgtgtgtgttcagagtatcttaagaaccagtggtaggtaggagaataggaggaagaggaagtggtcagagtcatggaaccaagcaatatgcacgcagtctccgatctgtgcacacagaagggtaggcagagaaaaggaaaaagaagatatcaacacaagtggaaccgcagcaatttctcttctctgtggatatccaagtgaacttggccagactctcgtttaacctaataagaggaaagactgccatctctacacctgcgggctctaaacaatgatccccagatgtctccctcagtggaggattagcttgatgtgttcacaataccaaattcggctaatacatctcaactgtgctgtttgttgcttcaggctttctccttttctatcatggcctttaaccacc

SEQ ID NO: 113323 - DNA, 308 bp, Homo sapiens
atccaatcacctcccaccaggtccctctctcgacacgtggggattacaaatcgagatgagatttgggtggggacacagagccaaaccatatcaatagcttaagagaatgcttgcttctttgaagctccctattttctccctctaccctccctcatccagaggtaactgctgtcctggatatcatgttaatcccttgcttttctttacagattgactgcatatgtatttgttcttaaacagtgttgtttggttttgcctgtatttgaattttatataaattgaatcatactacatgtatttttctgtgt

SEQ ID NO: 113324 - DNA, 396 bp, Homo sapiens
gttcttcatgtttctccaatgtaaacatttccgtatctctaaactatgctcttaggaaggaagtgactatgtacagcccacacttaaggagcgggaagttatagttcacctccttgagggtgctacataaattatttgaacagagacctacagccctctcatcttaatcaaaaattgccaaccccctcaaaaaaaaataataatacagggcctcaagaaaagaggtcatctttgggcccagcctgcaaggtaagctaagggaaagttaagcaaaacagtttctggtcccatcactctcacgtcaacagcagtagttcagagcagcctgtctcctttctttccatgaggcaggcaatcttaggaagacacactataaccacaaggacagcagcaggc

SEQ ID NO: 113325 - DNA, 2200 bp, Homo sapiens
  misc_feature (2052)..(2052): n is a, c, g, or t
agaaggtgaaatagaccctaccccctgatggaggatccacttgtatgtataaggatgggaagctttgcaggcagccatctttggaagccatccaccacagtggctcaatcaacctggtgatgacacagagtgaagtccccactttccaagaattttccttcacaagaaagttcctttcatttcacccacacaggaatgttgactttaaatgagaccaagacctaaaaggccacattcacagataggtaacagggcatctctttgacaagcctcaatcgctcttgggggcttcaatttcctcatctgtaaaataaagatagcctagagttgagttctacagccttaaacctcaaaggaaaagcctttatacaggtgttctaatttgcaactatcaccagatatttcccataaggccaggtgcagtggctcatgcctgtaatcctatcacttcgggagaccaaggcaggtggattacttgaggttaggagttcgagaccagcctagccaacagggtgaaaccccacctctactaaaaagacaaaaattagccaggtgtggtggtgcactcccataatcccagttactgaggaggctaaggcacaagaatcacttgaacctgggaggcagaggttgcagtgagccaagatcatgccactgcactccagcctgggagacagagagagactctgtctcaacaacaacaacaacaaaaaattatttcccgtaggattttccaaaggagggttaggaatgtgaagtcaatagttcacaaatgcactcctacttttcggaggtatattaggaatgcatatcttgttggtacctacacaaagcctcctttgaattttaacttccagattttttctcttgcttatggtctgccaccatgggtaaagcacccccacatacatcagcacagagcccacatacatcaattttttcataacccccaaagagagcagtcagccaaatcagaaagtttcagggagatatcaagatagaaaaggctagatacccagtctgagaagtcagacaactccacaaaactaataataataatgtcaccattcataggtattattattcatatgtagaatatagaggagtcaggatttggaggcaggcctgggacctaggttcaaatcctggcatcaccacctacatctgtgtggcctccatagggtactttggtaataataaatattcaatgaggtcatataagctagtgttggcagaggcccagcccatagaaagctcacaaccaagagtggctgtctttattgtcacattgattttcagtctaagaagttgcaactcagaaaacaataagtcatctatgttgcaaggctgtttgctcttcttccatccagaaagtggctgttagagaaagaaactcacactgaccatgtgtctactccttgctaaacatttcccatgtgcagccttgagtaagcctccaagtattcctgaagttattgtgaatatgaagaaattgaggctccgaggcttagattacttgccccaggacagataaccgagatgaggcagagcggggattaaaaccaggtggccctgatgggacaaaggctcaatgtaaatagaagagtcagcccatgtgtccacatccaatgaagtaaacatggaaaatgcaagatcacccatttgacctttaccattaacctatctaggcctcagtttcttcatctgtaacacaggggcattgaaacgtaaaacccaaagtttcatgaatgcatgatttggggtttaaaactaaaatagtattatttcagtgttctgaactgtatgttttcattaagtatcattttaaaatcacattttctaatttcatgtctctgagaagtctagatcccttatcaactcatagtggttgagaatctcaaaattattcaaaaatatccttgaggtgtggtgtcccaaataacctgggacataaactagcatagctggagcactaactttcaaaataaaattaatcaaggaataatagtcagctcttctaaaacaaatacatatataaacatatgcacatangctgtagcctcagaataccatttactctaagaatgtaagctattctcctatgctcaaaataatgtaaatttaaggattgagaacttcagtggtaaactgtcacctgtatctctatggtttaaacaaataaagaaaagaataagaaaac

SEQ ID NO: 113326 - DNA, 308 bp, Homo sapiens
tcaggtgatccgcccacctcggcctcccaaagtgctgggattacaggtgtgagccaccacacccgtttcattcttttgttcactcattcctcattcaacaaacacacagtggaaatccatatttctgtttctgcttttaatcacaggaagagtgaattgtctacacagttgttgatgtgctggatacatgaaaaatgtagtgtgtgtttcaacctgcttgctttaaaatattgcatgcagtctgtggggttcaactctctatagttgtggcctcacagtttagtttatccaacaggaaaataaaacaa

SEQ ID NO: 113327 - DNA, 412 bp, Homo sapiens
aggtatgcttcagttatccaatttacttgcatccaggctatttagaattaaccatctaaccaactcaatgaaatttttagaaaactgaaacttatccctttaggctccaaaatagttttgttttatcagccgggtgcggtggctcacgcctgtaatcccagcactttgggaggccgaggcgggtggatcacgaggtcaggagatcgagaccatcctggctaacacggtgaaaccctgtctctactaaaaaaaaatacaaaaaattagctgggtatggtggcaggcgcctgtagtcccagctactcgggaggctgagacaggagaatggcatgaacccaggaggtggagcttgcagtgagccaagatggcgccactgcactccagcctgggtgacagagtgagactccttctc

SEQ ID NO: 113328 - DNA, 536 bp, Homo sapiens
aagcttgttagagactcagcacccaggtttctactgggggctagtcactctctgtctagcacataccaaaattccagactccaggaggaaagcaggtattcagcataaaccatatggtttgtacaaagagcttaggcagtcttctcagttttaggaatgatggagactctcccgaaatccaagttcccacatgccagccaaaagccaacgtagcaaacaggtctttctaagaatagcagcggggcctgctgtattaactcttttctgcacaaaaaggaatgtggagatagcatagaactagtcactgcagaaaccagcaatcatccctagagctggagagagaaaagacaaagtttggagtatcagaacctagaagtatgctggacaagtctccaccaggcagagactcatccctgtaagagaagggagctgttcagcttctgctggtaccatagagggagccggtgaggctgtttccgggcatgctgggacaaaggtggaagctggaagcaccacactgccctgtggaagaagca

SEQ ID NO: 113329 - DNA, 895 bp, Homo sapiens
tctaactgccagctcatgtatgctccttccagagagtcattctgtctgcacttagaggaaagaaaacatggactccttgacaccacgtctctgaggactcatcttgtgtcttccatcctggcacaagaaccaagtgtaccagacagcctttgaggctgaaaagagatcgaggaacagcaggggaaaggcaaatagcacaatatttgtttccacaactgatgttactacaatgaatatgaaactcagaattttctgttaagtcaagcactagctgaggttgaataacatgctatgacaatagtggtgctataaacccaaggacattgttatgagttttcacattaaaaaaaatggctggaaacttagatttaattaagggcacacaattatggcaagaggggtgtagctgaaaaccatagagagtgagaaatacaggcagtaagattctcagagccatgtttgcgtatctacattgcctgtactttatggaattctggttcttggtgatatttggagttcagatagtggatttatagtgggaaagaggattttgaatatagagatagtagaactagggaatgattttttaaaaataaaaggtaaagaacagaataggccgggtgcagtggctcatgcctataatcccagtgctttgggaggcccaagagggggaattgcttgaggccaggagtttgagacagcctggccaacataaagagaccccatctctacaaaagttaaaatttaaaaattagctggtcgtggtggtgcatgtctgtaatcccagcaactcagaaggctgaaacaggaggatcacttgacaccaggatttcaaggttgcagtgaactgtgattataccactgcactccagcctgcctgtttctaacttaaaaa

SEQ ID NO: 113330 - DNA, 601 bp, Homo sapiens
caaataggaaataaaacaagctttcttagaaataatatgccttataggagaaacattaagaaataaatatttgcctttggatgggaatagaaaactgtaaactggactctaagaatattcctgtgtgccctgaagaaatataatgtttgctatattttcagtttcagtggatgacatgtgttttggttctttgaacatttttttgcatgcttgttttgactgtaaaagttgacttaccagccaactgccaacttgcaaagtgccttctcaggtaccaactctgcagttctggtagctaccaggtagtgacagttctttaaatgtgtccatgcagcccaacaagctgagagacattagacataagacaactacatatgctttctttttgtttatagtccagaaatattagtacctatatccaatataaatatcactaattactacatatgcatacatttaaaaaaatttattgtataaacataagcacattaacagaagccagtagttccatcacccaaacagtgtaaattgtttttatttttctgttttaccttccactttttgtacatatgcatctataatatttgcaaatataaataga

SEQ ID NO: 113331 - DNA, 1059 bp, Homo sapiens
tgtagagctaaaagaaaagaaagaagaaaataaaaataaaagaaaggtagcttcacctccacccaaatttggaaacatctattcatgcattttacagatatatgtgtgacatacactatgtaggagaaaattcaagctgtgaaagagaaaaccagtgcaatggctgcctgcatggagattacagtgcaatgaggaaaatagatgtgaataaatgaatgcaagtgtcatcgagaggaaacccaagcagctactggaatgtagaagccatggacttcaacaagtcttgaaaatggagtgagtgagaaggaaagattcttggcggaaaaaaaaagctggagttaactgaagaagtgaaaagaacatttcaagacaaaaaaatggtaaagtaaaatgactgaggtaggaaatcgaaaaatccatttgagaaaataaaagaagccaagcattggatggatcttaaacgacaagtgagaaaaaggcacaaaacaagtctgaagagaaatacatgaagaaactaaggatcaagcaccaagtcaactgcacaagatgttataatatgttcggcttaacttggaaccattgcagtattacctcagtcaactttctttactataattgaaagtgaatgattaccggctttttagctaatatcaaaaaagattcattccaatctagaagactgcctgcaagcaatgcgaacacgtgtgtctagtttcttggcagggtctcccagtttcccctgtcttttttctttctcctgatgcaaaatcacagaatgctttgacagctctgtgacccagccaactttagatttttcccagtaagcttcaaacaaaaccgagatctcaaacattcccaggcactgataaagttatctaggtttttgcccaaagcactgaaagaaactggccttggccctgagccaaatttcttaaaccttcctgaatatgccataactggacctccctcactagagctgtatttaggtagaacgtgcatttctctcgctgtcttctagaggattgctgcagactgtgtaataaatgctttggtctggtc

SEQ ID NO: 113332 - DNA, 816 bp, Homo sapiens
gcttaagcagttctcctgcctcagcctcccccgcggcatggtggtgtgcatctgcagtcccagctactcaggaggctgaggtgggaggatcacctgagcccagaaggtcaaggctgcagtgagccaaggtcacgccactgcacttcagcctgggcgacagaccctgtctcaaacaaacaagcaaacaaaaaccctcttgatcccatttcccaaaaaacgatttttttgagatcttatcatctcctggcttggtgcagagtacaggaaatcgagacaaagtacaacacacaaggaataaggagggagggaagcgtgggggaggctgacatcgtggactctcccagctcagtcgacccatgcgccttccttcatggaagaaaggaatggaagatgaatcatgccttcagcacagagagaccttcctcactagtaaatgcgcctccagaaatgtccaagaactcagtgccagagccaggctggctgcatgagaatcacctgcgagcttttgcaaacataggcccctactggctccaaatgtattcgtctcttggagaggaggagagaggcagaacaaggaacaggatgggaagaaaccagccttgtgcacaggaggatgctgggattcctcctgcaagtttagcgcaatgcagcctattttacaaggtcacagaagctcagagaggtaaacctgcccaggttctcatagcttgtaagtgacaaaacaaaacccgcccaagtctctgtctctagagatatttccacttgctttaactctggagctgtcttagttgtaaagacagattccactcctcactc

SEQ ID NO: 113333 - DNA, 211 bp, Homo sapiens
tgtgatttaggaggcaagaagccagcccaacctggaagagaccagctaatgagcaacaaagccctaacagcacttgaagtaagagacagcaaaaggcccagcactactgaaatgtaagccggcaagactcctgtcacagaagagaagaggtatgtgcgtgttcatgctcattttcatcctcttctctcattcaaccggcttttcccacccc

SEQ ID NO: 113334 - DNA, 563 bp, Homo sapiens
tcttactgtcgctcagcttacctgtgtctcagcaaagtcgtggactttggtttgaaataaattatcatgctgccaaaagaaaattatccaaaaaacaaagaatgactggtagcattttagtcccatacctggggtattgtctactatgcatgaaggctcaagttagagacaggatcacattcacatgctagtaaatggttctgggtcttttgtgtttttttttgtttgttttgtgtttcattctgaaaataaaacatcatagatagcagctggtttgtccattgtcttctttcttggaaatcttatggaaggttcctttgaacactatccttggcttctctgttaggacaaactgaaactgtgattgataacaaaccatagaagttaatttaaacaggattatccattttaattgacttgtaatcgtgagaataacaacaacaacaacaaaaaacccagaacctctaaatggtaattcttgaggggtgaaattgtatctttgctccgttctggatgttaccaggcaccgttaaaaaattaggaacaggctagacacgctggtt

SEQ ID NO: 113335 - DNA, 139 bp, Homo sapiens
tgtcacccaggctggaatgcagtggcatgaccatagctcaatgaagcctgaagtcctggctgaaccaatcttcctgcctcagaccactgtgtagctgggacgacaggtgtgcaccaccatgccagcttatttttattct

SEQ ID NO: 113336 - DNA, 135 bp, Homo sapiens
taagtcatttttcccctaacttttattcacacttccaattatgaacttctaacacataaagaaaattgagatttttgtcatgcaatgctgaaacccaaactgacatgtaggaggaaggagcagcagttctgtggg

SEQ ID NO: 113337 - DNA, 827 bp, Homo sapiens
cagaatgggcttggcttctttcactctgggctgtgtttatgagcatcacccagattgctgcatggaagccatcgtttgttcattttcaccaccatagagtattctactgttgatgggacataggctatttattccttctactgttgagggacgcatagttatttccagctggagactggtatatgtctcttggctaccttctgcatgcatttctgttggaggttgtttcaggtatctcttaacgtataacagaccaccctcaaattgagtccttgaaacaattaccattttcttctttctcaggatttggtgcatgggatgggctcagttgggcagttcttctgttccatgtgatggtactggggctgcagtcattcagaggctcaactgggctgaacgtgcaaggtttcttgctcacgtggccatcagtggtgctggctgctgttgggagctccactggacttctgtccagagctcctcagctcacctctctgtatccttgccctgtggctcaggcttctaacaatacagaggctggattccaagaggagggaattagaagcgttcagccttcttaagaccaggattcagatgtcccagactgtcactgtattgaccggagcatttacaggccagcctagtaatttttccatcttgggcaggaatgggtggcatatgctgggggtaggggtagcattgttggggatcatctttggagctgtgtgccaaggagtaaattgctcggctgctttctacctgaggaagtccgctatgcttgcttgtggagagtggattgtgtgctcagagtccacaaggatttaagaatc

SEQ ID NO: 113338 - DNA, 2084 bp, Homo sapiens
atgcttgtggtcgtctctagcaggatcccccatgggatgggctcagttgggcagttcttctgttccatgtgatggtactggggctgcagtcattcagaggctcaactgggctgaacgtgcaaggtttcttgctcacgtggccatcagtggtgctggctgctgttgggagctccactggacttctgtccagagctcctcagctcacctctctgtatccttgccctgtggctcaggcttctaacaatacagaggctggattccaagaggagggaattagaagcgttcagccttcttaagaccaggattcagatgtcccagactgtcactgtattgaccggagcatttacaggccagcctagtaatttttccatcttgggcaggaatgggtggcatatgctgggggtaggggtagcattgttggggatcatctttggagctgtgtgccaaggagtaaattgctcggctgctttctacctgaggaagtccgctatgcttgcttgtggagagtggattgtgtgctcagagtccacaaggatttaagaatccgagccctgctgcccttgcctcagcctgtgcattagggcccggtggtgagagcactgagccattgtgaatcaaggcccctccctcgacctgcatactaacaggccagaagagcttgcttgattttggtcctaggctcctgcctgtgggttggattccaggggcactctctcctccacaaaccagacggtggcaggtacatcccctcaatggaaattgcccacacttcaccctaaagacagatcctgctgttcagcaacaatgtgagtggcccacacatttgtccagcatgaaaccgtttgcagattcctttccagtacacagtcccatcagccggtcacttcacgatgacagctcctcgaagcaccttttggtttgccgttgtgtagcttagaagtaggagcctgcacggcttcaggaattcacagaaggagcacactttgtgcttggagaagttaattataggaatatcctgcaacctgctgctctgagcctgtgcacctggggtgtttccctggaggtcctgtgtatgaggatactcatcagcatggggtttgggaagcctagcactggagacaacctaggtggtcctctccaggggagtaggtaagagccctacagcagtgaaaagcattgaaggaaaagtgtgttcagcagtgctcttaatctgatcagagcagcctgaacacattctaaacacagggcatttagaactagggtagaggcactagagcaccatagatacaaactcagattctgaaggtaaatgcccaggttcaaatccaagccccctcgccaagtgaccacgactcccccgagtcacctgacctctgtgtttacatcctcaaagttaagtagtcaggaaagggggcttggggcttgccacatggatggttgccactctcctttgcaaagtgtagtccccaaaaacaggtggaagagggaagggtccaattagaaggccgagtaccagctgccatgaatatgccagagctgctggctagtgataaataactgaaacccagggggacagcagagcttgggtgaccatacattctaggaaagaaaacatgcctgttgtcctggctttttatccagcttagacaaagatgggcaaagaaaataatttagaaaatggtagagatgggcacagagaaagggcacggagggaggcacaaacagaaggccaagtgatggtggaggcagacattggagaaatgcctttacaagccggggaatgccaaggatgctggcaaccctgggagtgggaagaacctggaacacaccctccgtcagagtctccagaaggaactggcccttcatcacctttcggacttctggcctccagaactgggcaagaaaatgtttctgctgttggaggccatccagctggtggtcatttgttatggttgccacagaaaacgaatatagatttagacatctaatttgcatatatagatatgcatgtgtatttgttaaataaaagataaagcatgacaactcgatggacaacgttacaactcattaaattgtgttggtta

SEQ ID NO: 113339 - DNA, 192 bp, Homo sapiens
tttggtcttaatcttaagagaccatggcagggaaagggactgaggcttctataaaagaaactgacaggtgggaaggatcccacagtccactttacctcctgttagcctcatctcaggagttggctcctacacccaccgccatgtcccgtggtgctgctccagcagggcggccctgtcttgccttcagtgaag

SEQ ID NO: 113340 - DNA, 338 bp, Homo sapiens
tcggccgccgggattccttcggccgccgggattccttcggccgccgggattccttcggccgccgggattccttcggccgccgggattccttcattcttacatggataagctcaatttcattaaatacatctcttagaatataaaatgaacttcaaatattactggacagaaagttcaaatattacaggacaggttaaatgagagccaccaagcagagagtgtgcacctaaaggtggacttgctgccacagagtgctcgcaactgggccagggccaggcgcagacatgggctggttttgaactccacactttgaaggataagactgcagctttgcaaac

SEQ ID NO: 113341 - DNA, 257 bp, Homo sapiens
ggaggctcttcacctgcaatatctaccaggcccacatgttgttctgccgcctctcctacagagcatcttgatcactgtggcctttgtcctcctaccacaatgagcggctcccatggagagacaggcagaaagaggtccctgtaaatcagagagcatgaggggtccaaagaacatacctttcctttggacttggcatatgctggactcaagtttagggtcatagttataaacccaactggctcaaaatacttccccag

SEQ ID NO: 113342 - DNA, 637 bp, Homo sapiens
caagaacttaaattattatagagataaccaaacatataaaacctagaaaactactacaatcaccgctcatatatctactattgaaaaattatcatttctgtctctacaaaaaaatacaaaaattagccaggtgtggtgccatgcatgtgtagtcccaggtacttggaagattgaggtaggaggatggcttgagtcaagaatgtggaggctgcagtgagtcgagatcatgccactgcattctcgcctgggtgatagagtgagactccctgtcaaaaacaaaaactaacatttgaccatatttgattcatctactatctattataaatacttatatactgctatttttgctgaacaatttaaaagtaaatatagataggcatcatgacatttgtcccctaaatacttcaaatggtacagccgtcaaaataaggatatttttctatataaccataatatctttatcacatataacaaagtgaataatacttccctggtattatttaatatccagatatttaaaatatcaaattttactagttttctccacaatggattttatagctagtttctttgaatttgacatgattgaataaaggttcagacattacttttggttgtcatgtcttcatgagtctaa

SEQ ID NO: 113343 - DNA, 372 bp, Homo sapiens
cagtgctctacatcgttagtcatcaggtaaatgcaaattaaaaccacaatggactaccattaccaccaacctactgactggatcaacttaaagactgacactacaaaacatcagagagcaggaggagcaaccagagctcacatgtatacactgccagtgggaatctgtgtgtgtgtgtagagacagggcctcactgttactcaggctacagtgcagtagcgtgatcacaggtcaccgcagcctcgagcttcagggatcaatagatcctctcacctcactttgaaacctttgaaaacgcccattctactcacagctactctactcttagcacaaccaatactaattttcaggtttttaaaatatcactctcca

SEQ ID NO: 113344 - DNA, 190 bp, Homo sapiens
ctgctctactttctggggtgctcttactccacttctaattgtctaacttgcacatcctccgtgacctacctctggacttcaggaacacagagagagttgaaaaattccctggctgaatatagccaagtctactgatgtcagggaagtgttccagggtgggatatagctggagtctgggcttcctacagaa

SEQ ID NO: 113345 - DNA, 462 bp, Homo sapiens
cattctccatgtgatgtgcctgctcctacttcaccttccaccatgattgtaagcttcctgaggcctccctagaagccaaacagatgctggcaccatgcttcctgtaaagccttcagaaccgtgagccaattaaacctcttctctttataaattacccagtctcaagtatgtctttatagcaatgcaagaatggcctaccacagtggtataaagtatggatcaaagttcttgtttttctactgatactcagttgttctggtatcattggttgagtagactatcatttctccagtaattccttttgcatctttgtcaaaaattagttgcccatatatgcatatgtatatgaactcatatttcttggaaacttctctggggatccttcgagggctaggtaaaggcgggctcctccagtaaagattggcatttgcttctgccatgtgcctaataaaatcactttac

SEQ ID NO: 113346 - DNA, 519 bp, Homo sapiens
  misc_feature (11)..(11): n is a, c, g, or t
  misc_feature (15)..(15): n is a, c, g, or t
  misc_feature (19)..(19): n is a, c, g, or t
tccaacggccntagngtgnccgaaacaaattatggtgaaaccccgtctctactacaaatataaaaattagctgggtgtggtgtcaggcgcctgtaatcccagctactcaagaggttgaggcaggagaatcagttgaacctgggaggtggagattgcagtgagccaagatcatgccattgcactccagcctgggtgacaagagcaaaactccatcccccctgcccaaaaaaaaaattaattttcacagaaaattaatagcataggtattattatcctcattttacagagaaagaaacagccatagagaaaaatgacttgctcacaacacaggcaactttgactctagagataacacttattacagtaaaatccctcttcagacacaaaatacatgattatcttaaacacattcttaataaaaatttaacaaaaattgttaaatgttgtcatatatgtgtgtgcaaaacgtataaaatatacagaaaagagaaatacttcctgtatttaaaccatataaac

SEQ ID NO: 113347 - DNA, 411 bp, Homo sapiens
ggcatctggaagaggatagcccagcaataatcactcacagggcttcagtctaaaaagtattctaattgagcaatatagcagatctcttttgcactgtcttaccagctcaagaatggacacagccagtcatgattcttattcttccattacctttcccaccaccacccagctacctggatcaaaaggataagcaactgacccaagatgagccagtgagattgtagcttccagaaatttgaatttaagacaaacaaaaacttgtcttaaccaggaaagagatagactcagtaaccctgggggattggtttcaggaagtccacaggtgccaaaatccacagatgctcaagtcccttatgtaaaacagcatagtatttccaagtaacctatgcacatccttccatatacaggagt

SEQ ID NO: 113348 - DNA, 394 bp, Homo sapiens
gttgacagagagacctggtgagaggtgattggatcatggggccagttttccccaggctgttctcatgatagcaagtgagatctcatgagatctgatggttttataagaggctcttcccccttcgctcctcactgctctctctctcctgctgccatgtgaagaaggtccttgctttccctttgccttctgccatgattgtaagtttcctgaggcctccccagccacatggaactgtgagtaaattaaacctcttttctttataaattagccagtctcaggtatgtctttatcacagtgttaaaacagaccaatacatattctcttgtggctctttctcattaccttccccttttcccaccatacgttaaactccaagagtaggagcagctttcct

SEQ ID NO: 113349 - DNA, 756 bp, Homo sapiens
ttttaaccatgcaagtagagtttgttcctaagctcttacttatttattttttgagacacagtcttgctctgtcgcccaggctggagtgcagtggcgtgatctcggctcactgcaacctctgtctcctggttcaagcgattctccagcctcaacctcccgagtagctgggacaatagggcatgccaccgcatctggctaatttttgtatttttagtagagacagggtttcaccatgttggccaggctggtctcgaactcctcacctcaggtgattgcccgccttggcctcccaaagtgctgggattacaggcgtgagccaccatgcccggcctgtttttttaaattataaaatttcctgatggaattcctaccagttccacttaaagttaaattgtttaatgtgagataatttaaaactctataaagaatttgaaaatgaagatgttccctaataagacctcttttatggtttttagttttttttttttctgaggcggagtctggctctgtcgccactgcactccagactgggtgacagagccagcctccatctcaaaaataaataaataaaatactaataagtattgtaaatattgaagggataagtttcctaatccttcttagagcatctctggaaactagtatactgataagtatatttaggtaaattccagatagcattatagaagggattatgaaaatgttctgagtgctgaaattgaaaggaatatgctgtgaattgtttaaatgtattgg

SEQ ID NO: 113350 - DNA, 803 bp, Homo sapiens
gaaatggcaagacttctcttccgggttgagcaggtatatacacacctgtgcccaaaagtcaagggagctgaggggctgaagaaagaggctgatgagtccagtttctcagaaagaaatatttattagggacttagaagcagtatctcaggcatccatgagatataggatgcatgaatccaccctccagaaaatacctttttagttagcaaatatttagggcaaaggcttgtgcagctggtcatatctcatacttccttgccaaaatcatgaccacgggggaaactaaataagcacctttataaactatgctaccagcattgtttaaagaccttgctgcagaacactttggtttgtaggagtcaaatatcggtcatcatggtggtttcacttcaagatggcatcacccttgccaggcaataggctgttttcctacaacttcctaacttatgcttttttggagcatccgttcgtttgtactattttataaaactctaaaatgtttgcttttattctgctatagcaagctaagtgttattttacacaaattaacttgatttcttcattatatccattgcatggggttggtgtgagaattattcaagaaaactgaacggcacatagtaaacactcaataaatgtcactataattattgcatttattagctttatgctactatggctattattagttttatggtgtttcaggtgttaactaattcacacacatttttatattttttatgcacctttacacaaactaagtagtcaccagggtaccataagtaccccgaaactaaaccaaa

SEQ ID NO: 113351 - DNA, 808 bp, Homo sapiens
ggaagctgtggcttcaggaaacatcagcagtgctgtttctcaccaacgcccgtctctattcctcccttcctcttacaacctttttctttcttcttaaccttttctgtggcatctggtggttttcctgggcccattcggggtagagtagaaatgctgcccaccctgctgagaatgaggccccggaccttgcccagagatgctgcctgcctgctgttgggatgcctcacccaaggaggcctaaagtggcctgtgcctggaggctgagggcagctgtcatttagggagccaaacctggcctctgccctggcctttccctcagaccacgggcatcacatgacttccttagccacttctgtgagattccacagtggccatgatgctgtcctcctcttgatggagtgagtcccggcctgaggctcctgcgtgccccctgcctcggcccgtcgtgttctcccttcccacaaccctctgcgcccccaggtcctcccagaactccctgatgtctccaaggccaccctcaaagggaccctaatcccatggtttattctccagccgctggcatgccccacactgctcttctcaatcagactttacacctccctccggggaagcagccatgtccaggcactgtggtaactggagtagagggtaacatcaggatctttcagacatttgaagtcagcctaaaaaggcacgcacatttggcagccttgttattttagcaataggcagtgttttccttctatctagtttctttctacccataaagtcataatttggcaaattataaacatgatgtcagagtata

SEQ ID NO: 113352 - DNA, 259 bp, Homo sapiens
tataaggacacggatcccattcatgagagctaatcaccccatggcctaatcacctcccaaaggccccacctcctcataccatcaccttgagggttaagatttcaacatatgaacttggggacacagactttcagagcatagcacccccaatttcattccatatccccccaggatcccccatggcaccagccacctcaccctgtgtcacagttgactgccacataacacttgccccagatctggcttactgtacatctca

SEQ ID NO: 113353 - DNA, 644 bp, Homo sapiens
agtagctgggactacaggcatccaccaccatgcccggctaattttttatatttttagtagagatggggtttcaccgtgttagccaggatggtctcgatctcctgacctcatgatccacccacctcggcctcccaaagtgctgggattacagctgtgagccactgcacccggcccaattattctatattatttaactgttaattctaatatctgaaattcttgggagtttaagtttattgtttgttgtgtctgcagattctgtaatatggtggtttgttttcttttatctcttattgtgagctcatgtttaattggccgttcttcaaaggatacctggaaacctacactgaggatgtttaccgccattgaagataaatatgtgtgtgtggggtgtgtgttggggggcagagacatggaactttctggttaagtttggaatgtacagatttaattcctctatctttcagctagtttaaggcttaaatgcctgtttatagtgctaataatggcatttgtcctcaggacaatcctgtcttcttaactatacttaccactcatctccatgagactccaacacaaaataaaaattaatttttattcagaacttaagttgttttgaagcaacagggcccttcagagtttct

SEQ ID NO: 113354 - DNA, 619 bp, Homo sapiens
cctgtgtcctacccaggttattcatttccagctactgctcttcctttgctcatagcacacaacaccagttgttaggtcctggaggaagtaaaaatatgtgtaactatggtccctggctatatgaatcaggatgctctggacaagaattaaattatgaggaaaatttattttatttcataacattagtacgtgagtaggtaagcccaggagtttggtgattcagcaactctgagacctcttaaggggcctgaattctttccatctttcttccttgccattctaattaggtcagctgtgctctcagactgcctgccttcctgctgctgcagtttcaggcatcacacccagagataacattcataaaagaacaggagcatctcttctgtgttttcttctaaggaatgaaggaaccatttcccagaagtccttcaagaatcctcttctaggccgggcacagcggctcacacctataatctcaacactttgggaggccaaggttgggggattgtttgagtccaggagtttaagaccagcctggaacatagcaagaccctgtctctacaaaaaatataaaaaatgagcggggcatggtggctctcgcctgtggttccacctacta

SEQ ID NO: 113355 - DNA, 371 bp, Homo sapiens
gaaagggcagtgcaaagggagaaaaaactgtatcactcacagatgctcagctctgagccgatgtttctgctgccagctgtcctgcattgctgcagactccacttgctcactagtttcttgaccttatgggtttcttcctcactcaggaggcaaagtatttcctctagggaattaaggttctatcaccacctaaatatgtcattggcaagatgttaaaatgagccaaaataaaccatgtgtactccatcactgggagtaatttctctgtgactggagatgttgaaacagagttcatagtgtccacttggaaggattgttgtattatagttggagattacttttcaaggtctttccaacctcaagagattttg

SEQ ID NO: 113356 - DNA, 109 bp, Homo sapiens
aagctgccagcctagagaggaagaccaactccctgagttgcttctaagccatccaggcctgacttaaatgcaggtctctgctgatgtttgtgggaggaacaaagccttt

SEQ ID NO: 113357 - DNA, 985 bp, Homo sapiens
actgtatttgtacacagtcttctaagccatgaccgatctgcccgtgtttcacttaagagagaattaaggaaaatcatccagaattcccactccaaaagcccaagctctgcagccctgcagtgtggttttgctccatctggagagaacctcacacagactcccctgccaaaatgatgtaacatgatgactcagggatgtgagcgtgagaggaaccaacatttagttcttatacccacatatgctgtgtgttgtgtgattaggtttatttaatgaacttaatgcaagctgagaggcttgacaaaacgtccccttttgtggactgaagtagctatctttcagagaaagcatgcagatttagttggtgttaggttgtttatgttgaataaaaatctatttaaagacctggctgaagtgcattcagcctttcactgtctgcacttacaataaaaaagaaagattttattatgcatgacagagatccagattcttagagattgcctctttccctctggtctgtggaatctgccagaagccatctgttaatggatcttggaactggctgtagaaggcagagtaggttcctttgagaactgataggtccaaattattctctatccttgggtgccagatacgttgttccaaataagcattagtttgaatttgtaaagaaaacagctttgtacagtagtcattctacaaatagttttaagcagcattttgtatttatataagacaccatcctgctcgaccttcccctgggcacaaagctcacacctggtttacccttttcagagaggaggtgagtcacggaggtagccataataagtgttagaaaagagtgcctcctgcttcagctgaggaagacatttatcatcctccttttgtcctttaattcacgtctttgacatttggaaagtatttggaaagccaaaactacagaccaaaaattgtgcccttaattgagtgtgattgttaaaaaaaaaaa

SEQ ID NO: 113358 - DNA, 505 bp, Homo sapiens
gaaaattcataggagttcatccctgaatttatgcctgccaaatgcatgttccagcctggccagaaaccccaacaatattaagccctttgtttccaagaaatcacttaaagctttgttccctcacttccccagaataggctttgtgactgtcagggaagctgaagccagaccagcttatttttccttgggagctttcatccaaccattgaaattgtgccttttatttacaaaggtaggctgtgcttacttcacagtttttatattaattacctttcatattcatttacatgtagatagttgtggaaggctgcaaaatggcccctaaagatgtccagatcttaatccctggaacctgttaatgtgttactttccatggcaaaagaactttgcacatgtgattaaggctcttaaagtgagattatcctggattatttgggtagatccaatgtaatcccaagggtctttttttttttttttttcaggatctcatagtaaagtttaagga

SEQ ID NO: 113359 - DNA, 231 bp, Homo sapiens
tttttttaatatctgatgaagttgtttttagggaacactggattgcttttaaagtactttcatcagtatccagagaaagtgtcctggagtagcaccttatatcctcttttctagtttgtcagtttctaactcccattctactatttcaactatattttaaagttttttctcccttttttccagagaacctattaatattgcatcatgtggaatgtatttttcaaaatgacc

SEQ ID NO: 113360 - DNA, 762 bp, Homo sapiens
gtttattctagcagtgcacatttggtttaactgtgatgtaatgttaagggaaaaaatgtcaagacaaatagatgaatcccaactatgtaaaaacaaacaaaaagtaaaactggaaagaaaatgttaatagtggttgtctctggttgacaagattctgggtaattcattttccttcgtgtttatatttgttcgttccagagtttctaaggtgagcatgcatgactttctaagaaggaaaagcaaacaagaaataagggcaagtctacatagataaagatcgtatagtgagacaatgtcttagtgtaacaatccttgtgacatttgaaatttcataccatatctagtaccataccatagtgagccaaaggaaaagttacaccaatacactcctatgtgacttgcttatcggaatttttaccccgtagaaatgaacaatccctccctccgcccctgtcattttttttcattctttaaagtctgtcatcttaaacatacttgaggaactaattcataggtaggaactttatagtggattctgtttcaaaatgttgattccttgttatacaaataaagtggtgtttattagaatcttggtaaatttcttggatatgtaatacttatacatgtaaaaaaaatttcaggtaactaaagtgtctgtagtgaaaatgaagtctctcttcttccatcccctaattccccttccagagacaataattgttcctggtttcttccatatctttccagggatcatctatgtatatg

SEQ ID NO: 113361 - DNA, 529 bp, Homo sapiens
cccagagccaatgcctgccccttcttcccaaatactggcctcaggcttccttgactgagagcactttcctttccaagcactttgggctttccaggcagagagaaacaaacaacgcatggacccagtgcccacccaggtcagtggctgttcagcacaacacagcagaagggcagctccatctgcggggacttcatcatgtttgacttgcacagttgtggtcggtgccagatcacagtaagaagactggtattcttctgttacaggcacactaatgcatcatccttccaccactaaagtaaatcttagcaatcaagtttctttccagatactgtctaaactaaaacctagagggctaccactgttcaggtgctatgctgggatatgcttgtgacagcagcattgttgtctctttcaggagctagtgtggactctctcagtgtcatcgagaacgcaccactgcactccagcccaggagacagtgcgaaacaccgtgtcaaaaaaaaaaaaaaaaaagaatcagagaaatgta

SEQ ID NO: 113362 - DNA, 258 bp, Homo sapiens
cccgtctttaactcaactaaggaaaagtcctcaacatttttggtgcgcaacgtgggggctcgagaagtgaaaccatagatgtaaaggtgaagagtgtcggcaaatacactttctgccatgtggaaaaagctggcctgcagtgaaagggagaaatacagcagacacacatggagactctgaggcaagaaacaaagacctttcaagaagtattaaggaagccagatctcatgccttacagcacagtgggaagaaccactg

SEQ ID NO: 113363 - DNA, 379 bp, Homo sapiens
gctagtctagaggtcccgagatcttcttagaggattagatgaagtgatctggtcagttactttcaggagcttgtgacgttcatgcggttatgaaaaagtggttgacagagaagaacaaggttcatttccctctgtctgcggcctcatgagtagttttatcctttggaggaacagcagggctagaaagccagagagacaggggctctggccctttctgatgctgtttttcagcacctgctttccaaattttcagtcatcatttcctgtgacatttgttctttcataagaataacaacctcatgtgttcattttattttcactttactaattcatcaccacgtagttaacttaccatggtagaaaaacgagaagcggcgaa

SEQ ID NO: 113364 - DNA, 706 bp, Homo sapiens
  misc_feature (236)..(236): n is a, c, g, or t
  misc_feature (252)..(252): n is a, c, g, or t
  misc_feature (264)..(264): n is a, c, g, or t
  misc_feature (275)..(276): n is a, c, g, or t
  misc_feature (294)..(294): n is a, c, g, or t
  misc_feature (305)..(305): n is a, c, g, or t
  misc_feature (308)..(308): n is a, c, g, or t
  misc_feature (316)..(316): n is a, c, g, or t
  misc_feature (324)..(324): n is a, c, g, or t
  misc_feature (329)..(331): n is a, c, g, or t
  misc_feature (346)..(347): n is a, c, g, or t
  misc_feature (349)..(350): n is a, c, g, or t
  misc_feature (354)..(354): n is a, c, g, or t
  misc_feature (356)..(356): n is a, c, g, or t
  misc_feature (360)..(360): n is a, c, g, or t
  misc_feature (387)..(387): n is a, c, g, or t
aggtgccgtgcccgtcctccctgcccacgcaggtgctcagagggacaggtgggccaggactcctccatgtggggacgaggcaccctcctccccagccacgccccaaccacccctggccccccaccccacccccaaggggcctcccagcgcccaggaccgtgtctgggaaaaggtctttgcccggagagtgggaagagagaggggagggtgagcagaggacaggccgggagtttttnggaaaggaaaaaaaanaataaaaaaaanaaaaaaaaaannttgcacaagctggaatanaatggaaaaanaanaaattaanaaaagatnaaaannntgggctaaaaaaatnntnncaantnaacntctaaaataaatgggaacaaaaatgcnaaaataaaggatgaggctgctgtgtggcctgtggctgtggctctccttgctgaaagtcctgcaggcccagaccccaacccccctgccactcccgcccccgatgcagagcttccaaggaaaccagttccagggggaatggttcgtcctgggcctggcgggcaacagcttcaggccggagcacagggcgctgctgaacgctttcaccgcaacttttgagctaagtgatgatggccgctttgaggtgtggaatgcgatgactcggtgagtggctgtccctgccgttccaagcgggtgaggaggatcccgggcctgggtccca

SEQ ID NO: 113365 - DNA, 1717 bp, Homo sapiens
aggtgccgtgcccgtcctccctgcccacgcaggtgctcagagggacaggtgggccaggactcctccatgtggggacgaggcaccctcctccccagccacgccccaaccacccctggccccccaccccacccccaaggggcctcccagcgcccaggaccgtgtctgggaaaaggtctttgcccggagagtgggaagagagaggggagggtgagcagaggacaggccgggagttttccgggaacggaggaagagcagtggaggagatgagatctcagtcttgcccaggctggagtccagtggcacaatcatagcttactgcaggctcaaactcctgggctaaagcaatcctcccacctcagcctctcaagtagctgggaccacagggatgaggctgctgtgtggcctgtggctgtggctctccttgctgaaagtcctgcaggcccagaccccaacccccctgccactcccgcccccgatgcagagcttccaaggaaaccagttccagggggaatggttcgtcctgggcctggcgggcaacagcttcaggccggagcacagggcgctgctgaacgctttcaccgcaacttttgagctaagtgatgatggccgctttgaggtgtggaatgcgatgactcgaggccagcactgtgacacatggtcttatgtgctgataccggcagcccagcctgggcagttcactgtggaccacggtgtggagcccggggcggacagagaggagacccgggtggtggacagcgactacacccagttcgccctgatgctgtcccgcagacacacgagcaggctggccgtcctcaggatcagcctgctgggcaggagctggttgctgcctcccgggacgctggaccagttcatctgcctgggcagagctcagggcctctcggatgacaacattgtcttcccagatgtgactggaggtgccctggacctcagcagcctgccctgggtggcagccccagcctgaccactcagacagccgcggcccccaaggcctgactcttcttgtgggagggcgaggtcagcctgagtccctcctcttcctggagggatgcccaccgtgcccttctgattcccgcctctggtcctttacatgtgcataaccacatgcacacacactcacgcatgagcaaacgtgtacagactggcacatgcctccacatgcgaacacccacttacacacacgccactcacactggcacacatgctgtctacccgtgcacaggcacacgtgctggtctgcacacacctgcacacacctgcacactcgctatgccaggcctcctgggtctgcagtgagtctgggggcccatggggacagggacaggtgaggggcttcctgaggacctggggctgttgggagccgctgtgggccacatcttctgccccttctcagcctccctcaccccagccccttcccctagacccactgctggtcccctttctccctcctgcttctcacctgaagccacctgcccctcctttgtgccctcccttgcttcctcctgggctctgtcccctgctccccctttgtcctccatcccgactccatctcccccaccaggctggtcaccccaggccagcgtctgttgaaggatgaagcagctcctgtccggcccagccctgcctcacagctgtgcgagctctgccctcctcagctctcaaacctgaataaatgcaccaagcccagaaaaaaaaa

SEQ ID NO: 113366 - DNA, 1772 bp, Homo sapiens
atcccagcacttccggggctgggcgcgctggctcacacctgtaatcccaggacttcaggggccgggcgcgctggctcacacctgtaatcctagcactttgggggccgggcgcggtcgcgcacacctgtaatcctagcactttgggggccgggcgcggtggcgcacacctgtaatcccagcactttaggggccgggcgcagtggcgcacacctgtaatcccagtacttcaggaggcagaggcagaaggatcacttgaactcaggagtttgagaccagcctgagcaacatagttagacaccatctccactcatgacgcttggccactcccgccgtgggtccctctgaataagtggctgaaatctcctgaggggcccacctcagcatggacctgccagcttccggagccttccgcctccacctgtcccctcctacagaggccagcactgtgacacatggtcttatgtgctgataccggcagcccagcctgggcagttcactgtggaccacggtgtgggtaagccagtcacaggagggagggacggggtgctggcccacagggatgtgacgtctgtgccgcctcagagcccggggcggacagagaggagacccgggtggtggacagcgactacacccagttcgccctgatgctgtcccgcagacacacgagcaggctggccgtcctcaggatcagcctgctgggtgagcctcccaccccgtcctgggcccgtgtgtggccctggaggcacctccttccaggctttgggtcagaccctgcctccccaccccgcctggagtgacttgggggtacagatagttcaatctcccacctacccagcccccaaccccctgccaagtgcacagacccatgctgggctccctgggctgcaggcaggagctggttgctgcctcccgggacgctggaccagttcatctgcctgggcagagctcagggcctctcggatgacaacattgtcttcccagatgtgactggaggtgccctggacctcagcagcctgccctgggtggcagccccagcctgaccactcagacagccgcggcccccaaggcctgactcttcttgtgggagggcgaggtcagcctgagtccctcctcttcctggagggatgcccaccgtgcccttctgattcccgcctctggtcctttacatgtgcataaccacatgcacacacactcacgcatgagcaaacgtgtacagactggcacatgcctccacatgcgaacacccacttacacacacgccactcacactggcacacatgctgtctacccgtgcacaggcacacgtgctggtctgcacacacctgcacacacctgcacactcgctatgccaggcctcctgggtctgcagtgagtctgggggcccatggggacagggacaggtgaggggcttcctgaggacctggggctgttgggagccgctgtgggccacatcttctgccccttctcagcctccctcaccccagccccttcccctagacccactgctggtcccctttctccctcctgcttctcacctgaagccacctgcccctcctttgtgccctcccttgcttcctcctgggctctgtcccctgctccccctttgtcctccatcccgactccatctcccccaccaggctggtcaccccaggccagcgtctgttgaaggatgaagcagctcctgtccggcccagccctgcctcacagctgtgcgagctctgccctcctcagctctcaaacctgaataaatgcaccaagcccagaaaaaaaaa

SEQ ID NO: 113367 - DNA, 1056 bp, Homo sapiens
aggtgccgtgcccgtcctccctgcccacgcaggtgctcagagggacaggtgggccaggactcctccatgtggggacgaggcaccctcctccccagccacgccccaaccacccctggccccccaccccacccccaaggggcctcccagcgcccaggaccgtgtctgggaaaaggtctttgcccggagagtgggaagagagaggggagggtgagcagaggacaggccgggagttttccgggaacggaggaagagcagtggaggagatgagatctcagtcttgcccaggctggagtccagtggcacaatcatagcttactgcaggctcaaactcctgggctaaagcaatcctcccacctcagcctctcaagtagctgggaccacagggatgaggctgctgtgtggcctgtggctgtggctctccttgctgaaagtcctgcaggcccagaccccaacccccctgccactcccgcccccgatgcagagcttccaaggaaaccagttccagggggaatggttcgtcctgggcctggcgggcaacagcttcaggccggagcacagggcgctgctgaacgctttcaccgcaacttttgagctaagtgatgatggccgctttgaggtgtggaatgcgatgactcgaggccagcactgtgacacatggtcttatgtgctgataccggcagcccagcctgggcagttcactgtggaccacggtgtgggcaggagctggttgctgcctcccgggacgctggaccagttcatctgcctgggcagagctcagggcctctcggatgacaacattgtcttcccagatgtgactggaggtgccctggacctcagcagcctgccctgggtggcagccccagcctgaccactcagacagccgcggcccccaaggcctgactcttcttgtgggagggcgaggctggtcaccccaggccagcgtctgttgaaggatgaagcagctcctgtccggcccagccctgcctcacagctgtgcgagctctgccctcctcagctctcaaacctgaataaatgcaccaagcccagaaaaaaaaa

SEQ ID NO: 113368 - DNA, 1228 bp, Homo sapiens
atcccagcacttccggggctgggcgcgctggctcacacctgtaatcccaggacttcaggggccgggcgcgctggctcacacctgtaatcctagcactttgggggccgggcgcggtcgcgcacacctgtaatcctagcactttgggggccgggcgcggtggcgcacacctgtaatcccagcactttaggggccgggcgcagtggcgcacacctgtaatcccagtacttcaggaggcagaggcagaaggatcacttgaactcaggagtttgagaccagcctgagcaacatagttagacaccatctccactcatgacgcttggccactcccgccgtgggtccctctgaataagtggctgaaatctcctgaggggcccacctcagcatggacctgccagcttccggagccttccgcctccacctgtcccctcctacagaggccagcactgtgacacatggtcttatgtgctgataccggcagcccagcctgggcagttcactgtggaccacggtgtgggtaagccagtcacaggagggagggacggggtgctggcccacagggatgtgacgtctgtgccgcctcagagcccggggcggacagagaggagacccgggtggtggacagcgactacacccagttcgccctgatgctgtcccgcagacacacgagcaggctggccgtcctcaggatcagcctgctgggtgagcctcccaccccgtcctgggcccgtgtgtggccctggaggcacctccttccaggctttgggtcagaccctgcctccccaccccgcctggagtgacttgggggtacagatagttcaatctcccacctacccagcccccaaccccctgccaagtgcacagacccatgctgggctccctgggctgcaggcaggagctggttgctgcctcccgggacgctggaccagttcatctgcctgggcagagctcagggcctctcggatgacaacattgtcttcccagatgtgactggaggtgccctggacctcagcagcctgccctgggtggcagccccagcctgaccactcagacagccgcggcccccaaggcctgactcttcttgtgggagggcgaggctggtcaccccaggccagcgtctgttgaaggatgaagcagctcctgtccggcccagccctgcctcacagctgtgcgagctctgccctcctcagctctcaaacctgaataaatgcaccaagcccagaaaaaaaaa

SEQ ID NO: 113369 - DNA, 1173 bp, Homo sapiens
aggtgccgtgcccgtcctccctgcccacgcaggtgctcagagggacaggtgggccaggactcctccatgtggggacgaggcaccctcctccccagccacgccccaaccacccctggccccccaccccacccccaaggggcctcccagcgcccaggaccgtgtctgggaaaaggtctttgcccggagagtgggaagagagaggggagggtgagcagaggacaggccgggagttttccgggaacggaggaagagcagtggaggagatgagatctcagtcttgcccaggctggagtccagtggcacaatcatagcttactgcaggctcaaactcctgggctaaagcaatcctcccacctcagcctctcaagtagctgggaccacagggatgaggctgctgtgtggcctgtggctgtggctctccttgctgaaagtcctgcaggcccagaccccaacccccctgccactcccgcccccgatgcagagcttccaaggaaaccagttccagggggaatggttcgtcctgggcctggcgggcaacagcttcaggccggagcacagggcgctgctgaacgctttcaccgcaacttttgagctaagtgatgatggccgctttgaggtgtggaatgcgatgactcgaggccagcactgtgacacatggtcttatgtgctgataccggcagcccagcctgggcagttcactgtggaccacggtgtggagcccggggcggacagagaggagacccgggtggtggacagcgactacacccagttcgccctgatgctgtcccgcagacacacgagcaggctggccgtcctcaggatcagcctgctgggcaggagctggttgctgcctcccgggacgctggaccagttcatctgcctgggcagagctcagggcctctcggatgacaacattgtcttcccagatgtgactggaggtgccctggacctcagcagcctgccctgggtggcagccccagcctgaccactcagacagccgcggcccccaaggcctgactcttcttgtgggagggcgaggctggtcaccccaggccagcgtctgttgaaggatgaagcagctcctgtccggcccagccctgcctcacagctgtgcgagctctgccctcctcagctctcaaacctgaataaatgcaccaagcccagaaaaaaaaa

SEQ ID NO: 113370 - DNA, 994 bp, Homo sapiens
aggtgccgtgcccgtcctccctgcccacgcaggtgctcagagggacaggtgggccaggactcctccatgtggggacgaggcaccctcctccccagccacgccccaaccacccctggccccccaccccacccccaaggggcctcccagcgcccaggaccgtgtctgggaaaaggtctttgcccggagagtgggaagagagaggggagggtgagcagaggacaggccgggagttttccgggaacggaggaagagcagtggaggagatgagatctcagtcttgcccaggctggagtccagtggcacaatcatagcttactgcaggctcaaactcctgggctaaagcaatcctcccacctcagcctctcaagtagctgggaccacagggatgaggctgctgtgtggcctgtggctgtggctctccttgctgaaagtcctgcaggcccagaccccaacccccctgccactcccgcccccgatgcagagcttccaaggaaaccagttccagggggaatggttcgtcctgggcctggcgggcaacagcttcaggccggagcacagggcgctgctgaacgctttcaccgcaacttttgagctaagtgatgatggccgctttgaggtgtggaatgcgatgactcgaggccagcactgtgacacatggtcttatgtgctgataccggcagcccagcctgggcagttcactgtggaccacggtgtggacacacgagcaggctggccgtcctcaggatcagcctgctgggcaggagctggttgctgcctcccgggacgctggaccagttcatctgcctgggcagagctcagggcctctcggatgacaacattgtcttcccagatgtgactggctggtcaccccaggccagcgtctgttgaaggatgaagcagctcctgtccggcccagccctgcctcacagctgtgcgagctctgccctcctcagctctcaaacctgaataaatgcaccaagcccagaaaaaaaaa

SEQ ID NO: 113371 - DNA, 1600 bp, Homo sapiens
aggtgccgtgcccgtcctccctgcccacgcaggtgctcagagggacaggtgggccaggactcctccatgtggggacgaggcaccctcctccccagccacgccccaaccacccctggccccccaccccacccccaaggggcctcccagcgcccaggaccgtgtctgggaaaaggtctttgcccggagagtgggaagagagaggggagggtgagcagaggacaggccgggagttttccgggaacggaggaagagcagtggaggagatgagatctcagtcttgcccaggctggagtccagtggcacaatcatagcttactgcaggctcaaactcctgggctaaagcaatcctcccacctcagcctctcaagtagctgggaccacagggatgaggctgctgtgtggcctgtggctgtggctctccttgctgaaagtcctgcaggcccagaccccaacccccctgccactcccgcccccgatgcagagcttccaaggaaaccagttccagggggaatggttcgtcctgggcctggcgggcaacagcttcaggccggagcacagggcgctgctgaacgctttcaccgcaacttttgagctaagtgatgatggccgctttgaggtgtggaatgcgatgactcgaggccagcactgtgacacatggtcttatgtgctgataccggcagcccagcctgggcagttcactgtggaccacggtgtgggcaggagctggttgctgcctcccgggacgctggaccagttcatctgcctgggcagagctcagggcctctcggatgacaacattgtcttcccagatgtgactggaggtgccctggacctcagcagcctgccctgggtggcagccccagcctgaccactcagacagccgcggcccccaaggcctgactcttcttgtgggagggcgaggtcagcctgagtccctcctcttcctggagggatgcccaccgtgcccttctgattcccgcctctggtcctttacatgtgcataaccacatgcacacacactcacgcatgagcaaacgtgtacagactggcacatgcctccacatgcgaacacccacttacacacacgccactcacactggcacacatgctgtctacccgtgcacaggcacacgtgctggtctgcacacacctgcacacacctgcacactcgctatgccaggcctcctgggtctgcagtgagtctgggggcccatggggacagggacaggtgaggggcttcctgaggacctggggctgttgggagccgctgtgggccacatcttctgccccttctcagcctccctcaccccagccccttcccctagacccactgctggtcccctttctccctcctgcttctcacctgaagccacctgcccctcctttgtgccctcccttgcttcctcctgggctctgtcccctgctccccctttgtcctccatcccgactccatctcccccaccaggctggtcaccccaggccagcgtctgttgaaggatgaagcagctcctgtccggcccagccctgcctcacagctgtgcgagctctgccctcctcagctctcaaacctgaataaatgcaccaagcccagaaaaaaaaa

SEQ ID NO: 113372 - DNA, 1097 bp, Homo sapiens
aggtgccgtgcccgtcctccctgcccacgcaggtgctcagagggacaggtgggccaggactcctccatgtggggacgaggcaccctcctccccagccacgccccaaccacccctggccccccaccccacccccaaggggcctcccagcgcccaggaccgtgtctgggaaaaggtctttgcccggagagtgggaagagagaggggagggtgagcagaggacaggccgggagttttccgggaacggaggaagagcagtggaggagatgagatctcagtcttgcccaggctggagtccagtggcacaatcatagcttactgcaggctcaaactcctgggctaaagcaatcctcccacctcagcctctcaagtagctgggaccacagggatgaggctgctgtgtggcctgtggctgtggctctccttgctgaaagtcctgcaggcccagaccccaacccccctgccactcccgcccccgatgcagagcttccaaggaaaccagttccagggggaatggttcgtcctgggcctggcgggcaacagcttcaggccggagcacagggcgctgctgaacgctttcaccgcaacttttgagctaagtgatgatggccgctttgaggtgtggaatgcgatgactcgaggccagcactgtgacacatggtcttatgtgctgataccggcagcccagcctgggcagttcactgtggaccacggtgtggacacacgagcaggctggccgtcctcaggatcagcctgctgggcaggagctggttgctgcctcccgggacgctggaccagttcatctgcctgggcagagctcagggcctctcggatgacaacattgtcttcccagatgtgactggaggtgccctggacctcagcagcctgccctgggtggcagccccagcctgaccactcagacagccgcggcccccaaggcctgactcttcttgtgggagggcgaggctggtcaccccaggccagcgtctgttgaaggatgaagcagctcctgtccggcccagccctgcctcacagctgtgcgagctctgccctcctcagctctcaaacctgaataaatgcaccaagcccagaaaaaaaaa

SEQ ID NO: 113373 - DNA, 664 bp, Homo sapiens
gtccctgtgggcccagcagctgccaggatgaggctgctgtgtggcctgtggctgtggctctccttgctgaaagtcctgcaggcccagaccccaacccccctgccactcccgcccccgatgcagagcttccaaggaaaccagttccagggggaatggttcgtcctgggcctggcgggcaacagcttcaggccggagcacagggcgctgctgaacgctttcaccgcaacttttgagctaagtgatgatggccgctttgaggtgtggaatgcgatgactcgaggccagcactgtgacacatggtcttatgtgctgataccggcagcccagcctgggcagttcactgtggaccacggtgtgggcaggagctggttgctgcctcccgggacgctggaccagttcatctgcctgggcagagctcagggcctctcggatgacaacattgtcttcccagatgtgactggtaacatggttcacctgcaggcatgctgggcagtaggcacggggcccgcaggaatgagtttggttgaccctagaggagctggacccagtgtctacccagggagctcagccccagcctgcgctcaggggtctccaggctcctgggtccctgtgctcaaaccaggctctgagccacctcctgccgccccgggtcccctgtcctggg

SEQ ID NO: 113374 - DNA, 813 bp, Homo sapiens
tctgtgcgtgaggggaaacaggctcgggaaggccgcacagccactggccagggtcaccatgtccctgccagacccagattccagggggaatggttcgtcctgggcctggcgggcaacagcttcaggccggagcacagggcgctgctgaacgctttcaccgcaacttttgagctaagtgatgatggccgctttgaggtgtggaatgcgatgactcgtacttcaggaggcagaggcagaaggatcacttgaactcaggagtttgagaccagcctgagcaacatagttagacaccatctccactcatgacgcttggccactcccgccgtgggtccctctgaataagtggctgaaatctcctgaggggcccacctcagcatggacctgccagcttccggagccttccgcctccacctgtcccctcctacagaggccagcactgtgacacatggtcttatgtgctgataccggcagcccagcctgggcagttcactgtggaccacggtgtgggcaggagctggttgctgcctcccgggacgctggaccagttcatctgcctgggcagagctcagggcctctcggatgacaacattgtcttcccagatgtgactggtaacatggttcacctgcaggcatgctgggcagtaggcacggggcccgcaggaatgagtttggttgaccctagaggagctggacccagtgtctacccagggagctcagccccagcctgcgctcaggggtctccaggctcctgggtccctgtgctcaaaccaggctctgagccacctcctgccgccccgggtcccctgtcctggg

SEQ ID NO: 113375 - DNA, 1769 bp, Homo sapiens
  misc_feature (1264)..(1264): n is a, c, g, or t
  misc_feature (1271)..(1271): n is a, c, g, or t
  misc_feature (1422)..(1422): n is a, c, g, or t
  misc_feature (1488)..(1488): n is a, c, g, or t
  misc_feature (1495)..(1495): n is a, c, g, or t
gaattacgcatcaaatttgattctcagagcaataaattatccatgaagtgctctcgttctcagtagcggcatcatggccagtagtgtctttgaggagttcaccacttagattactgagtaattgtggtttccacatttgaaaacaactccttttataattattcactgctttttgtcagtgaaatagacatcttgcctcctgaagtagcttcatcacagagtgtcatgaagacagacagtcaggctgaaatggacagttctttgtggactctacccttcccttcaaggagtatgtcatatatcacaaaagaaattgccttacactggttcatgtttgcagttactgttgtacattgcatagatgtacacacgaatttaaatgtgatgtctttgtatatatctgtataatgttgagattacttacgaaatatgtctgagtgacacttttcacccttgtacagccaaaataatgtatatatggaaagtgacagacaaattctctaatctctttggtacctataacttattagaatcctctggatgagggttagaagagactttttccaaacttctacatgtagaagtatcataaatgtgctacacatttatgtttgtggatttaattaaagtattttaatatggttttcagtgctaaaattggagtcagatacttcttggttttaagctgtctacctaattgctgtctcccagcagactggtggcatgcccagtggctttgggggcaaggatagaaatgccatcaggaaatagctgaattcattgtgaaacatgaattcagtcatggtgataattggaaactcctttcaggtttttgcaagtagattttgtaatgtttgtgtatgcagccttgctgttgagtcagtccaaggggttttacttaggacaagttgtaccttgccctctctccagctctgctcccacattttcacatacctagctgtttctacctcattgggtaagtcatttaccactctgtgcctcagtttactctgtagtttaccattagactgtgagctccttgagggactttgtcataatcactgttacatcccagtgcctcacaccatgcctggcccttaagaagtgctcaataaatgtctgaacaaataagtgagtggagtgagtgaattgtaagatcagaataataatatttggttgtctatcgtacaagattcctgtatcgttgaatattgcttttaaagaaatatttgaagcgacttcaaattcagactgtgtttaaaangatttanaatcggaatccaaaatcaaagtattaaaaaataatgctgagtgtttaggattcacatacctctgagctctggtggctttgccagtcctgtccctctgctgagcaccagcccttcctgcagcagtcctgccggtgtgttctgtgcacctggngatgaagtgtgctcctcccccagcggttagcctcaatgcttttcctccctctgttttattatttgnaattagncaagaaaagcctgctgggcgggcacctgctgactcatcaactggacctggtggggtccgtacccgtccttgccacgaataggggaaataccgcgcaggcacgagccacagccctaggggtaaaaacttcacggttgcgaccttgctcgccgcaaacgccaccagttgcagcagcgccgaccgcgcggcatggaacgtccggtgcgccagacggcaaacagccgcagccggtggctactacgtccggcgcgcttttccgccacatgccgcagctt

SEQ ID NO: 113376 - DNA, 1987 bp, Homo sapiens
  misc_feature (1482)..(1482): n is a, c, g, or t
  misc_feature (1489)..(1489): n is a, c, g, or t
  misc_feature (1640)..(1640): n is a, c, g, or t
  misc_feature (1706)..(1706): n is a, c, g, or t
  misc_feature (1713)..(1713): n is a, c, g, or t
cagaagcttcttcatgaactctgcgaattcgctcctcgggaacggcctgtaagatgaacatggtcactcaacctgataggtccatagagatagtctctggaggatctatgaccatagtggctgtggatttgtcacactaatttgtatcagcgcggtcggcaggcgaagtcgtttctcgagcggaaatctcagcagtggtacgtacttgagagttcattaacatggaatctatctaatccgagtagatcgctagcgtcgtacgcttcgtaacaatcaacagtgtacggcatcatggccagtagtgtctttgaggagttcaccacttagattactgagtaattgtggtttccacatttgaaaacaactccttttataattattcactgctttttgtcagtgaaatagacatcttgcctcctgaagtagcttcatcacagagtgtcatgaagacagacagtcaggctgaaatggacagttctttgtggactctacccttcccttcaaggagtatgtcatatatcacaaaagaaattgccttacactggttcatgtttgcagttactgttgtacattgcatagatgtacacacgaatttaaatgtgatgtctttgtatatatctgtataatgttgagattacttacgaaatatgtctgagtgacacttttcacccttgtacagccaaaataatgtatatatggaaagtgacagacaaattctctaatctctttggtacctataacttattagaatcctctggatgagggttagaagagactttttccaaacttctacatgtagaagtatcataaatgtgctacacatttatgtttgtggatttaattaaagtattttaatatggttttcagtgctaaaattggagtcagatacttcttggttttaagctgtctacctaattgctgtctcccagcagactggtggcatgcccagtggctttgggggcaaggatagaaatgccatcaggaaatagctgaattcattgtgaaacatgaattcagtcatggtgataattggaaactcctttcaggtttttgcaagtagattttgtaatgtttgtgtatgcagccttgctgttgagtcagtccaaggggttttacttaggacaagttgtaccttgccctctctccagctctgctcccacattttcacatacctagctgtttctacctcattgggtaagtcatttaccactctgtgcctcagtttactctgtagtttaccattagactgtgagctccttgagggactttgtcataatcactgttacatcccagtgcctcacaccatgcctggcccttaagaagtgctcaataaatgtctgaacaaataagtgagtggagtgagtgaattgtaagatcagaataataatatttggttgtctatcgtacaagattcctgtatcgttgaatattgcttttaaagaaatatttgaagcgacttcaaattcagactgtgtttaaaangatttanaatcggaatccaaaatcaaagtattaaaaaataatgctgagtgtttaggattcacatacctctgagctctggtggctttgccagtcctgtccctctgctgagcaccagcccttcctgcagcagtcctgccggtgtgttctgtgcacctggngatgaagtgtgctcctcccccagcggttagcctcaatgcttttcctccctctgttttattatttgnaattagncaagaaaagcctgctgggcgggcacctgctgactcatcaactggacctggtggggtccgtacccgtccttgccacgaataggggaaataccgcgcaggcacgagccacagccctaggggtaaaaacttcacggttgcgaccttgctcgccgcaaacgccaccagttgcagcagcgccgaccgcgcggcatggaacgtccggtgcgccagacggcaaacagccgcagccggtggctactacgtccggcgcgcttttccgccacatgccgcagctt

SEQ ID NO: 113377 - DNA, 328 bp, Homo sapiens
tcaagagaatgggaaaactttattagttaataaagaaggaaggattcagttatgctttagctggaggtttttggtatggggaagctgaagataagctagctaccacgttagtgtgagcagcacatttggctttcttgattgatcctaagttggaagtggaaagaaacatgaaaaaagttttctgtcattgaccaagtccgaccttttttgctctcgattgttgcagaggttgtggtttagttccctggatttttttttgtaggttttttttgctctatcgtcctgtttggtgtggtggttttccaatatatattcagtccttcagatt

SEQ ID NO: 113378 - DNA, 451 bp, Homo sapiens
gacttaactgtctgtggatttcacattggcgatttcccatcttctccagggtccctggagaacattgagagggttttcccgttttggatgaagtgtgaataggaatccatggaccagagagcggccttggaagccatgttcactcagccccaggtggtcttcccagactttgttcataacagagaccaagacgtgcatccatgtttagcctgagcagaaaaagttgccccaaaccagctgatgtgctgggtaaatgttggcctaagcatgcttgtgtttttagtgatttgaaacgtaaaggcagcccactgacattttttaaagctttgcataattggtttttaattgtggctctttggaatagcattggccttcttccccctgactcagatgctttttttgtctcatacttgtttggcagagaggtccaatctgtcctctcttggaacag

SEQ ID NO: 113379 - DNA, 324 bp, Homo sapiens
tctctccttgtcttaacatgtaatgtcctaccatgtaataacatgtataacatgttacaataacaatggctaatgctaagtgctaacgctaaagttccttctaagcagtccgtgtatgatctcattaactcctcagagcaaatctatgaagtaggtacataggcgcagaaagatgtcgttagcccagagtaatgtgttgacagattggaaacccacataatttgtctctagggcctctgctcttcaccaaacctcctagctatcaagtaaagacaaagggaaaaatcttcaaatacttcctcttgtcttaaagggataattttg

SEQ ID NO: 113380 - DNA, 905 bp, Homo sapiens
gcacataatttttatttctaaaagttcccctctttcttgtcttgtgataaaactagtgtaacaaaaaaacaaaaacaaaaaacacaataacaaaaaaaatcctgccaaagcctgtttgtgaatattactccattccattataaattacaagattttctgtgactttttctggttaataaggagaaaagttatatcccagtaaagacacgaaagcttcaggtaattaaaagctctactaagtaatgaaaagctaatcctgtagtgaagacgtgtgggctgaaagaagatgaggtgttaaatatgcaaactaaatgtctatttattgctaatacagccctcacaagaacaaatcggatgccatgacaagtgttcttatcaacaacatttgttttcttcaagagaattgaaaagctaaaacatggacttctgcctggccacacacaaagcacagccccctcctaagaacccagaatgggaaagaaagctctagaagcaaagtacatggccactgaaagccacatacatgctaatgaggtcacgctgggcaaggtgacatcgcagctgcagagccttgttagaagtatgtgacatctacaagcacacctggacaacccactcatttggaagtaggctttattcggtcaggagtctctgaacgactttccagtctaagcattcaaaatgaaggcacaaaagaggttaaaaccacttaacccagttgtaacaagggaatttgtaccagaatttaagattacaacctggatgagatcaaaacccttaggcttccaaagggacttcacaacctttccagggttctgtggatgctacctgttaacacggtttacaatgcctcaccaataaggagagatgggtggggcaggtgaacaaggctacccagtccatgc

SEQ ID NO: 113381 - DNA, 579 bp, Homo sapiens
cttctgagcctcaattcctatatctataaaatggccatataccaactcatagtgtcattataaagatttaaagactcaccagttgtcacatgtcctcccacatcatagaccatgtggatgcttaatgagcagtggctaataaataccacttgcagtccagggcaagaagggcaattagaaaatgaattcgaggttcactttgcttctagtctatagactatttgcgggtggtatgtggcactaatgaatataaatgggtttgatcgttcactcgcattattgaatatttcatgcacctttacgcatggaatagtatgaactgatacacataaaatgactaaggtgattattctccacactagaggcaaacagaatcctgatttatgcagttcctcgttgttcctttcagttttgacccatggcaataagtgggaaatagattcacccaactcactccaaattctttataatttctttcaaagacagagattgctacattaagtatagttgtccctttaaaggaatatgggcagaaaaggcaaaagtcagattaaggggaaatagaagttgtataagtat

SEQ ID NO: 113382 - DNA, 202 bp, Homo sapiens
tgtagaccaatgtattcatctcataaatgtgcaaagagatgcttagaactgttaaatgacttgcccatgttggcatagctgataagaggcagagttaggacttcacacggttcttctgactccaagtccaaagctctctccataacatcgacgtgcctcattgcctttgggttatgcatattgtggcatttatagaaatgtc

SEQ ID NO: 113383 - DNA, 369 bp, Homo sapiens
tcacaagaactgcatctggattaagacatattagccctggctaagcagggtgactcacacctataatcccaagatttttggagtctgaggcaagagaatcacttgagcccatgagtttgaaaccagcctgggcaacatagtgagaccccatctgtataaaaaaatttttttaattagcctggtatggtagcatatgccggtagccctagccacacaagatgatcctcctgcctcagcctctgcagtagctaggactacaggcacatatccctgtgcctggctagtaaataggttgaaataacttaaagttatttatttttatttatttattttttgagactgagtctcactgttgtcctggctggatgg

SEQ ID NO: 113384 - DNA, 165 bp, Homo sapiens
ctcaccaactccaattggttcaaagatttaaacacagatcttgaaatcataaaagtactaagacaatatattagagtttttttatattttatatataaattaattatatattttacattttattttgtatattttattatatatatttatataaatttatatttt

SEQ ID NO: 113385 - DNA, 534 bp, Homo sapiens
ctgccctgcaaggaaaacctggctctgccctggtgtcctggcctccctgggcatatgtgggggagaattcctaatggtattggttacaggctcctatgcgagaccactcatctgtgtaggagaaaggaaaaagatgggggaaagaagagcagcagggagaggagaagcctctggatgatactctaaccccctgccatccaacacctgaacatcagtctcttcatccagtgctctcagctggcccagcccccagcctggggtcagatgagagcttcctgcaaatgcagatctctttcctgtggctccttctcaattacagacagctcctccacaaggtgcactctggccttgtgctccctccccaaaccagcccagccctcccagcctgcatcatcgtggtcctgtaggggctagaggttctcacacccatcgtggtctggcagaggctggtggttctcacacccatcgtggtccggcaggggcttagtggttcttatacccatcgtggttcaggaggggctagtggttctcaca

SEQ ID NO: 113386 - DNA, 326 bp, Homo sapiens
actgtgttgcctaggctggtcttgagctcctgggctgaagcaattatagcacttcagcctcccaaaatgttgggattacagatgtgagccatggcacccagcccttttttttttttttttaagagctgcgtgtttttattgctgtcttttcccttagagcaagaaattaaattgagagcaagagaaaatgctgcacaaaagaagctctgggctgggcgcggtggctcatgcctgtaatcccagcactttggaggccgaggcaggtggatcacgaggtcaggagttcgagaccagcctggccaagatggtgaaaccccatctctact

SEQ ID NO: 113387 - DNA, 379 bp, Homo sapiens
catgagcctgtaatcccagctacttgggaggctgaaacaggagaattgttggaacctggtggcagaggctacagtgagccaaaatcacgccactgcactccagcctgggcaatagagcgaggctgtctcaacaaacaaacaaaatacaacaacaacaaaaagaactaggatacctcagaaggtactttggaaaacatggggttttgaaagtctgagagcatctatgagaggaatgggtaagacagatctagatttaccgcagagtagttagggcacactgtctttccccttcagctgttggtacagcactgtgagatggcagtgtaactgcaaactccaatgagcaagtatttcccaaccctacctaattttcagactc

SEQ ID NO: 113388 - DNA, 170 bp, Homo sapiens
ctcccctagacaatgctcccccagtaggtaccaacactgggccttgaattgggggaggcaggagtctacacagcctccaggctctcctatttccttaggcctgaaccagcttcccgaatctatttccccacaagtaaaatggatgttaaaatacctgctttagctccagg

SEQ ID NO: 113389 - DNA, 183 bp, Homo sapiens
ccccatcaagaaacagaatctatttccccaccttttaaatatgaggtgtggagtgaccattagcttgaaatgaccaatgggacatcagcaagcaaacaaaccaaacccccaaaacacttggggcctctgagttcctcaattttccctgccactgccaccatgtagataacctgccatgctaga

SEQ ID NO: 113390 - DNA, 138 bp, Homo sapiens
gtgagcatcctaagtagagttgcctcaggtcttcctgcgatttttttggggggcctagagtctcatcaacattgctcaagttgattcaagagaaaggagggtggtagttataagataaatgacagaccaaatattaga

SEQ ID NO: 113391 - DNA, 182 bp, Homo sapiens
ggaggggctattccactttgtatttctagaacatagcacagtgcctggcccataaacgaaagctccagaaatacgtgttgtatggaattacgtcccgaggttccttccactatcaatcatctacttaaaaaggagaaaatgctctctttaccttaagtacctttcattattaaaaaaaaaaa

SEQ ID NO: 113392 - DNA, 521 bp, Homo sapiens
gggatagcattgggagatatacctaatgctagatgatgagttagtgggtgcagcgcaccagcatggcacatgtatacatatgtaactaacctgcacaatgtgcacatgtaccctaaaacttaaagtataataaaaaaaaaaaaaagaattttagtttttaccctaagagcattgtgaagctgttgtaggtttttaagggggtagtatggataggaggtaacacttattatcatacttgtacatctaaaatattgtaggcagaatgtagacagcaggagagcttgatagtagatccagagacacccagcaagagacagtgtaattgtagtcaggggctgcaggagcaatggagaagtgggcagatttaaaggcagggtgtcccggatggagcacactgttgaatggcggaagcacgcactgagtttgggaagactgaggaaggggcaataggttcgtcagggctggaaggcagcaggggcatgcgaagttggagacaccaagagtagatgccaagaagaact

SEQ ID NO: 113393 - DNA, 345 bp, Homo sapiens
agaaataaaaggaatgcagatcagaatgaaagatataaatttacctttatttgcagataacatgatcatcttacatgaaaaaattctacaaaatctatcaaaaaagcctcctagaacatataaataaggttagcaagttgatagaacaaaataaacacaaaaatcaattgtgtatatatacgcacacacacacactatatataaaaaattagcacatagaaacaaaaatgtaaaatgaaataccatttgcaaacatttttaaaattaaatacttagctttaaatatagccaaacatttgcaggtcttgtatgcttcaaactataaaacactgatttaaaaaatca

SEQ ID NO: 113394 - DNA, 289 bp, Homo sapiens
ggtctgttttcctcctagagctttaggagatgattgggagatgtccttgtgtttcctgtgcctgcctaatgtcactgacacaatgcaaatcaataaaccctgtatggtttagaaagtctaaaagactttgtcactaagtttttggagcagatttgaacagaaagttaacatatttgttggatattaagtatagaaagagaaactatatgtattgtctttcttactcctataattctaagctggtgtattccaccaaaaatccaattccaggtgtttttctttctttttt

SEQ ID NO: 113395 - DNA, 584 bp, Homo sapiens
gcagcagttggaggggaggacagtaaccagggaaggttagcgccagcagggctgcacgccacaggctggggctgggggagagggaaggtacagagagcggcaaactgtcgaactccttcctcttcatgcttcacggttccccagccacgtgtttggtgtaaatgaggagggccggaggggccagcctgcagggtgggttccagttgccctgaaaggcagggagcaggcagagatagagtgcagggcatggcattggaggcccagtccaccctgttcaccctcctctcccacatcaggctggcactctgcacatttagggtgtggccaagcctcagccagcagaagcaagtctggtcttgctgaccagcctggccggctggcggagaaaaggagaagacggtgtctctagggagatcccgggcctgagcggcagcgtctgtcaaatgtgtttggcttctgtctcttgagtagcccatctgaaatgaggaaagggccaaggggccccggggctcaggtccaccacccacactcccattctcacagccctgctggaccaaggcatctctcaagtgggccgcactggc

SEQ ID NO: 113396 - DNA, 694 bp, Homo sapiens
gaagacggctcaatgcagttattgaagaataagaaggcccatgatacgctgtctgcaagctggaaaactggggaagttggtggcatatctcagtccaagttcaaaggcccgaacaccaagggagctgatgatgtaactctgtctaaggccaaaggtctgaggacctgggaggccagagtctaaaggctggagacctggagttctgatgttcaaccaagggcaggagaagatgagtgtcccagctccagaagagaaagtgggcaaattcacttttcctctatttttgttctatccaggccctcaactgactggatggtgcccacccacattgggttacgggggatctttcttactcagttcaccaattcaaatgctgatctcttccagaaacaccctcctcatggatacatccatacataatgctttacccgctttctcggtgtctgttaacccagtcaagttgacacctaaattaaccaccacagtcacacagctatgaagtggtagaacagggacactgagcaggttgcctgggtgcagagctgatgccttagccctggcatactgcctcctgctccttgtagaaagggacaaaggtggcacttgcaacttcatggtcttctttggaatttctctggatgatttttcaaccatgctctgatatgtgctctcgaaaccctgaagtgacgttcta

SEQ ID NO: 113397 - DNA, 566 bp, Homo sapiens
ctttttttaaattttatttttcttttgggacagagtcttactgccacccagtctggaatgcagtggcataatcgtggttccctgcaacctcaaactcctgggctggagtgatcctctcgtcttggcttcataaagcaccaggatcacagataaactgtaatagtacctggtcacaacagcgtactttaaatcagtggtcagagaaggtgcccgagagggagaagcacaaagacctgaaggagggtgaggggtaagccacacagatacctggggacagcattccaggtcaaagaaggaacaagggcactagtcggaggcagcagacatggggcttcagagcaggcaagaggcccgtgtgctggaacagaatgagaatgggagtgggtgacgatggaaaagacaagagcctcccaaaacaggcaggagtcaggcacagcattcagtgtggggcccaagctgagacctggcagaaggaaggaagagggaaagcatgcctatcccccaaacacatggggtaagggggcacatgggcagaagaaaggaacaaaaattgaccacacaaaggc

SEQ ID NO: 113398 - DNA, 297 bp, Homo sapiens
  misc_feature (33)..(33): n is a, c, g, or t
  misc_feature (58)..(58): n is a, c, g, or t
ctgctaaaaaattaaacatatccaccaacagancaaaaaaacaaactacaactttagngaaggaaagcttgagaagaaatcgtcaaatgttgcaggattcttgtaagcacagagaactatgaagacctgacaaggagggtatctttttctttcatgcttgtccaacaagagagcacattgttagtgtgcttgaattccaacaaaagaaggcatagaatgaatcttggttgttcccttttacttgctaaatatgtactgaatgaataaatggtgcattatacatctataaaacagctg

SEQ ID NO: 113399 - DNA, 777 bp, Homo sapiens
gtaaactataattcaaattcttattttcaaatcatttaaacattttgtttctacttattcaatcctaaatacttaaaaggtagagatgtgttatagaagctgctttttgttttctacaaaagaggttaattgatatcctcagtcatataaggaacttgtggcagaataagaattagtgtcccagccaggcgcagtggctcacacttgtaatcctagcactttgggaggccgagaggggcagatcacctgaggtcaggagttcgagaccagcctgaccaacatagtgaaaccccatctctgctaaaaatacaaaaattagccaggcgtggtggcacgcacctgttatcccagcaacttgggaggctgaggcaggagaatcgcttgaacctgggaggcagaggttgcagtgagccgagatcacaccactgcactccagcctgggcaacagagtgagattccgtctgggaaaaaaaaaaaaaaagaaaaaagaatgagtgtccctaaagctctccattcccatctgatggttgttcagcaacatccttgttggttcgctctttttttcctcttcattaagtgaaagcaaactgctgttttcaacatacgtattttctgagagattatacattgctattaccttttggctcagactcgatttttctatgctttcaactttttttttttttctagctaggatttgaacctatatcctttcaacttcttttagaaccattttaatgcctagagcattggactcagaagtctagcttctggccg

SEQ ID NO: 113400 - DNA, 249 bp, Homo sapiens
ggtttttcaaccagcgacctggcatttccattttacaaagcatgtagcttgttctgttcaacggaacctctgggctcacctccctcacaaccacttccctcaggccatagtggtagcttggaggtctgttaaatgtcacagaacttttgtctagactgccctttttcctttgctatggagaaaattctgatccttcaaggtcctgttcaaatgtcacctcatccttcaagtgctctttgcctctttcag

SEQ ID NO: 113401 - DNA, 535 bp, Homo sapiens
ctctgtaaatgcctgagaaatagtggcagaagacaggataaatctgcttatggctttttgccttagggtaattccctccttccatgatttgtgttattctttgttgttcctcatagaccaatatcaaactctgaccacgcaggccagtcataacaatcccatataatctagttccttgtacttgacagaggaaacagatgccgcataatgtggtggtgaaaagtacagtctttggattcatactgcctaagttaaaactctgctgcttacaagttgtgtaatattggacaagtcacttaacttcactgtgcttcagcttcctcctcttaaatatgggaatattagtatacctaccttactagaataacatgacatatgataaatagtatatattggttgctgctaatgttactgggattatgatgatcattatgccattatttacttatatgttcatctaaggtctactctagaggtatgtctgttaactagaggtattctgactcaaattgctggaagagacagaggacagcat

SEQ ID NO: 113402 - DNA, 326 bp, Homo sapiens
gactgatgtgagatggcatcttactgtggtttttgcttgcatttatttatttgatgattagtaaggatgagtgttttttcatatacttgagtgtcttcttttgagaaaatatctgttcatgtcctttgccttttcttgatttaaattttaagttctggggtacatgtgcaggaagcgcagttttgttacatagataaacgtgtgtggtggtggtttgctgcacctatcaacccatcacctaggtattaagcccagcatgcattagctatttttcctgatgctctccctctcctcaaccccctacagaaaattatagtgtgtgttgt

SEQ ID NO: 113403 - DNA, 827 bp, Homo sapiens
agagccctcctgatccaatcacctcctaaaggtcccacctctcgatattgccacattgggaattaggtatcaagatgagtttcagaggagacaaacatttaaaccatagtagcatgctatgctggcatcagccagaagtggacgtctattataccacagccatattctgaagtggccctgaaaatggtgatgaaggaaaatcctcccaggaggcagaacttccagtgattcatttggttgttcattttgttgggactgagaacagccagatgactggatccacactgcctcataagcaatggctaatgggttatccaattggtcagggacttggaaagagcaagactggaaaactggtggtaaggaggtattggggcaggtatatggatggacctctgggactaagcccaaaatatgaaaatatccatgtccatataaatgctgagtagagggcatctactgcagaggaggctgtcaataattaggtggactagagaatccatccttggatgtcagtcagactcttcccccacttatcctggtgtttcctcgatgatcttataaactcagtgtcagagcatccacaatataggcttcccttacaaagctcactgctagatgtctgactggccagcagcagaggccagctctgagtctttgatatggcaccactcccagaggggatcagacacatgaaacagacatgaatggaacttgaagtctggagtcagcctggtccagctgcacccagcctaaatcagctgaatcacaaccaacccacacacttgtggccaagaaataaaatgtttgctctattaagccactga

SEQ ID NO: 113404 - DNA, 358 bp, Homo sapiens
gaatctatgagaaaggctttcatgccttagttacattttctgtctcctccaattagactcctccaatgctactgaagggctttagtacagtgctctgcacacaataggtgcttcacagatatttgcagaatgatttattgaggaggaatccatagatgatctcacagaaattcaaggaaaaatctactatgtgaaaaacaaagtgccgattccatgcttcaattccatgattctggcagccagcataacaaaacagccacaacaataacaagaaaaaaaagccacgatgatgtttagaagttaactttaaactcttctgttgttcatagagtcatatgtatattttctctcctgggtg

SEQ ID NO: 113405 - DNA, 423 bp, Homo sapiens
gagtacaattcaaggtgagatttgggtgaagacacagagacaaaccatatcattctgccctttgcccctccgaatctcacatcctcatatttcaaaatcaatcctgccttcccaagcatcccccaaagtcttaactcatttcagcattaacccagaagtccacagtccaaagtcacatctgaaacaaggtaagtcgcttgcacctatgagcccataaaatcaaaagcaagctagttatttcctagatacaatgggggtacaggtattgaaaaaatacagccattccaaatgggagaaattgtccataacaaaggggttacaaggcccatgcaagtctgaaatcctgtggggcagtcaaatttgaaagttcgaaaatgatctcgtttgactccatgtctcacatccaggtcaagctgatgaaag

SEQ ID NO: 113406 - DNA, 430 bp, Homo sapiens
cggagatggggggtgggaagaggccaggagggacctgacgtctgggggcgataggggagagacacaaagcctaactgtcctatccctttgtcaaatgagcagcagatatgtgccaggtactgttttaggctctgggttacagtggtgaccaaagcagatgaaaccgctgcctccaggggatctgggagaaaagttacagcatgcagtctaatgaggggatatcaccccttggggtggcaaaatagcctactctttatatgcatacagcacaggtctaagtactgtaagtaaacagatacacagtgtttctgtggtgtttcaggggaggggacaaattaggaaaccaaaatgtctcagaaggctccacggtggggtgataatggataaaaggttgtgacagccgggcacggtggctcacgcctgtaatccc

SEQ ID NO: 113407 - DNA, 844 bp, Homo sapiens
agcactccaccatgtactcatgagtgaatgtgaatgaaaacaagagaaataatgccttcatattattacgaaaataatgctgatattccaggtctcctgaaaaagtttgaggttcccccgggggtgctgagaccacactctgagaaccattggtggaggaaggtgtagtggaggccagaacactgggaattacaaactaaggttttgtgaacaaagaaacagcttaatctttataattttgtttttagaaactgatctccaacgatgttagagatcagctaattttgtaaacatttacaaaagtttaataaaatcattctgatttatcttcagaactccgaattcctacatataattgctactcaacatctctatgtggatgtctagtagacatttcaactcttgttcagaactcatctcctgatcttctacccttaagtttctcctgttgtggcatcacccatttagttaatggcaatttcatcattatagttgctcagacacaacacctaaaaatcattgttgacccctccctgggatcaactctgtctgggatgtagctctggtctgagccaccagcatctctcacctgggttactcttacctgttctctctgctcctaccctccctgaccaaatccccattgtccattttttgttaatagccaggatgatccttttaacacctaagaccgtgcacttttctgctcaaaactatgtaatgactcctcctttcaatcagcgtcaaagctgacatcttaaaatgcccttaagaccttacctgctctgtctcaacctgtccctctatgagcccgtggctccctgtcccgcccccacactgctcc

SEQ ID NO: 113408 - DNA, 265 bp, Homo sapiens
ggttcacttatctgtgatgagggaagaaatttaagaccaaagggttaaagccaaggttttcttctttgtttgctttaccttaataagcagagtctttaatgctggctgtaagaacaagacaacagtattttcttttcttttctctctcttttttttttttttttgtgagactgagtcttgctccattgcccaggctggagtgcagtggcgcaatcttggcccactgcaacctcctcctcctgggctcaagcagttctcctacctc

SEQ ID NO: 113409 - DNA, 446 bp, Homo sapiens
aagatggcaggcctacctgaagcctgagcccagcccgccacagcagggcccagggtgcggcacttgtgggcctctggcctagatccaggatagacattctcagagcacctgcagccacccaatagggcctcacctctcactcatgccaggggtcccttgagaactctccccacgacacccaccctgggttcagttagagctttggagttggcatgcctgggcctacagtgccctgggcagcagggacacgctccccttcctagcatcatagggactgcacagcccccagctttgctgtgtcccaagtgtactcagcatctttcccgcagctgtgctccctcgggttatccctgactcctctggtcctctccctcatgtaaagacaccaaggccacggattctacttaaatctctctgcccatcccttctcaccatccccaccctca

SEQ ID NO: 113410 - DNA, 203 bp, Homo sapiens
ctcttccacctcctccaagcagcagcctgtgcttgtcgttctgccttgtccacagctgtttcctcagcacctggcactggcctcagtagatggttggtggacaggcaattgaggggttggctgagcctaacctgtgagtttgcgccccttctgatgtccaccctcagctgtgtttgggggatgcatcctagggctcaaagatt

SEQ ID NO: 113411 - DNA, 269 bp, Homo sapiens
caagcgtgcatagtggagggagaacatcgataccgtattgaactggttcaccaaggaagaatttgactttgtgactctgtactacagagagccagataacatgggacatcgattcaggccagaggcagagaacaggaagttgatgattcagcaaatcaacaggaccatcgggtatctggtgggagccactgagaagcacagcctgcagagcacctcagcgtcatcatcacatgagaccatgggatgaccaccgtgaagaagagacccaa

SEQ ID NO: 113412 - DNA, 406 bp, Homo sapiens
agaagccatcagaagccaacagtctaattctctcaccagctcacctgccttggtgcccccacattctgccttccttccacccagtttggtttctctctcatccatgccaacccctcactgtgtgcctagagcccacccccctttgcctgctcacatctctctttggcatttgtctttccctcgctactggataatttccaccaatgtacaaatatgccatttttttctgtagccttccaaaaactccccctccatttgagcccctctttcttcttaagcgactgccccacctttgcttctatttacaacaaaattctatgaaagtattattgacactcatttccagtttctgtcttcccatttttttgtttgtttttggattcattcccatcaaggttttgcccct

SEQ ID NO: 113413 - DNA, 840 bp, Homo sapiens
gtatatgttttaaagtatattacagaaaatttcaaaatgtataggggattatataatgataactcccgtgtacccatctcctaacttcaacagttaccaactcctagcatcaacagttataaactcatagtcaatgctgtttcaactatacctcttttaccttttccctcactttcccatggattattttgaagataatctgacataatatcctttcactatagatatttcagtatacatctctaaaatagaaggactcttaaaatacacatttagtaccattatcatacctaatgacttctaaaaaataattttttttttgagacagagtcttgctttgtgtccaggctggagtgcagaggcacaatctcggctcactgcaccctccacattccaggttcaagtgattcttctgcctcagcctcccaagtagctaggattataggtgcgcaccaccatggccagctaattattgtatttttagtagggatgaggttttgccgtgttggccaagctggtcttgaactcctggccttaaataatccgcctgccttggcctcccaaagtgctgggattacaggcatgagccaccacacccagccaaataaacagtgttttaatatcattaacagagaatcagttgttctaattgttttctaattgttgggtatatatatctatttataacttaaattagttttattaaatattgcaaacatgtacaaaactgcacacagaaatgtacaactaaatattcatgtaacctgcacccaggtcaaaaattagaacatttctaatactccaaagattcccgtcatccctcttccagactttcactcc

SEQ ID NO: 113414 - DNA, 408 bp, Homo sapiens
cctgccttgtcttaggaaacgtttttctggcagtggctcacacctataatcccaatactctgggaggctgaggcaggaggactgcttgagcccaggagtttgggaccagcctgggcaagagggtgaaaccctgtctctaaaaattagccaggcatggtggctcacacctgtagtctcagctcttagggaggttgaggtgggaggactgctggagcccaggaggtggaggctgcagtgagccgagatcacaccactgcactccagcctgggcagcatggcaaaactctgtctctaccaagaaaaaaacaaaaaattaacagaaggaaaaacaaaagggctttcttatcaaaaatacactttaaggaacaaatttatcatattaagttggtgcaaaagtaatcgtggctt

SEQ ID NO: 113415 - DNA, 263 bp, Homo sapiens
taaagttcatttactggagaagcaaataaaataagacagcagcagctgatcaccagtccttgcccaaggatgtggagacagaggaaatccacatctttggctcctcttccccaacaagcatgtagatatcccagcctcaaccaccctgactccaactccccaccaagcatgtagatatcccagcctcatccaccctgactccaactccccaccaagcatgtagatatcccagcctcaaccaccctgactccaactccccacca

SEQ ID NO: 113416 - DNA, 739 bp, Homo sapiens
ttgcctaccattttcaatgctcaaggattatatctgtgtatatgtctctgcttcagtatgttttatctacaaccataaagaaaaatattggattcattatctatcaagctacctgctaggaaagagtttcttgctcaaattaggcttatgtggggaacttggaagtaatggaaagggacagtttaattcttttccaggttcaaggatgtgaattattgtgtcttgtaaagctggaaggggaaaatgaggaatgataatgatttttcatgtcattagtttttatatttataaaattatagcttccattcatccctctttgaaatttaaggtttggtactaaaaataatacttccaggatactcttacatgttcattgatacccacctcccttacctcagctgtcttaaaaaagcagagggtaggtagctgccaagcttttaagtagctccaaatggactaagcacctgcctagatcaggaatggtagaaggattgatctgtaaaataatcacatgtagaacttttctttggtaaatgtaagtcattatatatcaatcagtttaacttcttatctgtgaagcatagtaacagctatgttagaatagtgttgtgtttgacatggtttcgaccagttgtttccctgttttaaaatcacatcttacttggaaatcttactataaactggtagatgatgaggtattatgaatttgaaaattcaatcctagttaatattaagattg

SEQ ID NO: 113417 - DNA, 554 bp, Homo sapiens
tacttgctagcttatcaagctcctgaaaaatttccgtttcttggctgattataaaatatgtctaaggtttattccaattttaggaatactcaattcttgaaataaggaacattcttcaggaaagaggtgttttactttttaaatcacaaagtaaacaaatacagagaatacatattttgaagtgtaggattttgtgattgcctctgtttgtaacctgatgcaattgtaaataagaatgcaggctaggccaggtgcttacacctgtaatcccggcactttggaaagcagaggcaggtggattacctgaggtcaggagttcaagacgagcctggccaacatggtgaaaccccacctctactaaaaatacaaaaattagccgggtgtggtagcatgaacatgtagtcccagctacttgggaggctgaggtgggaaaatggcttgaaccggggaggcggaggttgtagtgagctgagatcgcgccactgtgctccagcttgggtgacacagtgagaccctgtctcaaaaaattaaaaaaataagataaaaaagggaat

SEQ ID NO: 113418 - DNA, 555 bp, Homo sapiens
gggccaatctatttaacatttccctcaccacccctccactctgtagcccctttgccccttgtatttctctccatagtacttattttaatatctaacacactataatatcaaatgttaactccatgaggataggcattttgatctgtttggttccctgcggcatctccagcacctagaacaatgcctggtacatagtgggtgcttaatatgtacatgtcacgtgagataggaaaaaaacgagtgtattaaagaatccaggagccgggcgaggtgtgtcatgcctgtaatcctagcactttgggaggctgaggcgggtgcatcgcctgaggttaggagttcgagcccagcctggccaacatagtgaaaccccgtctctactaaaaatacaaaaaatcagctgggtgtggtggcaggcgcctgtaatcctagctactagtgaggctgaggcaggagaatcgcttgaactggggaggcagacgtcgcagtgagctgagattgcgccattgcactccagcctgggcaacaagagggaaacaccttctcaaaaaaaaaaaa

SEQ ID NO: 113419 - DNA, 415 bp, Homo sapiens
actgatggcatgggattgagctttcgtctgtgcagaattttacagacagactcatgttctgccaggcagacattcagcccttgatcttctcacagtcgccattgtgaaggagagcaagccctttctccacactctctgtggactactttctaacttttctattgtcatgggagaaaaatttaaaaaactgattaaaagggggcaagtgcatggcttctatgaaaactctaccgctctaaactgtgggactgcttgaaactgtttgttttggctggcctcggtggcaagactgacatatttatgtagcaagctcacatgtaatatttaacttggaattttacacataggaatgatgaactaaacagaatataagggtttgttgttgttgttgtttccctgcttgttctgaaatgtg

SEQ ID NO: 113420 - DNA, 579 bp, Homo sapiens
tactgtgaatgaaaagcatcctacaccatgttacagacatttgttaagcccttactgtatagcagaacctatagggctaggcatttgagacacaattgcctaaattctgagaggagatgcactttgggtcactcactgctccatcctcagcctccagcacagcaatgagacagagaggtactcaacatttgcagaatgaatgaatgagaaatggtctctgtctttgaaaggcttagagtacactatgaagacctggcatataactagtatagtagctatcatagctgatttgaaagaagtccatatcatcagggcatgaaggaaggagtggtcaattcaacttggactatgttcaatgagtgggagtgcaaagaaagtaagaaaagccttcaaagaggaggtaagcttggcctgaacctttggtgcacaaattcattaataagtctaactctccttcagccataaggtatttggagtgagagacatgttaacacatgagttatgtgttgtaaattggggagtagtaaggaatagattgtgtttatatcatctttgctacacgtaattctagtgaactga

SEQ ID NO: 113421 - DNA, 457 bp, Homo sapiens
aagggtgttgttgcggggaaggaacaaagagttctgttttagatattttaagtttgaaattatgattagatatccaggttgaggtatttattagacacttgataaacatgttaaaattttaggggaaaagccctcataggagacatatacttgagagtggttagcatgtatctggaatttaagctgtaagccttgataagaccacttaggagttaaccatagattaaaaagaggtccaaaaatttggactgtgggatgtactaacatttatactcaggcagataggtaactagcagaagagactgagaagaaatgtaaatttggtgttccagaagccaagtaaagaaagacttccagacagtgataatttttttcatttaagtgctggatttaatgatgtggaggtcactggcaactgcaacaatggcggtttcagtggagtggaggttgagaaggc

SEQ ID NO: 113422 - DNA, 1568 bp, Homo sapiens
cttcctagtagagtataaactcagcaggaacagagactcctgtttagtgcactgctggaacaatgctcactactcagtatatcctaggcgatcagtcaatatttgttgaatgaattaactgaaggaaatacctacttctagcaaaagaatttacttgaacagtaaatttggtggtctgaatttaccttgaaaacattttaagaacttgactgcactgtgctgttaagtaataatgataactactttttgagggatgtatactagaaactatgtcaaacgtgcagttgaataaaagatgtattgacttgtgagttaggggtctgtggctgccatcctatagcagttaatgccagttaatcctaaatatctgagactagaagaatcatgtgtaggagaaaaaagaagggcagttatctgtcttgaagtagaattttttttcattccttacacttctcagtgagtggtaactgtagtttttgctatcatttttcattttcgtttttgcagttgaacatacttttttcactcagagagttggagggacttgcccaagactgcccaatggcaatgagatttcaacctcaaatcaatgttctttttaatgcaagatgataaagagtaggatttagcctaatttaggatagaataaagccaaataatttaggataggttctttggtgttcatgggtgtaatctaatgcccatgatgcaagtggcagagtagagaattagtgcacagcaataattaaagtgacatattgccaaaggaagcggttatagcccattatataataccttttaaaggacagacgcatactcaggtttattttacctgctgagcttctgccttagaagttttcagaattgtgattacattgaataggaaaaaagtctgaactatcagaagcagtgccgcaactttgacaaacaactgattatataataatctgcctctagcatgagactatattaattattatttagctctggtgacttcataagcagccagtgacaacagaaagttaagataataaaatgaaggaatgttacaatttgttatcatccgggagcctgaggcaggagaatggcttgaacccgagaggtggaggctgcagtgagctgagatcgcgccactgcactccagcctgggcaacagagactccacctcaaaaaaataaataaataaaaagaatttgttgttatccacttcagagctcattaatgccacatttgtcacatctccgttgagaaatccacaatggttttgtatctgctatgccatcaagcccctgttttactttcaagcctacacacaatagacgttattccaattttaaatcctcttttccattacttgctaaactctatccaactaagttcctcactctcctatcaatagtttatgtacagagttgcccacatgtttcattaatatcgttcctggccgggcacagtggctctcgcctgtaatcccaacactctgggaggctgaggcaggtggatcacaaggttaggagttcaaggccagcctggccaagatggcgaaaccccgtttctactaaaaatac

SEQ ID NO: 113423 - DNA, 176 bp, Homo sapiens
ctcaaaaaaccacctattccagcttagtctttgaaaagttcagccagaaccatcctaccagatatcttccaaaagctgacaaagaattttaaagtcaggagatgacccttacattccaaacagtgactacaaaaaggtctgttcctttctgcaaatatcaaaatcgttaagtcagt

SEQ ID NO: 113424 - DNA, 883 bp, Homo sapiens
tataagaggttaaaaaatataacaagattgttacgcaggttaacttgtatctaagaaccagtacattatttgataaccaaattaccttattaactacccttactcgggaatctaacaacatgcgtaaaatgttgtattttgttagcacacaaaacgacttgtagggaacccaatagtaaattacaatttatcatttttaccaaaataaatacttataataaaacatcaaccaccagcttaatgagaactagatcactagtatacagtgttttgatttgtagggcattacagacctcagtcagctgctacagataaaatagaggaaagatgaaatccatctaccaatatagtaatttaaagaagcaaaaggaaagttggtcaatcttcaatgaccaaagaaaatagtctagcagataataaaatacatgctactatcattagacaagtttgatgcaaaaatggacaagtagagcagtggaacagaatagagggttcagaaatatacccaattaagtatgagaatttagtacaggtgtatgataacagtaacattcaattcagtgggaaaaaaaaatggtttacttggccaggtgtgtgagtctgtaatcccagtactttgggaggccaaggttggaggattacttgagcctaggagtttaagataagcttggacaacatagtgagaccctgtctctacaaaaaaaaaagtgtttttttaatatattatccaggtgcagtgacatccacctgtggtctcagctatgtgggaggcttagctgggaggattacttgagcctgggagatcgatactgcagtgagccatgatcatgccactgcacaccagcctaggcaacagagtgaggcactgcctcaaaaaaaaaaa

SEQ ID NO: 113425 - DNA, 522 bp, Homo sapiens
gcctgtgtccaggcttggggaaccacatctcggggagaaagcaacagcagtcagggagaagtcagtccctagatggcatcaggtgacctgagagctatggagcacagcaagggtggcaaatgtacttggggaggacacctgcaaatgccagggtcatattgactttctcccagtattcctgccacaaacaaacaaacaattaagtaaagggaagtctaataataagaattagcctctcaggccgggcgcggtggctcacacctataatcctagcactttgggaggcccaggcgggttgattgcctgagctcaggagtttgagacccgcctgggcaacatggcaaaagcccgtctctactaaaaatacaaaaaattagtcgagtgtggtggtgtgtgcctgtaatcccagccactcaggaggctgaagcaggagaatcgcttgaacctgggaggcagaggttgtagtgagccaagattgcgccattgcactccagcctgtgtgacagagcgagactttgactc

SEQ ID NO: 113426 - DNA, 464 bp, Homo sapiens
agaaagaaagaaagagaaggaaggatgggaggtgggaggggggaggtagaaagaaagaaattaataaattataaaacatggagttcctttttaattgctaaatatactagaattgacaccttactctgcccatagtatcaagcaatacatattttggtaatcatggtatcggaaaagaaatgtggcatagaatatcgtcatcaatttcctttgttaaattattggttaattcactgaaaagaatcacctcagtcactaatgatgctaaaaagtaaatattcaagtcatcagtaaatattccctaaatttctatacaatgaagcacagcatgagtatcacaattttctactctaggtagttatgtagaattatgagagatatatacagtttttaaaaaatataacagtcttaaatctactgttcatacataatagcttatagttaatcatcttaagagttttatt

SEQ ID NO: 113427 - DNA, 471 bp, Homo sapiens
gtttcatttcgggaacagctattaagttccgatggggataaatcgctcggcgggcatttctagtagcctaaaccaattgtctcctgcatcctgctagtggcaaaatgccattgcacaggatgggaaaagtgttatctctatattgttacctaaagtttacactgtatgattctagaaatgaatacaaaaataaaggaaattgagagatgtgtgaagtgcaaagtagtattagttcattagttcattagttcattaattcctttattcagcaaacaaatattctatgctagagcctggtcacggtgtcttgggaagtaaagagatgaagcagatttagaagatctccctgtcctcaaggtgtctacaatgtgatactggggagtgggctgcctagaaacagtggttgtacatcatgaaaccatatccacaaagccagagtatcaaattttaatatttactctataaaatata

SEQ ID NO: 113428 - DNA, 400 bp, Homo sapiens
gtagcagaatatgataggagtgaaaaaaatcaagaagaatctaggtagaagattgaaagggtagagaaaaatctcaagaatagcaaagtgagaacaagactttaatccggttttcatttagaagcaggaataaatttcaatttttaataagtaaatcttaaggctattttagggcacaatcaagatggtataaatgcaaataagcaataataatcctaatgattaaaatattaatggaaagtaaagaattactggaatagatattaatagctgattactcagggatgactatacagtttagagattaatattattacttttatttatttctcttctcatcttctaaccactctggattatatcaccaattataaacggcttgatatacacacagtaggtc

SEQ ID NO: 113429 - DNA, 391 bp, Homo sapiens
ttaaaagagattagttcttgatttttcatcaggaagacatatttaccaaatgctttaaaaggcaaaaaagctcaggcgtggtggctcacgcctataatcccagccctttgggaggccaaggcaggcagatcacctgaggtcaggagtttgagaccagcctggccaacatggtgaaaccccgtctctactaaaaatacaaaaattagccgggcatagtggcacacgcctcagctacttgggaggctgaggcaacagaaagaaatgaagtgactcagcttctggctcctctgctacatcaaatatcttgtttaatggggcagatatgcattaaatagtttgtacaagcagctttcgttgaagtttagaagataagaaacatgtcatcatattt

SEQ ID NO: 113430 - DNA, 407 bp, Homo sapiens
tgggctctgttaattttcagtgaaatgtactgtcaaagactgctttgtctttgcctagagaaaagaattaggagaggcttttccctgtataatgtttgagatctttctaattttgacacaagtaaatgcattattacataatgaaactcaatgtctaggtgagaggttggcaaactacagcctgcaggccaaatctggctcaatgcctggttttctttttaattgggatataattgacataccaattcagtggtttttaatatgtttaatatattcacaaggttgtacaaccaacctcactacgtaattccagaacatttcatcatcccctaaagaaaccctgtaacccttggcagtcattccttattcccccactcctagaacttggcaaccattaatctagtttc

SEQ ID NO: 113431 - DNA, 264 bp, Homo sapiens
acgatgcacctcaatccttaaaaccttccaattttaattgtttcattatacataaaatggagtcctaaggttttattttttactattgagaatatatatctggcttaagacacaaaaatgtatgtgatgcataaaagtagcctgttgtatgtttaactcatcttgttatatctgatgggaagttatacaagtcatattgatatcatattgaattttaaataatttatcattttgactattggaacagtttgttactttgaagca

SEQ ID NO: 113432 - DNA, 559 bp, Homo sapiens
cgccttgaagactcttcccaggttgccggggttttcttgggaataatttgaagttgacatctctgtttccttccaggaaaggttgcatcagtttatgtgatcatgttcaagtccctcgaggttggactcagaaccaagctgaatgctcaggaaacaagtaggctggttctgcagtctgagcctggaccctgtctgtttggaggctttccttctctctttgtgaatattctctttagaagagagctctctttctgcacctgtggggatcatcaccaccatgtcagaactgagtaagttctgtggtttgtttttatagctaacagagtttcccattgttgtccagcaaagggatggagcactggatgggtgaggattggcatccagaagaaagggtggcatgaagggtccacgtatctctgcccaacttctgggctgcctctctgtctcatgagctcatctgcacttggtggtctctgcagccagggtcagaaagtagagagacaggagcagccttgtgtgtttcctgagtgcctattggagtctaagttctagaatagtg

SEQ ID NO: 113433 - DNA, 359 bp, Homo sapiens
tgagatcaagtgacttcactgcagtggctcaagagtggctgactccctccttccaaatcagcccatcatagaacacctattgctaaatagcaaaagccagaggcttagactggatccctcataattggagacttcaaagtgttcagaacttcaagcctggcctttgaagtaaaatcttttttttttttttaagtacaattgcaatttttttatttttctccagaggctagtttttcttcagtccttaagaactctgctccttatatgggcttcggtggcagtcatggggcagcaccgcaggtctacagtggggtggaggtgttcggtccttgcgggcttcatgaccttgatttctggcg

SEQ ID NO: 113434 - DNA, 591 bp, Homo sapiens
tttttcataaatacacagttttgtttgctattttcaggggaaacttaggcattcaactataagctgataaaataccatacctaaaaaagtataaaagtataaatatccccttagaataaattttagtgaattgtcttaatatctttaaatttaaaaaaaaaaacacaacacaagcctatctattgtatcaaggtcaaaaatcaaacaatgctaaggggccagcagctccccagagagtacaccctgagggcccacagtggctgccttcctccagagctctgctggggaggacaggtcatcccatggctaagtctgccctctagaaaggcttttataaattgtctaaggccaaacatttaacagcatacaagagaccttacaaagaggaggtggtaagtcctaatgctggagaacttggttaatcaggttattggcaaagaagaagatgaggcctaggcaagaagtctccagaagcactggaaaccagacagtgtcagagcctctgacctgcacatgggcagctggtggtcagtctgcacagtgccccttgggaagctggagttccagaaacaaagagcttggagcatgccc

SEQ ID NO: 113435 - DNA, 702 bp, Homo sapiens
gggagacatctctttcttctgatctcccatgatacttagctcataccttttaaataatatttcttatacatttttacttttaatacattatattgggttttatgatgacttgaactatgaaaaggggtcctggactagaggaagaatatattactggttaaacctagatttaaaagtattttgttcaggctgggtgtggtggctcacgcctgtaatcccagcactttgggaggctgaggcgggaggatcatgaggtcaggagttccagacaagcttgaccaacgtggtgaaaccctgtctctactaaaaatacaaaaattagctgggtgtggtggcgtgtgcctgtaatcccagctactcagaaggctgaggcaggagaatcgcttgaacccaggaggcagaggctgtggtgagccaagatcgcgccactgcactccagcctgggagacagagcaagactctgtctcaaaaaataaataaataaataaataaagaaaagagtaatttgttcaaaagcaaagcctggaggtgaccagatttcaacgaggctggtcagtggaaactggggaaaggaatctttcgatgagaaggagcaaatttttagtcaaagttggtttaaaataataactaatttctctagatctacagtattatggttgtgaaggtaaagtgtactatgtacttacaagtttttaccccatg

SEQ ID NO: 113436 - DNA, 424 bp, Homo sapiens
ggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcggcagagcgagactccgtctcaaaaaaaaaaagatgtttcgtaagtatttgttgaatgaataaatgaatgaaacgggccaagtgtggtggctcacacctatgctgtaatcccagcactttgggaggttgaggcagaggatcgtgtgaggccaggagcccaagaccagcctggtcaacataggaagacccccccacacacaccttttttccaaaaaaaaaaaaa

SEQ ID NO: 113437 - DNA, 408 bp, Homo sapiens
atactgatctgctgacccaccgaccacactctgatctactgaatcagaaagtttgctcaaggtaaagtagttatttttatccctattttgcaaatgaagttaaatggttgcaaagctactgtgttggaattagcagaagctatgctgaccaagctgaagaaccagagatagggtgtatcagttagaaatacttttgtttgcaaacaacagtatacctagcagtgacttaggcaatgaagacttcaggccaggtgtggtggatcatgcctgttatcccagcactttgggaggctgaggtgggtggatcacttgatatcaggagtaagaggccagcttggccaacatggcaaacctcatctctactaaaaatacaaaaattagctgggtgtggtggcttgcacctatagt

SEQ ID NO: 113438 - DNA, 419 bp, Homo sapiens
tgtcggacctgctcgccctctctgcccagcactgacaacattagagccagtgactagaaccactcctcccccacccccacatactgtcaacagagctggaaatcaaaaggggactttggtcagaagacttttccataatgtttagccctaaaatggactagaaagaaccacagagataacttacacaagatcagcaccctggccgggcgcagtggctcatgcctgtaatcccagtactttgggaggccaaggcgggtggatcactggaggtcaggagtttgagaccagcctggccaacatggtgaaacttcgtctctactaaatataaaaattagccaggcgtagaggcaagggcctgtaatcccagctactcgggaggctgaggcaggaaaatcgcttgaacccagagaggggcggag

SEQ ID NO: 113439 - DNA, 688 bp, Homo sapiens
gaggctggggtgggagatcacttgagcctgggcagttggggctgcagtgagccatgatctcgccactgtactccagcctgggcaacagagcaagaccccatctcaaaaatcagtgaatagaaagacagatgttaagagttcttgagcatctgcaatggtagtttttctttttaatgagtgtttccttaccctctccccaataaaaatcaacaaccagcatgatcagtgttaagtaggagggtaagggctttgcaagctcttcatggcaagcggccctgccttttgctttccaagttcctcagcaaatgcaggagcaggcagaggtgggtacatgggcaggcctcctgagggctctgtacccactcttcaccacttgccgttagtgctgtggggacctggcgcccaccgagtcctggtcagtgcagtgaagcactgccttccctctgcgctaggagccaccatcgcactgctttcttcagtacgattggcttctacctgaaaacctccccttccctcttaagtcatatttttcttaacacagtcacatttttaagtcatatttttcttaatactgcagatttataatcagtacatcactttgtcaattttgaaaacgaaaatacaataatcatataaaataatttgttttttaaaaacattattaattttttttagcctaatcacaagg

SEQ ID NO: 113440 - DNA, 117 bp, Homo sapiens
tattcattaaaaagtagttactataagcctgctatgtgttaagtgctattctaggttccaggacacaggggtgaattagacagttattaacctcatagggtttacattctaggggag

SEQ ID NO: 113441 - DNA, 279 bp, Homo sapiens
cctgggatcaagcgattctcctgcctcagcctcccgaatagctgggattacaggcatgtgccacaactcccagctaattttgtatttttagtagagacagggtttctccgtgttggtcgggctggtctcgaactcctgatctgaggtgatccacctgcctcagcctcccaaggtgctgagattacaggtgtgagccactgcctggccagaatatgttattttttaagcatccttttctctagtgattagcatgctgccaaatctttgcttgttccgctg

SEQ ID NO: 113442 - DNA, 156 bp, Homo sapiens
ccgtagtggaatcagctctgcacaggaagcagagggagcctccataaaagcaggtgagggccaggcacagtggctcacacctgtaatcccaacactttgggaggccaaggcaggcggatcacctgaggtcaggagttcaagaccagcctggccaac

SEQ ID NO: 113443 - DNA, 295 bp, Homo sapiens
gatggtctcgaagcgcccccagggaaatgtgcctccaacaaatcgaagtggataaaaagggcaggacactctaatgagcaccgggcactctctagacatctttttcagattccccctcgctatgaggcaggtctgtctccatcttgcagatgagaatctcagtgaggaggttcaggatcacacagccagtacaggactctggtgccgcgccgtctctaaagcccaccgttcaaccactcgcctgtgctctcagagaggtcggtggaacctgcgggatttctggaaggggagcctg

SEQ ID NO: 113444 - DNA, 995 bp, Homo sapiens
aagagcggagcctacggctgcacttgaaggacaccaaagcatctcagggtcagaaaggggaaaaagcaattgcagggaatttagggggtagtaaaaggaacccatctcttgccgcataaatgccccccacccccacccaggactgattctggaagcaacctagtgttcgaaagggaaaggctcctacttttccattacagccgcggaaatccgcaggcaaatctccgaggagaattttagggaagcttcattgacagctgtctggagagcagtagttcccgcctgtgcaaatattccagagagttaaatcatttagaaagcactagttctttcaagaacaggtagtgtgattgtctgcagtcctgggccaagctggggaaaacaaaacagcagagagaggtgtaacattaaatagcgtcctgaccacactgcgcaagaaacagcaaatgaaacgtccaaactttggaaagatctgaagaacacttgccgcccgcatttccccttgacttctccctttttcttcccaatctcgaggcgttcatgcctggctttaagacgccaagataactctcttgttttggcattgtcgcaatgtccaaatcggtcaaaggagtgggataaggtgaaaggaccaggtcagaaactttagaaggactcggtaaattaatttgtttggaagccagtgaggtggactatgttgaggtagcagttccgcaccacgactttggagccaaagaaaaacccaggccgaaaaagcgagccttgatgtctttgttctgccttggcctgcaggggttgggaacaaaggagaggagctaagaggatgcaccaaagtagccgcgccctccctgcctggcgctgtccgcggtgctgaccgtggcccttttctctctccgtaatcaaactggaaaagcaataggaccgtcccgtccctactcaaaagaagagtaggatattaggtaatttgaaaaataacatttaaaaagagaaaaagg

SEQ ID NO: 113445 - DNA, 489 bp, Homo sapiens
agaattataatatcacctttctgctactcctaatgatatagtgtatctaaatagtagtcatcaatcactgctgacttcacgaaaaaggagacaattagacattttatatgccctaatagaggctcacagcaccatttatgaagttgacttgccaaatgaatccaaggtgaatgtgattgagcctctagatccaactaataatttgcagaaaacacatgggacagaaaagcatgatacgtgaaaccacaaggatccaattagcaaattcttacgggggaaattctacaggaaaacaatgtgtttaaaaaacaaaagagtaagaggaaaattgaatctatacattaaaggaaatttaaatgacatatcaaccaattttagtgtatggaacttattttgatgctgatttgaagatattttataaatgtatcaaaattataagataatcagacatctgtatacagacatttaatattaaggaactatcattag

SEQ ID NO: 113446 - DNA, 748 bp, Homo sapiens
cccatggttttcagcccctaactgcatattagaacaaaaatatcaatatcttagcactactccagatcaatgaactcagaactctcgagtgtggggccagggtagtggcacgttctaaaagcccccagtgtgactttattgtgcagccaggcttgagaaccactgccctagaatccacaagccagctctcatcttttcttgccttatgtctcacgatgggggatcagtgatttatgctggtacagtcctactcagcactgggcttggcttagagaagggaccgtgggaatattccttgattaattcacagaagagctacataaatgtagatatggctcccagctgggaaaatgagcagaagtgagagaatgagagaatggtggtggtggtgtggtggggagcggagataatgctacaaagtgtgagccttcagtccctccctgcctcattcctcttatgcattcattcagtgtgttctttcagattcctgtgatagcatcatacatctttgtgccttttctacttagttcagaggtatcctagatctcttatgtatacctctttcattttctcctccaggaaaagagaactaatagtgccagctcagatgacttacacagtctttccaaaatagcagaacatacccactttctaccaggcttgctcttttagtcttgtcatttctgtaaatggcaccatcatccccttgattgcttcaacttaaagcctgggaattgtgctagtattg

SEQ ID NO: 113447 - DNA, 314 bp, Homo sapiens
gcgtgtgtcaggttctccctcctttttaaggctgaatcatattccattatatggatgggtcacattttatgtcttcatttgttgatgaacagttgtgttgtttctaccttttgactactctgaataaagctgctataaacatgggtgtacaagtatctgttcaagtcccttctttcagttctgttgggtctatacctaggagcggaattgctaaatctacatgtaacttgttcaggagccaccatactgttctcccctgtggctgcaccgtttttgttcccaccagcaatgcatgaaggttccgatttttccac

SEQ ID NO: 113448 - DNA, 258 bp, Homo sapiens
ccagccgccatgctctccctgaattgtcagctccatctcaacccagtttctgctgggccctgcctgggtcctgcttcctgtaccatggctgggaactctcgggaggcagtgagctggggctgccagagggcttggctccactttgaattttggggaccaccgtcctttgctgcctgacctccagggtccctggggccattgtctcccatctcctgtcttgtctgcgtttttggcctttccagggaggagggtgatggg

SEQ ID NO: 113449 - DNA, 351 bp, Homo sapiens
cggtagccttcccctgctggcacgtgcccacctgcagccttctcctgccagtgtgcatttgcccacagcttccccgtgccactctgcaggcatgcatgtgcgtgggagcctattgctgccccaccagagttcttttgctggcagctgccatcggagtgttgttgccagtggaccgggaacatctcagctccttcagagcagtaggtacttaacctcaaggagccagaaaataaagccacaggcctggtcccagcaccacaaggattagagcatgtagcccaggagtgctctgttgagccttggcctcctgaaagcatccacaatgaagccagttgactaaaccaaacaaat

SEQ ID NO: 113450 - DNA, 427 bp, Homo sapiens
tcattgttcttgcacctcaaagccttctctggagaaggacacagatttctggagaaataaataaacgggatcccacatgccagtagggtgactgtgaccacattcccacctccagcttcctgtcaccagtcccctaccccaccagccccacaccctgagagggggcagaaggtccttctctccctccaagtatgtctcctcttccaaacggggtctccttgtgggtcttgagcaatcttgccacagccacagggggcctccaggtccccatgggggatgagaaaaaaaaccctccaagtcccatgcccaggctcggttgctttcagcaacttccctccccactgctcaggggcaccacaaaacactaagcaccccaggcactgcacctgggagtccctccctctccagggattgttttcccacctgt

SEQ ID NO: 113451 - DNA, 761 bp, Homo sapiens
gatattttacttttcccagccttcatttgtatatcaggtaaagcaagatgcctgtaagtgaaagagtaacaggcataatgaacagttatttgaagagtcttagtaaagccttttaattttacttgtaggaaattgacatgaatcattctaatgactgggtaacaaatcactttgcaagtagggtgtttccacttctatgctttaaaaaaaactgaaggagaacataatcaagcagttggttgatatagaaaataatttttaatgtagaatcactgattttttggcacctatgagaaaggaattcaagtaatagagggatattgttataacaaacctccttttattcccatctacttatttatatgaacaaagtttctatgttaagataagttagagagtgctgtggaaacaaaccctgtaatactagtggttaaaaacaaaactcagaagttaatttattgatcatgcgaagcctgctatggtcaggacacttgcctccaagcagtaactcacagatccaggctgtgtcctacctccagaacatggggcttccagtgctgctatggcactagagaactgttaagttcccaggtttaggaagaaacacgtggcacttccactcgcgtgtcattggctggaactagtcacatgacctaacctaactgaaaggaaatccaggaagtcttctgctttgtgtgctcaggaaagagaggataagggactacagacagcaccagcaattgctaccagagtttctcaac

SEQ ID NO: 113452 - DNA, 235 bp, Homo sapiens
cgagtttgagaatgcagtgagccacaatcatgccactgtgttccagcctgggctacagaacgagactcttatctcaagaagaaaaaaattacaaaatattaaactattcatgtcatagccactctgccttatttgagcagcatatgatttctccagagtacttatggtcttgcattaaggcagagtggctatgacatgaatagttcaatatttggtactttttatagagacagag

SEQ ID NO: 113453 - DNA, 378 bp, Homo sapiens
ataggcaatacctgtgcatgatacaagaaatacaaaggtcttaaaaagagtgaacaatgttaagttagcctaccttttggccatcccttccttggaaagaaccagtgttttcttataactttccagagattagtcatctagatacaagtatgtatatatgggagaatttctcatatttgggtgatatggtctttttctcttttcttttcttttcttccggtctgtctttctttctgtcctcgtctcgtctcttctcttctcttttcttcatttcttttgatggagtcttgctttgtcatccaggctggagtgtagtggcgcaatctcggctcactgcaagctctgcctcccaggttcacgccattctcttgcctcagc

SEQ ID NO: 113454 - DNA, 299 bp, Homo sapiens
tgcagtctcccaactcctaggctcaagtaatcctcctgcctcggcctcccaaagcactaagattacaaatgtgagccaccaacccagcgcagttacagcttttgataaatcaagtaaatgggaagttaagagataaaaggtagttaaatagttaaaatatgtgtgtaatatatatattacttttctaccttatttttgcattctcttcaaattatcctgaagcatttctaaatgattttatactcaaatgtagagaaaactttaacatatttctagaaagcactcgtgaccacattaca

SEQ ID NO: 113455 - DNA, 838 bp, Homo sapiens
tgcagtggcatacacctgtaacctcagcactttgggaggccaaggcaggaagatcatttgagcccaggagttcaagaccagcctgggcaacaaggtgagttgttctacaactctataaagttgttgaacaactttgtagtctctacaaagtagtgtgtctctacaaagaaaaatacagagccaggtgtgggaatgcacacctgtagtcccagctactcaagaggctgaggtggggtgggggtcacttgagcctgggaggcagaggtaacagtaagatgagaacatgccactgcactctagcatgtacaacaagcaagactctgtctcaaaacaaaaaaaaattaggagaaaatctaggccctctctctctctctccttttctctctctctctctctatatatatatacacacacactatacataatgttttatatatgaatataaaatataagttttatatgtgaatatattagactatataacatatactaatacattttatatatttaaaagtatttatttctgctgtttaaagggaaaatctagttgatcttcagtttggctatgagtttttatacaacaccaaaaagcaagatctatgaaaaaaaaattgggtaagctggtctttattaaaacctacaacttctggccgggcacggtggctcatgcctgtaatctcacccgaggcgggtggatcatctggagtcaggagttcaagatcatcctggccaacatggtgaaaccccatctctactaaaaatgcaaaaaaaaattagccgggcatggtggcgcgcacctgtaatcccagctactcaggaagctgaggcaggagaatcg

SEQ ID NO: 113456 - DNA, 372 bp, Homo sapiens
gacctgagatcttccgggactgtggccaaaccccttcgtcctcagagacctttgcctcctcctgcccctcaggctctcaagactctgctctgaaccttggcacccctggaaccgcttcattttttggagcctcccccacgtggcagggctgatcagtgcatgggtagtgtgacctaagcctgacgacgactagagattcaagaaggcctcctaaaaagaaaatgaaccaactcttccaaagggactggaggtcccaagctacccaggaggggaagtgatcccagctttgatgtattttagggactgcacacttgatgttgcccagtgtctgctgtccaggaggaaggcagatcgatggccgagtgctcgagg

SEQ ID NO: 113457 - DNA, 840 bp, Homo sapiens
cacggtggctcacacctgtaatcccatcactttgggaggccgaggtgggtggatcacctgaggtcgggagttcgagaccagcctgaccaacatgaagaaaccccatctctactaaaaatacaaaaaattagctaggcgtggtggcgcatgcctataataccagctactcgggaggctgaggcaggagaatcgcttgaaccagggaggtggaggttgcggtgagccaagatcacgccaatgtactccagcctgtgtgacaagagcaagactctgtctcaaaacaaaacaaagacaaagaaaaaaagaaaaaaggacccttatgatgaagaaagcaaaaggaaactgcctaaaacagacaacagcaacatatcagaggacataatcagctagggagtcaggctaatgagagaaaatctgtactgtacccaattattattaaaggatgccccagtgtggcagaagacagacgaactattcagaacaaaagggaaggcattataggcaatcacaagtacgagtatgaaaaaaattagacagtccaaaaggttagaacaaaacatcccagggatttctgaagtacattttaagaggttccaaaccctggggtggtgccctagaaccagaaggggcatgatggtatggtaccatcaaaagaaatttcttttattgggaaaagtagatgaaatgacaaaatacagaaaaattcctcagaaatattcaccctagtagcagtatcagtctaaagagttttatcagaaaaaagttatcctatcagtttctcactgaaacagttaatgtgtagattatttgttctgagaacttgtgcccatagaagcaaat

SEQ ID NO: 113458 - DNA, 564 bp, Homo sapiens
cagaatatgggtatatgtagaggaggggatcgctgattatagtttacaatctataatgtgcttcgtactacgcatggactatccccagagcttgccctggagggcaaatagattaagcctatacatttgaaagccatttaccttcaaagaggcctgttaaaaatcagctgctgccaaagtgtggctagattgaaacagtcttgcaaaatgtttttagttcctgctaagtgccaacactggaccaagcactaagggacaagaatatataaaaattattctccggccgggtgcggtggctcacgcctgtaatcccagcactttgggaggccaaggcgggcggatcacaaggtcaggagatcgagaccatcctggctaacacggtgaaaccccgtctttactaaaaatacaaaaaaattagccgggcgtggtggtgggcgcctgtagtcccagctactaggggaggctgaggcaggagaatggcgtgaacctgggaggcggggcttgcagcgagccgagatcacgccactgcactccagcctgggcgacagagcaagactccgtctc

SEQ ID NO: 113459 - DNA, 782 bp, Homo sapiens
gatatcacttaagtatttgatgtttatatttgatatttatcaaattcttaagttataaactacttattcctaagttaagaaatttataatcacagtttatttttttaacttgtacttcttgtacttcttaattcctttttttttttttttttttgagacggaatttcgctcttgttgcccaagctggagtgcagtggtgggatcttggctcactgcatcctccacctcccgggttcaagcgattatcctgcctcagcctcctgagcggctgggattacaggcgtgcatccccacacccaactaattttttgtatttttagtagaaacggggtttcgccgtgttagccaggctggtttcaaactcctgacctcaggtgatctgtccgccttggcctcacaaagtgctggtattacaggtgtgagccaccgctcctgggctgtactacttaattctaaccatacatcaaatactgtgtgataataagatcacattgctaatctagttctgatttaaaaggaagaacttgaccttctagtacatgttatcaaattacagttggtttcccttgtttatagctgtgttctattaatataaggctgccacaagtatgaaaccgttttcacataggggaagtacaggattgggttcctacaaacctctgatcacaacattttcatcaactgaaaatacgtgactttgttacatgtgtatttctgtttagacatgccttaatgtatgttaaattcacatcgaactcactacccagtagcactgtaatttg

SEQ ID NO: 113460 - DNA, 689 bp, Homo sapiens
ctaaataaaattacactgaagtcctagccacagattggcaaggacagttttgtgggggcagccccacatgccatagccctctgcagggagccataacttaacatccccatgtttaaattttaaattatatacccagccccttgttttgtccattaccagttgagaagtgaggtaattcattctcctttctactgcttctgcccatggtgagaacagaacttccatatacatcttctctgcccagctggagggggctgatggaggacacagcttctgtcatccagcgcctcccctgggagtctctttactgattggtcttcatttgatctacattaggtcacatttactgatggatggaataaactgctttaacagaatcatggtctccaagtttcacttcaccttctgtcctcaggtgtggcaggtgccctggccagagcctgctattctctccggcttcctgtttctttgtgtcttttatctactgttctgaaaaagtgaatggagtcggggagatgggaatttaaagtaagaggcccggctgggcatggtggctcatgcgtgtaatcccagcactttggaaggctgaggtgggcagatcacctgaggtcaggagtttgagaccagcttggccaacatggtgaaactccgtctctactaaaaatacaaaaattagccaggtgtagtgg

SEQ ID NO: 113461 - DNA, 737 bp, Homo sapiens
gctttagtaactgttgtggggcttgaatctcgttatcttggtcagttatttggctccagcttttgtctctatgctgatcttaaatgagtacaaaggccactgataagaccgggtcagccagacagagccaggctcatggcagggtaggcagaatgctgcagtgcggtgcaccccactctcgcttgtgtaaatatttttctgggcaggagcgtttctcaaacagaactctgagcccactgcggtgaacctgatagcaggaattacgtgctatttgtcaagtataagactagtttgcagtgactggtctggctagaacccacctggtgttttctgagatcatctgtaaggaaacacacagcacagcagaggcagtgtgcgcccgtggtggtgagtcttagacctgtcatctgtgttagcattaccccgaaggcagagagtttgctgattagaaactatggctgctttaattcatgggtaccctccgtgacttttcagggtctcctggttgaatgaatttgcagaaggattaaaatgtgtgttcttatttgtgctttgtattctcccataagtagtgtgttggaggctattagaatagctgagagggtaaaacataaacacataggtaggagcctgacataaacacataggtaggagcctgccataagcacgtaggtaagaactaaaagggcgtgttttcatttcagttgtccagccttcttccatactctcagatgaca

SEQ ID NO: 113462 - DNA, 142 bp, Homo sapiens
agggagatttttctgatctttgtatgcatttatttatgattatctgaagcgtgatgtaaaataacttatgtatatacatagcacagtgagttctggatggagagaagactaattatttatagaaaaagtctttttaatgtaa

SEQ ID NO: 113463 - DNA, 281 bp, Homo sapiens
atggtctcgatctcctgacctcgtgatccaccctcctcagcctactaaagtgctgggattacaggcgtgagccaccgcacccggccagtatgtcatcttttgagaagtgtgtgttcatgtcctttggccatgatcgtggctcactgcagcctcaacttcctgttgcccactttgtaatgggattttttttttgcaaagtgggtgttctttgagttccttgtatattcttctgctcagtttttcattgggatgctgtcttttgtcgctgagttgtgtattag

SEQ ID NO: 113464 - DNA, 159 bp, Homo sapiens
gcctggggtggtggggcagggagaccctagctcagggactctgacagatttgctgatgttctcacggccagagctcattgcaagtagctgagggaacagtccctagaccacaggtcatggccaaatcaccaggaggctcactggggtggggaggggcta

SEQ ID NO: 113465 - DNA, 673 bp, Homo sapiens
ggcatcctattcctcccctttcctcccgaatgtgtgggtgagagggatcaggagaggaaaagacggggaacgacggagcaaaaggaaaaactgaggagaaaagaatgagggagacccataaatacacggcaaaatggatgatactttagggacttgcaaagagagcaagagtgaaagagaacggatggaaaaagtagcagggggagaaaagcacacagagaaatttagaaaaaaaggggaccttcagagagatgaagggcagcaaaatagagtggggcggcaaaggaggaggcactgcagacagacagacagtggggagaaggtgaaagagttggagccgcggctgacagagctacgtggtgctgggactgaaagagagggagagagggcagtgggtgacaagcagagtagagggagaaccacagcagggagtaagcctaggaaattgggggtgctagagagtgggaacaaaggagatgtaacagggaagagggaatttaacaaggagagcagagagggagcttagatgggggaaaagaggcagaaatacgtggagattggggacaatcggaaagattggggagaaagagctacgagaggtgaagtaagttgcagagcattgggcagaacagacataaaagagggaataaagaaaggggtgcaaaacagaaaa

SEQ ID NO: 113466 - DNA, 689 bp, Homo sapiens
ttctgcggtgtttctagaggatcccttcatgtgagagcattcatgcctgggtggtgagagggatcaggagaggaaaagacggggaacgacggagcaaaaggaaaaactgaggagaaaagaatgagggagacccataaatacacggcaaaatggatgatactttagggacttgcaaagagagcaagagtgaaagagaacggatggaaaaagtagcagggggagaaaagcacacagagaaatttagaaaaaaaggggaccttcagagagatgaagggcagcaaaatagagtggggcggcaaaggaggaggcactgcagacagacagacagtggggagaaggtgaaagagttggagccgcggctgacagagctacgtggtgctgggactgaaagagagggagagagggcagtgggtgacaagcagagtagagggagaaccacagcagggagtaagcctaggaaattgggggtgctagagagtgggaacaaaggagatgtaacagggaagagggaatttaacaaggagagcagagagggagcttagatgggggaaaagaggcagaaatacgtggagattggggacaatcggaaagattggggagaaagagctacgagaggtgaagtaagttgcagagcattgggcagaacagacataaaagagggaataaagaaaggggtgcaaaacagaaaa

SEQ ID NO: 113467 - DNA, 1159 bp, Homo sapiens
atgctatataagcccaagttctaaatcctcttttgagtattcatctcagtactcccctgtgtttgtacaatgcacatgctttgtttctgtcttgtcaatctgtcttttgttagtctacttgatagggccacagatggagaacctaagatgaatagaaaaaaaagatttttctccccaacagaaggattatcgccagttgcacttgttctatatacccgtagtctcggtatgctgacccagacttgggtaataggacccagtgggtaaccgaggaaccccacctttgtgcaggatcagtgaagatgtaatctggatattcataagctcttctctacctcttggcatcccacagtcctgtgttaatgtaagtgtggtcttccccagaaaggggaggcctccctaacattgttaaagcctagcatatgctgcttagaggaaattctatatccctaagcacttagattgctgaataagaaagaatgataataaaataaacaattaaataaaagttttaaaaaatgaataaaataaacctgtggaaactataaggaaggccagaagaaatataaaattggagattaattggggtgcaggaaagttatggaaagaatataagtcctgctagataaatcattagctattttaataaagaatacagaagaaaataggaacaaaagaatatatactggaataattttgagagtaatttgaagaattagatgcaaataaatttgaaaacctttaaaaagaaaccaatggcctaactgacccaagaagggaaagaaaatctaaacagactgataaatacaaaatgaaattcagacacttacagagcagccaggcatggtggctcacacctgtaatcctgtcactttgggaggctgagatgggaggatcacttgaggctaggagtttgagactagcctgggcaaggctcccatctctaaaagaaaagaaattagctgggcatggtggcatgtgccttagtttcagctactcaggaggctgagacgaggattgcttgagcctaggagggcaaggctgcagtgagccatggtcatgccactgaattccagcctaagtgacagagcaagaccttgttctcaaaaaaaaaaaaaaaaaaagttacagagctccaactaaataatgtggggaacaa

SEQ ID NO: 113468 - DNA, 1126 bp, Homo sapiens
atgctatataagcccaagttctaaatcctcttttgagtattcatctcagtactcccctgtgtttgtacaatgcacatgctttgtttctgtcttgtcaatctgtcttttgttagtctacttgatagggccacagatggagaacctaagatgaatagaaaaaaaagatttttctccccaacagaaggattatcgccagttgcacttgttctatatacccgtagtctcggtatgctgacccagacttgggtaataggacccagtgggtaaccgaggaaccccacctttgtgcaggatcagtgaagatgtaatctggatattcataagctcttctctacctcttggcatcccacagtcctgtgttaatgtaagtgtggtcttccccagaaaggggaggcctccctaacattgttaaagcctagcatatgctgcttagaggaaattctatatccctaagcacttagattgctgaataagaaagaatgataataaaataaacaattaaataaaagttttaaaaaatgaataaaataaacctgtggaaactataaggaaggccagaagaaatataaaattggagattaattggggtgcaggaaagttatggaaagaatataagtcctgctagataaatcattagctattttaataaagaatacagaagaaaataggaacaaaagaatatatactggaataattttgagagtaatttgaagaattagatgcaaataaatttgaaaacctttaaaaagaaaccaatggcctaactgacccaagaagggaaagaaaatctaaacagactgataaatacaaaatgaaattcagacacttacagagcagccaggcatggtggctcacacctgtaatcctgtcactatgcccggctaatgggcgtttcccaatgttgacccagggctggtctcaaactcctgggctcaagcaatcccacccactttcggcttccaaagtgactgcatttctttttaactctagatacattccactattcagaagtacacggttatccagttactattgaaaggaatctgttccaggttcggatcactctgcataaagctgggataagcactcgtaacaacggagaaacagaaaacaactcttggcggca

SEQ ID NO: 113469 - DNA, 192 bp, Homo sapiens
aacctttacaaagatggtgccacatggaaggtagatgggacaggaagtctggtagggagggagaccaaggaggagacgacacatacggtggtgccatgagaggagcaggtcccttggccctggatttcctgcaacagcccagccatggcaagagtccccctcctacaagccagggctgggtggctgggcact

SEQ ID NO: 113470 - DNA, 249 bp, Homo sapiens
agagatagggcggggattgccttaacatccacgttgggaatttggtctgatcctaatgaaatggagaaccacttataactaactccagatacaaattgtggaaagatacttggcttacagtttaaagaatggaaaggacatttggagggtgcgtggggagcttagagacccatccagagactgaaagctctcctttctcctttcaagcagcgccaggcatgtgtatatccagcttgcaaggaccccatt

SEQ ID NO: 113471 - DNA, 840 bp, Homo sapiens
gatacttgatttttaaaattctgttggcagtcacctgccaacagataagctcctaagttttcctggtggtccttgcagtcccattttttccttgggtcttgggccaagttgaatgcattctgattgcagatgagctcccctcttcttcctccctaattccagatgggacccttggctctttttgtatttattctgggatcactgatgcgaatttcagcatgcagctccagtcacatcattccactgctcattacccctcagtgacttcgcatcaggtgctagcttagcaacactttagctggctgcttgagagccttcaggctgtggacccatccagccctgcagccttccctcctctccctcgagcatcctgtgtccagagaagcctggcttttgatgtttgcctgaatacatcatgctatcctgcctgtcgtctttttcgagcttctccttctggtagtgtccttcccttcacttgtcaatagcctatttgtaccttgggaccacctttgattacatctcctgcatcagccacttttctcctgttaataagaggtattaacatcattacccttggagccagcagagcactaaaatagggaggatgctagcagcagctgcagaccgcatgccagcaacactcaggattacggagagtatttcaggagtgcagcgagtttcacagaagtgcacaaccccgtacaggcattagtatcccggctttgccagtgaggtaacagacagtggagaggggcttataaaagcccatctgtatcagagccggaagtcaagccttggtctgttgccatctgcttcacgattggctgtctcttgtacctg

SEQ ID NO: 113472 - DNA, 611 bp, Homo sapiens
aagtaaactaaaccaatgataacaaccatataatcaccagttgttctaaatgcaaaataaataaataaataaataaatagggtaataagaatgcagagtaattgggatagtcacttcagggtgcctgcagagaccacaggagagggtgacgtgtgtttgtgatttctgtggtaccacccatcagtggacctgatggaccatggttctgacttctatcctttccccattttatagatggggaagatgagatgcagaagcacagtaactttccatgtgcatgtaggcatctatgtaagtggttaagtgagaattcaaacccaggtggtatgactccagagttagtatttttaaccactgtgctgtactgtcccacaagtaatattagtttaattttagtgaaataaccaagataagtaccaagcagactaaccccaaagtccgctcttaacagctacactaactgcctctcaagaggtcgtagagcttatagactgacacagctggtgtgtttttatcattttttttctgtgaagtaattagtatttattttttctattttttttcgatttcattatttttcaactaattataaaacaccttcaaaaaaaaaa

SEQ ID NO: 113473 - DNA, 571 bp, Homo sapiens
cagtggtttacaattcagacttgaaattcttttagctttaaacctaaatccacatttaagatcaattaagaccattcattctgtccagcattagtacagatggaatcctgctgtacactagtacaataatgtccatgtattttaaatcacgactaacttcctcgcttttcctcagaaaaataacataaactaccatattctttgctcattagacctattttccaaagctacacccacctctgcaactctcttttgaatggcgatatggtttggctgtgtcgccacccaaatctcacctggaattgtaataatccccatgtgttaagggcagagccaggtggagataattgaatcatgggggcactttcccccatgttgttcttgtggtaacgaataagtctcacgagagctgatggttttataaatgagagttcccctgcacaagctctcttgcctgctgccatttaatacgtgcctttgcttttcctttgccttctgccatgattgtgaagcttccccagtcatatggaactgtgagtctattaaacctctttcctttataaattaccca

SEQ ID NO: 113474 - DNA, 474 bp, Homo sapiens
aatgataattgtgcgtatttatggggtacaatgtgatgttttgatatgtatacattattgaaagaggctaacatagccatcaccttaccaatttatcattttgttatgagaatgttagaaattattttagcaattttgaaatatacaatacattattagtattagctgtggtcaccttgtagtgcaatagataactaaaacttattcctcccatctaattaaacttcgtactcttggatcaacatcttttccccatctgtcccacccctgaactcccaagtctctggtaaccatctttctactctctgtttctatgagataaagttgtttagattccacatgtgagatcatacagcatttttccccagagaataagagaatccagctgctttttattaagataaatattaaagacatttgcaaaaatgtaaatcaatattacttttctcattaaatttgttttttaaaagttat

SEQ ID NO: 113475 - DNA, 676 bp, Homo sapiens
ggatataattcactgggtggggtgctggtggcctcacgcctgatattcccatggtactttaaggcgagtgctcgcatagcgaggatcacatcggtctttaaccatgtgatggcaattgcgttgccagagtagccagacactccgtgccattagcagtccatcctgaggctactgcgtgatgagactcctggactctcattacatggatttattaacatgaagtccaaagctactcgtacctgtgggcatggtagctcatacctgtaataccagcgctttgcgaggctgaggtcagaggatcacttgtagtcaggagttcaagaccagcctgggcaacatagaaagaccccatctctacaaaaagtaaaaataaaataaatatgtttcctgattaaaatttgcaattatgcattcggaaaaatataatgagcaaagtacaaatcacaaaaaaatgccatcacttagaaataacattttggcaattctagttttttaatgcatatttcattcatataggtaagatcatataatacatacaatttcatatccaatttttatcttaaataatataaatgtaattatatcacaaatcagttcatattactaaaatttcaaaaatatttgaatggctgcatgttgaacaccatcttaaatcaggggttgcagactcagatag

SEQ ID NO: 113476 - DNA, 338 bp, Homo sapiens
taacttcattaattgctaaatttaatattcataaaatttcaagatggaaataattttttggtcagattcctgagtatgctgagaaatcacagccaaaagtatattaaatgcattactagtagccaaataaaatttaaaggcaatgttaaaaaatccatttgactactttttgcaacctaaaatacttatatttaacatgagacataggtgcattttaatatgtttgctgtgaagtgagatgaaatttcaaaattaaaagtatcgaggtcctacaaaagtcttaaaatggctctgtttgagtatgctctaaataaggcacgtggttgcacagagttgga

SEQ ID NO: 113477 - DNA, 772 bp, Homo sapiens
gcaggaggatcacttaaggccgggagttggagaccaaccctggcaacatagtgagatcctgtcactacaaaaaaattagaataaaaaataaggccagcatggtggcacacacctgtagtcccagttgaagtgagataatcatttgagcctgagaggtggaggctgcagtgagccgtggtcacgccattgcactccagcctgggcaatgagtgcaatgagtgcaaatgagagcgagaacctgtctcaaaagaaaaaaaatatatatggtcacagagtaatgtgctgcttttatgtcctctatgattttgaaatatttaccctgggatagtgatttcttcttatagctccaatcatgtttttgaatatgaaagaatcattgtattttaaaaagatagccagtagattttatttttaaatctgtttctaaatatccaaagactccagtgattcattaaaatacttttgtttccctaggaaaaaaagtttccacatatgcacggtaatcatttggcattttgtaggcttaagccttggggagttagtggtatttggctcctgacatggaagtctttctcttgtcagacaaatccttcccctgcacattcctgctgaaaaatttgttgctgttgtgcctaatggcaagcagtgtggtggttggatatgggtctgtactgcccaagcgaactctccacattgatactttaaacctctttgtgagtatactttaactttatataatattaacccatttattgtttcatcttactccaga

SEQ ID NO: 113478 - DNA, 852 bp, Homo sapiens
ctggagaaaaatcagaatgctgtagaatatgggatgatttggttagggctaaaaggatgacctgtctttaacaaggtaggcaagactataggaggagcaggttttgagaggaaattaagaatttgcaatatacttgttaatttaaaaatgccttctaggcatcccgtggagaggttaagtatgagtctggagttccatggagaaaataagctgacatataaatttgggattcacctgtgcacagccattgactggatgagatcacagagagaatggcctgagggatagaagggatcaagcccaagtcattgctcatcccaaattaaagatttgtaaaatgagaacgaaccttaaaagaggactaagaaagaatggtcagtgagactgggcacagtcgctcatgcctataatcctagcactttggaaggccctcaaggtggcaggatcgcttgagcccaggtgtttgagactggcctgggcagcatagcaagacctccctctctacaaagaacaaaaaaattagccaggtgaggcagcacacacctgtcatccaaggctgaggtgggaggattgcttgagcccggcaggtcaaggctgcagtaagctgtcattataccattgcactccagcctgggtgacagagtgaccctgtctcaaaaacaaacaaacaaacaaacaaacaaacaaaaaacaaaaaggtcagagagcactgaggagaatcaagaaacagttgtgaaagccaaatgaagaaagcagtttaaatgtgactgactgactgatggcctgtgttaaatcctggtgaaagatcaggtcgggtgagtttggagaaatgaccactgggtttggcaacct

SEQ ID NO: 113479 - DNA, 219 bp, Homo sapiens
tagtagtgggtcaggtgtacatgcagtcctggacccaggagagagacagaaggcttaagggggaaatttggggaaggcatttggagagagagaaagaaatgagaaacaccaaggagagagatacagaagagaaagatgtaaaaagaccgagggtgagagactgaaggcaagagctggggcaagctggaagaggcccacgaaaagatgctcccagggagc

SEQ ID NO: 113480 - DNA, 325 bp, Homo sapiens
ggacactgagtactatgtctgaaacacatgggaatccctaggataccttccagtaattatccagtggtaaaagttagcagattagaacaacccaatacaagtcaggccaaatacaagtcagtccactagaggctaggcccttgaggaataaagattttggattacttcattaagtaaagaactaattctaaccagctgagatgctagccaaacaaataaaatatggatttcccagtggagggaagttataaatatcagctatagcctcgtgaccagttgcagaaaagatggctaggctgtgcatattttcttgcttgtatatata

SEQ ID NO: 113481 - DNA, 649 bp, Homo sapiens
cttcgggccttgtatattaaattggtttcttaaatttataaagcagttcatagcttctgtcaaacttacgtatcttaaaacccaatataactcccttgttgtgactgaagaatcaatgatttgattacccaaaacatgagtggggaatgtgatacctaccctgttttaacctgccccaagtttacgtgtacagtgggtcagaagggtgacttctgacccttctgctcagagtgactctctcttagctgagatagctggacactctccattttagcttcttcacttgcagtccccttatccccctcccttaagggaataactagtgcaagctgactccaagcacatccaggaatgcacttactgataagatattgaggcaagctgtaccagcagctcctggggacgtgctcggcggatggtacccaagcccctgcatttatctctttgtgatagtttaagcccctgcacctggaactgtatttttctgtaactatctctgtaaccattaatttttttaactttttgcctgttctgcttctgtaaaaattgcttcaagtaggctccccctcccctatttagaccatggtttaaaaagaaatctatcccgttcttcgaggccaagagaattttgagctctagccatctctcg

SEQ ID NO: 113482 - DNA, 204 bp, Homo sapiens
taatttatagaaatgaggtctcactgtattgcccagactggtcttgaactgctgagctcaagtagtccccccatcttggtctccctagtagctgggattataggtgtatgacacgatgcccagctctatttgagtaatctgtttttttttgttgttgttgttttttttaaagacagagtctttctgtgttgcccaggctggagt

SEQ ID NO: 113483 - DNA, 683 bp, Homo sapiens
gagagtgtttttctctttgaattgctaaaaatgttatttcctctctcctggatttttcaaggtgtgcaataagttgtgtagttgctgctctgctgcacagagctttaatataaactgcgtattttcactctgtatgtgtgagtaatctgtgccttctatggctctgatcgtgggtaagcaaaaaacacagtgactgctgaaatatagggatggaaatttctttgtcagtaaagatcctatgaaatcatatactgagcatacgtaaaatatggaattgtctctgcagtattgatcgagcacaaatccactttcgtaaagcaaaaataaaggtcaaacagaaaaggcacatcactggtttttaaaattttttgaataataagtacttgaaattccttaaaaatgacactatatatgatttaacttagatagctagaatagtcaaatacatagaaacagaaagtagaatgcttattgccaggggctccagccctggtgagggaggaatggggagttaagtgtaataggtgctgggttttagagatgttgacaaagttctgaagatagatggtggtgatggttgcacagtagtgtgtgggtatacttgattccaataaactgtacacttaaaatggttaaagtggtaaattttatgtaatgtatatttaattgcaataaaaaggata

SEQ ID NO: 113484 - DNA, 574 bp, Homo sapiens
tctgccttgtctggcatacagcaggtaatcaacaaatgtcaattacctttcctgctcatctcccccttctccatttcctcttcctcccctatcccacacacaaaaacagctcaatttgtagtgacaatctagattccaaacaataaaaactagacacttctcagatggagttgggtatcctctgcccaaaatgctgaagcaaaagggcacttacagtgagcattcctatttaggtttctcttaaccaggaaagttgactctaactccttattttaaacttaaaactgactttcaactccagatccagggttgtccctcaaagctacagctgtaatccagagtcaaaaatcacctgacccctattgccaaggtttctgcttctgattttggctgggtaaataggctatgtgtgttgggagagagagaagagaaagcaagaactaacttgtactgaacatctcctgtgcgccagatgctttaaatatgctcatctttcaaaccacaatgcaacaggtatcactctcttcacattacagacaactgagttagcagacagtattttttgaatgacaaa

SEQ ID NO: 113485 - DNA, 349 bp, Homo sapiens
agttggatggggagatcagagtgggtctcaagagtgccactcctcggcattgtgtggatgggcggtagtgagaataattactaagggcgtcataccctctcgtatctgcatcacccataaggggtgggcagtggtgctgccgtgtcttgtcaggaggccagctctgtgtcacccaccaggctgggctcagccacaagtcggcaacgtagtgcctccagggcagatgccacggaccgtagagaagcaacgcaaggtcagagagaaaagattgcggccggccggtgtcaaggcgggggacctgtgagctgggcctggagctgaggcagaacttgatggactatgactcaag

SEQ ID NO: 113486 - DNA, 594 bp, Homo sapiens
cttctgccagccaagaatctactgggttactttcaaaaaagtgcacaattggttattggctcttccttcctaggtgaggaaacctaggcatttcaaagaagtaatttttgcagtggactccgagtgcactagagcccacggatgttgactggtttaggccagtggctacacatctgtaaagaatatccagtgctggggaccttgacttatgagctctaagtaggcttcttttctttggtgacaggatagagagctgtgtacttgaaggtctagcaagtagagctttagtgaatcttggggtaggtgctgtctctctgggttagtatattagaatgggagtggggaaccttttttatatagaggacctctggcctacagagagaaatcaatcagtagctacttaaaaatagcagaagtggggtttgggaaaagcaaaaaacaaaatgttctgtatgatccctgtgttacattaaaaacataattttaatgtttttaatctacaaatgatagagtgcaaataatgagaaatacatttaaaaggcatgttgtacttaagtttcatcactaagtaaattgagaaggtgggaaaaaata

SEQ ID NO: 113487 - DNA, 411 bp, Homo sapiens
gttgcattccagcctgggcaacagagtgagacaatgtctcaaaaaataaaaaagagagagtctgaaattcattctttcaacatgcttgtgttgggtgctgcctggcacagcaattggtgcccactaactcacagcgtcggggaagataggcacggaacaagtcatctggtgtggtccctgcagtgggggagcccagtgagggcctgtccagcccagctgagaggagactgagagaaggctaggtggcataagtaaagatatggatagcgctttcctcttcagagtgtttattaccagggttagataaagcagatctcatgtattttctgctactaagtagaagttcttgttttgtttgatttctggtgggctttgatattttccaaaaagataataactcattgtagagta

SEQ ID NO: 113488 - DNA, 113 bp, Homo sapiens
agggatttatacaggaagatactgtagtggaagggcagaaggtaagaaatctgcatgctggcatcagattaggtggattcaaatcatagcacactgtggcttgacagctgtgt

SEQ ID NO: 113489 - DNA, 629 bp, Homo sapiens
atggctggaatgccacccacctacaggtgggatagttggacagtgcatcctgggagcagatcaaggagacgaagagactcggccatggtccacagctcccacctgctgtgtctggtgctgggaggcaggttcttgttgcagcagaggagccacccctgggagcagggcatctggggaccaatccgaagatgctgttagcacatggctagcaggtgcccctcagcccccacctcccacaagttcagggtccctttctgccaagtggggactgctggttcttcaggacaacccagcttccccaaccctctgttcagacactaagcagtcctctgactccccatcactagggatcaggagagccccttacaacacacacattctgtcgagggtgctagaccagtctctattagtttctgtggctgctataacacactaccacaaactgggcagtttaaaacaacagaaatttactctcacagtcctggaagccagaagtctgaaatcaaggtgtcagcagtactgtgctctctgacggctctgggtgggggtctttccttgcctcttccggcttctggcggctccgggtgttccttggagtgtggctgcatcactccaatatcagcctccat

SEQ ID NO: 113490 - DNA, 398 bp, Homo sapiens
ttctgcctgttactccttgttctttatgcattctaccctagtatcattctatgctctaaccatgccaagtgggcatagtctctgaatgtactctgttctttcaccctctctgcatctctgcacacactgccccttgcctggagtgccataccttattcatctatctaactcctccttctttgaggctagcaaatcatgtagcacttcctcccacaagccttccttcattcacattcctccccttctactctcccagagcaccctatgcttatcttgttcattgcccttattatccttaattttaacacattctaagctcctaaaggtcaacacttataccttttgctctgttccttatgcaatatttagcacaatgcctagaacatcagaggtactca

SEQ ID NO: 113491 - DNA, 344 bp, Homo sapiens
atagcaaactcatggagtacgtgaaacgcatatcatggcacacaaaatgaactatgctattgcacaaaggctgaagacccaccataaccaatttcacccattagttgaagaaaagactggatacagggatgatctaggcaactgtgccaccattatgagaaaacccaagatacattacaactgcatattagattgataatgtatttatactagtttgtataggattatatcatgtgacaatttatattttagtaactcctgaatatataaatagcaaaacatctacttaatttgtgacacaaataaaaaattagaaatgttgttcatgggacctgacattagtc

SEQ ID NO: 113492 - DNA, 592 bp, Homo sapiens
atggggctgaggggacaagtgggacctaaacaggtccagcaggtaagggcagaggcatgaaaggaaagtaacctctctccttctctgagaggcttcctgcggtggaagatggaaacaaaaaccagaactttcttctgttctgtggatgcccacgggaaactcctctctgggctgccagggatgtcagggatgatgggaaggctgggagacttatcttcccccgaccccatctttgctgctactgggaaaagctgctctcctctttgccaaagttccctggcaatctgggctcatggtgaaatgtttccaaccagaacagggagggtcatgccaaggtgtgccaaggacacaggcaccctgcatgctttcttcttctgaaactcagcaccatgcaggagaaaaagcagaacttttgagtcagatagaactgggttcaaacttgggcttccccactcatttgccaagtgaacttgggcaagtcccatatgtactctaagcccagactggttcatctgtgtgatgggaataagaatagtgacctctctgtgttgacaagaggattaaagaggataacagaggccaagtgtctcgc

SEQ ID NO: 113493 - DNA, 312 bp, Homo sapiens
gaaagatgtactgttatttctaggatcagatatcagggatgtcctgcatcagtgatgagagtgaagcttcacagttttgatggctgtttaacggagatatgatacttgaagcagacctccactgatgggtatgtcggtggtttgcaattttttgctatttaacaattgcagaaatcaatatcctgatgatggattattttgcaaatgtgtaagatatgtgtagaataaatttctagaatgattcaaaggcatatgcatctttaattttgattgaaattgccttatttatctccacagaggtttgtatcaatt

SEQ ID NO: 113494 - DNA, 300 bp, Homo sapiens
ggtcgactctgcctcttatctatatacagacaagatttctttgttccacagtctaccaagtagactgtggaacaaagaaatcttgtctgtatatagataagaggcagatatgcaaacaaaagcagagggagagggagcatgggcacctcctaggtccgggctggctttccatttgtcccctaattccagtctctctctgaggcccagctgctcccattcttaggtctggcaacctctacatccttataataaacccctctttctgctaaggctagctcgagttcttctcagacacctaca

SEQ ID NO: 113495 - DNA, 578 bp, Homo sapiens
tgaatgccaaggctgcagcctgaagcatttatttagtgccggagagggatctagttattttagagttcccttgaatgcaatattttaattttgttgttcttcttgaaaaattagatccctctgagcttccagtattgatggttgagatgaatgactttggctctggctgaccatggtctttggaaggataatctcagagttgtgatgggagtggacttggctgttgaccccaaatcttactttttggatggtaattccctcctgcctgccagacctgctgccgttccactgccacattaattcaccctcagaatcagggcagatgtttctaagctgttgaaaatttcttgttctctaaagagagaaaaacaccaaggacctgatgctgtgtgtcatcccgtccttcagggaaaataatgagcaccctacaaccatgcaaagctacatttatggactcgaggtattttgtgttcattatgggtgaaatgatttaaagtcaagtttggatcagcctccaatcgcacacattaaagaagggtagcacgacatggatagcaccaaaaaaaaaaaaaaaaaaa

SEQ ID NO: 113496 - DNA, 445 bp, Homo sapiens
atgatggtgtgagcctggggtgagcacagaacacacagcaggtggttcgtctgggttcctaggggaggacggcaggtctggaggggacccaaaacaaagcccagaagccgcccaaccatgtgaaatcatgaaatgtggtaactacttaaaaatgtgggccgggcgcagtggctcacacctgtaatcccagcactttggaaggccagggcgggcagatcacgatgttaggagttcgagaccagcctggccaatatggtgaaacaccatctctactaaaaatacaaaaattagccaggtgtagtggcaggtgcctgtaatcccagctactcgggtaggctgaggcagcagaattgcttgaacctgggaggcagaggttgcagtgagctgagattgcgccattgcaccccagcctgggtgacagagcgagattttgtctcaaaaaaaa

SEQ ID NO: 113497 - DNA, 240 bp, Homo sapiens
tggtgtttgtgcatcctggggtaaggactcacccgtccatggctcttctcctcccaaaagtattccgtattcctggaggctgcctgggaaaaaaagtgctttccgtctaggctggatttggggaactgtctagtggagaggtgatagccaccttgattcctgttttcttggcatacccacccaacgcagatgtgctgggtgaggcagaaatctcgtccttcctttttagatgaatttaac

SEQ ID NO: 113498 - DNA, 378 bp, Homo sapiens
ctgattccatgcccttaagtatctctgatggtgttaggggccgatgggcaggtagcccgcaggggtaaatgatcaaggtgttgaaggcgctccagagagcaggtgttaaacattttcggccgggcgaggtggctcacgcctgtaatccgagcacttagggaggccaaggcaggcggatcacaaggtcaagagatcaagaccatcctggccaacatggtgaaaccgtctctactaaaaatacaaaaattagctgggcatggtggcaggcacctgtagtcccagctacttggggagctgagacaagaatcgcttgaacccgggagttggaggttgcagtgagctgcactccagcctggcgacagagagagattccatctt

SEQ ID NO: 113499 - DNA, 549 bp, Homo sapiens
agagttacaggcatggtgtagttagaaagctttgcaaaactgaattgaagcaaggctttgtgagataagcaattaaggtaaacctgaggaagaaggtcagttgtgagctgaaacacaaaggaggagaagaggagtggggagcacattttaggtgaggaattcagaactagtaacaactgatgtctactcactggcaatgagaagaccatcctgatgcatgtacgtcactgaagataatcttggagagtaaaaagtcaccagacttgaaagggccttgaatgccaggaaggcgttggtaattggcagtgtttaagttgatggactgtaccaaagacaggcatccctattcttgaacaagtaagaggcagtgccatgcgtggattgccaggagtcgaaccaagacttggagttaagaggatattcatcttttgcatccaacaggcagaatatgatctgtgtccaaaagtgaacttgagtcaggactgaatcaattacagcatacaacagcacaaaaatttagtctgctggctgactggaagcaaaaaaagt

SEQ ID NO: 113500 - DNA, 558 bp, Homo sapiens
agaggaaagagataataaacacattaaggcaggactgtgtctaatgtgttcaagacaggcagagacaggcatagtggcacagtcccagctactcagggtgctgaagtagaagaccagcatggacaacatactaagaccctgtattaaataaaaatgattcaaccagcaggtcagaaggctgaaatattgcgactgaaactgataaaaggagatgacatcagagaggaaatttgggaagcagattgtgtaggtccttgaggttgttgtagtaatcttggcttaatttttcatgaaagatgaaacaattagagaattgagtggagaaatgacataaactgacttacatcttaaagggctcattttggcttttgtgttgaggttagacactagtggagcaagaatggaaacagaaagtccagttagaagaacattgccgtcttaatattgctatgggctaggaagatagcaatggagataataagaaatggttaattctacatctgctttaagtgcaaagccaaaagtgtttctttctggttgcattttccctcttactct

SEQ ID NO: 113501 - DNA, 629 bp, Homo sapiens
tcacagctacaggcaaaaatagagcagcctggggaaaactcagactgtacctgcacagataagcaggcaaggtccagcacagaagccttttgttctttgtgtgattagcaggctcccaggaaaatgttttctccccttttcagatatgaacacggggggatccatgggagattgcactggaaacagagggggtttacctaaaagaaacccacaattactcaaacaagaaaaaactatgctttgtgcttacctagagacatctcacagctgtataggtaggtggagttgtgcagacaggttttcaaataagagaagttactcaaacagctacagagatgagaggagtttcttataaaagcttttgcattcagctgtaaaatggcaccccacttgggctctcctctccactgtggagagctttcttctttcacttactaaacttttgctccaacctcaccctttgcattcatgctccttaattttctcagtcatgacacaataagttcaaataacaccttagacaatgagacaatggaccctgacctatttcaataatactgaagcattgggcagtttgaaagaggaaagttctcaacagtaagaaattgtagtgtgagttatcttaatga

SEQ ID NO: 113502 - DNA, 663 bp, Homo sapiens
gttgatttagggcaggggaaatattggctgggtgagagtgagataaggagctggtacggcatgtgggctgtgggtcacgggatttggagatgaagttggcaggcagtttggccctgtgaatgatggatgccctgtggacaaggacagcattcctgttcagaaccaagatctcccgaccttgctttcttttttggtttttgggtgacttaaacagcagaaacttattttctcacccttatggaggctggaagcccaagatcaaggtggcggcagggctgggttctcctgaggactctctccttggcttgcaggtggccaccctcctgctgcctcttcacacggccatccctctgtgccacacctttctatagtgaaatgtctcatagcctcttcaggggctctgtcctaacctcaggtctgtctttgtatctgcagtgtgttcaagcctcgagaccctcggtggtagctggtgactgccgtaggtggggagtagttactaggtctgaggctaccagatgtcagacctgtgtaccctgactttttttttaagacacaatctcgctctgtcgtccaggctggagtgcagtgttgtgatctcagctcactgcaacttctgcctcccaggttcaagtgattctcatgcttcagcctcctaaacagctg

SEQ ID NO: 113503 - DNA, 289 bp, Homo sapiens
taaaatatttttttcttttttggagcaaggtagagatggggtcttgctatgttgcccaggctggtctcgaactccctgcctcaagtgatcctcctgccttggcctcccaaagtgctgggattacaggtgtgagccaccacacttgaccacctctaaacttctgaatgccaggcagggccctcaatccccagacctctcactcaaatcggattctaacaaatctgctagatttttctctctgctcatctctcatgctgaagtacttccctgatttatggtgggaactgga

SEQ ID NO: 113504 - DNA, 280 bp, Homo sapiens
gaaatcccatctcaaacaaaaaaaaagccagggagttgagaaggaactagctaaagatactgagaaggaagggccagtgaagtaagaggaaaacaaggagaatgaggtgtcctggaagccaagtaaagaaaagtgtttttaggaggaggaagtgatcaattgtatcatgatcctgacaggtcaagtaatatgaatactgaacattaacttttgcactttgcaatgtggtagccattgagtgaccttgacaggagcagtcagtggcataagaagagcaaaa

SEQ ID NO: 113505 - DNA, 111 bp, Homo sapiens
acataaaaactctcacctaaagcaagcattcagttcatgtgcatgaagccttctaaaacctatccaagagtgttttggtagtttctagaacctttatgaaatattctagat

SEQ ID NO: 113506 - DNA, 437 bp, Homo sapiens
tcttgtgttcctcagggacaatctatgtcactgtcacgttagtgaagataatggagagaaatatgccctgccagctggtggcactcagaaagtgccatggagcagcacagcctgcgtctcagaatggacaggaaaaaagctttatcttcttcctgtcaaaggagggaaataccttgtggaaggtcagggtgccgtgcacctggcaagtgcctgcctgaccccagcctgtggcagaacctgaagggccactgcgatctttatcaggtgactcagtgcttagcactggggaagggcggagcatggagcaggcacagaaggtcccgtggagaggccctgagcagcccagacaggagcgctccattctgctgctcaaggcattacctccagcagtcaggcgcgtacagctcgcgtctctcggatgatttctctctctctct

SEQ ID NO: 113507 - DNA, 816 bp, Homo sapiens
tattgctacactatcttcttgcttgcatagtatgtgacaggaaatctaagtcatctttattattgtttctctttatgtgaagtgtcatttttctcaggtttcttctaagattttccttttatcactagttttaagcagtttgattatggtgtatccccacgttctcatgttttctttcttgtgcttggagtctattgaattttttggatttatgagtttatagttttttttcagattcggaaatatttcagctatgatttcttcaaatattttgtaactccctgcttgccttctttcctttagcaactcccattacacattacacacatatttggctgcttgaagttgttccatggttcaatgatgctttgtttattttttcttggtcttttttttttttaatcttctgtgcttcgttttggatagtttctattgctatgtctccaagttcatttatctttccttctgtgatgtctaatcagatgtttatcccatccagtgtgtttttcatttcatacattttagttttcatctgttgaagttcatttttaaaaacatcttatgtatcttaatttgttaaatttttctctaaacttttgaacatatgggatgtgttcaaatatcataactgtgttatcataactgtgttactcttatttattaatgctataatctatgtcattttaaaagtatttttgataaattattttcttctcctcaatgtcagtttgatttttctgactctttgtatgcctggtcatttttttttttagatgcacaacattgtgatttttatcttgagagatgctgtatatt

SEQ ID NO: 113508 - DNA, 500 bp, Homo sapiens
gacatctcaagcagtgttgtcaagcagggtgtagggtgtgtcagtctttaattcagatgctttttgaacagtagacaggagtttcagtcattagtatgtaaatagagattaaaggcacatgaaagaatgagatttcttaggggagacacttagggaaaggaagagagctgagaattatgccccagggctctgcaacttctcatgtctgaagaagaggatccagaaaaggagacaaaggaggagtgcccagtgacgtaggaaggaagccagggcactagtgttcaagagctttggttaaaacactgacagggaaggatgataaattggataaggatgaagattaaaaagtgaatattaagtatggcaaagagaaagttattgccaactttgctaaaagtggttttggtggaaaaatagtaaagagagctttattaaatgaggtgaggtgagaaaatgcagacagagagtaaaggcggctttttcatgaggtcttgtagtaa

SEQ ID NO: 113509 - DNA, 342 bp, Homo sapiens
ctcctcctgcctctctgtggagctgggacagtggtcttttcctgcccttggtctgaaatggaaacaccagctctactggggcctcaagcctgctaccttcagactggaactgaagcctgggatctcctgggtctccagcgtaacagctgcagatcatgggacttctcagcctctataatcacatgagctaattttttgtaacagatatctctccatctatctctatctctatctatttatcatctatctatgcatccatcctattggttttatttctctggagaactctgcctaattcaatcagcaaggaagtggaagaagacaggacaacaagaaagtcca

SEQ ID NO: 113510 - DNA, 278 bp, Homo sapiens
caaagagccatgtcacatagtaagtggccagaataggttgctgacagcatgtctagaggaaatgtattagatgaaacatattaaattcaaaaactttttttgaggcggggggcagaaatgaggtacaggggagagaaacacctacttggaaagaaccacacaactgaattggaaaacttggaatggggcttgtgggagggggactctacctgagatctggctccagtacttacagcaaagggaacttgggtgggttacagactctctgtgccttggtt

SEQ ID NO: 113511 - DNA, 827 bp, Homo sapiens
atcacttataacacacttttagtatcaggcactgtgctaagtaacttaaatatacttgttattgtatcttttacacaataatttggactgttataatccttattttgcaagtagggcaactgaggcatagtcattgatttatttccttttgtgcacaaaggagaaaaagataattctaagggctttttagctatggtctttatcttctgaaattcaaattcagatgtcaaaaggttaatttgaattctttccccatgatcaaatggcatgaaagacctgtgattatatttacaggatgcatattaaactttcaaggtccaggtgtctcaaaaagtgcttttaaaaaatagacttccagtataattttatcaccactaaatacagaacatgattaggttatagtaaaagttttcctgtctctgcagctttctctctaaaatttattcatcttagctgcccagagttccttttgttacttgaactgctaattgaagacagtttccaaagcctaagatgagatttcatttgttagaactgaattagaaagagcaggacctaatcacttgattgcaaacataggaaactagattttgcaaagggaatatgggatgtacaatattctgcttctacacaggtgttcctaatgtatatctgatctcaattttaaaattcctattctttaaagccaggtcaaaagccaggtctgagaatcttcttgtgatttaacctcttctcatcctggtgaccgctgtttccttattgtagtattcagtctgcactttgccattttgcacttgacagactgctttatgtaagggtaaaaacca

SEQ ID NO: 113512 - DNA, 748 bp, Homo sapiens
ggccggcgctcccgcctccgccctgaccatactggggggaccctgagctattttcgcgcctctccgggacctcagcgccctgcgtggccccgctggcggtttggccgcgaggcgcgggagtctgaccccagcgggaggctgcgggtgggtggggcgggctgcgccgccagggatccgtcggggtcgagggccgggagctccagccgcgccgctgcgtgccggccgggccgcccgcgaggaggggctccgtcggggcctggggaagcgcagaagcgggtggactggagaggttcggccggggagagaagagcccaccgcggaccactcgcccgcacccgctcggctgcctgctcagcgttccgggccggggaaggggcgcgcccctgctctcccagccctgggatgggacgcgccgccagtccaggcgcagcctggaccgccagttcaccgccgcctgtgagggacagtcggttgcccaaggtcgccggggccggagcccgggacaagatcccggagagcgggcagccaatctcagaggtcgctgggaaccgcacgggccgtagcctcaggactccgggcctcgcccaggctgtgcggaccttggggcggcttcagcacctcggagagctccccgcgccctggcccagcagcctcgcctgcctgattccgctccagcgcttgtctccctccgagagcgcccttccgggggaccgccggggtcggacgctccccactgcgcccaggaccg

SEQ ID NO: 113513 - DNA, 855 bp, Homo sapiens
gagaggaggagctactgatttccagctgcaaggttgaaatgaaaaccagcaaaagtgcaagccaagggttcagtttcccaatagctgcagctgtctagcacccggagctatttttaaactccttttcagaacttccagtgcttgcgatggatctattttcttaactgccaagagataatgcttaaaagggatagcttgaaaatattccacggcgctcatacaaatgactgaaatagatagtgtacaagacggcctttgtctggagcagcagaggaaagcaagatgaagtctttcagaccccaggaccatggtgctgctggatctgctgctgacaaccgtggctttgtgtcttgaatgtgcactgtgaccagaaaaggcaagaaaaccaaacagtaattgtaaagaacatcagagacctggcatttaaattggtcattgattccaggaaacaggagaccccaaaatagctcccaaagaatcccccttgacttgaagagtgctgccttatctgcaacgtggatggagctggaggccattatcctaaggaaactaacacaacaacagaaaaccaaatactggataagtgagggctaaacattgagtatgcatggacacaaagaaggaagttatttgaagatgtgctccagcaaaataagaggtaacccgggatccatgaaaaagtgttttcaacccaagagtgtgacaaagagaatttccaggatgacagccctggttcaggtctggagatcaactgccgtatacgtacttgagaacaagtatgaaagtgtccctgagggaggtatccagggaacaaataaaggggagagcatggcaaagtatttctgatatgataac

SEQ ID NO: 113514 - DNA, 314 bp, Homo sapiens
agtgcagatggagctcactgggccaaatttagtcaaggcaccagctgggtgggttctttctgggggctccagggagaccccgtttcccgccttctccggcgtctgaagccgcctgccccttggtgcagccctgagtcaccccagcctctgcctccgtctcacgtcaccgcctctgatacagccgcccccccatccctcttgtgaggaccccgcaatgacgtgggcccacccagatcatccaggaacatctccccatccccacgtccttcacttcatcgtctgcaaagtcccgtatgccacggaaggtgacacag

SEQ ID NO: 113515 - DNA, 180 bp, Homo sapiens
aaactctaatcattgtggcttaagctagttatgttttattttttttgcaaaaaatacaaatctttattgaagaactaaataaaacataccaaaacataagcataccaaatgtgtgtcaaataaatgtatacatccaataaaactctaatcattgtggcttaagctagttataacaaatac

SEQ ID NO: 113516 - DNA, 302 bp, Homo sapiens
aaaagcattggtttgggaccttagttgaggaggcacagaagaaactaaaatagcttcatctatgttaggacttaagctaaatttccatgtatttagacaaatactgtaacaaatgcatttaactctcaatactataaagcagcagaaggattgagaatccatgaataaatggatatttaccttttggttatagtttaagatacaggctattattagctgatcagtaacaagctaaggttagaattcaaaggtgccaatgacaacattcacaaggggtttctgcacatccctgcaatctaatt

SEQ ID NO: 113517 - DNA, 1067 bp, Homo sapiens
taaacccttggcttcaaggactcagggtctccctatctcttatgaagtattgggaaacactgattactggagtcaataggttatcattttgctatttattttcttctctcaagctctgaaaaaaatgtcctctgtataaattaaacaacaacaaaaaatgttgtaaattctatgtcattacagtcaacagaattataataatgcatccaaaatgtgcggccacaaaatatcaggtatatgtttgaaaaagaaaaaaatgacattctagccttgttaaaaggataatggtcccatatttttattaacaggttagcaaaacaaaatccaatggattacaatatttacatgttatttgaaaaataaagtagtgataaaagcatgtcacaattattttctttttttttttcctttttctttctttttttgtttgttttttggtaaccattacaaacacccaatccaggtatggaactgtttaatacatttgaaatgaggccaattaaaaacaaatatagacacaaaatgaatctttgtctggatagttcacactttccccattttctggtttccacatgatggcccccatcccttaaaaaaattaaattaaaacaaacatcctacaaataaaaattcttaacagtaagaaaataaaagaagaacatgcttttcaagtaagcacttattccacaaatgcaacatctttccatggattttatttgaagctgtgtgggacactgtcatctcagcaattccccttccctttcttccctcccaccctcccacaacccttccaagtaaaaaaaaaaaaaaaaaaacatgaaaaccaaaggattcacacgtgcacacatgcacacacacactcatacacgcacacacacatccaagcacacacacacacgggcttctaaaacctaggcttcaagaaaagttcttttctattttttggaacgaaaccctttgttcacaatcagaacatattataaatgtaggcttagatttagtctaagctgctccctcctgaaaaagctgatatgggggacagagcagctggcagctagatttaaaaa

SEQ ID NO: 113518 - DNA, 368 bp, Homo sapiens
gctcagctggctttcgtgttgagttgccacacagcctttcctgttcattgtcacagacccagcagcacctagcacatagtgatacaaatgctcagcaaatagacactaaatcagcaaatgtgtgacttgaaatagtttttcattatgactgatttcctgtccactttatgtctggcttttttgtttttaagctatataaggtgtaatgatttcattctgtctgattctgatttgtgaaccacatcaaatcatttcatcaaggagtcagggtatagtataacctgaaaggaatatgcctctgttttatacactgtgacaacacagtttggatgttcctgtgagagagagagagagagagagagagaaag

SEQ ID NO: 113519 - DNA, 4500 bp, Homo sapiens
  misc_feature (3597)..(3598): n is a, c, g, or t
  misc_feature (3606)..(3606): n is a, c, g, or t
  misc_feature (3612)..(3612): n is a, c, g, or t
  misc_feature (3643)..(3643): n is a, c, g, or t
ggattttcagcaccacagtctgaacatggacctcgaactttagataatctcattaatcctccactcaaccttcaagaaactcaagtcactatagaagaaatcactcctcttgtccccccacaatcaggagataaagggcaagaagatctcacaagctattttcttgaagcacttctaaaatacatagtcattcaggtaaaaagtttagaatggaagaacaaagaaaaccaagaaaggggattttcatttttgttttcacattttaagaaatattacttgccttatatttttccaaacatctgtaaggaaaacagtttatatcatcctatacttgacatcccgcagatgagaccaaagccacattatgtcgtgataaagaaagatgctgaaaccaatgaagcaatctattgtacaaaggagcctttcattaaggctcgtgttattgtcattcgttggctggtttctttctggctggagccaaaaccacatacaggacctcatattcctgggatggaaggtgaagtcttgccaaagaatattcagagagcagctgctagtttagtatccagagaagaaagcaaaaatgataatgctgataaaacagacagaactacagaacccgaacagtctcattccaatacaagcactctcacggagcgagaacctagctcatctagtctctgtagtattgatgaagaacatctcacagacattgaaatagttcgcagagttttttcttctaaaaggagtaatgtaaactttgtgacagagatatttcgtcaggcatttttattaccaatttgtgaagcagcagctatgagaaaagtggtaaaagtatatcaagaatggatccaacaagaggaaaaacctttgttcatgcaagagcctgaagaaattgtgatcacttcttcagacctcccttgcattgaaaatgtcacagaccatgatatttcaatggaagaaggagaaaaaagagaagaggaaaatgggaccaatactgctgatcatgttcgaaattccagttgggcaaaaaacggctcctaccaaggtgctcttcataacgcctctgaagaagccacagaacaaaacatacgagctggtacccaggcagttttgcaggtgtttattataaactcatcaaatatatttcttcttgaacctgcaaatgaaataaaaaatcttctggatgaacacacagatatgtgtaaacgcattcttaacatttatcggtacatggttgtacaagtatcaatggacaaaaagacttgggaacagatgctgcttgtgttgctcagagtcacggaatctgtactgaagatgccatcacaagcttttctacagttccaagggaaaaaaaatatgaccttggcaggtcgacttgcaggaccacttttccagacccttatagttgcctggatcaaagcaaacctaaatgtgtacatctcccgagaactttgggatgacttactgtcagtattgtcatcgctgacctattgggaagagttggccactgagtggtcactgactatggagacattaactaaagttttagctaggaatttatatagtttggatctcagtgatttaccattggataagctgagtgaacagaaacaaaaaaagcacaaagggaaaggagttggacatgaatttcagaaagtttcagttgacaagtcattttctagaggatggagtcgtgatcagcctggccaagccccaatgagacagaggagtgcaacaaccactggttctccaggaaccgaaaaggcgaggagtatagtacggcaaaaaactgtcgccatgagaagccgatccattggtgaatgtgctctgccatcggcctatatacgcagtgctaaaagtgctcctgttctgatccatacttccaaacccttcttgcctgatattgttctcactcccctttctgatgagctttcagatattgatgatgctcaaatacttccccgctcaactagagtcagacatttttcacaaagtgaagaaactggaaatgaagtttttggtgctttgaatgaggagcagccattgcctcgaagtagcagcacttctgacatcttggaaccattcactgttgaacgagccaaagtcaataaagaggacatgagccaaaaactgcctcctcttaatagtgatattggcggcagcagtgctaatgttcctgatctgatggatgagtttatagcagaacgacttcgaagtggtaatgcctcgactatgacaagaagaggaagtagtccaggcagcctggaaattcccaaagacctccctgatattctaaacaagcagaaccagatgcgccctattgatgacccaggtgtgccctcagaatggacttctcctgccagtgcagggagcagtgatcttatcagctcagatagtcattcggattctttcagcgctttccaatatgatggccgaaaatttgacaattttggctttggaaccgacactggggttacgtcctctgctgatgtggattcaggttctggccatcatcagagtgctgaagagcaggaagtggctagtctaactactcttcatatagattctgaaacaagcagtcttaatcagcaagctttctctgctgaagttgcaactattactggttcagaaagtgcttccccagtccactcacctctgggctccaggtcacagactccttccccttctacattgaatatagatcacatggaacagaaggatctgcagctcgacgagaagctccaccactctgttcttcagacaccagatgatctaggcaatatttcaaaattagatatttaccttttttcttttagggcgtcagtgtcaggagatcataaataaggcatcttacatttgattatatatgattattgtaaatattttggacttttctaagtcctttggaaatttgttaatgtaacttttttcttgttcttaaagatatttgttgtctgagttttattcattttattatagttgattagagtcctcaaattagttattgcattattttcaagtattgtattatcatttattgatattggtagtgtttcctaaaacaggaaatacataatttggcatccttattcttagttttatacctaaagaacctagtaactcacaggagaacgtagtaacattatcacttgttaatcaagctttcagtgaaacagtttatcaaaccattttttttattttgattcagcaaatttgtcaactaaatttaatttaaaagtagaggtccaaatgaatattttcaagtaaatgttaaaaagtgacttgggaaacctaagtaactgccaagttttttttaaagttatttttgctagattttgtataatgtaacaaacatcagacaaatatgcacatttatggcatatgcaaatatgccataaattggtcaaagacacagttaatgagatatttacaatgaatgaaaagctagttttcattgataaggtagcacatttattctctgacgaaaggaagaaatttaaaactatataacttctaaacttcttttaagaaacccgtttattttaaaactaactgtagaggtgaggtttcaccatgttgcccaggctggtcttnngcttctgngctcangtgacccgcctgcctcggcctcccaagattncgggtgtgagccaccacacccggcccaagggacccattcgttaacttgcaattgccttgtaattatatagccctaattttctggtttgtggattatttctgaccttttctttttctcctttgatctgcagttgtttatttgtttacagttatttccccaacatttggaaaaaaacttcagttatagaagtgtttcaaggctagtaaaatgaatgcacataaaccctttatataaattcatcaattaatattttgccactttgtctatatttacacacagcacatatatgcacaaaatagcctgcccttcccacatgtctccctaaccttttatttttgctgaggcatgtaagaggaaattgcaaatatcagatccttcagacctaaacatgtcagtggatatgtcctaataagtgtatgttttctgcgtaaccacaatataatggccatattcatgatatttaacatagatacattgctgttattttagtctatagtcgtaagtcctcaattgtcccaataatgccctttatagctaccccacaccgtcagcaatccaataaagaatttaatcaggctgggcaccgtggctcacgcctgtcatcccagcactttgggaggcaaaggcaggtggatcacctgaggtcaggagttcgagaccagtctggtcaacatggtgaaaccctgtctctactaaaaatacaaaaattagctgatcatggtggcacacgcctgtcatcccagctactcggtaggctgaggcaggaaaattacttaaacctgggatgtggaggttgcagtgaactgaggtcgtgctgccactgtactccaacctgggtaacagagtgagactgtctc

SEQ ID NO: 113520 - DNA, 2752 bp, Homo sapiens
  misc_feature (1892)..(1892): n is a, c, g, or t
  misc_feature (1897)..(1897): n is a, c, g, or t
ggattttcagcaccacagtctgaacatggacctcgaactttagataatctcattaatcctccactcaaccttcaagaaactcaagtcactatagaagaaatcactcctcttgtccccccacaatcaggagataaagggcaagaagatctcacaagctattttcttgaagcacttctaaaatacatagtcattcaggtaaaaagtttagaatggaagaacaaagaaaaccaagaaaggggattttcatttttgttttcacattttaagaaatattacttgccttatatttttccaaacatctgtaaggaaaacagtttatatcatcctatacttgacatcccgcagatgagaccaaagccacattatgtcgtgataaagaaagatgctgaaaccaatgaagcaatctattgtacaaaggagcctttcattaaggctcgtgttattgtcattcgttggctggtttctttctggctggagccaaaaccacatacaggacctcatattcctgggatggaaggtgaagtcttgccaaagaatattcagagagcagctgctagtttagtatccagagaagaaagcaaaaatgataatgctgataaaacagacagaactacagaacccgaacagtctcattccaatacaagcactctcacggagcgagaacctagctcatctagtctctgtagtattgatgaagaacatctcacagacattgaaatagttcgcagagttttttcttctaaaaggagtaatgtaaactttgtgacagagatatttcgtcaggcatttttattaccaatttgtgaagcagcagctatgagaaaagtggtaaaagtatatcaagaatggatccaacaagaggaaaaacctttgttcatgcaagagcctgaagaaattgtgatcacttcttcagacctcccttgcattgaaaatgtcacagaccatgatatttcaatggaagaaggagaaaaaagagaagaggaaaatgggaccaatactgctgatcatgttcgaaattccagttgggcaaaaaacggctcctaccaaggtgctcttcataacgcctctgaagaagccacagaacaaaacatacgagctggtacccaggcagttttgcaggtgtttattataaactcatcaaatatatttcttcttgaacctgcaaatgaaataaaaaatcttctggatgaacacacagatatgtgtaaacgcattcttaacatttatcggtacatggttgtacaagtatcaatggacaaaaagacttgggaacagatgctgcttgtgttgctcagagtcacggaatctgtactgaagatgccatcacaagcttttctacagttccaagggaaaaaaaatatgaccttggcaggtcgacttgcaggaccacttttccagacccttatagttgcctggatcaaagcaaacctaaatgtgtacatctcccgagaactttgggatgacttactgtcagtattgtcatcgctgacctattgggaagagttggccactgagtggtcactgactatggagacattaactaaagttttagctaggaatttatatagtttggatctcagtgatttaccattggataagctgagtgaacagaaacaaaaaaagcacaaagggaaaggagttggacatgaatttcagaaagtttcagttgacaagtcattttctagaggatggagtcgtgatcagcctggccaagccccaatgagacagaggagtgcaacaaccactggttctccaggaaccgaaaaggcgaggagtatagtacggcaaaaaactgtcggctaatgaagaaaagccatatgatcacatcaatagatgcagaaaaaacatttggcaaaatccaacacccatttaggataaaaactctcagcaangtagnaataaggagaacttcctcaacttgataaatctattaaaaaataaaaacacaggacaacttacctctagcatcatacttaatggtgagaaactaggtttttttctgctgagatccacaacaaggcaaggatatctcactattcctgtaagacaggaaaaggaaataaaaggtctacagattgagaagaaataaataaagctatctttgtagatgacatgattatttatgtggaaaatttcaaagtgacaacctcctgaaactaataagcaattatagcaaggttataggatgccagattaatatataaaagtcagtcgctccttccataccagcaatgaacaactggaatgtgaaactgaaagcacagtaccatttacattagcatcaaaaatctccaaaacaattaggtataaatctagcaaaatatttacaagatctatatgaggaaaactatgaaactttgatgaaagaaatcaaagaataaataagttgagaggtctagttcatgtacatggatagaaaaactcactattggcaagatgtcatttttttccctacttaatctgtagattcaacacaatctcagttgattttgttcttaacaagttattttgtggatattgacagaatctaaaatttatatagaaaggcagagcatgagcaacatggcaaaacctgtctctacaaaaaatacaaaaactagttggatgtggtgtcatgtgcctgtagtcccagctacttgggagcctgagatgggaggattgcttaagttcaggaggtcaaggctgcagtgagccatgattgtgcccctgcactctctagcctgggtaacacagcaagatcttgtatcagaaa

SEQ ID NO: 113521 - DNA, 2080 bp, Homo sapiens
  misc_feature (368)..(368): n is a, c, g, or t
gatgtcatataatttctgaaattgagattggtatgattctcaatatgtagttactcaacatattataaagatggatttgattgatttgatatagttattctccatattataaagatggatttgattggattccatctgggtagaactatattgtgtagatgagtgttcttcagatagctccttaaggtcactacttaatttgtggttgcggagacgggagcattctccacattatcacttccagttcctcagcttttgaataggtttttatttgatgagaggatattgtggccgataaatgattttaaatgattgatgtagatacataaaatgtaattttaatttttaatatttaaggaactctaaanatttgaaattgtctttcaaagatgtttaatatttgaatttttataagaagtatgtatttgaaagttaactattaaccaaatgcaaacatatgcaagaaggaaacattaatcagtctttttattttaagggaacagatgctgcttgtgttgctcagagtcacggaatctgtactgaagatgccatcacaagcttttctacagttccaagggaaaaaaaatatgaccttggcaggtcgacttgcaggaccacttttccagacccttatagttgcctggatcaaagcaaacctaaatgtgtacatctcccgagaactttgggatgacttactgtcagtattgtcatcgctgacctattgggaagagttggccactgagtggtcactgactatggagacattaactaaagttttagctaggaatttatatagtttggatctcagtgatttaccattggataagctgagtgaacagaaacaaaaaaagcacaaagggaaaggagttggacatgaatttcagaaagtttcagttgacaagtcattttctagaggatggagtcgtgatcagcctggccaagccccaatgagacagaggagtgcaacaaccactggttctccaggaaccgaaaaggcgaggagtatagtacggcaaaaaactgtcgatattgatgatgctcaaatacttccccgctcaactagagtcagacatttttcacaaagtgaagaaactggaaatgaagtttttggtgctttgaatgaggagcagccattgcctcgaagtagcagcacttctgacatcttggaaccattcactgttgaacgagccaaagtcaataaagaggacatgagccaaaaactgcctcctcttaatagtgatattggcggcagcagtgctaatgttcctgatctgatggatgagtttatagcagaacgacttcgaagtggtaatgcctcgactatgacaagaagaggaagtagtccaggcagcctggaaattcccaaagacctccctgatattctaaacaagcagaaccagatgcgccctattgatgacccaggtgtgccctcagaatggacttctcctgccagtgcagggagcagtgatcttatcagctcagatagtcattcggattctttcagcgctttccaatatgatggccgaaaatttgacaattttggctttggaaccgacactggggttacgtcctctgctgatgtggattcaggttctggccatcatcagagtgctgaagagcaggaagtggctagtctaactactcttcatatagattctgaaacaagcagtcttaatcagcaagctttctctgctgaagttgcaactattactggtaaagttattcatgggaatgtgtttcttaaatgtattttttaagccttcaaagaatttgattaaaattttgagagattttaagtattacttattactatttaagtatattttttcattcatctttatgtaacaatgaaggggagaaaagacattagtttcttgacctgaggtccactgggttaagcttcagaggactctgtgaacttgtagtattttatgcaatattttgtatatatatgcactagaacattttctgcaggattaaaaaaaaattttaatgggaacataatagatgtatatgtatatggagtacatgagatagttggagtgatttttaaaataaataaaaaagttaaaagtaaaaa

SEQ ID NO: 113522 - DNA, 1511 bp, Homo sapiens
  misc_feature (368)..(368): n is a, c, g, or t
gatgtcatataatttctgaaattgagattggtatgattctcaatatgtagttactcaacatattataaagatggatttgattgatttgatatagttattctccatattataaagatggatttgattggattccatctgggtagaactatattgtgtagatgagtgttcttcagatagctccttaaggtcactacttaatttgtggttgcggagacgggagcattctccacattatcacttccagttcctcagcttttgaataggtttttatttgatgagaggatattgtggccgataaatgattttaaatgattgatgtagatacataaaatgtaattttaatttttaatatttaaggaactctaaanatttgaaattgtctttcaaagatgtttaatatttgaatttttataagaagtatgtatttgaaagttaactattaaccaaatgcaaacatatgcaagaaggaaacattaatcagtctttttattttaagggaacagatgctgcttgtgttgctcagagtcacggaatctgtactgaagatgccatcacaagcttttctacagttccaagggaaaaaaaatatgaccttggcaggtcgacttgcaggaccacttttccagacccttatagttgcctggatcaaagcaaacctaaatgtgtacatctcccgagaactttgggatgacttactgtcagtattgtcatcgctgacctattgggaagagttggccactgagtggtcactgactatggagacattaactaaagttttagctaggaatttatatagtttggatctcagtgatttaccattggataagctgagtgaacagaaacaaaaaaagcacaaagggaaaggagttggacatgaatttcagaaagtttcagttgacaagtcattttctagaggatggagtcgtgatcagcctggccaagccccaatgagacagaggagtgcaacaaccactggttctccaggaaccgaaaaggcgaggagtatagtacggcaaaaaactgtcgatattgatgatgctcaaatacttccccgctcaactagagtcagacatttttcacaaagtgaagaaactggaaatgaagtttttggtgctttgaatgaggagcagccattgcctcgaagtagcagcacttctgacatcttggaaccattcactgttgaacgagccaaaggtgcagttcctgtcattgacagttcatcccgtcatgcaccaagcttgcagagttccacagaggcttcttcaataactagatccactgaaagccacatcactgatactcatagtagagagtcttctctggaagttggtgatagcatatatgaccatctttgtcatttaataggtccagtagaacttgcagattcagcttttgaacaaatccagtacattgaccttgaaggagatgatgatcttctttccaccctgaaagaatattttaaggaaaaccaggaaaatcatagtaaaaatgagacagggaaagacccagct

SEQ ID NO: 113523 - DNA, 2504 bp, Homo sapiens
ggattttcagcaccacagtctgaacatggacctcgaactttagataatctcattaatcctccactcaaccttcaagaaactcaagtcactatagaagaaatcactcctcttgtccccccacaatcaggagataaagggcaagaagatctcacaagctattttcttgaagcacttctaaaatacatagtcattcagagagcagctgctagtttagtatccagagaagaaagcaaaaatgataatgctgataaaacagacagaactacagaacccgaacagtctcattccaatacaagcactctcacggagcgagaacctagctcatctagtctctgtagtattgatgaagaacatctcacagacattgaaatagttcgcagagttttttcttctaaaaggagtaatgtaaactttgtgacagagatatttcgtcaggcatttttattaccaatttgtgaagcagcagctatgagaaaagtggtaaaagtatatcaagaatggatccaacaagaggaaaaacctttgttcatgcaagagcctgaagaaattgtgatcacttcttcagacctcccttgcattgaaaatgtcacagaccatgatatttcaatggaagaaggagaaaaaagagaagaggaaaatgggaccaatactgctgatcatgttcgaaattccagttgggcaaaaaacggctcctaccaaggtgctcttcataacgcctctgaagaagccacagaacaaaacatacgagctggtacccaggcagttttgcaggtgtttattataaactcatcaaatatatttcttcttgaacctgcaaatgaaataaaaaatcttctggatgaacacacagatatgtgtaaacgcattcttaacatttatcggtacatggttgtacaagtatcaatggacaaaaagacttgggaacagatgctgcttgtgttgctcagagtcacggaatctgtactgaagatgccatcacaagcttttctacagttccaagggaaaaaaaatatgaccttggcaggtcgacttgcaggaccacttttccagacccttatagttgcctggatcaaagcaaacctaaatgtgtacatctcccgagaactttgggatgacttactgtcagtattgtcatcgctgacctattgggaagagttggccactgagtggtcactgactatggagacattaactaaagttttagctaggaatttatatagtttggatctcagtgatttaccattggataagctgagtgaacagaaacaaaaaaagcacaaagggaaaggagttggacatgaatttcagaaagtttcagttgacaagtcattttctagaggatggagtcgtgatcagcctggccaagccccaatgagacagaggagtgcaacaaccactggttctccaggaaccgaaaaggcgaggagtatagtacggcaaaaaactgtcgatattgatgatgctcaaatacttccccgctcaactagagtcagacatttttcacaaagtgaagaaactggaaatgaagtttttggtgctttgaatgaggagcagccattgcctcgaagtagcagcacttctgacatcttggaaccattcactgttgaacgagccaaagtcaataaagaggacatgagccaaaaactgcctcctcttaatagtgatattggcggcagcagtgctaatgttcctgatctgatggatgagtttatagcagaacgacttcgaagtggtaatgcctcgactatgacaagaagaggaagtagtccaggcagcctggaaattcccaaagacctccctgatattctaaacaagcagaaccagatgcgccctattgatgacccaggtgtgccctcagaatggacttctcctgccagtgcagggagcagtgatcttatcagctcagatagtcattcggattctttcagcgctttccaatatgatggccgaaaatttgacaattttggctttggaaccgacactggggttacgtcctctgctgatgtggattcaggttctggccatcatcagagtgctgaagagcaggaagtggctagtctaactactcttcatatagattctgaaacaagcagtcttaatcagcaagctttctctgctgaagttgcaactattactggtaaagttattcatgggaatgtgtttcttaaatgtattttttaagccttcaaagaatttgattaaaattttgagagattttaagtattacttattactatttaagtatattttttcattcatctttatgtaacaatgaaggggagaaaagacattagtttcttgacctgaggtccactgggttaagcttcagaggactctgtgaacttgtagtattttatgcaatattttgtatatatatgcactagaacattttctgcaggattaaaaaaaaattttaatgggaacataatagatgtatatgtatatggagtacatgagatagttggagtgatttttaaaataaataaaaaagttaaaagtaaaaa

SEQ ID NO: 113524 - DNA, 1300 bp, Homo sapiens
ggattttcagcaccacagtctgaacatggacctcgaactttagataatctcattaatcctccactcaaccttcaagaaactcaagtcactatagaagaaatcactcctcttgtccccccacaatcaggagataaagggcaagaagatctcacaagctattttcttgaagcacttctaaaatacatagtcattcaggtaaaaagtttagaatggaagaacaaagaaaaccaagaaaggggattttcatttttgttttcacattttaagaaatattacttgccttatatttttccaaacatctgtaaggaaaacagtttatatcatcctatacttgacatcccgcagatgagaccaaagccacattatgtcgtgataaagaaagatgctgaaaccaatgaagcaatctattgtacaaaggagcctttcattaaggctcgtgttattgtcattcgttggctggtttctttctggctggagccaaaaccacatacaggacctcatattcctgggatggaaggtgaagtcttgccaaagaatattcagagagcagctgctagtttagtatccagagaagaaagcaaaaatgataatgctgataaaacagacagaactacagaacccgaacagtctcattccaatacaagcactctcacggagcgagaacctagctcatctagtctctgtagtattgatgaagaacatctcacagacattgaaatagttcgcagagttttttcttctaaaaggagtaatgtaaactttgtgacagagatatttcgtcaggcatttttattaccaatttgtgaagcagcagctatgagaaaagtggtaaaagtatatcaagaatggatccaacaagaggaaaaacctttgttcatgcaagagcctgaagaaattgtgatcacttcttcagacctcccttgcattgaaaatgtcacagaccatgatatttcaatggaagaaggagaaaaaagagaagaggaaaatgggaccaatactgctgatcatgttcgaaattccagttgggcaaaaaacggctcctaccaaggtgctcttcataacgcctctgaagaagccacagaacaaaacatacgagctggtacccaggcagttttgcaggtgtttattataaactcatcaaatatatttcttcttgaacctgcaaatgaaataaaaaatcttctggatgaacacacagatatgtgtaaacgcattcttaacatttatcggtacatggttgtacaagtatcaatggacaaaaagacttggtaaaaaaatttttatcctttatgtctatgtg

SEQ ID NO: 113525 - DNA, 970 bp, Homo sapiens
ggattttcagcaccacagtctgaacatggacctcgaactttagataatctcattaatcctccactcaaccttcaagaaactcaagtcactatagaagaaatcactcctcttgtccccccacaatcaggagataaagggcaagaagatctcacaagctattttcttgaagcacttctaaaatacatagtcattcaggtaaaaagtttagaatggaagaacaaagaaaaccaagaaaggggattttcatttttgttttcacattttaagaaatattacttgccttatatttttccaaacatctgtaaggaaaacagtttatatcatcctatacttgacatcccgcagatgagaccaaagccacattatgtcgtgataaagaaagatgctgaaaccaatgaagcaatctattgtacaaaggagcctttcattaaggctcgtgttattgtcattcgttggctggtttctttctggctggagccaaaaccacatacaggacctcatattcctgggatggaaggtgaagtcttgccaaagaatattcagagagcagctgctagtttagtatccagagaagaaagcaaaaatgataatgctgataaaacagacagaactacagaacccgaacagtctcattccaatacaagcactctcacggagcgagaacctagctcatctagtctctgtagtattgatgaagaacatctcacagacattgaaatagttcgcagagttttttcttctaaaaggagtaatgtaaactttgtgacagagatatttcgtcaggtaacatacctctcagtatttttaatttataaggaaggcttttatctttaatattaaacatactgatttttagctgggaacagtggtgtgtacctttagttgtagttgttcaggaggctgaggtgggagaatcgcttgagcccaggagtttgaggccactttggacaacatggagagactgcatctc

SEQ ID NO: 113526 - DNA, 622 bp, Homo sapiens
ggattttcagcaccacagtctgaacatggacctcgaactttagataatctcattaatcctccactcaaccttcaagaaactcaagtcactatagaagaaatcactcctcttgtccccccacaatcaggagataaagggcaagaagatctcacaagctattttcttgaagcacttctaaaatacatagtcattcagagagcagctgctagtttagtatccagagaagaaagcaaaaatgataatgctgataaaacagacagaactacagaacccgaacagtctcattccaatacaagcactctcacggagcgagaacctagctcatctagtctctgtagtattgatgaagaacatctcacagacattgaaatagttcgcagagttttttcttctaaaaggagtaatgtaaactttgtgacagagatatttcgtcaggtaacatacctctcagtatttttaatttataaggaaggcttttatctttaatattaaacatactgatttttagctgggaacagtggtgtgtacctttagttgtagttgttcaggaggctgaggtgggagaatcgcttgagcccaggagtttgaggccactttggacaacatggagagactgcatctc

SEQ ID NO: 113527 - DNA, 445 bp, Homo sapiens
ggaaggtttatattatatttcgtattccagtggcaatgcttaatttcttcaaatttactcaaagatatattctgcatacatttctagaatttatgattatttatatacttatctgaaaaaggcaacaaccattgcaatattttaccttccttttttcttttctcttaaacctctcaagttttcatgttgagatcatctaggatttagtccatattgctactatttttttacaataataattatttagatttagttacagttttttacggtttcactgttcgccattgtttcttttactccacataatcccttcagattcagtttttattttgctagagtacatcctctaataattcactcaaagatgaataatggttggtgaaatatttgttcttgcatgtctgaaaaatattttccttttgcaacaaccctcagccttccaact

SEQ ID NO: 113528 - DNA, 359 bp, Homo sapiens
tgtgagtataaattaaagtaacaggagatgattacatgacccaaaagtgtggatttactgggttaggagcacatctgttggatcttggttctcactatattaacctgttgcccctagagttttccttgtggtaaatacgtaaaagtctctcactctgccactgtacatggaatagatttggaaaggatactttcagcactttgtttccatcactagagttaattattcctgcttacacagttaacactcctgccattaaagtaaaattgtgatctcagagaccctgcttgccagcgttatttatcttaaaaacatggatgcagaggtaatgttgacaccagctcagagccacgtagtcc

SEQ ID NO: 113529 - DNA, 210 bp, Homo sapiens
tcacccctacaccgcctggccaaacatgaggaagtgagatggcctgttcagagcttcagaacttgacgtaagacggacagtgtatagtatggggactggtgagagtgtgaaaaggcacggccactgtgaagaaccgagtttaccccagcacatgacccactcctagatacaggccccaaggacttgaagacacgcatccacacaaagagt

SEQ ID NO: 113530 - DNA, 351 bp, Homo sapiens
gattactccagcctctgacttgttcatggtggcagtagatctctagcgtggtttgtgttccatctcaccatacctactctccttaaaaaaaaacaaaaaactagctttcttgggcctcagtggctcattgaataagtgagagacgacttgtgcttccctggctttagactctggcatttgctaactgtgccaagcactgtggagaccagtagtggacataaggttagggtagatacagccagaaaggagataaataggcagacagataaaattcttataggatttggtgagttctatgaaggaaataaggcaagaggctgctctgtcagggtaggtgagggtgtgctgtga

SEQ ID NO: 113531 - DNA, 278 bp, Homo sapiens
ctgacacatatcagatgctaaataaatgctgttgaacgaataattcaaaatatgctgctctgtattagcaccaagagtgagttttttaaaaatattctaatccaaatgcacaagaatattcacaaaaaagccctttaaagataagcggcagtatttcaaatataaggagattctagttttccaaaacatcttacactgcatcttaaaatcagaataattggcttttatcaaacctgtgtcattttaataagggctctcatgaacttaatatgattctt

SEQ ID NO: 113532 - DNA, 636 bp, Homo sapiens
ggatgtgcctaggttatatgcaaataccacaccattttatataagagccttgagcatacttggactttgatatttttggagttcctggaatcaattccctgtggatataaaagaacaactgtgtaggattctttggtcattattaaggggaaatataaatatatctgttcttttgtaatgataggtcaaagaggcctataatatggtattttttcttatattcattctaaaatcttttcttaagtattgctgcttatattatcatagattatgtagtatgtataaagatgagtaaattccatcattaaggaccttaccgactagtaggagaaaaggcagaacatattcaacaaaatatatattcaaagtcaagtctggtaactgctttttaaaagaaatatatatataaaataaagtattatcatccctttgaaattaagtatttgtggagctggttatagttagaatgtaaaaagaattaagcaagttctagagaatactcttactttattttctatttttttaataaacagctttagttgtcaaaatttaaattatcagcttaagtgaaataatacataaacactagtatgaaagatactatctttcaactaagttaaatactttttagattga

SEQ ID NO: 113533 - DNA, 787 bp, Homo sapiens
tcttgttctgaggactaaatgaatgaacatacatgaaatacttataacactgcctgtcatataaggagagctatataagggtttgcttgttactattaataaatcagagaaaaataaatcattggcacagggtggtggagtgttgtcctgtaaggactattgggtggaaacaagagtaggaaaagatttacgagtaatgaagagaaaaacctgaaaaatagagggaatattaaggatgcaagacttttaaaaattaattgttattgacaaaaattatactatttatggcttacaaatgttttgatagatgtatacatggtggaaatgctaaatcaagctaattaacatatttattacctcatatacttacttttttgtcataagaacatttaaaattgactctgttagctattgcaagtatgcaagatgttttcattaactgtagccaccatgttgtacagtagacctcctgaacttattccttctgtctaattgaacatcggcctaattccccccctaatttctccaacatctacctaattcttccccttcatccagccctcggtaaccaccattctactccctgcttctatgagttcgacttgttaaggttccacatatgaatgacatcatgcagtatttgcctttcggtgctttgcttatttcactcagcataatgtcctccagtttcatccatgttgttgcaaatggaaggactgctgtctattttaaggctgaatagtattccatggtgaatacaggaatatatattcctatattcctcaca

SEQ ID NO: 113534 - DNA, 457 bp, Homo sapiens
tctgcctacttgttttatcaatgtgagaggggtgttgaaatttccaactacaagtatggattggtctatttcttatgtaaattctataattttgcatcatattattttaaacttcatttttagatgcagaaacatttaggattgttacgtactcttggtgaactgacccctttatcattatgaagtgaccttctttagctctagtaatatcattgccctaaaatctattttgttattaatatagcaaccccagctttcttcttaatttgtgttagcatgttagcatcgtatatgtttttctatccttttatttttaatgtatttgtgtctttatatttacaaggttttttttttagaaatcatagttggatcttggtttttaaaaatctaatctgaccacctctgcttttagttagtgtatttagtccatttacatttattgtgattattaagatgg

SEQ ID NO: 113535 - DNA, 190 bp, Homo sapiens
agtgagctgtggtcgacccccactgcactctgcctgggcaatagagcgagaaaaaaattttttttaaattaggttttcataattatctttttcatcattatgaaagcaatccttccacaccaagggaaacattgagaaaataccaagttttagaaaggcgaaatgaaaataaatctcctaacttcccatc

SEQ ID NO: 113536 - DNA, 395 bp, Homo sapiens
ctcccacccttgccctgtagttgaggctgggacgtaccaccctggtcaactcttcaaacagaggcattcatttccccagcttccagaagtgtcacctgccaatggcactcagtcaagtcccttcaggaacttccctcttagggaaggggctgggtttaggataagagctgcctggctgagctcacaccccctttctgggagcagcccacatgctatgactggtcgatgcaggggtatcaagtccaaggcccctcgcctccattcgagacatctctgaaaggccatcccactgggcctctgctgcaactgcctcatgtatgaatgcgtctctgccctatctatttgcggctggatgtggagtctgagggcctggcaccgactctgggtctgtgaat

SEQ ID NO: 113537 - DNA, 179 bp, Homo sapiens
ggactacctagaactgggcctaacatgcagcaggcgctcaataaatatttttcaaatgagtgaatggtgactaagacacgcatttggaaccagacagacccaggcgtgaatactgttatgccaaccatgaccatgcagcctctctgtgactaatttcctcactggggcactatgaaggt

SEQ ID NO: 113538 - DNA, 206 bp, Homo sapiens
tgggatgccaagacaaagctttctgggaagtatgtgctttaagacatgggtaagattttgagggggtacagaatgggatagtattccttgctgaaggaagagaacagtaaaacctcttcattggctggggaacagaatcgtctccagaatgtcagtgggaatacaatactaacaagggagagctcctatcagccggactagttaat

SEQ ID NO: 113539 - DNA, 401 bp, Homo sapiens
ctttgtatctgagaatatcttattgtaccatactcatccttcttcttgtgctgacatgagatgacaccatgcctacgtgacgagatgcagtggggtgaatgacataggcattgtgacttagtattgggctactactgaccttgaccatatgtcagaagggggatcatcaagccatgatgttgccgattgacctagggtaactgaaactgcggataaacggggactactgtactttcttaggcaacaaaagcaaaactgggatgttctgaacatctcatctgttttctttgatgctgctttatcagtatcatgtcacggacatttttccatccagggttaaatcactttaaaatcactacttttggtatctgcatggcactctatataaataatacagcaat

SEQ ID NO: 113540 - DNA, 378 bp, Homo sapiens
acggggtttcgccgtgttggtcaggctggtctcgaactcctgacctgagttgatccacccacttcgacctctgaaagtgctaggattacaggtgtgagccaccgtgcctggccatatacatgtttatctatcacatacatatatacaaggggtaatagaagtagaacttgtcttgaaatcctaatataaggtttctgtttttccccaataactgataatgcttgagaaatatattctgagcacacaggtgacagtaagggctagtagaaaagtgctggatcctgaagtcaggaaacctgagttccaatccaggctctgccactgactgacatgtctttgagcaagtcatttgaattttctgggcctcatttcccccat

SEQ ID NO: 113541 - DNA, 590 bp, Homo sapiens
ggaatgaagggtcttataattaataatttgtagatttaagatatgatcaatcaagaaaaatattattctgtcattccccatcaaaataactttttggccaggcacagttgctaggattacaggtgtgagccacctcacctggcccattcaactactttatattaaacacctccatgggttatgcactgtgctaggccctagggatacaagggtgtacacaatgaatatgattcttttcctcttggctctcactatatgatggagggagacagacagaaaattataatagtcagttataattgtacatgatatctactctgataggatagataaagggccagagaaggcttctctgagaatagtagaatctatgtgaagacttgaaggatgaaaaggagttgcttaagttatgggtgagggagtcatagatgtataagctggacgtgagagcatggaatgttcaggaactcagacatcaacatagctagtgtagagtgtgaagcaggaaagtaaccagaaatgaagatagagaagtatttagtgttaagatggtagagatgtacttttttgtaccctatataaatgtataa

SEQ ID NO: 113542 - DNA, 211 bp, Homo sapiens
atttgttcagatcaagaacaaaaaccactcaatgtaaaatacggacaaaagatttcaacagataccacataaaaagacaaatccaaatgactaataaagccaatcttattgttgtcaaggaaatgcaaatgaaaatcactatgactcactgtccaccagaactggcaaaaatacaaaagtgtgaaaacaacaggatggttactttggtgag

SEQ ID NO: 113543 - DNA, 294 bp, Homo sapiens
aggaggaaaccagagaaaccagagtatttccatccttcctcttcgccttgggcaggaactccattagcagcttgtcttctcccttgttctaactctcctatgcaggctcactgtggttccagctcccataaaggaatctctcagtccctggctctggccacaccactgtggtagatgtgaggtactcaggtcctctttaaggaaggacttgctgcccaacggcaggtgctgcagccagcatccagctgtcagcccctacagggtcagccttacttgcagagaaccaccttgctc

SEQ ID NO: 113544 - DNA, 372 bp, Homo sapiens
actgcattccagcctgggcgacagagtgaggctccatctcaaaataaaaaaataaaataaataaaataaaatagtgagttgtaaaagcagtgaacggtcgctttctggccaggaattgtaggccagggccttttaacaaatgatctggtaggaaatttatcaacagcagtgaaaatgggaagatactctgcaagagctctgtcttcatagggcactgtcatctctgcctatggaaaagaatgcatgtctcatagcaatgcaggctatgctcttttgaagccagaaaataaagtagaggtccttggcttgttggctaaaaagctaccagttttccaagacaagccagttcaggtacagaagacaactattcca

SEQ ID NO: 113545 - DNA, 621 bp, Homo sapiens
tagtagttaaattattttaaagttattttttaacagctaattcaaaagattcaatacagatgactgtgccaaacaagccagtaaatagaatcagtctacatcctgacttttggaatgcaatgaatcacaccacaccaaagcatgaatttggatcagtgcttttatttactcttttatttcatttgtcttgtgtcttaggtttgctctggacttacagttctatacaaataatgtattttaaaccctagagttttttacataattttgtcataaagagttaaagcctattaatgattcttcatttcatagttcctgaaaaaatatactcagttatatatctccatcataattatttttcagttctttttccttgttaggtggtgggggttagcttttgggtggagacattaacaatttatacactcttatgatttacactcttcttctgtagttctttgggaaggaagttaagaatgacggaaaggttctaggagagcctcagaccaattctgtgaaaagtgttattggttttctgaaggaatgtatgtttctaagaaactgtatgaccagaaatgaattgtctttgattcagtttcatcaccagtttaataagctagtttt

SEQ ID NO: 113546 - DNA, 601 bp, Homo sapiens
gaatgtgctctaaattatttgtgaaaaattattagcaaactttgatattacttataacttacctcatgacttggaactcttaagatgaattcaaacaccaggctatcaagactaaggatacacaggttgagaatccctgaaccgcaaattggaaatgctttaaaatccaaatttctggagcgctgacaggaggccacaagtggaaaatttcgcacctgacctcctgtaatgggtcaaggtcaaaacgcagtcaaaagtttgtttcatatatgaaattgtgaaaaatattgtataaagttacctacaggctatgtgtgtaaggtgtatatgaaacaaaggaattttgtgtttagacttgatatatccccaaggtacatcattatgtatatgcagatttaaaaaaaaaaaccaaaacagaaaaaaacctctaaaatccaaaaaacttcccatcccaaacattttggataacggatacctagcctgtattttgtatccccgggatttgcaacagttctgtttagataatggtgccaagtgttaaattactttatgtttaaaactttttattgctttaatttattagataattttttagagatct

SEQ ID NO: 113547 - DNA, 401 bp, Homo sapiens
ttctcattaggcctcacttcccaacattgctgcactagagattaaatttctaacacatgcttttttgtttgtcttgtttcgttttgtttgtgagacagaatcttgctccgcctcccgggttcaagcgattctcatgcctaggcctctcaagtagctgggactacagttgtgtgccaccatgcccagctaattttttcatatttttgttacagatggggttttgccatgttggccagactggtctcgaactcctggcctcaagtgatctgcccaccttggcctcccaaagtgctgggattacaggcctgagccactgcgctgggtcccaagtctggattttttttttttttttggccttccaaattggcggttttaaagctattgggtttaacctatttttc

SEQ ID NO: 113548 - DNA, 801 bp, Homo sapiens
acagttaagaaatgctcttaggccaggtgtgatggctcatgcctataattccagcactttaggaggctaaggcaggaggatcacttgagccgaggagttcaagaccagcctgggcagcatggcaaaatcctaactctgcaaaaactacaaaaatcagcttggtatagtggtgcatgcctgtagtcctagctactcaggaggctgaggcaggaggattttttgaggctgggaggtcaggactgtagtgaactgtgatcatgccatccagtccaggtgacagagcaagacctcatctcttaaaaaagacaaaaacaaaacaaaacataaaaacacctctcaggagcttgtttagttcctagaatgaattgaccactcccttgtacttcctctattccatattcagattttattgtaaaattgctttgttttacttgtgggtttttttgtttgtttttgagatgggctctcactctgtcaccctgcttgaagtgcagtggtaatcttggctcactgcatcctccacctccagggctcaaatgatcctccccctcagcctcccaagttgctgggactacagatgtgctccaccacgcctggctaatttttctgtatgtttggtagagacggtgttgctatgttgcccaggctagtcttgacctgagctcaagagatattctcacctcggcctcccaaagtttaggggttacaggcatgagccactgcgtctggctgttgcacttgtttatatttttgttacctgtgtcctattcaggtttgcattgtgcatcacacactatagtg

SEQ ID NO: 113549 - DNA, 256 bp, Homo sapiens
gactgtttttaggttgtgctgtcaggccgtgggggtgctgtcagggatctgaatgtgaaggcacgaggggtgagtgcaccatcccacctgatggtgacaagtgactgattttgaggtggcgatggctggagggcacctgctgccttcctgccccaggccacctgtcaggcaaggagcgggtggctgagtacccctcctgggagagaaggattgactggcagagagggcagatgctgaggtggggcaggcgaggtgt

SEQ ID NO: 113550 - DNA, 430 bp, Homo sapiens
tgagatggagtcttgcactgtcgtccgggctggagtgtagtagcatgatcttggctcactgcaacctttgcctcctgggttcaagtgattctcctgcctcagccccccaagtagctgggattacaggcacccaccaccagacccagctaattttttgtatttttagtagagatggggtttcactatgttggccaggctggtctcaaactcctgacctcatgatctgcccacctcggcctccggaagtactgggattacaggtgtgagccaccatgcctggcccactcccactttttaaaatgcagctcagaaatccccttgcacctggctgcctcccagagacccttcatgctttgcgggcagaacagtcaaagcttctgcctcccgccacttgttccccatggggcctggcacctagagagtgctttgc

SEQ ID NO: 113551 - DNA, 442 bp, Homo sapiens
catttgctggcccattaggaaccagatggcacagcaggaggtgagctgtggttgagtgagcattaccacctgagctccaccacctgtcagagcagtccaacattagattctcataggagcgtgaacgctactgtgaactgtgcatgcaagggatctagattgcatgctccttataagaatctaatgcctgatgatctgaggtgaacagtttcatccggaaaccttcccttccacccctccctatctgtggaaaaattgtcttccatgaaactggtccagtgtcagaaaggttggggactgcagttttaagagtattcttattagctttgtagtaatttaataataataaaagctactatttattgagggcttcccacatgccaggtactgttttaggtgctttgtagaataactcatttgcaagacaggtattttctttctt

SEQ ID NO: 113552 - DNA, 417 bp, Homo sapiens
cagggctgacgacgaagacaggaacccagccagcctctcccgggacgatgctggagacgggcacattcactgctggagctgcccaggcactggaattagtagatgtggctggcctagcacaaaccgctaggtccagatgcggccgtgtgcaacaggagagtaccagctcttcattagctcgtccttgctcagagctcttctagttcatatcatttgagagatcaagaaagaacatgacagtcccccaggtctccccttctgcacgcaggatagttttagtcatcccaaacccctcctgtattacagccgactacctcctctcctcttctaatctaactctactttcattaagttgctttctgcaacaggaaggtgtgtatcccggacccctccacactcttcttcatgatgtcagag

SEQ ID NO: 113553 - DNA, 492 bp, Homo sapiens
tggctgggagtgtaggagccccgtgagagcccaaggaaagaggtggctggggactctgggctctgcggctcaggctctgagtggttttcatatgaaaggtgtgctcacagagggtggtttaccatctctaggaattagcttgccctggaggtgcaatctctccagagtcagcaaggccccgagatgccaagcaccagaaaatacagaaaacagggcgggcacggtggctcacacctgtaatcccagcactttggaaggccaaagtggacggatcacttgagttcaggagtttgagatcagcctggccaacatggcgaaaccgcgtctctcctaagaatacaaaaattagccgagtgtggctagcctgtaattccagctactctggaggctgaggcaggagaatcgcttgaacccgggattgggatgttgcagtgagccgagatcgcaccactgcactccaacctgggtgacagagcgagacatctcaaagta

SEQ ID NO: 113554 - DNA, 337 bp, Homo sapiens
aaccccagctccaggggctcagcaggcaaagggaatcactgagtgggggcaccacccgtggactccaatatctcaacctctccctccacaggttggaggtgggaggaacaacccccaccaaacccagagccgaaaactgagggagttttacagacaggacggagctcctgcacctcggagcctcagttgggaatgacctggggtcttgtcctgaagctgagtctggtgaacgtgccccatttgtaacatgaggggtacttctctggagggactgtatgttgacagtggcagagtggagccctgaagtccacctgagtgaatataccagggcttgaga

SEQ ID NO: 113555 - DNA, 698 bp, Homo sapiens
gagtttgttaaacctatcaaagcagagactgtcagggcctttgaagttgtgttaaaaagaaaattctagacataaatggatgagaagacatgttttctttgtggcttcaggtgaaattttgattaagtatctgaattttatattgaaaagcactgaatagtttgtagatattaccttcctagcatacagctgctactgttcttgttggtgaacgaatgcttctcagctgcaatgtagtgttagacaattttttttcaacatagtattatgaaactgttcaaatgtatagacaaattgaaacaatttagtaaattaattttaagacaaaagtttgagatttttcttgattgtgacgtgtgttgtggcaacctggatcttgaactgcttagtcctgttgatttgggaaaactgtacaaatcaagtaactggttttaaatttcttctgaagaatccatattaagattgatgatctaaatctgaaacctttcatgttagagctttccttccctttttttgactacactgtactacctataattaaaatgtgaccaaatttaaggctcattcagaaaaaaatttcttcctttacacaatattactaatttaagtacggaagttactacatttagaagaccactatcagtttgtgactttaattgataagcaggcttggagtaaatcttagtcatataatatgg

SEQ ID NO: 113556 - DNA, 372 bp, Homo sapiens
atataagctcactctatggcagcaggtattttgctgtcttgttcattcccgtatttccaggacttacagcagtgcctgggaaatagcaaaaatgactgcagcgaaaatgttcaaagagctctgaggttctaggcgccttccagtgatgagctcagagtcctcctgagaggctgtgaggagggtcttatgactgtaaccctcttactgatgcagctaagacccagacttaggcacccccttgggaagtctggcctatgggtggacactggcccatgggcaggtggtataggcagtgatagtggcctggacagaccggctggatttggctaggcagatatctgttccggagagcccagcacaataaggggtacg

SEQ ID NO: 113557 - DNA, 338 bp, Homo sapiens
ttcggccctacaggtcagaatggtggcagcggagcatcgtcattcttcaggattgccctactggccctacctcacagctgaaactttaaaaaacaggatgggccgccagccacctcctccaactcaacaacattctataactgataactccctgagcctcaagacacctcccgaatgtctccttcgtccccttccaccctcagtggatgataatatcaaggagtgtcctcttgctcctcttccacccctcagtggatgataatctcaaggagtgtctccttgcccctcttccaccctctcctcttccaccctcagtggatgataatctcaagactcct

SEQ ID NO: 113558 - DNA, 834 bp, Homo sapiens
cagtgaaggccttgagaaaaagactgaccttccccaaggagagggaatggggaattctgctagcagactgccttcagtctcatactgtgacttttttcttcagcctgcctgcctatccttcagattttggacttgccagcctcaacaatcatgtaagccagttccttaaaataaatctcaatcactctctctgtctctctctctctttctctctgtacacatcctgttggtttccctggagaatgctaatataggaagttcacttcaactgttcctgcagctgttcacgctatactttttctgagtactcttcccctgatagaaagttgtctgggactttcatgagtgaaaagtatttttaaatatcacttttccccttgcctactttatttttttcaaggcctaatttacatacaatgaaatgtaaagatcttacacagttcagttagttttggtaaaagcagatatatacccatgtaaccctcatctctatgaagatataaaacatttccatcaccccacaaagctcaattgatgtgtcttgtactgagtggaatattggagtctcttatttgtgtgtttatatgtatatatcttctatacgcctcctgtagttttctttataaagtggttgctatgttatctgatgcatagatattcacaattttatgtcttcattgtgaattgtgactttcagtattaaaaagtgccccttttatatttaatgcctttgccttgaattctgtgttttgagaaataagataggacttttaaacaatttccacttgcctgaaatacctttgttcatacctttatttaccctttctgtatctc

SEQ ID NO: 113559 - DNA, 346 bp, Homo sapiens
ccaagtagctgggattacaggcgcccaccaccacgcccagcttatttttgtatttttagtagagacagggtttcgccatgttggtcaggctgatctcaaactcctgacctcaggtgatccacccgcttcggcctcccaaaatgctgggattacaggcgtgagtcaccacgcctgaccatttgttaaatttcaaagtggtatttctcaaagtgtaaccatgaaccatgcatatcagaatcacctgggtgtttgttacaagagtgattcaagaacctgttccttaccatctgaatgggaagttttgtgtgagaccctatgcatatttgagcactggagccctgaagcc

SEQ ID NO: 113560 - DNA, 336 bp, Homo sapiens
gcaagatggggcagaagagttcttctcgcgttccttagtccgtggtcgaaggaagagcctccctgacgtgctactgtcaatctcgtgaggatatctggtgggacgggcagggcacctggcctcaggcttagagacgtgagaccccctaggtatggaatatgcagacatcagaactggaagaagagggccaggcacagtggctcatgcctgtaatcccagcactttgggaggccgaggcgggcagatcacctgaggtcaggagttcgagaccagcctgaccaacatggtgaaaccccgtctctactaaacacaaaaaatcagccaggcatggtggag

SEQ ID NO: 113561 - DNA, 144 bp, Homo sapiens
gaagggtcaactccccagattagtcaaagcaacaagaaaggggataatggataaaatataaaactgccaaacagagaatctcagttgcctccactaggaaaggacttcccagaagatccactgcaacctcatccaggctttctc

SEQ ID NO: 113562 - DNA, 494 bp, Homo sapiens
gctataccaaagggtggtctatgggaaatctgcagtggaaagattttattctcaggaccctttctgcaggggacagctgtcaaaatctgaggaatatatagggggagatgttttttaagttcaaatctacaagacttaagtccaggggaagtttcatgtccccttccagccaaggagaacatgctcatgtttacttgcagctgcctgttgctcctctctagctttaagagaatgagctcttgcatttactctttgcccctggcattcccaatgtgtctttttaaattgtggtaaaatatgtttaacaaatttgtcatctcaaccatttctaggtgtacaattaattcagcggcattaattacattctggatgacgtacaaccatcaccgcttcctgtttccaagatttttcctcactccaaatagaaactttgtgaccattatgcaaaaactccctgttcccttcttccctcagcccctgctaccctctcatct

SEQ ID NO: 113563 - DNA, 219 bp, Homo sapiens
gcacacctctgtttggaacctgggcagagcaggaggtaaggcaaaggcaggcaggcaccaagaaccagaccccttgagaaggcgctgtgggtgggtctttgttctgctgttctgcctttcctgacaggtggggttggggcacacagacattggaatatttgtactgctctcgtgccatttgagaggctgctgccccaggcaggccagcccctactcctc

SEQ ID NO: 113564 - DNA, 234 bp, Homo sapiens
ctggtcaccttctgtatgccaggcatggcactggcacttcaaatcacagctttctcaattctcactgcaaccctacaagggcttctaattgccacttcacagatgaggaagctgagactcagaaaaacaagtgagaacgtatcccggcactgcccagctgcagttcagggacagacagcatgggcaccacccaggagcttatctcaaatgctcatgtcctgaccccagcccaga

SEQ ID NO: 113565 - DNA, 536 bp, Homo sapiens
gcaagagggcacgggctttaggcgctggctcagtggccctgcagttttctggccaagagctccatggcagcgggccctgggcctgggcctttgacctggggcctctgttaggagtggtcctgatcctgcttctggcagaggcacacacagggctcctccaagtacaggcagccaggctcaggatgggagggagcagccagtcccaacaattacacagttcgggagctgaaaagttatgtttgccactctcaggagccagctgtggaagggaggccagtggagggctttgccctggcctctgagccacacacaagccgtgctgggaggacaagggccgggggtggtgaaggaccctcttggagcctttgctttccaggagcaggcactcgtcttccatatcacactcacaaaggctggtggcttcagtggctgtgaccagctggccacagctgactcctctggggtagtgctgtttctaaatattagttcctgctgttaacccttgctgtgcggccccagtggacagccggctgcct

SEQ ID NO: 113566 - DNA, 426 bp, Homo sapiens
gcctaattgctctggtcagcacttctagtactgttaaatagaactggtaaaagcaggtatccttgccctgttcttataagaaaagttttcagtctttcaccattgaatatcatgttcactgtgggtttttcatatatggcttttattacattgaggtaattccctactattccaagtttattcaatgtttttatcatgaaagggtgttaaattatgtcaaatgctttttctggtcaattggaaagattatgcagtttttccccatcattttgttaatgtggcatattacactaattgattttcctatgttaaaccatttttaacattccagggaataaatcccatttgatcatggtgtataatccctttatcatgctgctgaatgtagctcactaatatttggttaaggatttttgcatcaatgtt

SEQ ID NO: 113567 - DNA, 310 bp, Homo sapiens
agattacaggctggccatggtggctcacacctgtaatcctatcactttgggaggccaaggcaggaggatggcttaaggccaagagtttgagaacaacctgggtgacatgtcaagactcctgtctctacaaaaaattaaaatattaaccaagtgtgatggggcacacctatacttgcaggtacgtgggatgctgaggagagaggattgcttgagtctaggagtttgaggtatcagtgagctatgatcgtgccactgcactccagcctgggtgacagagcgagtccctgtctcaaaaacaaaacaatgaaaa

SEQ ID NO: 113568 - DNA, 379 bp, Homo sapiens
gagaccagcctggctaacatggcgaaaccccgtctttactaaaaatagccgggtgtggtggcacgcacctgtagtcccagctactcggggagactgaggcaggagaatcgcttgaacccaggagacgaaggttaaagtgagccgagattgtaccactgcattccaccctggaagacagagcaagactccatctcaaaaaaagaaaaaaaaaagtaatcgattgtaaaaaacaaaacaaaaagcccaatactgtattgtgggacttttgcacatggaacatttatcaagacagaccatattctgagccataaaacaagtctcagccaggcgtggtggctcacgcctgtaatcccagcactttgggaggccaaggcgggtg

SEQ ID NO: 113569 - DNA, 316 bp, Homo sapiens
atatttcttttaagcacataaaatgattcagcatctaagttgacagaattgagtaaatgagacactttagagcaacattatggaaaagaatatttagagaagtatttatacagtatagaccctctgatacacacacacacacgccagctagaaataaactagcaatgtttcaggtcaactgaatggctaatgttacacagaaattaaaaagcatgaaaagaaaatgttttacgtccttggagataacaaggggaagataagactcatttggtgctgctcagagacaactcagggacagaatgcttgctcagcaaag

SEQ ID NO: 113570 - DNA, 367 bp, Homo sapiens
gaaccaccaggctgactgttgaaggcatgacccaacatgtgcataaagtgcctcagcagactggaagaggggtggattccaggcatttaagaaaatcaggtcaaccattagctgaccaataaactaagtaaagacatcagtgaccacacatgacaaaaaatataaactttacataattagttcaaaaaagtcactaaaataaacaaacagccacaacgacaaatcctgaagggagaaggaatctgagtttcagagttgtaaaattatttaaagtgaacagtttttggcaaaaagtatgtgacatacaaagaaacaaaaaagcatggcacacatacaggaaaaatgcattcaatgaaaccgtccttca

SEQ ID NO: 113571 - DNA, 296 bp, Homo sapiens
ggggttccagctgaattttctgtcccgaggttgagttagaaatcagcttttgtttgctttacaatttctcgtggcttcagtcaaacagtggtgtcaaatgtggtatcattgacatctgtggtagccttcgttctctgaagtctatcagcaatatccatgctgataattcagtctaaatgattgcccagccacaagctggacagtgaacactgttttctcagttgggttgggtgctcctcagggagtcccactatgccaagcagatgaagcacagtttgccattcactgagaaggag

SEQ ID NO: 113572 - DNA, 360 bp, Homo sapiens
caaggaaggaaggaatgaaggaaggaaggaaagggaagcaaggaaggaagaaagaaagggaaagaacctatatatttaaatggctgaggaaagattctaacccaggtctgcattaaagatgaaaattttccacatgttcaatgaattttactaattctttttcctcaatgagtacctaaagctgaaagaaaatgatatggatgtcacacgaaaatccttacctcctctgtcctcagtgccagtatacaatggagctgaagagaggcagtagaggaggtgatggagaaagaggggaggaagaagaatgagcaggaggcagaggagactgcctggaggcatttccccagggtcccccactgc

SEQ ID NO: 113573 - DNA, 794 bp, Homo sapiens
ggaaataaaaactcagaagtataaaaaaagtacataaaatgaaagtaaagtttttcttcctacctcccacctcatcttctcagatcttatcacagatgttttttgttcttttgaatggttgcttccttctgtaaatgatgtgcttatatttcttaatttatgcattttccctgttgactcaaattattactttggaagacaaggaacttaaattcttaaacatttatcaactgtgttaccatatttctactattaccctaataactctaagtgtatatttggagctggatttattgcttcattgactttgaacaataactcttaactgcccagtgtagaacttagagcattggtttctacatttttatccttttctgtcccttacaacctaacttctctcagctacactatcaattctacagtatcaaaatttataatgtttaaattatgttaagtataattgtttttcctattttgcttcatggttgaatctgaaaattaaaaactaagtagcatttacagtattgttatgtaaatattcatttagtttatcatactatttattaagtgatcatctttgaacagactgttctctgaacctcctgcatagctatcacctgcgggtttcttttcaatgcttggttagttctacttacttaaattctaccattccctctttagttttcccttttcattgttggctggtgtccattttccaaaaatatctaatgcagtaactttaaatataaattgctgtatataaattgaaatttctattacaaaggaataagtga

SEQ ID NO: 113574 - DNA, 477 bp, Homo sapiens
atcagatcccttttatctatttatttatttattatttttttgagacagagtctcgctctgtcacccaggctagaagtgaggctccagctcaaaaaaaaaagagagagagatgactgttagtcgctggttgaggttgcatccaggggctatgagtgactcagagccctagaagggtctggtggggccccccacacctgcctccctcacccctagctcctagcgccccagacatcctaggcaggtcctgggaggcaggcgataatcccattctgctgccagtttgtcctgaaggtctgagcaagagggctggctcacaaataccagtgtttgctggagaaatggtcgcacgaaggacagatggacattgagaggtgccttcagagcaggtaagaagggagaaggactctggaggccacacaccaatcagtgccctaaatggggtggctttaggctcctccccactcctaagctgagtag

SEQ ID NO: 113575 - DNA, 401 bp, Homo sapiens
atcagatcccttttatctatttatttatttattatttttttgagacagagtctcgctctgtcacccaggctagaagtgaggctccagctcaaaaaaaaaagagagagagatgactgttagtcgctggttgaggttgcatccaggggctatgagtgactcagagccctagaagggtctggtggggccccccattctgctgccagtttgtcctgaaggtctgagcaagagggctggctcacaaataccagtgtttgctggagaaatggtcgcacgaaggacagatggacattgagaggtgccttcagagcaggtaagaagggagaaggactctggaggccacacaccaatcagtgccctaaatggggtggctttaggctcctccccactcctaagctgagtag

SEQ ID NO: 113576 - DNA, 640 bp, Homo sapiens
atcagatcccttttatctatttatttatttattatttttttgagacagagtctcgctctgtcacccaggctagagtgtagtggctccatcttggctcactgcaacctctgcctcccgggttcaagcaattctcctgcctcagcttcccaagtagctgaggtaggagaatggcttgaacccaggcggcagaggttattgtgagccgagatcgcgccactgcactccagcctgggcgagagtgaggctccagctcaaaaaaaaaagagagagagatgactgttagtcgctggttgaggttgcatccaggggctatgagtgactcagagccctagaagggtctggtggggccccccacacctgcctccctcacccctagctcctagcgccccagacatcctaggcaggtcctgggaggcaggcgataatcccattctgctgccagtttgtcctgaaggtctgagcaagagggctggctcacaaataccagtgtttgctggagaaatggtcgcacgaaggacagatggacattgagaggtgccttcagagcaggtaagaagggagaaggactctggaggccacacaccaatcagtgccctaaatggggtggctttaggctcctccccactcctaagctgagtag

SEQ ID NO: 113577 - DNA, 352 bp, Homo sapiens
agcactttgggagaacgaggtcaggagttcaagaccagtctggccaagatggtgaaaccccgtctctactaaaactacaaaaattagttgggcgcagtggcaggtgcctataatcccagctattctggaggctgaggtaggagaatggcttgaacccaggcggcagaggttattgtgagccgagatcgcgccactgcactccagcctgggcgagagtgaggctccagctcaaaaaaaaaagagagagagatgactgttagtcgctggttgaggttgcatccaggggctatgagtgactcagagccctagaagggtctggtggggccccccacacctgcctccctcaccccta

SEQ ID NO: 113578 - DNA, 295 bp, Homo sapiens
acaggaccacgtgcctgggagattccgacaggctgtccttccgccccccaccgagacggcatgcgggcgcgtgtttccacggatctagtccgtcttatctgcaccaaactgccattccagtcactcactgggatcattaaaccaccacttgcagttttccagggctttctttgttctactaggaagtatatgcccccaaattatgaaattccatttcaaacagaattaacagaatttaaaaaataaaaatgttaaagctccttttaatgaagacaaagtgaatggactagagtgg

SEQ ID NO: 113579 - DNA, 179 bp, Homo sapiens
gtggcggggcatcgtcgtatagtcgactgcaggttgtgcgagctgaggctttctttgttctactaggaagtatatgcccccaaattatgaaattccatttcaaacagaattaacagaatttaaaaaataaaaatgttaaagctccttttaatgaagacaaagtgaatggactagagtgg

SEQ ID NO: 113580 - DNA, 353 bp, Homo sapiens
agccggtccatccatccctctctcacggttcacgcaattctccgtgtcctcagcctcccgagtagctgggattacaggcgcccgccaccatgcccggctaatttttttgtatttttacgtagagatggggtttcaccatcttagccaggcttgtcttgaactcctgaccctgtgatccacccgcctcggcctcccaaagtgctgggattataggaatgagccattgcacccggcctgggcctcttttaaaaaagtgagatttgagcaatgagttgaattagatgtaagttagcaacaggtatctgggggaaaagtacgccaggtagagagaatatcttgagcaagggtcttaa

SEQ ID NO: 113581 - DNA, 421 bp, Homo sapiens
cctagttcaaagactgttatttccagaattagagaggatactggaaattcagattccgcagagaactcggtgactcattcacactaagatgtaaaataaccccatcaagatttatttcctttttgttctctagtgagaggaaaaaagaaaaaagaattctttgccgggccaggcgttgtggcttgcgcctataatctcaacactttcggaggctgaagcaggaggattgcttgagcccgggattttgagaccaacctgggcaacacagggagaccccatctctacaaaaaaatttaaaaactagctgggcgtggtggcacgcacctgtagttcctacacgggaggctgaggtgcaaaggattgcttgagcccaggatttcaaggctgcaatgagcatgttcgcgctccaacctggatgaca

SEQ ID NO: 113582 - DNA, 262 bp, Homo sapiens
taacaatcgttttcattgttcaggatggctcaaaatagaggaaagacaagaagccttttcctatgcatttttcacattgaggccggttagtttgaaaatactgttactatgttgaaacaaaagatcacttgtcaaatctgtggtggcttttcatatttaatgtgttgttgtctctgatcttaaaatgttaaccttgctgtaaggaggcaagactatcttacatgtttgtgtcaataggctggacggcacaaagctgagccca

SEQ ID NO: 113583 - DNA, 493 bp, Homo sapiens
cttcatatcaatctgatggcccctttctatgtgaggcaggatagcattacagacaggaagatgaaccctggaaccacaatgcctgggtttgaatcctggccactactcatttgccatgtgatcttgagaatataaagaggcgtgacaaagccccctctcacttggctttcatgaggaacaagcaagtggattcacataaagtgcttgcaagaatgacaggcatatactttttgaagcatgtttgccacagctgcttataaaatacttttatgggaaactataatttgtttgacaagaacctttgtaaaacttatcacagacaatcttgaaaaaagttacttaaaaacagaattgagactatagtacatatacagttttataaactgctttatacttattacaaaggcattaaggatttttgagggtcatgagattactgccagatgatacttcagaaaaacagtatcaatttatactaggatcaacagtattt

SEQ ID NO: 113584 - DNA, 232 bp, Homo sapiens
atcctttctgcacctaagcctgcctgctgtaggcaggacagcgcgaggcacaggggacatcagagtggagaggtccccactctcatggcactgactcctgcaccacgggccttcccaagccactgaaaagtgaggacagcagtcctttctctgctcagctccctgcctcaaccctcccctgccagcccagctgcacagaagtctcatcagattgaatgtacccaattccaca

SEQ ID NO: 113585 - DNA, 314 bp, Homo sapiens
tccagcagcttctcactcagctgccatgcattgacttccctgttgatccagcctactgcggacccaaatattcctgttgccagataggagggatgagtaatggagactccagtcctcagagaccttgatcaagtaaagcaaaaaccccttcctccactttctttgcaagtggctaaacccttagtcactctgggaagaaaagtaaactgaaaacttgaaaaagtcccaagacagaatctaactccatcccctgccccagataaaaagcaagatagcacaactatagcaaccttttaagtcaaattaaatgagct

SEQ ID NO: 113586 - DNA, 422 bp, Homo sapiens
ccacataaaatttaaacaaacaaaacactttgatatttacatacacatgcaaaaaacaaaacaaaacaaaaaaccctcgaaacaaagcaaaaaacaacataacctccattgaaaactgccacgaaaatcactagggactcagatttttagtaaaacagaaggctcagaaattcagaaaaaaacaaaggcaacacttataaaggcaaagagaagggggaagttgaagaagtaacccactgatttttatcaggggagtccagccttctttagacctaaattatttcctctacatagacatgaaggaaatgaaacagaatgcaaatgtagtttgattcaaagaacttttttgtttaaatataacttcttggaaagcataaaggttcagtttctgttcaaggaaactaggaattttgtaaaaaaaa

SEQ ID NO: 113587 - DNA, 422 bp, Homo sapiens
ttgctgtctctccaccagacagggagaggctgagtcagctctgggtgcttgaggccacccatctcaagacctggcagggagcaggcattggggaagggtggatggtcagagtctctgacgccatcacccagcttgtcaccaagccgggttccaagccgaaacgtagttcagtacctcctggccctgtctctaattcttcctcctctccagctgcttccttgggcctgttggcagagacagtacagatgctaggcgaatgggaagagagcagaggggatcccatccacgtgactttgggcccaaaggtggggtgtgggaaacagggaaaggagcactggattgggagtcaagcttgggtttaagtcgcatctctgttttctcaggctgtgtgacctggggtgagccactccatctctctgggt

SEQ ID NO: 113588 - DNA, 522 bp, Homo sapiens
ctccatggctttaaggaaagaaaacatttccttcagcaaacacgcccagagtccttttccacacattagttcttacaaaagtgagacagaaaaggaccagaggaagcaaagttgagtaacattttacatgtgatttgagtttcatgaaaatctactgggctattgtttggtttgaaaagccactgagagttagctctgagtaagccagcctctcctcagacaaggcaaatcaattacctgccagtaactcattaatgagtatttattaggtgctcattatgtatgacgaactatggtgatacatagacaaaactccaacctagaaagaacactgagttgcttaacttctctaaagcaaccacctcaaaacaagccatctgcccataggttgatttggcaaagccttgtcgagatcttttgcaaattaaaatattttaaaactataggaattcatacttatgtaaaatttagccattgggagaaaccaggtgaaaggtacacaggacctctctgtataccttt

SEQ ID NO: 113589 - DNA, 335 bp, Homo sapiens
gagatgggatcgtgctttgttacccatgctggtcttgaacccccccattgctttatatattgaaagcaaactactgtcaccacaaagcatgccttgaaaaaaaaatatcattcctatatttggtgcacatttggagtttaaaatcctgaaggatactggctaacaaacatgctgaagtttatgatggttcttggtttccgtgggcctaaaaaggagggaggacaccctcaccctgtcccttccaagtgtctctcctgagttgcttacctgtcctctgatttatccctgctttgactgataattggttgctggtatggatggaactgaataaatgg

SEQ ID NO: 113590 - DNA, 331 bp, Homo sapiens
ccagtctgggcaatgaagccagactctatctctacaaaaaacaaaaaaatagccgggcatggtggtgcatgcctgtggttccagtgactcaggaggctgaggcaggaagatcagttgagcccgagagtttgagtcttcagtgagctatgattgtggcactgcactccagcctgggcaacagagcaagaccctgtctctaaaaaacaaaacatcaaaaaaccaaatcttaaaatccttaagtaggtctcctatctctcttgagttaaaaggcccaaattcttatgatcatttagaataatcttcaagttctatttcctacttattcctctgc

SEQ ID NO: 113591 - DNA, 359 bp, Homo sapiens
actggctgccctgccccaccaatctcactcaactaggagaaggccctgcccaggaatcacagactcaagcttctataggacattgcaggaaaactcaaagttcccaaagcccccagaactccattctccaatccccaaaggtgtgttccagccaactagataacggaacaatgaaaacagcacccataggagcccgtgggtgacacacagggttaaagaagcccaaccaaagacttaagacccccaagtgaaaggtaaatggactcacacaattgtcttttatggtctcccttaattacctaaaagaacagtccatgctgccgaacaggcctggagaaaacctttcatctctcccttac

SEQ ID NO: 113592 - DNA, 447 bp, Homo sapiens
tttatttctagttttagttttagtagagatggagtttcatcatgttagccaggctggtttcgaactcctgacctcaagtaatctgcctgcctcagcctcccaaggtgctaggattacaggcatgagccaccatgcccggccataagtccttttaggtatatgatttagaaatactttctcccagcctgtggcttgtattttcattttttagcatcctctttctctctttaatacttttattgagatataattcacatttccttgagcaaaagttttaaagtttgaattctaatttatcattttttctttcgtagattgtgcttttgctatatctaagaaatatttgcctaacccaaggtcacacctctttgcttctagttttatagttttgggttttacttttaggtctgtgatacattttcaggtagtcttttatttttaattttt

SEQ ID NO: 113593 - DNA, 345 bp, Homo sapiens
ccgccacctaccgggtgggaggcagagatcagcttgtgttggcagggaaagcccccattttgcggttgccctccctgccagcagggggcatactcatgggtactgaaaggggcgaagtgcgacacattccccaggtggtctctgggcgggacaaagcagtggctatcctgctgctggctgcatcactgcttgttcagcgggctactccgcggggctcgcgtccagttactatgtgcccagatgtaaaggcagcagtcgcttgaaagtcacccatctgcagtggcagtgtgtctttcctgattccaggtgggtccctgcattttcattttgtgctgggctccacca

SEQ ID NO: 113594 - DNA, 1071 bp, Homo sapiens
caccagatgctcccacccttcaaattaagccatattacagaggaggaaactggcacagagaggttatgttatttccccaaggtcacacagcagagaaagtgggaaaaccaggatttaaacccagatgctccagttccagagcccatgctcttgagaatttagctaagccacctgctgctctgagacaggctcaggtagggtgaacgtgggctgatactgactgtgcttggggaaagcagggggtacgcggggacgagcttgagtgccaggtgccctgtctgggctgcctaggaaggaagagacctcaggatcacgctgttggcatcttgcatttgaggctggcctgagccgagggctcttgaggtcagtgtggatttcctcttacaccttggcctttcgaggattctgtgatgtctgcagattgggcctggctggaggagggaggaggaggccagaagtcctggaatcggggcttgactcctctcggggctactgaagaaccagcagtgatggggaatcactgtgagtgtctggggcaagctgttgagtgagtcagggccagagtccatccagttctgggggtgcccttgaggttacaggcaccacttcaccaagagcctcagaggagagaggcgcaggtatcctggtagacgcgactttggatctgcgccctagaggtgaggcaggtcttaatggctagagagggatagcctaggaagaggcacagctgtggccagggctgggcggcctacagcctgtgatgtgtgattccagggaactcagagcagcctggccagtggtttccaatcacctgggcagtgcgtttatagattcttaggtcccacatctagaaagggtgactctgcagatttggggagggccccaggaagctgtattttaataagcaccttccctaaaggtgattgggattctcaggcaggtttggggatcttcccagtctctgcatttacacaggaagaaataggggtccagggaggtgaaaagtcatggctagcagcatttccctttgcctggagtcaggggctgtatgtgtgtgcggtgggcactgtg

SEQ ID NO: 113595 - DNA, 328 bp, Homo sapiens
aaaacagttttgatcagagatgttcctctgtagctatgctaatattacatgatcataattgctttttgtttatgagattatatgtcctccactagtgcagaaccagatgaaacttaagtttaacctggcatgattatttttaacacctggcttatctattctctttcctggggaaaggattaaatgtgtcgtgattttttttccttattgattataagtcattagagaaagctaagtgctctttatctaacataagccagaattattattttattttattttattatactttaagttccaggatacatgtgcagaatgtgcaggtttg

SEQ ID NO: 113596 - DNA, 317 bp, Homo sapiens
ctcaaatgatttgtgtgtggtaatgtatagaagaaagtttacatatctgaagtgatgtattttaatccaataaaaattagagctggtattaattggccaagccagtaacctttatgaaacaggatagtaatttccacacataattttaaaggggaaactagtaataatatagcactaaggcatgagtctagggtggtttgtattaatatgtaatggtgcagcatgcaatgtaaatttcaaaggctagtatttatttttcccagtgtgcagttatctctatctttctttgatttttcttaattacaaacttaatttcc

SEQ ID NO: 113597 - DNA, 790 bp, Homo sapiens
ctgtcaagtaaaacggttatagtaagtgttgtgtaaacagatttccctacggctttatgttctaaagaaccccagtcttataagtatccccttggaaagcagtccatgattttgaactggtcttctatcattgagctctttaggaatatttttagaaccagtaccatgtgcattgatagcaagtctccatcctctgcagttagctcttctagttataacattgaaataactagtagttatagagcaatgtctgttggcaggcattgtgccatgaacttttatacactatttcatcttaatcctcacagtcctggggcatactacgtataggtagtatcttcatcgttagtttacgatgatgaggagactgaaactgtgtggttaggcacctgatagaaggacacagagctggaattcaagctaggtccacctgagtccagagcttgagctataagctgtcatgctctactgactgccttgatgtttattggctagaagtcattaagtgtgcctgccatcttatgatttggactggtgagcaggttgttaatattggttagttaaaaaggaaaaagaaaggaaaaaaatactattacagagaattcctgcagcttgttttcttacattgtttgagtatcaaccaaagtccttaaaaggaatggcagcatcactagcagatgcacagaggccctacccacgggctttgagggggacatggcttccttttgtactttcaaagtattttcttactggttttacttgtttcattggcatattttgagtgtgttgt

SEQ ID NO: 113598 - DNA, 363 bp, Homo sapiens
tataagatatcaaatagcatatagttaacaccatggttaccctagatctcacaataatttggagggttttttttttaataagaaaactttcttttgttaggtgtggtgaagtcctgttgtacatttttttctgtgatctgtaactgtgccgcaaatagtgaactccaaaatttcagtaccgaggtcaacatgtttttctgtgcaaaatctactaaaaacaaatggagacaggaggcaggcatgaggcaattatgctacctactcagcctaaaaaatgtaattgctactcatgtctcatgtttttttcttaagcatttggttttaaaaagaatctagacagaaaatctcagaattagtcacacc

SEQ ID NO: 113599 - DNA, 352 bp, Homo sapiens
aagctctgtttcagacagacaagattctggcttctggccaatttcattcaggatatattattaagaagtaaatctgttcacctttctgggtggatacgcattcaccctttgtgcctctaagacaccctgttctcagaagggattagatgtctttcaaagcccttcccccacccactgccttgcacactttggacctgttagctctcctgggtttgtgtcagtcttaccacttatgtggggtatcccctgcctgggcagggacctggcttactctcagctcccctttcaccagcctggcacacggtagctctgcaggccttgtattgcttatttggtactgttggacctgcta

SEQ ID NO: 113600 - DNA, 388 bp, Homo sapiens
accttcaaaattctgggggaaaattaccccatgtctaaaatcatacagtaagacaaataatctatcaagtatgaggaaataatctatcaagtatgaggaaagaagaaagacattcttcagacacgcaaggtctcaataaagttgcctcccccctaccctttctcaggaagctattggaaattgtcctccattaaggccagaattcaggaaagggactcacacccgaaggagagaaaaagtgaacaaaggtcatagctgggcaccaagctgaagcccagaccgaagcaggtagaagctcttgcttcaaggctcatcacacctatggcatctgaactactgagaggagagtgaggcagggcggatgaattagtgaaggagataaaaaacc

SEQ ID NO: 113601 - DNA, 353 bp, Homo sapiens
acacttaggtattagactgttctccaggatagaggtatcccatgaagggcacactctaaacatacaaaacaatctccctgaagccctgtcgaggttatactttatatccactctcaggagagaaacctcaaactcaaattagaaataaaaaatagagcagaggccggtcgcagttgctcacgcctgtaatcccagcactttgggaggccgaggcgggaggatctcaaggccaagagatcgagaccatcctggctaacatggtgaaaaaccgtctctactaaaaatacaaaaaattagccaggcatggtggcacacacctgtagtctcagctactcgggaggctgaggcaggag

SEQ ID NO: 113602 - DNA, 414 bp, Homo sapiens
tgctagattggatggtaacaggttgtttagctttgtaagaaattgcaaaactgccttccaaaatggctgtcctattttgcattcccaccaacaatgaaggagagatcccattgctccatatccttaccagcatgtggtggtgtcagtgttctggattttagccattctaataggcaaataatggtatctccttgtttttttgtttcttgttttgttttgagacagtctccctctgtagctcaggctggagtgcaatggcacgatctcggcccactgcacccggcccaaaatgtttttaaaaggcatcacaggaaatgtaacacaaacagcttaatatttggttttatggaggtgatttagggagcaataggaagtaatttattgataataaaaaagccgttaattttataattg

SEQ ID NO: 113603 - DNA, 330 bp, Homo sapiens
gccattctcctgcctcagcctcctgagtagctgggactacaggcgcccgccaccacgcccggctaatttttttttgtatttttagcagagacggggtttcactgtgttagccaggatggtctcgatctcctgacctcgtgatccacccatcttggcctcccaaagtgctgggattacaggcgtgagccactgcacccggcccaaaatgtttttaaaaggcatcacaggaaatgtaacacaaacagcttaatatttggttttatggaggtgatttagggagcaataggaagtaatttattgataataaaaaagccgttaattttataattg

SEQ ID NO: 113604 - DNA, 361 bp, Homo sapiens
aacctcctttctgaaagggccatgccagcaagtcggtcctgtgcttgggttaactactgccttcattccaagctgttagcacagtctgatggcctggaagatttgtcattttttttcttctttgttattcagacacttttggagccctttagatggagaatagacgtaacccagacatagtttccttatcattaaaagataccagttattagaccaggtgcagtggctcacgcgtaatctcagcacttcgggaggagaagggaggcggattacttgaggtcaggagtttgagaccagcctggccaacatggtgaaaccctgtctgtactgaaaaaatacaaaaattagccaggcatggtgg

SEQ ID NO: 113605 - DNA, 159 bp, Homo sapiens
gggtggctgtcagagacagcaaaattacttgaaaatctcccaaagtgaagggcagaaacatatattggcctttatctgaaaaccatttccaagtctccctgtgctggaacccacttcagcctcctgcatcacacactctgcccttctccgtgctgtgag

SEQ ID NO: 113606 - DNA, 224 bp, Homo sapiens
tgctgagatagcaggcgtgggccactgcacccggccgctgatctcactcttaggccatatctgaactctaaggattttccgcacacaccttcacattcccctgcatttccagaggaggagagtcttggtgacacagatttcctggagaacattatgacaccaatggcccattccaggatgaaaagggcaacccttgaatgtttctaaatgtttctaacagagga

SEQ ID NO: 113607 - DNA, 181 bp, Homo sapiens
tggcttatattcatttagcttatatcatatacatatgtaccaaatactgtggttgagctaaagctgtagacatagaagatacagtccccattctcaacttgtttaaaacaagcaaactggaccatgataagctaatataataaatatgacaaaagtaagtaaaacactctatggaactatg

SEQ ID NO: 113608 - DNA, 405 bp, Homo sapiens
tattttttattagttattcaagatgagttaaaatttaatatgactatattagcttttttccaaagcttttttccaaagcatttccggaatgctttttcattaaaatagctatttagtgaaaattctttataatacaatgatattccagagtagactaattttgcagacaaaaataatgttaaatgtattaattgaatcctaaaatggttattttcaatgaatatgggactgatagccaaatgtaaaagcttattaatatctaatgccaggagccatggcatttggtataaatatgtgtaatttatggtacttttagatgaggtttatatattataccttcctgccattagtggatgaagaaaatttctgaaggctaaactagaggatacaagaaatgtctaatag

SEQ ID NO: 113609 - DNA, 329 bp, Homo sapiens
aatatcattccaccattgacaatcatgataataataatgacaactctacactgtttcctgaagcacattttttctgttttgttttagtaaagagaaaaaaccatctttttctatgtgtattgagtcacataatcagataaacactagctgtcctgagactttcactggttgatttcatggctatttctctcactgttctttaatagaaaatgcataaggaatggtacgggtaggaatggttgaactaaagttctaattctggcttttccaataacctaatgagtcatttgctgccttacattattttttggtagcactgatggaatgat

SEQ ID NO: 113610 - DNA, 502 bp, Homo sapiens
ggtctcagaacccagagggaagggacctcgcttttgttgagcatttgtcatgtgccaggctttgtcctgggcattttaaggatggcctgcttactcttcacagcaaccccaagaaggtagtcagaaactggatttgcagagcccagcgtgggagccagtatccccatgtgctaattggagcttaaatttaatgaaatgaagttaaatgggccgggcacggtggctcatgcctgaaatcccagcactttgggaggctgagacaggaggattgcctgagcccaagagttcgagatcagcttgggcaacatggcgaggactcatctctactaagaatcaaaacaaattagccaggggtggttatgcacgcctgtagtcccagctactcaggaagctgagacagtgggatagcttgagcccaggaggtcgaggctgcagtgaaccatgtttgcagcactgcactccagcctgggtggatagagccaaatcctgtcttaaaagaaaa

SEQ ID NO: 113611 - DNA, 322 bp, Homo sapiens
tgtttcaaaatccttcccttagatagacatcaagatgatttaaaatcaaaatatgtttcacaaaatatgccaacacaaagtattgaataatgactctgtaataaacctaataatgaatgagtaaattacaaaaattttatccctagctagtggtgacttctaaaggggcaatttcagtaaaaattttaagttcaaaaaaatagtatctttaaaaatacaacgaagacatgaaactgggaacttctaagttaaaaaaactgttgagacaacatttttcagaccagaatataaaatggtttctttgatttttattccctcacaa

SEQ ID NO: 113612 - DNA, 319 bp, Homo sapiens
agtgctttgggatgttgaggtgggaggatcatttgaggccaggagttcaagcctagctaggcgacttgtacaaacctgtaaaaaattatacaaacttgtaaaaaaaaattgtaagcatattttggtaataaatagtcttacataaaaccagggggaaaagccgtaacttaagataggacaaacaggtttggtatatgttgtaaggggcttacacctttaaattcctatagccaggtgcagtggttcatgcctataatcttaacactttaggaggccaagttgggaggatcgcttgagcccaggagttcaagaacagcct

SEQ ID NO: 113613 - DNA, 567 bp, Homo sapiens
gggcgccatcactgaaaagctttccatgtcctcaagaaaacttctgtctcaaagtctcaatgttattgatgttcctttctataagaagtgctaattatctacagttggcccttgaacaacacgagtttggactgtgcaggtccactgatatgtggatctttttcaataaatatattggaaaatttttttgagatttgtgacagtttgaaaaaaactcaaagatgaactgcatagcccagaaatgttgaaaaattaagaaaatgttaggtatgtcacaagtacataaaatatatgtaaatattagtctattttatcatttactatcataaaatatacacaaatctattataaaaattaagaacatcaacatttatgcacacaaacaccaccgtccatagcaccatatgcagttgggagaaatgtaaacaaacataaagatacagtactaaatcataactgcataaaattaactgtagtaatactgtactactcaaataatttctacaactatactgctaccatactactttaataattttgtaaccacctcctgttgctgttgtgatg

SEQ ID NO: 113614 - DNA, 735 bp, Homo sapiens
tagtgtgcaaacttcagccattatttctcaagtaggtattaatttgttacccattaaaatgaggcaaaatagcttgcctgctctccatggatgcataatgtcaaagtacatgaattctctacacagacatttaaatcaacaaaaatcacataaccctggagctggcaaggcaaggaattgctaactgtgttcatgttactgggacatgctttagctagtaaacacaagtatctagccaccactgatagacttagtattgaattgttcaagatcttcaggaagttatctctcacttaaagtgcaaatcccctttttaagtgacctatactgtaataatcatgatctgtggcctatagtcattaagatgtaggtagagaatgatcttctatgctctatctccatgtaaatatgagccagtttccaacagcaaatagattatccttcagacccatacgcactttagatcatctgtgggtgaccttgacataaaacctaacagttaatttagtttgattgaaattttacccaggcattttactattaaacaccaaatgttttcacaaatagctaagctgatcatagattatggtttcatatcagcagagagagttaattgctgttaataaagagaagaagaagaaagactgcttagaattttaagacattctttcattcctgacacctctctccctcacaatgcctctcccagtcttttcttatggcagtttagacact

SEQ ID NO: 113615 - DNA, 390 bp, Homo sapiens
agtgaagtaggtagaacaagatgatttgtaaattcagcctcacagttaaattgtactgaccttagcttttaatttgtacttttttttctcttcaaagtttatataaattatggaaactcttaaagtaaatctcaactgagttttagaaattgaaggcagaggatttgttctttccagctgactagtccagtgcaggtggtttctagttgtattcaggcacaaagaaatgtacttactgccttttgatgttctgtaacatcctttgtcatgtttccttcctttcttgttgtgtttattcttttatgattagtaatgttatactgtatggattggagtagagacttcccccatgactcaaggaccacacagataaaaaggagggaagacatt

SEQ ID NO: 113616 - DNA, 432 bp, Homo sapiens
aagaattgtattatattaaagcaattactgaagtttaatatgtacggatgtgtagtttaagacatgggttttatgtgattgtgaaagctaagtacggtagtcctctcttatccttggtgtcgctttctgagcttaaagttacccacatttaacctcgatatgaaaatgttaaatggaaaatttcagaaatacacaatttataagttttaaatttctcactttttttttttttttttgagacagagtctcgctctgtcacccaggctggagtacagtggtatgatctcggctcactgcaacctctgccttccgagttcaagtgattctcctgcctcagctgggattacgggtgcctgccaccacatctggctaatttttgtgtttttagtagagacggggtttaaccgtgttggccaggctggtcttgaactc

SEQ ID NO: 113617 - DNA, 783 bp, Homo sapiens
gggtaaacaaatatacaagtggcaagttacggggtcgcagtatcacaggagaagggggaatcgttgcaatatataaacatctgaaaagggacacaattaaaaatacagctcataaggcaaagatctggaggaggtggggagacacagatatctatggaggagaggtctgagaataggggacagcaaatataaatatgttcccctggcattatggaggaacagcaagaaggccagtgtgggtgcacagctctgaacaatagggagagtggtcgttaagagagggtgctgtaggctcatgaagtgtcttgtccacctctactctgaatgagatgaggaaccattagagagttcttaatctgacttgcgttttcaaaggatcactctggctgtggtatagagcaatcattagccaaccttttggtctcagggcatttgtactcaaattattgaaaattccaaagagctctaacccctaagagctcagaaatgtaaatctgattatttattaattttaaaataacaataatgccactgaatgttaacacaagtaacatatgttttgaaattatattttccaaaacaaaagaacaaaaagatgtcagtgtttaagtttttgcaaatgtctttaatgtctggcaatcagtctgttcactgtcatgtatcatgtagcctctagaaagcttcactgtgcagtcacaagacaatgaatttaaaaggccaataatgtttagtattcttgtgaaaatagttttgacctcactgattccccaaaaaggcacactg

SEQ ID NO: 113618 - DNA, 204 bp, Homo sapiens
aggattgctttgtctccagacactgggcctcctgtgacttgctcagcagtattaagatacaaacttctgagctgctcattctagagatgtggattttataaaacggcaacaataacaacaatgaaaacccagatgccatggaggatcccagaactggtcaggctgggacgcttggttcctgccagtgtccaccagctctgcccc

SEQ ID NO: 113619 - DNA, 595 bp, Homo sapiens
gaaaagtttgtacacaaatgctcacagcagcattatccataataactaaaaattggaaacaattgaaatgtccatcaactgataaatgaacagattaaatgtggcatatccatataatggaatattatttggcaataagaagaaatgaagtacttacacattctacaacacaaacacgtcttgaaaacaatggccatcagagatttcaatgcactgtcaatctacaagaagggtatatgatatgcagttgtttcacaaacactgtaacaaatgattttgaagaggacatcttaggatactctgagttactccaacttggacatttcacagcaaacgttgtccatcgctgttaagatgaccttgaacactttacatgactttctgagcctctttttcctcattaaaagagagattgcatcacccactctgcttactcacaaggaatttgtaaggattaaattaaataatgactatgcaaataaaagtactgttattcgagcgagactccgtctcaaaaaaaaaaaaaaaaaagtactgttattcagcagaagagaggcatgtgcattaataagcacgatgatagtttgttatatat

SEQ ID NO: 113620 - DNA, 263 bp, Homo sapiens
tattatttaaacctttaaataatacattcacaatgtgcatgctctctttgtctttattaattactctgggtttttttttcccaatttcttggaaattacctggtgagaaccctgcaggactgcatgcagaggtactcagtaagttaatttaggcaactgcagtaatggctgtctttgcttagcatgatatatgaaatattttgcaaaaaataaaatcacatgtagaatgacatatgcctatagaaattctataatttgatggg

SEQ ID NO: 113621 - DNA, 689 bp, Homo sapiens
cggcgcggagcacctctgggctccccacttgaacggcgggccgcgccggcccatgaggaaagcggggtgcggagctcgccccctgccggaggatgcgctccgccggcgggcaccctgcggggaccacagccggacgccagaagtgacctgaccgtgaatgtgcgctttgcgtgcagtcattgcatcgtcgcaggcctaggagacagatgaagagatggctcttaaggaaattctcggttatactgaaaaatccagaagctctgaagataccagtcaaataaaatcacaccctataactctacaccagacttgtggcatggtttctgtagctgccagcggtaaaaccaagagaaactttacaaaaaccttttgtgcatctgaaaaggaggaagtgtgagagacactggaaattcaatatgtcagacaaagccgtctcctgacactgcaggacagtagaccagtcaaacaatctttttaaagcccccatgtaagaagttgctatatgaggtggcagcttgggtcagacattatgtatggcctttggtattttagtagcactgcatgtaaaatttaactttctaaaatcgctgtattcgtggatagcttttatcattgcactagacaacaagttacaatttaaaaattgtatctgtttctttttatgttttttgatccttttggtgtctgaa

SEQ ID NO: 113622 - DNA, 697 bp, Homo sapiens
tacttttatttatttttcaagttgtaaaaccatattgaatattttttatttgtgaaactaaaaatgaaatatttgtccaatcttatattggtaactgaagtgatagctttggaagcaattgttgccttccttatctgagataatcaggaaggaaccttgttgagaccggtttgctcatcctttagaatgttgattcctaagtttagagctgttaggtacaattagtccatccaactgatgtttattgagttcttgtgtgctacttctaggcagtggtgaataagatagttgtggttcctgccctcagattttctaagaattgatgagggcatgcgttgaataaagatttaaatataatgagtcttgttagggggggaagattgtgctaaggaggtgtatgaagatattttacttgatctagaacaggggaggtttctctgagaaagtgacttttgaatgaagtagtagtttaaatggcaaaaaggtgagtggcctagaagggtaagtgggagagcattttacacaaaaagcagcatgaattaaaagtctttaggcaggaaaaggcatggcatatgagtaactttaagtctagtatgattggaacaaagagagctgggggaaaatgatgtgatgtgaagctggagaagtgcagacaattaagaaacttataagcttcgggaatttgtaatttttcagt

SEQ ID NO: 113623 - DNA, 263 bp, Homo sapiens
tgggacaagaacattgaacctaaaattaatcaaccaacacaaagatgattttctctccaaaggtaaaaccaggttgagcagggggtagatgtgggcagatattgctgaaactcagtttagaaaacaccttacaacaaggagctcgctgtataccacaatataatagttcactgtttctctcagacctcagcagtgttctcattttgcctggcaagagtttgaacaagatagtccaaataatccattactagctaacttctgag

SEQ ID NO: 113624 - DNA, 752 bp, Homo sapiens
atttttgccaaagtcaaataataatcttgagtaaaattctcattgcttataagatataatttataatatatatttatttaaagtatatggataatatattatcctggaatttgctaaataaagtgaaatattttataaaattatgaagttccataatgtgaaaaacaatgattttgattaatgaaaataacttaaatattatttccccctgttattcttattagtatttcattaaattctatttcattagctcttcttttgattatatcaaaatttcattagtactctatatcatattgcatatgtattagtatagatacatacctggttattcattgtgacctcattactcttaatgatagtgtggttatagccggtaaaattactgatactcttggcattgtctattatttacagaaatcaccttgtgtcttaattttatctacttgcttgttggatgcttgtctttatgtatttttccaatactttgctctagtgctctgatgctgggcagccatgcaaatgtcagaactactttttattgatgtcagtttggaaaggggatatctaaaatagcatatattctcaaagttttgtgaagttacaataaacctcttccctattaatatactacaggcttggtctcactttttgggaatttatgtggttgattcctggaaacactggaacaaatctgccacctttagtgaaaaaattcaatatccacaatatccacagtctgaatttcctat

SEQ ID NO: 113625 - DNA, 537 bp, Homo sapiens
gaacttgccccaggcacagaggtaggaagtggcagaggcagaatttgaacccttaagagtctacctccagggcccaggctctcacctcagtcctgggctgcccttcatttaccctgtagtaaatgtagtgcagtttctactaaacacactgctccttatttaccctagaattccttcagtgcaggattatctgaggaccacctgtgtcacaatcacttgataaagatgcagattttaggcaatatctcagaccaactgaattgaaatttcggggaacaatgcccagaaatctgttttgttaacaagctccttcaagaaatttaacagtcaccacagtttggacttccagagtgaagatttctttctaagcatttctagtaggcttagggttccatttgggaaaaaatggaaatgatatatctatacctgtagaattttctatagcatttctgtttctaaataggttagtgtttaattgaatgaaatcccgtctctactaaaaatacaaaaaattagccgggcgcagtggcgggcgcc

SEQ ID NO: 113626 - DNA, 388 bp, Homo sapiens
agtctcccaaagtgctgggattacaggcgtgagtcaccgcgaccagcctaggacacctatttcttcaaacataggaagaaacatcttatctgcatgatccctcctggggagctatcttacggtcttatgtgataaggtgacctctcctttgggtgagtggagtaaaaaagcgggcgaggtatctggaatatgcttctatccctcctaacctcccctacaaacaaagctttcctgaatgccttgtccttagcttcctggactctgaacctagcttggctaaattttctttttaaagcatcagcataaatcatgaataccttgggaagggaacattaaccatcagccggcaaagttaaaattcccctccagcccacttaaatggactgaa

SEQ ID NO: 113627 - DNA, 370 bp, Homo sapiens
catgactgcttaattatgttcaagaaatctccaaaacagtataaaacttagtacagaatttaatccaatttacatatacccagtataaaagggagcatgtgctgtttaggctcatggggaactgatagagaattcttgttggtagatgcttctgtttgtgtttgagtgaaaaaaataacgcactttctcttcatgtatgtacatatttattgcagttacagtacattataccaattataaattatttataggaataaaatagatgaacatacattaaatacattagtataggtgaaaaattcccccaagatcacatacacaccttggaggttactctgtaatctagtaccatttcacaagaatatgttac

SEQ ID NO: 113628 - DNA, 398 bp, Homo sapiens
actgaatagtttagacgacatttattgagcatctacatgtacagagcaccctattagctgctgctgggagatacagaggaaggcgtgatgtctgttctaaaaaggtttctagcttaaggaggaggagggggaggcaacaagactaatgttctgttcattcattctttccctcacttaccacacattttcctgagcatccactgtgtgcccagcatgtaactgtaccagatgctgcaggaataaagatgaatatgacacaacccctagcttcatgtagcccggaaatagagggaaagacacagactatgtcaataaataattaaaatacaacgacaaatgaagtgtcagaaatggcacagagtagggaataatcaacttttcctgaggattttaaaaag

SEQ ID NO: 113629 - DNA, 882 bp, Homo sapiens
caagaatggtgataatttaaaaatcaaaagacaatagatgttggcatggatgtggtgaaaagggaacagttttacattgctggtgggaatgtaaattagtacaaccactattgaaaaaatatggagattccttaaagaactaagtgtagaactaccattggatccagcaatcccattattgggtatctacctaaggaaaagaagtcattatatgaaaaagacagatacacgtgcatatttatagcagcacaataggcaattgcaaagatatgaaaccaacataagtgcccatcaaccaatgagtggataaagaaaatgtggtatatatacaccatggaatacttcagccatataaaggaataaaataatgtcttttgcagcaacatggatggagctggatgccattattctaagtgaagtaattcaggaatggaaacccaaatatcgtatattgtcacttataagtgggagctaagcaatgaggatgcaaaggcataggaatgatacaataggctttggggatttggaggggtggaccttgggagggaggtgagggacaaaagactacctattgggtacattgtatactgctcaggtgacaggtgccctaaaatctcagaaatcgctactaaagagcttatccatccatcacttcacagccttttagctgagatcaagtgtagaatttatccatctaactaaaaaccacctgtaccccaaaaactattgaaatgaaaataaaaagtaaaaaaaaatgcaccattgtgaaccattgtgataaaaaggcattttttaaaagtatgactttatctacctgaaataaattatagcagcatagactttctcaagagaaataataaaatatgagtaattttaaagtat

SEQ ID NO: 113630 - DNA, 720 bp, Homo sapiens
gggtctggctgtattgtgccaaattcctggcctcaagcaatcctcctgcctcagcctcccaaagtgctgggattacagccataagccatagtgccgggccatatcttactcttctaagcttaaggacttttcctcattgttaacacaaagaaaaaggtaaatctttttccccacttcaagtaactctgttattctgagcattaaacttcagtggaggttatagttacccttctaccctagttttgtcccctgaaagcagaagtgctagagccacagcatagaaggctaggacaagaaaatacaggaataatggctcgtttgcttctttttatcagctgtgctttggttgctccagccataggacaaatgcatctccttggaccctgggacttggtctgactgagatcctagcaacttttattttagcctgttttaaatatacaaaggatcgtttgacttttaagaggcaccagccttactctttgggcatctgatttccagggattatgatgctgttaggttggagtttgaatcggctcatagctttggtagtaattgtgattaatattagtaattatgtaattttagtgactcaagatgaattgtactctaattgcattatgacactaggacattttaaatgattaccatgaaaagtcaccaagcatgaataaaggcctgcatttacctgggagtgagtcataaacaccacaaatacat

SEQ ID NO: 113631 - DNA, 802 bp, Homo sapiens
tcttgtccacctgttcagggaagaaggacgggctgggcggggcaggaggagggatggagaagagaggctggtccccagtatctgaagggctgccatatgaaggaagaaggatgcctgctgagggtctcggggcacaggcacaagttttgaaataagacaactgatttcagcacagttgccctgggatgcagcaacttccccagacagggatcctcagtagagatggactaatgactcggcagcgacaccagatcacagcacgttctaaagacctttcagctgctgctgcgactccagcctccccagcacctcctccacggggacctgactgctgtgacttagtccattttttgttgcccatttctttccctgggcaacagcctggcacgctcttggacctggcagccaagtagtttggtggcattgacacccaagaagcataagtgctgagtgagttcacgagaaatggctgcagggcgctctgacgacagaacaatggtatgcgccccatactcatccagcccccaaaagacctttagatggaatagacaaacacagcagaacaagccaaaatcgtctctgaaacaagcacagcctgagcccaccccactgtgactgcatcgcccagggtccttcacctgtgactgcatcgcccagggtcccaggaataaccaacagcagcttcagcagaatacgagcctgcacagctggggaaagcgacctgggttttggcaaaacagcctgagtctctgccatgtccccttctctaacaataacagaaaaaagcccctcatttatttag

SEQ ID NO: 113632 - DNA, 681 bp, Homo sapiens
ggttcaatctctgcctctgtctggtctctgagaagttcctcctgccaattcaaatgtctgtgggggtaatgggatctcttgtctctaggatcccagagggttgtatttggggtgtggtgccttggagttcctttactcaccccttccttaggacctgttgagggccaggagctggtcttggtgctcggtgactccatgcaggcttcccagtttcctccctctttagccacaatgtctgtcacctccctatcgatttttggtgttttctctcaaaatattttttcaaagtataatggtttactctacattttggtttctgttagtgagggaggcctttcccagctgcatctagtcagccatcttctagatctttttcttgattctgacactttgacctaatttaaatgttgacctgaggatattttgactctgcttctaaataccaatattcagatttatacgatcatcaatgaattcaggtcaataaggagttcttacattttttgaagtaaaatctatgagtttgattccttaattttttgtatagcagtgttaaactatggttttattcttttttattctactaaacttcattggactgaatgtcaatttaaaaacaaagatttgatttagtgattatgttttatctacattgtttgaacaaccaaagctatttcatta

SEQ ID NO: 113633 - DNA, 530 bp, Homo sapiens
tcttaagtccccatagctttcttcataatgtggagtttagcctcaccctaaaagaacctctgattagcatttatagggccttgaaagtttttcagtttttttaagaatttgttcaccttatctgatccctggagctgtggattttcagaggcagctggcctcgtttgtgggaagcatcttaatacttttctcctggctcgctcatgtttggtctggttggtttctccctctcacctttgccttttccacataattaggaatatgctttccccaacagcaactactcatcttattcacattaacctgctctctgccccagacacgcacactcggctccagcctaattagcctgttcccactgccatcttttcttctgtttcttcattgtgacaataagatagtcctatttaaaaaaagtttggagtattgatttttaaacattctaattcagtactccagggaagaaacagaaagctattaattcaaatattagtatgctcctactttaactcagtctctctgccttgatg

SEQ ID NO: 113634 - DNA, 312 bp, Homo sapiens
gcatatagaagtacctagcatggtgcctgacatacaacagagattttaaaaatacatcctcctttgtacctatgtgacaggcctgaattttcgagaaaaggattttattcttattctggttctccatttctagtcttaacaaattggcctctgacaaccatttagagaagaacattctgcactggccattcctctgtgggagcagattttgccaggtatgctcatgtatcggtgtgggcactctgattctaaggtagagcaaataacccaaaatatctcttgctgttgctattgaaacttctaaaacctatt

SEQ ID NO: 113635 - DNA, 724 bp, Homo sapiens
acatcagtagattatcttagctttataaagccattccaattgatcactagggcttgaatatgccttaggctcaaagtatataaattggaatttctcttgtggttcagttttccttctgaagggttacaaaattggagctaatagctagagaaagggtcctctagcatattacatataatttggtgggattgtccctcttgatatatttataaatgtctctcagcccctttacatgtactttcgttgatgcttcaattaccttttggtgaagagggcgtgaggaaaaataattccattatcgaatatgcttttattattcctctttaatgcctttttcattttggggttttaggaaattatgctcacttttgtttttaaactaatcattgactttttataataatacaactactttttcaatatagtaaagctttgacagtgtttcccaaaaaactcttgcaggaatatgagagtaaaaatttatagtcagtagttctctctcatgcctttgtttcccccacttctggttacaccagaaggtcctgtgcttatatttggtcatcacattcctggaggctttgccttctgactgttctccttctgtagattctgtggtcaccacaacctgaaatgaggactactttgtgacatgaagcagtaacttgaagaagggccaaggggatgaaaaagacaatgtaggctaacacaatataacaagtagctt

SEQ ID NO: 113636 - DNA, 858 bp, Homo sapiens
gtgtgtgtaatatgtattttaaggtagacattaccccttttcattgaagacagttgatgtgattgaagtattattcccaacagcttagcatgagacatttaataacattttaagacatttcaataacaacatggaagttttatattttaaaaagatttgagagatcaaaaaatgataagtatatgaagtaatgcatatgttaattagcttgatttagccattccacaatgtgtatatattttgaaacaacatgttgtgtatgactatgtaatttttattggtcaacttaaataagatttgaaagttttagaatctagaatgtcctgcctctaagctacctgtaatctgactttttggcataggcaaggaagaaacttttcattttggcatgaggaaaatattcaaatgtaagagcagtttcatacacctatagacaaatgtcttttacttgtctggaaaaatccagaacaattcaagaagaagaaatagcttttacaaaaaagtgatgtataataatttaagtggtatttccgcttccttactcagtttagtctctgatacgtcctatcactgtctaaattactccattattaggggaaaaggccaatttttaaaagcaggttgggtgcagtggtatgtgtatgtagtcccagctactcgggaggctgaggcaggaggcttggttgagcccaggaggtcaaagctgtagggcactaagattgagcctgtgaataaccactgcacaccaacctgaacaaaacagtgagataccgtctctttaaatcaaacaaacgagacgaaaccaggttactactattgaccaactgtagaaatcactgggttcagtattcctttctt

SEQ ID NO: 113637 - DNA, 441 bp, Homo sapiens
gtatcggcacagaaaaatgtgttatcatacagatctttaggtcagaagtctgaaacaggccctactggactaaaataaagatgtctgcagagctgcattccttctggagctccaggggagaatctgtttccctgccttttccagcttctggaggctgagtgcattccttggctcaaggctgccttccagcaatagcatcattctgatttcttgtgtcctcacatctccctctctggcctgactcttccattttcctcttttccttatgattacattgggcctactcagatattctagggttttcttcccatctgcaaagccttaaaattaattacatcagtgaaattccttttgtcatgtaaggcaaggtattcacagatttcagggattattaggacagggatatctttgactaaacattattctgcttactgcaccagg

SEQ ID NO: 113638 - DNA, 408 bp, Homo sapiens
agaaggcaagaaaataatcatttccacccttttatctactttgaaatcaccacttttcttactttggtcttctgtttcctctataaactatgcttaagagaccagagtgagcagacttcttcgtgaaaacctgagcttgggagttgggatggtttacagtcttggcttcagtccacttttctgacttaacacccagacccctttccggctaaatttattgtctcctgttcctgctgggcctttctggagcgtccgcctctggagtgccctctgctcttgaggtcccaaactgcccatcccacacctacctggtcacagctttgcagtttaagtccccacatgccagtgactgcttcctttctggacccctttactgcatttcagcagtgctgtcaatccttcctttaa

SEQ ID NO: 113639 - DNA, 246 bp, Homo sapiens
tgagacagactcatacagtcccaggagatggatgtgacacctctgtaccactcagaattgcctgaagtggggtggggtggaggagaacggggggaagcactcaggtaaaagtacaaagagggtgaacttaatgtggagaagacaggaagggggagaggaagggaatgtcatgaatattaaaaacagggaacataaaaacaatgcaaccaattaaaatattgtttagagacagacaaaaagagatac

SEQ ID NO: 113640 - DNA, 242 bp, Homo sapiens
ggcaggggatagaggatgagtggtgacaggcagcttggtgtagatcagaatggcccaactccacatacccagtacagctgaggggcttcaggcacattcctggacatctttgggcctcagtttcctcatctgtaagttggacagctgtgaggataaagagctgagagactggatacacaaatggaggagggccaggctgtatataaaaacaggactctgccccacagtctgcagcaacctgg

SEQ ID NO: 113641 - DNA, 387 bp, Homo sapiens
agctggcagccagtgcacacgcagaaacgacatttcaggacccagcacagtctcatttggctggagccaccggctctgcggagctgacttgcccattccctctacacctcactgtgtccttcaccctgtctgacctagtcccgggaaacctggtgactcccaaaagcatcttctgctgccagtaacataggtcgaggctgggagtcgggagacttgagttctagtttacaggctgtgtaaacccgggcagtcatccctcagctctgcgccttgtgctcgcttttcctgggccaccatttgtaaaacgggcctcctgctcctgttgcctgcataccccatgggacagaaggggaaagggggattggacctcagagtctcttatctcga

SEQ ID NO: 113642 - DNA, 298 bp, Homo sapiens
tggcctgctttctcctacctgagttgcagtagctttgtgatttgtcttaaagcttaaagcacttttaaatgttactgtttaaaaataaacatgaatctggcgggtacggtggctcatgcctgtaatcctagcactttgggaggctgaggtgggcaggtaacgaggtcccaggagatggagaccgtcctagctaacacggtgaaaccccatctctactaaaaatgcaaaaagaaattagccgggtatggcggtgtgtgcccgtagtcccagctactcgggaggctgaggcaggagagtg

SEQ ID NO: 113643 - DNA, 330 bp, Homo sapiens
ccccagcttctttaccagcagcggctcagggtttgaggccttcttcacggcggccgggaccctggtggtggctgtgtgcacacggaaggagtatttgaccatgagtttgcccgaagtgtcctttgccgactctgcctggcactgcgtggctatcgtccatgtgcctgggcgccggcccttcagccagaacctggtccatgtctacaaagacggccatctggtcaagacagcaccccttcgctgcccctccctcagtgagcctttctcctcctgctgtatcggctccgctggataccgcacaacgaccaccaccacagggctgcccacacc

SEQ ID NO: 113644 - DNA, 559 bp, Homo sapiens
ttacggcatatcgtcgaccacgcgctccgcggacgcgtgggctggaagtgcttttttatgactatgcttatcatactgttagcttactggacatattagaacaagcctcttacagagtaagatttgaagaggtaattgaatatgtaacagaaccaagtgaagcactaatatttacagatgggtgggcaaatgagaagaaaaaaatgaaactgaattttatgatacatcctaaaactactttctaaaatagcattaagtcagctaacttcgaacaaagcagaacaattgtgattagatgaatattttattaaactaggaattgatagagatctttttaaactaagagtatgttagcaatattgtacctgtttaatggcatggcatgccatgccaagccttctaatgggcatgcttggggaccagttgctggcatcaaggggtgaatgtacagtttatgagctgaagcaatctactttctcagttttcaacactttttctttgtcattagtacctttgaatctgcttttgtcacttagccatacttttgtttttcctaccg

SEQ ID NO: 113645 - DNA, 131 bp, Homo sapiens
atagattactttagataatatgacactttaacaatatttattctttcaatccatggacatgaaatattttaaaatttgtgtcttcaataatttatttcattgatatatcttttttgttttgttttgttttt

SEQ ID NO: 113646 - DNA, 165 bp, Homo sapiens
cttccttctccacagtgttgctgtgttttgaatctgtgcttctcaaactgtggcacccaggccagtagcatcagtatcacctggaatttgacatgcacgtttattcagccccaagcaaatctgttgaatcagaaactctgaggacaggtagggtccagcaagcaa

SEQ ID NO: 113647 - DNA, 396 bp, Homo sapiens
gaaaggatcttatttcttctttggaccaaagttgctgagaaatgagcctagcctttgactcacggttaagctggggaaatgacaggggcagctgaaatcaactgaaaagatgaagggtataaaaaccttctatgagtaatgcaagacccttctcctgtagcttgttgaatttgcgtgtaattcatgctagccgagtatgtcgtgtgatgtgaagaacttagtatgaggtagaaacagtgcaagggaatggttgtggcttataaagatctttgattctttaggttattgctttgggaaaatgctttcctttgcttggctgtcataggcaggatttttattttcaaccccagtaaagcatatttgtacttgtattgctctttccttctcattttattt

SEQ ID NO: 113648 - DNA, 301 bp, Homo sapiens
catgtgctttcccgacggggtggggtagggattgggtgaagcctgagttaggatttcaaatttaagagtataatgtaccacaacaaaaataaatgtcagaaacaaaggagtgcatactgtatgactctaattatgtaaactttttatagagcaggcaaaactaatctataaagacaaaaagcagatcagtagtggagtggggtgagctacctaacaaagaacacaaagcaacatataaaaatgttctggccaggcacggtggctcatgcctataatcccagcactttgcccccgtcgaggt

SEQ ID NO: 113649 - DNA, 749 bp, Homo sapiens
taactcagaatcctgtaagagagtacagaaaaaaacatgcttcagtttcttctaacatcagtaataacaatttctccctgaatcttgtattcacattagattacttacattttgcctttaacttttattggcagagacagaggttctggtcagtgtcaaacttcctaaattaatcacctatattcatttgcatcactttttcacccactttccctcccaaactactgcaattagatttctatcctccaacattctacagagatgattctagaaaagattttgaaatactgaataatgcccaattccttataacttagccctcctcttccactccctgaacaaccagcatcactccctcccatcacctgaagactctcttttaaagctcttctgcttgtcttgttttctgaatgcagatcactcttgctaaaattctttcaaagattttcccatcttcaagtatgtgttaatcatagatatttcccaggatactaccttcaggcatctttcttttctgtttcatccttcctagcaatcaatctctaattctcacagcttcctctgtcacagatgtacttcttttttgtcaaatcttttttatcatatctacatctgaagtctgtcctacgtttatttagtctatgttcctactagacatttccaaatagatattttatggcaactcaaataaacattattgcatgggcaattcgaactaacatatcaaatttatctctccccctcctcac

SEQ ID NO: 113650 - DNA, 653 bp, Homo sapiens
gggcactgtagtcccagctactcagaggctgaagcaggagaatcactggaaccggggaggtgggaggttgcagtgagccgagatcgccccattgcactccggcctggacaacagagcgagagcacattcctggctgtggtggctatggggagagtctccttctgcctgaggaagggagaggaaagagtaaaggggattttgtcttgcagcttaggtatcagctcagttacagtgagatagagtgccaggcaggccctagggttcctgattccaggccttggctcccagatggcatctctgggtctgcccggcattaggaggaactcatcatacttaggaggaactcatcctcttagaaagaactcatcacactaaaaggaaggacataagcctggataactttgccacctgctgagtgtagagcccttggtccatgagtgaaaataggctgtagccaggcagtagtcactgcaggccttaggtgagacccagtgctgtgcagtcccagtggtggtggccatagggatgcttgcattacccctctcccagctccaggaagctcagcacagagagagaccctgtttgtttggagggaatgtggttctgaatcattatttaggggaatattgtctgaacatggtctactttgaagt

SEQ ID NO: 113651 - DNA, 302 bp, Homo sapiens
aactttttctgatgaaattctttcctgctccacctaactcccgtgtcccacccccaccagcagagtggtatatctagcacaagaggcatgaaattaatttagtaaatagcaggactactagaaacttttaaggattatttaacttatttttaatcaaaattttatactcagataatgaccttttgggaagttatgtctcttaatgatctcaagtggtgacacttttctgttgacacggtttctcttgggtagttctcatagtagtttgggcatgagaaaacaacttttaccactttagactt

SEQ ID NO: 113652 - DNA, 153 bp, Homo sapiens
tgctacgattacatgcattagctaccatacaccgattgtacaggccacaggctagccccacacaccagattttgaagattaagtgtggtttaaaaaaatgcaaaatatcctgttaataatttttgataatattacatgttgaaatgataaagt

SEQ ID NO: 113653 - DNA, 591 bp, Homo sapiens
attaatgtccactatctgtttatgtttttatggatgcaatatctgtttgtgtctctgatgctaacaattcaatatatacttgaatatattgaatgttttgaatgatcagtaagtctcctcaggtataaactctgtttacaacttgcggtttcctttcaaggtgttggcattcctcaaatgcacagtgattacttaatatgtgctcatttgtggctgaaatttcctgttagttggctaacaggaaaaatgagatgagatggatcgaagggagctgtggggtcctatgggaggatgtaacagaaaaccctccagaacctcaaacagggtcatgggctcccttaagctgagtcttaagggtgagtgagtgtttgccaggagaagaaatggccaaggagtgacttattccagggagagagaacagtgtgttcaaaggccctgatggtgagggaggcaatgttcttacccaaagtaggaaatctccctctttccaaattatgtaggcattattcagtaattgggggcaaacgctatttgttctaagggtctctggaacagctgatcagtaaattcccacatggtttctacccaaca

SEQ ID NO: 113654 - DNA, 463 bp, Homo sapiens
gtgccaccgcacccggctaatgttttgtatatttagtagagacagggttttaccatgttgcctacacttgctgcccgctgtggcctcccaaagtgctgagattacaggcgtgagccacagtgcccagacgaaaccccactatttaaaggcatgggaatgcaaccaaagcaagtagaaatggaggggaactgatccttgacagaaagagactccactggatgagatttgaattatgacttttctcctgaaaccagtacccagtccatatggtctacagctactaactctcatacctgacactgcagttatacatagtccaaaggtagagtttgaaccttgctctgtggttggaaagtgaaggggaaatcctagggggaaaaaagtcacataaaagagattgccctcaaatccgcatataaactcttaccaaatctttgcctgaccccagaagtgctcatgagag

SEQ ID NO: 113655 - DNA, 725 bp, Homo sapiens
cacggtggctcatgcctgtaatcccagcactttgggaggccaaggcaggcagatcacgaggtcaggacatcgagaccatcctggttaacacggtgaaaccccgtctctactaaaaaaaaacgtgaaactaaaaaatgtgtgtaataatcgagacgaaaactcaataaatgggataaaatctgactggaaaaatcaaagagaattactgaatttgaaaatagtattgaagaatttaccaagaaagaagcacaaagaaataaagagggaaaaatattaagaagatgttaagtgaaataacagttggattgagagactcaatattgttcctcccacctccaaaattcaacccacccacaaacttctattgaaagcactactaaagaactcagaacgttctttagtagttctttcaaaaaaaagaaaacctggaatgatatgggatgtaagaagcattaatgaacaaagtaatagataaaaagatgttgttaaattaattactgacaattcaagattaacatttttgtttgcttaaaagagttgggaataaaatgtagacagtaaatacaaggaggatagaagaggtggaattcaattttgtttaaaaagatgaggatattaaatttctttagactttgtcaggaaatataacattttatatgtatgttgaaagtaatcaccaagatgatagaaacgcaatctatagcttccaaaccattagaagagaa

SEQ ID NO: 113656 - DNA, 3485 bp, Homo sapiens
  misc_feature (991)..(991): n is a, c, g, or t
agtgtattcttgggacaggtggcacaaatatatggcccattctgctggggtgacctaaaagggagatgagattatatactcactaaagaattcttttctgtttgttttgttaaaattgaaaaataggccgggcatggtggttcacgcctataatcccaacacttcgggaggctgaggcgggcagatcacatgagtctaatttatatatatatatgtatgtatgtatgtatgaaaaattagggaggggcagaatttctttaggggcagtagcagggaggatcccgaactcagtcatagaatttttaggattgaaacaaagtttgaggtcagaggggaacataaaaccttggtaataccccgcccccggccaccatctttgtacatgtgtctttgcagcttagtgcatctctttgacaaagatttgtgcaatgatgtattttattcaacacatcattctgaaagaacgtgtggaaaactaatgactgagcacaaacctgttgaagatgcagttcttcttggtagcctaaataggattatcttggacctaagatagtgaccttgttttttttcttaatttttccattgaaatacatggccttaaggaaatatgcaaaaaaaaaaaaaaatgaacctggaaaaaaaaggtcctggaccaggtggatgcctcatatattaagaaatccccgaggccgggtacagtggcttacgcctgtaatcccagcactttgggaggccaaggcgggcggatcacgaggtcaagagatcgagaccatcctggctaacacggtgaaaccctgtctctactaaaaatataaaaaatttggtgggcgcctgtagtcccagctacttgggaggctgaggtaggagaatggcgtgaacgcaggaggtggagcttgcggtgagtggagattgcgccaccgcactccagcctgagcgacacagcgagactccgtctcaaaaaaaaaaaaagaagaagaaaaagtatccccgntactattcaaatggaactttatcactaataaacacaagggaagaccatgccccatgttagcaatgcaaattattgctacagctgcctatgataatttggtctttagttgataatatacaagagaatgtggacttctaagtccccttgccttgcatcctctgtttcaaatgatttaatgtgttgtgtaggaaagcagataataaaacttaggagaatccttcccagatttacaagggtcatgaaggagatacttctataggtataaagtgtatgagtgttagaagatcattagcaggaacccaagtacgaaatggttatttgaataaacattctcagatttgagttagcctgtcttgagatctggctgggagcgtaggacacgtgctcccttttgttctgctcaggtagttcccaagtgtgggccgacaggttctttttccttgatgttcaggttcagcagactgtacaggatctttttggcagagccccaagtaaagctgtcaatcctgatgaggctgtggccattggagctgccattcagggaggtgtgttggccggcgatgtcacggatgtgctgctccttgatgtcactcccctgtctctgggtattgaaactctaggaggtgtctttaccaaacttattaataggaataccactattccaaccaagaagagccaggtaagagccatcacttcctaccttgtcacatgggttttaggttctatgacggatgtaattgcagccactttcatgagttttttctagaaaacttcatttttatctgttttacagtttagaatattaaacagttaactgtgggtggtgagaatcctgtgttttgttttttgtttttttgttaccagaaaagttcttacatgttagctggtagtgatgattataagaaggacatcagtagtctcctccacaggattaacataatttgctaaaagggatctcagtcatttgagactgaatttcctgtagtcttctgttctcaaagacagtaaaaagggtagtctggaccagacttaggggagtgttcttatcttatggatgaatgaagggggtggtatgagggtgccgagataccaagcagggctacttggacatggcttgttcttgaagtaggaattatttctggctgggcaccgtggctcatgcctgtaatcccagcactttgggaggctgtggcgagaggattacttgagctgaggagtttgagaccagcctgggtaacatggtgaagctccctctctccaaaaagttaaattagccaggcatggtgctgtgtacctgtagtcccagctactcaggaggctgaggtgggtggatcacttgagcatgggaggcagaggttgcaatgagctgaggtcatgccactgcactccagcctgggcgacagtatgaagtgaggtcttgtctcaaaaaaaaaaaaaaaattatttcctgacttacccaatcttgtgatgtttttccataaaactatggttgttggtatatttgtgccgtgatgtatttgtcaacacatcactctgaagaaaagtatgtggtgactttctgtgactgagcatgatacatcttctttctctgatcccgtttccccagatgagcatgtttcaacattttagttccttttgaggacttctgtcctaatgctgcgtctttgtacaatgcatttgcttagctgaaacagttgctattgtatgcccatttgctgtactaatcctacttctattccctataaagacatcagcctttgttctgaacataccgtaaattaggagtcttccagtcttggaatgtaaacctttggctttcattttttctatagaaatggagtaggttaatcacattgacaacccaggagggtttcttcttccctaggtattctctactgccgctgatggtcaaacgcaagtggaaattaaagtgtgtcagggtgaaagagagatggctggagacaacaaactccttggacagtttactttggtaggttattgtgaatcctgaatactatgcctccttcactgtaaagtgagataatattctaagccataaaaatattagtataaactgctggcatacacatacatactgagtagtcttgagaagaagggatgcaactagatacccatggcatcagtttttacctgaaagccttgctttttccttgtgccttaggaatttcctcagaaataaactcctgattactcatttaaaagacatttgatattgttactggtttctgatcagcattgcttattggttattggtgaggtgaataataggagatttgctatctgtcatttagtgtgtccacaggtacatacagccattatggttacttgctatagctaaacttcactggtataaaaccagttgatttcaggcagcgaactactactgttgcttataaactttgtgttttgtacattaaatcacttgtttctcccaggaaccaagtgacttgtttactagaaaaccatatagatt

SEQ ID NO: 113657 - DNA, 703 bp, Homo sapiens
  misc_feature (690)..(690): n is a, c, g, or t
  misc_feature (702)..(703): n is a, c, g, or t
cggctagtgcgaggctgggtgttgaatcggccgagggcccgcgctgccgccaccgcatcgcgcagctctttgccgtcggagcgcttgtttgctgcctcgtactcctccatttatccgccatgataagtgccagccgagctgcagcagcccgtctcgtgggcgccgcagcctcccggggccctacggccgcccgccaccaggatagctggaatggccttagtcatgaggcttttagacttgtttcaaggcgggattatgcatcagaagcaatcaagggagcagttgttggtattgatttgggtactaccaactcctgcgtggcagttatggaaggtaaacaagcaaaggtgctggagaatgccgaaggtgccagaaccaccccttcagttgtggcctttacagcagatggtgagcgacttgttggaatgccggccaagcgacaggctgtcaccaacccaaacaatacattttatgctaccaagcgtctcattggccggcgatatgatgatcctgaagtacagaaagacattaaaaatgttccctttaaaattgtccgtgcctccaatggtgatgcctgggttgaggctcatgggaaattgtattctccgagtcagattggagcatttgtgttgatgaagatgaaagagactgcagaaaattacttgggacacacagcaaaaaaaattgggnccccttttgggnn

SEQ ID NO: 113658 - DNA, 342 bp, Homo sapiens
tcctcctcctcttcagggttttcttttacttctatgtgaactgtgtttccttctactttttctgtctcctcatcactttcactgccttcactttctccctcctcttcctcctcttcttcactttcttcatcctcttcttcctcttcttcctcctcctcctcctcttcagggttttcttttattctatatataatttccttaatttgtaaatttagtgaccattagctagtgatcatttaatggacagtgattctaacagtataaagttcacaatattctatgtccctagcctgtcatttttcagctgcatgtaaaaggacagacgaccagcagagcacgccg
